(12) United States Patent
Doucette-Stamm et al.

(10) Patent No.: US 6,800,744 B1
(45) Date of Patent: Oct. 5, 2004

(54) **NUCLEIC ACID AND AMINO ACID SEQUENCES RELATING TO *STREPTOCOCCUS PNEUMONIAE* FOR DIAGNOSTICS AND THERAPEUTICS**

(75) Inventors: Lynn A. Doucette-Stamm, Framingham, MA (US); David Bush, Somerville, MA (US)

(73) Assignee: Genome Therapeutics Corporation, Waltham, MA (US)

(*) Notice: Subject to any disclaimer, the term of this patent is extended or adjusted under 35 U.S.C. 154(b) by 0 days.

(21) Appl. No.: 09/107,433

(22) Filed: Jun. 30, 1998

Related U.S. Application Data

(60) Provisional application No. 60/085,131, filed on May 12, 1998, and provisional application No. 60/051,553, filed on Jul. 2, 1997.

(51) Int. Cl.[7] .............................. C12Q 1/68; C12N 1/14; C12N 15/00; C12N 5/00; C12N 5/04; C07H 21/02; C07H 21/04

(52) U.S. Cl. ...................... 536/23.1; 435/6; 435/320.1; 435/325; 435/254; 435/419; 536/24.1; 536/23.4; 536/24.32

(58) Field of Search ............................. 536/23.1, 23.4, 536/24.32; 435/320.1, 325, 254.11, 419, 6

(56) References Cited

U.S. PATENT DOCUMENTS 6,420,135 B1 * 7/2002 Kunsch et al. ............. 435/69.1

FOREIGN PATENT DOCUMENTS

| WO | 9514712 | 6/1995 |
|---|---|---|
| WO | 9531548 | 11/1995 |
| WO | 9608582 | 3/1996 |
| WO | WO 98/18930 | 5/1998 |
| WO | 9818931 | 5/1998 |
| WO | 9826072 | 6/1998 |
| WO | WO 99/33871 | 7/1999 |
| WO | WO 00/14200 | 3/2000 |

OTHER PUBLICATIONS

Database sequence, Genbank acc. No. W65693, Jun. 11, 1996. See sequence alignment.*
Database sequence, Genbank acc. No. AA025574, Aug. 14, 1996. See sequence alignment.*
Database sequence, Genbank acc. No. X67663, Jul. 18, 1996. See sequence alignment.*
Database sequence, Genbank acc. No. AAV42980, Nov. 8, 1998. See sequence alignment.*
Database sequence, Geneseq acc. No. AAZ96269, Apr. 10, 2000. See sequence alignment.*
Database sequence, Geneseq acc. No. AAX30819, May 20, 1999. See sequence alignment.*
Database sequence, Geneseq acc. No. AAZ96466, Apr. 10, 2000. See sequence alignment.*
Database sequence, Geneseq acc. No. AAT98768, Nov. 10, 1998. See sequence alignment.*
Database sequence, Geneseq acc. No. AAZ96379, Apr. 10, 2000. See sequence alignment.*
Database sequence, Geneseq acc. No. AAV52231, Oct. 23, 1998. See sequence alignment.*
Database sequence, Geneseq acc. No. AAT98563, Nov. 6, 1998. See sequence alignment.*
Database sequence, Geneseq acc. No. AAT98628, Nov. 6, 1998. See sequence alignment.*
Database sequence, Geneseq acc. No. AAV52490, Oct. 23, 1998. See sequence alignment.*
Database sequence, Geneseq acc. No. AAV52268, Oct. 23, 1998. See sequence alignment.*
Z33011, Genbank, Aug. 18, 1995.*
M15328, Genbank, Oct. 23, 1995.*
M81748, Genbank, Nov. 8, 1995.*
T58840, Genbank, Feb. 9, 1995.*
X16548, Genbank, Sep. 12, 1993.*
M57624, Genbank, Apr. 26, 1993.*
X54994, Genbank, Jan. 15, 1993.*
L26052, Genbank, Aug. 3, 1994.*
U66912, Genbank, Sep. 5, 1996.*
X02656, Genbank, Feb. 18, 1992.*
Buck Ma et al, "Single Protein Omission Reconstitution Studies of Tetracycline Binding to the 30S Subunit of *Escherichia coli* Ribosomes", Abstract only, Biochemistry Jun. 5, 1990;29(22):5374–9, American Chemical Society Publications, Columbus, Ohio, USA.
Nishi K et al., "DNA Sequence and Complementation Analysis of a Mutation in the rp1X Gene from *Escherichia coli* Leading to Loss of Ribosomal Protein L24", Abstract only, J Bacteriol Sep. 1985;163(3)890–4, American Society for Microbiology, Washington, DC, USA.
Willison JC et al., "The *Escherichia coli* efg Gene and the *Rhodobacter Capsulatus* adgA Gene Code for NH3–Dependent NAD Synthetase", Abstract only, J Bacteriol Jun. 1994;176(11):3400–2, American Society for Microbiology, Washington, DC, USA.
Stephens S et al., "Bacterial Protein Secretion—A Target for New Antibiotics?", Abstract only, Chem Biol Sep. 1997;4(9):637–41, Elsevier Science Ltd., New York, New York, USA.

(List continued on next page.)

*Primary Examiner*—John S. Brusca
*Assistant Examiner*—Shubo "Joe" Zhou
(74) *Attorney, Agent, or Firm*—Genome Therapeutics Corporation

(57) ABSTRACT

The invention provides isolated polypeptide and nucleic acid sequences derived from *Streptococcus pneumonia* that are useful in diagnosis and therapy of pathological conditions; antibodies against the polypeptides; and methods for the production of the polypeptides. The invention also provides methods for the detection, prevention and treatment of pathological conditions resulting from bacterial infection.

14 Claims, No Drawings

OTHER PUBLICATIONS

Moelling K, "DNA for Genetic Vaccination and Therapy", Abstract only, Cytokines Cell Mol Ther Jun. 1997;3(2):127–35, Elsevier Science Ltd., New York, New York, USA.

Smith DR, "Microbial Pathogen Genomes—New Strategies for Identifying Therapeutics and Vaccine Targets", Tibtech, Aug. 1996;14:290–93, Elsevier Science Ltd., New York, New York, USA.

Rost, R, "Twilight Zone of Protein Sequence Alignments", Protein Entineering, 1999 12(2):85–94, Oxford University Press, Cary, North Carolina, USA and Oxford, United Kingdom.

Crickmore N et al., "The *Escherichia coli* Heat Shock Regulatory Gene is Immediately Downstream of a Cell Division Operon: The Fam Mutation is Allelic with rpoH", Abstract only, Mol Gen Genet Dec. 1986;205(3):535–9, Springer–Verlag, Berlin, Germany.

Gill DR et al., "The Identification of the *Escherichia coli* ftsY Gene Product: An Unusual Protein", Abstract only, Mol Microbiol Apr. 1990;4(4):575–83, Blackwell Science, Ltd., Boston, MA, USA.

Wower IK et al., "Ribosomal Protein L27 Participates in both 50 S Subunit Assembly and the Peptidyl Transferase Reaction", J Biol Chem, Jul. 1998;273(31):19847–52, American Society for Biochemistry and Molecular Biology, Bethesda, MD, USA.

* cited by examiner

NUCLEIC ACID AND AMINO ACID SEQUENCES RELATING TO *STREPTOCOCCUS PNEUMONIAE* FOR DIAGNOSTICS AND THERAPEUTICS

This application claims benefit of prior U.S. provisional applications 60/051,553, filed Jul. 2, 1997; and 60/085,131 filed May 12, 1998, all of which are hereby incorporated herein by reference in their entirety.

FIELD OF THE INVENTION

The invention relates to isolated nucleic acids and polypeptides derived from *Streptococcus pneumoniae* that are useful as molecular targets for diagnostics, prophylaxis and treatment of pathological conditions, as well as materials and methods for the diagnosis, prevention, and amelioration of pathological conditions resulting from bacterial infection.

BACKGROUND OF THE INVENTION

*Streptococcus pneumoniae* (*S. pneumoniae*) is a common, spherical, gram-positive bacterium. Worldwide it is a leading cause of illness among children, the elderly, and individuals with debilitating medical conditions (Breiman, R. F. et al., 1994, JAMA 271: 1831). *S. pneumoniae* is estimated to be the causal agent in 3,000 cases of meningitis, 50,000 cases of bacteremia, 500,000 cases of pneumonia, and 7,000,000 cases of otitis media annnually in the United States alone (Reichler, M. R. et al., 1992, J. Infect. Dis. 166: 1346; Stool, S. E. and Field, M. J., 1989 Pediatr. Infect. Dis J. 8: S11). In the United States alone, 40,000 deaths result annually from *S. pneumoniae* infections (Williams, W. W. et al., 1988 Ann. Intern. Med. 108: 616) with a death rate approaching 30% from bacteremia (Butler, J. C. et al., 1993, JAMA 270: 1826). Pneumococcal pneumonia is a serious problem among the elderly of industrialized nations (Käyhty, H. and Eskola, J., 1996 Emerg. Infect. Dis. 2: 289) and is a leading cause of death among children in developing nations (Käyhty, H. and Eskola, J., 1996 Emerg. Infect. Dis. 2: 289; Stansfield, S. K., 1987 Pediatr. Infect. Dis. 6: 622).

Vaccines against *S. pneumoniae* have been available for a number of years. There are a large number of serotypes based on the polysaccharide capsule (van Dam, J. E., Fleer, A., and Snippe, H., 1990 Antonie van Leeuwenhoek 58: 1) although only a fraction of the serotypes seem to be associated with infections (Martin, D. R. and Brett, M. S., 1996 N. Z. Med. J. 109: 288). A multivalent vaccine against capsular polysaccharides of 23 serotypes (Smart, L. E., Dougall, A. J. and Gridwood, R. W., 1987 J. Infect. 14: 209) has provided protection for some groups but not for several groups at risk for pneumococcal infections, such as infants and the elderly (Makel, P. H. et al. 1980 Lancet 2: 547; Sankilampi, U., 1996 J. Infect. Dis. 173: 387). Conjugated pneumococcal capsular polysaccharide vaccines have somewhat improved efficacy, but are costly and, therefore, are not likely to be be in widespread use (Käyhty, H. and Eskola, J., 1996 Emerg. Infect. Dis. 2: 289).

At one time, *S. pneumoniae* strains were uniformly susceptible to penicillin. The report of a penicillin-resistant strain of (Hansman, D. and Bullen, M. M., 1967 Lancet 1: 264) was followed rapidly by many reports indicating the worldwide emergence of penicillin-resistant and penicillin non-susceptible strains (Klugman, K. P., 1990 Clin. Microbiol. Rev. 3: 171). *S. pneumoniae* strains which are resistant to multiple antibiotics (including penicillin) have also been observed recently within the United States (Welby, P. L., 1994 Pediatr. Infect. Dis. J. 13: 281; Ducin, J. S. et al., 1995 Pediatr. Infect. Dis. J. 14: 745; Butler, J. C., 1996 J. Infect. Dis. 174: 986) as well as internationally (Boswell, T. C. et al., 1996; J. Infect. 33: 17; Catchpole, C., Fraise, A., and Wise, R., 1996 Microb. Drug Resist. 2: 431; Tarasi, A. et al., 1997 Microb. Drug Resist. 3: 105).

A high incidence of morbidity is associated with invasive *S. pneumoniae* infections (Williams, W. W. et al., 1988 Ann. Intern. Med. 108: 616). Because of the incomplete effectiveness of currently available vaccines and antibiotics, the identification of new targets for antimicrobial therapies, including, but not limited to, the design of vaccines and antibiotics, which may help prevent infection or that may be useful in fighting existing infections, is highly desirable.

SUMMARY OF THE INVENTION

The present invention fulfills the need for diagnostic tools and threapeutics by providing bacterial-specific compositions and methods for detecting, treating, and preventing bacterial infection, in particular *S. pneumoniae* infection.

The present invention encompasses isolated polypeptides and nucleic acids derived from *S. pneumoniae* that are useful as reagents for diagnosis of bacterial infection, components of effective antibacterial vaccines, and/or as targets for antibacterial drugs, including anti-*S. pneumoniae* drugs. The nucleic acids and peptides of the present invention also have utility for diagnostics and therapeutics for *S. pneumoniae* and other Streptococcus species. They can also be used to detect the presence of *S. pneumoniae* and other Streptococcus species in a sample; and in screening compounds for the ability to interfere with the *S. pneumoniae* life cycle or to inhibit *S. pneumoniae* infection. More specifically, this invention features compositions of nucleic acids corresponding to entire coding sequences of *S. pneumoniae* proteins, including surface or secreted proteins or parts thereof, nucleic acids capable of binding mRNA from *S. pneumoniae* proteins to block protein translation, and methods for producing *S. pneumoniae* proteins or parts thereof using peptide synthesis and recombinant DNA techniques. This invention also features antibodies and nucleic acids useful as probes to detect *S. pneumoniae* infection. In addition, vaccine compositions and methods for the protection or treatment of infection by *S. pneumoniae* are within the scope of this invention.

The nucleotide sequences provided in SEQ ID NO: 1–SEQ ID NO: 2603, a fragment thereof, or a nucleotide sequence at least 99.5% identical to a sequence contained within SEQ ID NO: 1–SEQ ID NO: 2603 may be "provided" in a variety of medias to facilitate use thereof. As used herein, "provided" refers to a manufacture, other than an isolated nucleic acid molecule, which contains a nucleotide sequence of the present invention, i.e., the nucleotide sequence provided in SEQ ID NO: 1–SEQ ID NO: 2603, a fragment thereof, or a nucleotide sequence at least 99.5% identical to a sequence contained within SEQ ID NO: 1–SEQ ID NO: 2603. Uses for and methods for providing nucleotide sequences in a variety of media is well known in the art (see e.g., EPO Publication No. EP 0 756 006)

In one application of this embodiment, a nucleotide sequence of the present invention can be recorded on computer readable media. As used herein, "computer readable media" refers to any media which can be read and accessed directly by a computer. Such media include, but are not limited to: magnetic storage media, such as floppy discs, hard disc storage media, and magnetic tape; optical storage media such as CD-ROM; electrical storage media such as RAM and ROM; and hybrids of these categories such as magnetic/optical storage media. A person skilled in the art can readily appreciate how any of the presently known computer readable media can be used to create a manufacture comprising computer readable media having recorded thereon a nucleotide sequence of the present invention.

As used herein, "recorded" refers to a process for storing information on computer readable media. A person skilled in the art can readily adopt any of the presently known methods for recording information on computer readable media to generate manufactures comprising the nucleotide sequence information of the present invention.

A variety of data storage structures are available to a person skilled in the art for creating a computer readable media having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A person skilled in the art can readily adapt any number of data processor structuring formats (e.g. text file or database) in order to obtain computer readable media having recorded thereon the nucleotide sequence information of the present invention.

By providing the nucleotide sequence of SEQ ID NO: 1–SEQ ID NO: 2603, a fragment thereof, or a nucleotide sequence at least 99.5% identical to a sequence contained within SEQ ID NO: 1–SEQ ID NO: 2603 in computer readable form, a person skilled in the art can routinely access the sequence information for a variety of purposes. Computer software is publicly available which allows a person skilled in the art to access sequence information provided in a computer readable media. Examples of such computer software include programs of the "Staden Package", "DNA Star", "MacVector", GCG "Wisconsin Package" (Genetics Computer Group, Madison, WI)and "NCBI toolbox" (National Center for Biotechnology Information).

Computer algorithms enable the identification of S. pneumoniae open reading frames (ORFs) within SEQ ID NO: 1–SEQ ID NO: 2603 which contain homology to ORFs or proteins from other organisms. Examples of such similarity-search algorithms include the BLAST [Altschul et al., J. Mol. Biol. 215:403–410 (1990)] and Smith-Waterman [Smith and Waterman (1981) Advances in Applied Mathematics, 2:482–489] search algorithms. These algorithms are utilized on computer systems as exemplified below. The ORFs so identified represent protein encoding fragments within the S. pneumoniae genome and are useful in producing commercially important proteins such as enzymes used in fermentation reactions and in the production of commercially useful metabolites.

The present invention further provides systems, particularly computer-based systems, which contain the sequence information described herein. Such systems are designed to identify commercially important fragments of the S. pneumoniae genome. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A person skilled in the art can readily appreciate that any one of the currently available computer-based systems is suitable for use in the present invention. The computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the S. pneumoniae genome which are similar to, or "match", a particular target sequence or target motif. A variety of known algorithms are known in the art and have been disclosed publicly, and a variety of commercially available software for conducting homology-based similarity searches are available and can be used in the computer-based systems of the present invention. Examples of such software includes, but is not limited to, FASTA (GCG Wisconsin Package), Bic_SW (Compugen Bioccelerator, BLASTN2, BLASTP2 and BLASTX2 (NCBI) and Motifs (GCG). BLASTN2, A person skilled in the art can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. Aperson skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that many genes are longer than 500 amino acids, or 1.5 kb in length, and that commercially important fragments of the S. pneumoniae genome, such as sequence fragments involved in gene expression and protein processing, will often be shorter than 30 nucleotides.

As used herein, "a target structural motif," or "target motif," refers to any rationally selected sequence or combination of sequences in which the sequence(s) are chosen based on a specific functional domain or three-dimensional configuration which is formed upon the folding of the target polypeptide. There are a variety of target motifs known in the art. Protein target motifs include, but are not limited to, enzymatic active sites, membrane spanning regions, and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the S. pneumoniae genome possessing varying degrees of homology to the target sequence or target motif. Such presentation provides aperson skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the S. pneumoniae genome. In the present examples, implementing software which implement the BLASTP2 and bic_SW algorithms (Altschul et al., J. Mol. Biol. 215:403–410 (1990); Compugen Biocellerator) was used to identify open reading frames within the S. pneumoniae genome. A person skilled in the art can readily recognize that any one of the publicly available homology search programs can be used as the search means for the computer-based systems of the present invention.

The invention features S. pneumoniae polypeptides, preferably a substantially pure preparation of an S. pneumoniae polypeptide, or a recombinant S. pneumoniae polypeptide. In preferred embodiments: the polypeptide has biological activity; the polypeptide has an amino acid sequence at least 60%, 70%, 80%, 90%, 95%, 98%, or 99% identical to an amino acid sequence of the invention contained in the Sequence Listing, preferably it has about 65% sequence identity with an amino acid sequence of the invention contained in the Sequence Listing, and most preferably it has about 92% to about 99% sequence identity with an amino acid sequence of the invention contained in the Sequence Listing; the polypeptide has an amino acid sequence essentially the same as an amino acid sequence of the invention contained in the Sequence Listing; the polypeptide is at least 5, 10, 20, 50, 100, or 150 amino acid residues in length; the polypeptide includes at least 5, preferably at least 10, more preferably at least 20, more preferably at least 50, 100, or 150 contiguous amino acid residues of the invention contained in the Sequence Listing. In yet another preferred embodiment, the amino acid sequence which differs in sequence identity by about 7% to about 8% from the S. pneumoniae amino acid sequences of the invention contained in the Sequence Listing is also encompassed by the invention.

In preferred embodiments: the S. pneumoniae polypeptide is encoded by a nucleic acid of the invention contained in the Sequence Listing, or by a nucleic acid having at least 60%, 70%, 80%, 90%, 95%, 98%, or 99% homology with a nucleic acid of the invention contained in the Sequence Listing.

In a preferred embodiment, the subject S. pneumoniae polypeptide differs in amino acid sequence at 1, 2, 3, 5, 10 or more residues from a sequence of the invention contained in the Sequence Listing. The differences, however, are such that the S. pneumoniae polypeptide exhibits an S. pneumoniae biological activity, e.g., the S. pneumoniae polypeptide retains a biological activity of a naturally occurring S. pneumoniae enzyme.

In preferred embodiments, the polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

In yet other preferred embodiments, the S. pneumoniae polypeptide is a recombinant fusion protein having a first S. pneumoniae polypeptide portion and a second polypeptide portion, e.g., a second polypeptide portion having an amino acid sequence unrelated to S. pneumoniae. The second polypeptide portion can be, e.g., any of glutathione-S-transferase, a DNA binding domain, or a polymerase activating domain. In preferred embodiment the fusion protein can be used in a two-hybrid assay.

Polypeptides of the invention include those which arise as a result of alternative transcription events, alternative RNA splicing events, and alternative translational and postranslational events.

In a preferred embodiment, the encoded S. pneumoniae polypeptide differs (e.g., by amino acid substitution, addition or deletion of at least one amino acid residue) in amino acid sequence at 1, 2, 3, 5, 10 or more residues, from a sequence of the invention contained in the Sequence Listing. The differences, however, are such that: the S. pneumoniae encoded polypeptide exhibits a S. pneumoniae biological activity, e.g., the encoded S. pneumoniae enzyme retains a biological activity of a naturally occurring S. pneumoniae.

In preferred embodiments, the encoded polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

The S. pneumoniae strain, 14453, from which genomic sequences have been sequenced, has been deposited on Jun. 26, 1997 in the American Type Culture Collection and assigned the ATCC designation #55987.

Included in the invention are: allelic variations; natural mutants; induced mutants; proteins encoded by DNA that hybridize under high or low stringency conditions to a nucleic acid which encodes a polypeptide of the invention contained in the Sequence Listing (for definitions of high and low stringency see Current Protocols in Molecular Biology, John Wiley & Sons, New York, 1989, 6.3.1–6.3.6, hereby incorporated by reference); and, polypeptides specifically bound by antisera to S. pneumoniae polypeptides, especially by antisera to an active site or binding domain of S. pneumoniae polypeptide. The invention also includes fragments, preferably biologically active fragments. These and other polypeptides are also referred to herein as S. pneumoniae polypeptide analogs or variants.

The invention further provides nucleic acids, e.g., RNA or DNA, encoding a polypeptide of the invention. This includes double stranded nucleic acids as well as coding and antisense single strands.

In preferred embodiments, the subject S. pneumoniae nucleic acid will include a transcriptional regulatory sequence, e.g. at least one of a transcriptional promoter or transcriptional enhancer sequence, operably linked to the S. pneumoniae gene sequence, e.g., to render the S. pneumoniae gene sequence suitable for expression in a recombinant host cell.

In yet a further preferred embodiment, the nucleic acid which encodes an S. pneumoniae polypeptide of the invention, hybridizes under stringent conditions to a nucleic acid probe corresponding to at least 8 consecutive nucleotides of the invention contained in the Sequence Listing; more preferably to at least 12 consecutive nucleotides of the invention contained in the Sequence Listing; more preferably to at least 20 consecutive nucleotides of the invention contained in the Sequence Listing; more preferably to at least 40 consecutive nucleotides of the invention contained in the SequenceListing.

In another aspect, the invention provides a substantially pure nucleic acid having a nucleotide sequence which encodes an S. pneumoniae polypeptide. In preferred embodiments: the encoded polypeptide has biological activity; the encoded polypeptide has an amino acid sequence at least 60%, 70%, 80%, 90%, 95%, 98%, or 99% homologous to an amino acid sequence of the invention contained in the Sequence Listing; the encoded polypeptide has an amino acid sequence essentially the same as an amino acid sequence of the invention contained in the Sequence Listing; the encoded polypeptide is at least 5, 10, 20, 50, 100, or 150 amino acids in length; the encoded polypeptide comprises at least 5, preferably at least 10, more preferably at least 20, more preferably at least 50, 100, or 150 contiguous amino acids of the invention contained in the Sequence Listing.

In another aspect, the invention encompasses: a vector including a nucleic acid which encodes an S. pneumoniae polypeptide or an S. pneumoniae polypeptide variant as described herein; a host cell transfected with the vector; and a method of producing a recombinant S. pneumoniae polypeptide or S. pneumoniae polypeptide variant; including culturing the cell, e.g., in a cell culture medium, and isolating an S. pneumoniae polypeptide or an S. pneumoniae polypeptide variant, e.g., from the cell or from the cell culture medium.

In another series of embodiments, the invention provides isolated nucleic acids comprising sequences at least about 8 nucleotides in length, more preferably at least about 12 nucleotides in length, and most preferably at least about 15–20 nucleotides in length, that correspond to a subsequence of any one of SEQ ID NO: 1–SEQ ID NO: 2603 or complements thereof. Alternatively, the nucleic acids comprise sequences contained within any ORF (open reading frame), including a complete protein-coding sequence, of which any of SEQ ID NO: 1–SEQ ID NO: 2603 forms a part. The invention encompasses sequence-conservative variants and function-conservative variants of these sequences. The nucleic acids may be DNA, RNA, DNA/RNA duplexes, protein-nucleic acid (PNA), or derivatives thereof.

In another aspect, the invention features, a purified recombinant nucleic acid having at least 50%, 60%, 70%, 80%, 90%, 95%, 98%, or 99% homology with a sequence of the invention contained in the Sequence Listing.

In another aspect, the invention features nucleic acids capable of binding mRNA of S. pneumoniae. Such nucleic acid is capable of acting as antisense nucleic acid to control the translation of mRNA of S. pneumoniae. A further aspect features a nucleic acid which is capable of binding specifically to an S. pneumoniae nucleic acid. These nucleic acids are also referred to herein as complements and have utility as probes and as capture reagents.

In another aspect, the invention features an expression system comprising an open reading frame corresponding to S. pneumoniae nucleic acid. The nucleic acid further comprises a control sequence compatible with an intended host. The expression system is useful for making polypeptides corresponding to S. pneumoniae nucleic acid.

In another aspect, the invention features a cell transformed with the expression system to produce S. pneumoniae polypeptides.

In yet another embodiment, the invention encompasses reagents for detecting bacterial infection, including S. pneumoniae infection, which comprise at least one S. pneumoniae-derived nucleic acid defined by any one of SEQ ID NO: 1–SEQ ID NO: 2603, or sequence-conservative or function-conservative variants thereof. Alternatively, the diagnostic reagents comprise polypeptide sequences that are contained within any open reading frames (ORFs), including complete protein-coding sequences, contained within any of SEQ ID NO: 1–SEQ ID NO: 2603, or polypeptide sequences contained within any of SEQ ID NO: 2604–SEQ ID NO: 5206, or polypeptides of which any of the above sequences forms a part, or antibodies directed against any of the above peptide sequences or function-conservative variants and/or fragments thereof.

The invention further provides antibodies, preferably monoclonal antibodies, which specifically bind to the polypeptides of the invention. Methods are also provided for producing antibodies in a host animal. The methods of the invention comprise immunizing an animal with at least one S. pneumoniae-derived immunogenic component, wherein the immunogenic component comprises one or more of the polypeptides encoded by any one of SEQ ID NO: 1–SEQ ID NO: 2603 or sequence-conservative or, function-conservative variants thereof; or polypeptides that are contained within any ORFs, including complete protein-coding sequences, of which any of SEQ ID NO: 1–SEQ ID NO: 2603 forms a part; or polypeptide sequen ID NO: 2604–SEQ ID NO: 5206; or polypeptides of which any of SEQ ID NO: 2604–SEQ ID NO: 5206 forms a part. Host animals include any warm blooded animal, including without limitation mammals and birds. Such antibodies have utility as reagents for immunoassays to evaluate the abundance and distribution of S. pneumoniae-specific antigens.

In yet another aspect, the invention provides a method for detecting bacterial antigenic components in a sample, which comprises the steps of: (i) contacting a sample suspected to contain a bacterial antigenic component with a bacterial-specific antibody, under conditions in which a stable antigen-antibody complex can form between the antibody and bacterial antigenic components in the sample; and (ii) detecting any antigen-antibody complex formed in step (i), wherein detection of an antigen-antibody complex indicates the presence of at least one bacterial antigenic component in the sample. In different embodiments of this method, the antibodies used are directed against a sequence encoded by any of SEQ ID NO: 1–SEQ ID NO: 2603 or sequence-conservative or function-conservative variants thereof, or against a polypeptide sequence contained in any of SEQ ID NO: 2604–SEQ ID NO: 5206 or function-conservative variants thereof.

In yet another aspect, the invention provides a method for detecting antibacterial-specific antibodies in a sample, which comprises: (i) contacting a sample suspected to contain antibacterial-specific antibodies with a S. pneumoniae antigenic component, under conditions in which a stable antigen-antibody complex can form between the S. pneumoniae antigenic component and antibacterial antibodies in the sample; and (ii) detecting any antigen-antibody complex formed in step (i), wherein detection of an antigen-antibody complex indicates the presence of antibacterial antibodies in the sample. In different embodiments of this method, the antigenic component is encoded by a sequence contained in any of SEQ ID NO: 1–SEQ ID NO: 2603 or sequence-conservative and function-conservative variants thereof, or is a polypeptide sequence contained in any of SEQ ID NO: 2604–SEQ ID NO: 5206 or function-conservative variants thereof.

In another aspect, the invention features a method of generating vaccines for immunizing an individual against S. pneumoniae. The method includes: immunizing a subject with an S. pneumoniae polypeptide, e.g., a surface or secreted polypeptide, or active portion thereof, and a pharmaceutically acceptable carrier. Such vaccines have therapeutic and prophylactic utilities.

In another aspect, the invention features a method of evaluating a compound, e.g. a polypeptide, e.g., a fragment of a host cell polypeptide, for the ability to bind an *S. pneumoniae* polypeptide. The method includes: contacting the candidate compound with an *S. pneumoniae* polypeptide and determining if the compound binds or otherwise interacts with an *S. pneumoniae* polypeptide. Compounds which bind *S. pneumoniae* are candidates as activators or inhibitors of the bacterial life cycle. These assays can be performed in vitro or in vivo.

In another aspect, the invention features a method of evaluating a compound, e.g. a polypeptide, e.g., a fragment of a host cell polypeptide, for the ability to bind an *S. pneumoniae* nucleic acid, e.g., DNA or RNA. The method includes: contacting the candidate compound with an *S. pneumoniae* nucleic acid and determining if the compound binds or otherwise interacts with an *S. pneumoniae* polypeptide. Compounds which bind *S. pneumoniae* are candidates as activators or inhibitors of the bacterial life cycle. These assays can be performed in vitro or in vivo.

DETAILED DESCRIPTION OF THE INVENTION

The sequences of the present invention include the specific nucleic acid and amino acid sequences set forth in the Sequence Listing that forms a part of the present specification, and which are designated SEQ ID NO: 1–SEQ ID NO: 5206. Use of the terms "SEQ ID NO: 1–SEQ ID NO: 2603", "SEQ ID NO: 2604–SEQ ID NO: 5206", "the sequences depicted in Table 2", etc., is intended, for convenience, to refer to each individual SEQ ID NO individually, and is not intended to refer to the genus of these sequences. In other words, it is a shorthand for listing all of these sequences individually. The invention encompasses each sequence individually, as well as any combination thereof.

Definitions

"Nucleic acid" or "polynucleotide" as used herein refers to purine- and pyrimidine-containing polymers of any length, either polyribonucleotides or polydeoxyribonucleotides or mixed polyribo-polydeoxyribo nucleotides. This includes single- and double-stranded molecules, i.e., DNA-DNA, DNA-RNA and RNA-RNA hybrids, as well as "protein nucleic acids" (PNA) formed by conjugating bases to an amino acid backbone. This also includes nucleic acids containing modified bases.

A nucleic acid or polypeptide sequence that is "derived from" a designated sequence refers to a sequence that corresponds to a region of the designated sequence. For nucleic acid sequences, this encompasses sequences that are homologous or complementary to the sequence, as well as "sequence-conservative variants" and "function-conservative variants." For polypeptide sequences, this encompasses "function-conservative variants." Sequence-conservative variants are those in which a change of one or more nucleotides in a given codon position results in no alteration in the amino acid encoded at that position. Function-conservative variants are those in which a given amino acid residue in a polypeptide has been changed without altering the overall conformation and function of the native polypeptide, including, but not limited to, replacement of an amino acid with one having similar physicochemical properties (such as, for example, acidic, basic, hydrophobic, and the like). "Function-conservative" variants also include any polypeptides that have the ability to elicit antibodies specific to a designated polypeptide.

An "*S. pneumoniae*-derived" nucleic acid or polypeptide sequence may or may not be present in other bacterial species, and may or may not be present in all *S. pneumoniae* strains. This term is intended to refer to the source from which the sequence was originally isolated. Thus, a *S. pneumoniae*-derived polypeptide, as used herein, may be used, e.g., as a target to screen for a broad spectrum antibacterial agent, to search for homologous proteins in other species of bacteria or in eukaryotic organisms such as fungi and humans, etc.

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it. Preferably, the polypeptide constitutes at least 10, 20, 50 70, 80 or 95% dry weight of the purified preparation. Preferably, the preparation contains: sufficient polypeptide to allow protein sequencing; at least 1, 10, or 100 mg of the polypeptide.

A purified preparation of cells refers to, in the case of plant or animal cells, an in vitro preparation of cells and not an entire intact plant or animal. In the case of cultured cells or microbial cells, it consists of a preparation of at least 10% and more preferably 50% of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally-occurring genome of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant DNA which is part of a hybrid gene encoding additional *S. pneumoniae* DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA, synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by agene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitro-cellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared ×100. For example, if 6 of 10 of the positions in two sequences are matched or homologous then the two sequences are 60% homologous. By way of example, the DNA sequences ATTGCC and TATGGC share 50% homology. Generally, a comparison is made when two sequences are aligned to give maximum homology.

Nucleic acids are hybridizable to each other when at least one strand of a nucleic acid can anneal to the other nucleic acid under defined stringency conditions. Stringency of hybridization is determined by: (a) the temperature at which hybridization and/or washing is performed; and (b) the ionic strength and polarity of the hybridization and washing solutions. Hybridization requires that the two nucleic acids contain complementary sequences; depending on the stringency of hybridization, however, mismatches may be tolerated. Typically, hybridization of two sequences at high stingency (such as, for example, in a solution of 0.5×SSC, at 65° C.) requires that the sequences be essentially completely homologous. Conditions of intermediate stringency (such as, for example, 2×SSC at 65° C.) and low stringency (such as, for example 2×SSC at 55° C.), require correspondingly less overall complementarity between the hybridizing sequences. (1×SSC is 0.15 M NaCl, 0.015 M Na citrate).

The terms peptides, proteins, and polypeptides are used interchangeably herein.

As used herein, the term "surface protein" refers to all surface accessible proteins, e.g. inner and outer membrane proteins, proteins adhering to the cell wall, and secreted proteins.

A polypeptide has *S. pneumoniae* biological activity if it has one, two and preferably more of the following properties: (1) if when expressed in the course of an *S. pneumoniae* infection, it can promote, or mediate the attachment of *S. pneumoniae* to a cell; (2) it has an enzymatic activity, structural or regulatory function characteristic of an *S. pneumoniae* protein; (3) or the gene which encodes it can rescue a lethal mutation in an *S. pneumoniae* gene. A polypeptide has biological activity if it is an antagonist, agonist, or super-agonist of a polypeptide having one of the above-listed properties.

A biologically active fragment or analog is one having an in vivo or in vitro activity which is characteristic of the *S. pneumoniae* polypeptides of the invention contained in the Sequence Listing, or of other naturally occurring *S. pneumoniae* polypeptides, e.g., one or more of the biological activities described herein. Especially preferred are fragments which exist in vivo, e.g., fragments which arise from post transcriptional processing or which arise from translation of alternatively spliced RNA's. Fragments include those expressed in native or endogenous cells as well as those made in expression systems, e.g., in CHO cells. Because peptides such as *S. pneumoniae* polypeptides often exhibit a range of physiological properties and because such properties may be attributable to different portions of the molecule, a useful *S. pneumoniae* fragment or *S. pneumoniae* analog is one which exhibits a biological activity in any biological assay for *S. pneumoniae* activity. Most preferably the fragment or analog possesses 10%, preferably 40%, more preferably 60%, 70%, 80% or 90% or greater of the activity of *S. pneumoniae*, in any in vivo or in vitro assay.

Analogs can differ from naturally occurring *S. pneumoniae* polypeptides in amino acid sequence or in ways that do not involve sequence, or both. Non-sequence modifications include changes in acetylation, methylation, phosphorylation, carboxylation, or glycosylation. Preferred analogs include *S. pneumoniae* polypeptides (or biologically active fragments thereof) whose sequences differ from the wild-type sequence by one or more conservative amino acid substitutions or by one or more non-conservative amino acid substitutions, deletions, or insertions which do not substantially diminish the biological activity of the *S. pneumoniae* polypeptide. Conservative substitutions typically include the substitution of one amino acid for another with similar characteristics, e.g., substitutions within the following groups: valine, glycine; glycine, alanine; valine, isoleucine, leucine; aspartic acid, glutamic acid; asparagine, glutamine; serine, threonine; lysine, arginine; and phenylalanine, tyrosine. Other conservative substitutions can be made in view of the table below.

TABLE 1

CONSERVATIVE AMINO ACID REPLACEMENTS

| For Amino Acid | Code | Replace with any of |
|---|---|---|
| Alanine | A | D-Ala, Gly, beta-Ala, L-Cys, D-Cys |
| Arginine | R | D-Arg, Lys, D-Lys, homo-Arg, D-homo-Arg, Met, Ile, D-Met, D-Ile, Orn, D-Orn |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me-Cys, Met, D-Met, Thr, D-Thr |
| Glutamine | Q | D-Gln, Asn, D-Asn, Glu, D-Glu, Asp, D-Asp |
| Glutamic Acid | E | D-Glu, D-Asp, Asp, Asn, D-Asn, Gln, D-Gln |
| Glycine | G | Ala, D-Ala, Pro, D-Pro, β-Ala, Acp |
| Isoleucine | I | D-Ile, Val, D-Val, Leu, D-Leu, Met, D-Met |
| Leucine | L | D-Leu, Val, D-Val, Leu, D-Leu, Met, D-Met |
| Lysine | K | D-Lys, Arg, D-Arg, homo-Arg, D-homo-Arg, Met, D-Met, Ile, D-Ile, Orn, D-Orn |
| Methionine | M | D-Met, S-Me-Cys, Ile, D-Ile, Leu, D-Leu, Val, D-Val |
| Phenylalanine | F | D-Phe, Tyr, D-Thr, L-Dopa, His, D-His, Trp, D-Trp, Trans-3,4, or 5-phenylproline, cis-3,4, or 5-phenylproline |
| Proline | P | D-Pro, L-I-thioazolidine-4-carboxylic acid, D-or L-1-oxazolidine-4-carboxylic acid |
| Serine | S | D-Ser, Thr, D-Thr, allo-Thr, Met, D-Met, Met(O), D-Met(O), L-Cys, D-Cys |
| Threonine | T | D-Thr, Ser, D-Ser, allo-Thr, Met, D-Met, Met(O), D-Met(O), Val, D-Val |
| Tyrosine | Y | D-Tyr, Phe, D-Phe, L-Dopa, His, D-His |
| Valine | V | D-Val, Leu, D-Leu, Ile, D-Ile, Met, D-Met |

Other analogs within the invention are those with modifications which increase peptide stability; such analogs may contain, for example, one or more non-peptide bonds (which replace the peptide bonds) in the peptide sequence. Also included are: analogs that include residues other than naturally occurring L-amino acids, e.g., D-amino acids or non-naturally occurring or synthetic amino acids, e.g., β or γ amino acids; and cyclic analogs.

As used herein, the term "fragment", as applied to an *S. pneumoniae* analog, will ordinarily be at least about 20 residues, more typically at least about 40 residues, preferably at least about 60 residues in length. Fragments of *S. pneumoniae* polypeptides can be generated by methods known to those skilled in the art. The ability of a candidate fragment to exhibit a biological activity of *S. pneumoniae* polypeptide can be assessed by methods known to those skilled in the art as described herein. Also included are *S. pneumoniae* polypeptides containing residues that are not required for biological activity of the peptide or that result from alternative mRNA splicing or alternative protein processing events.

An "immunogenic component" as used herein is a moiety, such as an *S. pneumoniae* polypeptide, analog or fragment thereof, that is capable of eliciting a humoral and/or cellular immune response in a host animal.

An "antigenic component" as used herein is a moiety, such as an *S. pneumoniae* polypeptide, analog or fragment thereof, that is capable of binding to a specific antibody with sufficiently high affinity to form a detectable antigen-antibody complex.

The term "antibody" as used herein is intended to include fragments thereof which are specifically reactive with *S. pneumoniae* polypeptides.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

Misexpression, as used herein, refers to a non-wild type pattern of gene expression. It includes: expression at non-wild type levels, i.e., over or under expression; a pattern of expression that differs from wild type in terms of the time or stage at which the gene is expressed, e.g., increased or decreased expression (as compared with wild type) at a predetermined developmental period or stage; a pattern of expression that differs from wild type in terms of decreased expression (as compared with wild type) in a predetermined cell type or tissue type; a pattern of expression that differs from wild type in terms of the splicing size, amino acid sequence, post-translational modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

As used herein, "host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

The "metabolism" of a substance, as used herein, means any aspect of the expression, function, action, or regulation of the substance. The metabolism of a substance includes modifications, e.g., covalent or non-covalent modifications of the substance. The metabolism of a substance includes modifications, e.g., covalent or non-covalent modification, the substance induces in other substances. The metabolism of a substance also includes changes in the distribution of the substance. The metabolism of a substance includes changes the substance induces in the distribution of other substances.

A "sample" as used herein refers to a biological sample, such as, for example, tissue or fluid isloated from an individual (including without limitation plasma, serum, cerebrospinal fluid, lymph, tears, saliva and tissue sections) or from in vitro cell culture constituents, as well as samples from the environment.

Technical and scientific terms used herein have the meanings commonly understood by one of ordinary skill in the art to which the present invention pertains, unless otherwise defined. Reference is made herein to various methodologies known to those of skill in the art. Publications and other materials setting forth such known methodologies to which reference is made are incorporated herein by reference in their entireties as though set forth in full. The practice of the invention will employ, unless otherwise indicated, conventional techniques of chemistry, molecular biology, microbiology, recombinant DNA, and immunology, which are within the skill of the art. Such techniques are explained fully in the literature. See e.g., Sambrook, Fritsch, and Maniatis, *Molecular Cloning; Laboratory Manual* 2nd ed. (1989); *DNA Cloning*, Volumes I and II (D. N Glover ed. 1985); *Oligonucleotide Synthesis* (M. J. Gait ed, 1984); *Nucleic Acid Hybridization* (B. D. Hames & S. J. Higgins eds. 1984); the series, *Methods in Enzymoloqy* (Academic Press, Inc.), particularly Vol. 154 and Vol. 155 (Wu and Grossman, eds.); *PCR-A Practical Approach* (McPherson, Quirke, and Taylor, eds., 1991); *Immunology*, 2d Edition, 1989, Roitt et al., C. V. Mosby Company, and New York; *Advanced Immunology*, 2d Edition, 1991, Male et al., Grower Medical Publishing, New York.; *DNA Cloning: A Practical Approach*, Volumes I and II, 1985 (D. N. Glover ed.); *Oligonucleotide Synthesis*, 1984, (M. L. Gait ed); *Transcription and Translation*, 1984 (Hames and Higgins eds.); *Animal Cell Culture*, 1986 (R. I. Freshney ed.); *Immobilized Cells and Enzymes*, 1986 (IRL Press); Perbal, 1984, *A Practical Guide to Molecular Cloning*; and *Gene Transfer Vectors for Mammalian Cells*, 1987 (J. H. Miller and M. P. Calos eds., Cold Spring Harbor Laboratory);

Any suitable materials and/or methods known to those of skill can be utilized in carrying out the present invention:

however preferred materials and/or methods are described. Materials, reagents and the like to which reference is made in the following description and examples are obtainable from commercial sources, unless otherwise noted.

S. pneumoniae Genomic Sequence

This invention provides nucleotide sequences of the genome of S. pneumoniae which thus comprises a DNA sequence library of S. pneumoniae genomic DNA. The detailed description that follows provides nucleotide sequences of S. pneumoniae, and also describes how the sequences were obtained and how ORFs and protein-coding sequences were identified. Also described are methods of using the disclosed S. pneumoniae sequences in methods including diagnostic and therapeutic applications. Furthermore, the library can be used as a database for identification and comparison of medically important sequences in this and other strains of S. pneumoniae.

To determine the genomic sequence of S. pneumoniae, DNA was isolated from strain 14453 of S. pneumoniae and mechanically sheared by nebulization to a median size of 2 kb. Following size fractionation by gel electrophoresis, the fragments were blunt-ended, ligated to adapter oligonucleotides, and cloned into each of 20 different pMPX vectors (Rice et al., abstracts of Meeting of Genome Mapping and Sequencing, Cold Spring Harbor, N.Y., 5/11–5/15, 1994, p. 225) and the PUC19 vector to construct a series of "shotgun" subclone libraries.

DNA sequencing was achieved using two sequencing methods. The first method used multiplex sequencing procedures essentially as disclosed in Church et al., 1988, Science 240:185; U.S. Pat. Nos. 4,942,124 and 5,149,625). DNA was extracted from pooled cultures and subjected to chemical or enzymatic sequencing. Sequencing reactions were resolved by electrophoresis, and the products were transferred and covalently bound to nylon membranes. Finally, the membranes were sequentially hybridized with a series of labelled oligonucleotides complimentary to "tag" sequences present in the different shotgun cloning vectors. In this manner, a large number of sequences could be obtained from a single set of sequencing reactions. The remainder of the sequencing was performed on AB1377 automated DNA sequencers. The cloning and sequencing procedures are described in more detail in the Exemplification.

Individual sequence reads were assembled using PHRAP (P. Green, Abstracts of DOE Human Genome Program Contractor-Grantee Workshop V, January 1996, p.157). The average contig length was about 3–4 kb.

A variety of approaches are used to order the contigs so as to obtain a continuous sequence representing the entire S. pneumoniae genome. Synthetic oligonucleotides are designed that are complementary to sequences at the end of each contig. These oligonucleotides may be hybridized to libaries of S. pneumoniae genomic DNA in, for example, lambda phage vectors or plasmid vectors to identify clones that contain sequences corresponding to the junctional regions between individual contigs. Such clones are then used to isolate template DNA and the same oligonucleotides are used as primers in polymerase chain reaction (PCR) to amplify junctional fragments, the nucleotide sequence of which is then determined.

The S. pneumoniae sequences were analyzed for the presence of open reading frames (ORFs) comprising at least 180 nucleotides. As a result of the analysis of ORFs based on stop-to-stop codon reads, it should be understood that these ORFs may not correspond to the ORF of a naturally-occurring S. pneumoniae polypeptide. These ORFs may contain start codons which indicate the initiation of protein synthesis of a naturally-occurring S. pneumoniae polypeptide. Such start codons within the ORFs provided herein can be identified by those of ordinary skill in the relevant art, and the resulting ORF and the encoded S. pneumoniae polypeptide is within the scope of this invention. For example, within the ORFs a codon such as AUG or GUG (encoding methionine or valine) which is part of the initiation signal for protein synthesis can be identified and the portion of an ORF to corresponding to a naturally-occurring S. pneumoniae polypeptide can be recognized. The predicted coding regions were defined by evaluating the coding potential of such sequences with the program GENEMARK™ (Borodovsky and McIninch, 1993, Comp. 17:123).

Each predicted ORF amino acid sequence was compared with all sequences found in current GENBANK, SWISS-PROT, and PIR databases using the BLAST algorithm. BLAST identifies local alignments occurring by chance between the ORF sequence and the sequence in the databank (Altschal et al., 1990, L Mol. Biol. 215:403–410). Homologous ORFs (probabilities less than $10^{-5}$ by chance) and ORF's that are probably-non-homologous (probabilities greater than $10^{-5}$ by chance) but have good codon usage were identified. Both homologous, sequences and non-homologous sequences with good codon usage, are likely to encode proteins and are encompassed by the invention.

S. pneumoniae Nucleic Acids

The nucleic acids of this invention may be obtained directly from the DNA of the above referenced S. pneumoniae strain by using the polymerase chain reaction (PCR). See "PCR, A Practical Approach" (McPherson, Quirke, and Taylor, eds., IRL Press, Oxford, UK, 1991) for details about the PCR. High fidelity PCR can be used to ensure a faithful DNA copy prior to expression. In addition, the authenticity of amplified products can be verified by conventional sequencing methods. Clones carrying the desired sequences described in this invention may also be obtained by screening the libraries by means of the PCR or by hybridization of synthetic oligonucleotide probes to filter lifts of the library colonies or plaques as known in the art (see, e.g., Sambrook et al., Molecular Cloning, A Laboratory Manual 2nd edition, 1989, Cold Spring Harbor Press, NY).

It is also possible to obtain nucleic acids encoding S. pneumoniae polypeptides from a cDNA library in accordance with protocols herein described. A cDNA encoding an S. pneumoniae polypeptide can be obtained by isolating total mRNA from an appropriate strain. Double stranded cDNAs can then be prepared from the total mRNA. Subsequently, the cDNAs can be inserted into a suitable plasmid or viral (e.g., bacteriophage) vector using any one of a number of known techniques. Genes encoding S. pneumoniae polypeptides can also be cloned using established polymerase chain reaction techniques in accordance with the nucleotide sequence information provided by the invention. The nucleic acids of the invention can be DNA or RNA. Preferred nucleic acids of the invention are contained in the Sequence Listing.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

Nucleic acids isolated or synthesized in accordance with features of the present invention are useful, by way of example, without limitation, as probes, primers, capture ligands, antisense genes and for developing expression systems for the synthesis of proteins and peptides corresponding to such sequences. As probes, primers, capture ligands and antisense agents, the nucleic acid normally consists of all or part (approximately twenty or more nucleotides for specificity as well as the ability to form stable hybridization products) of the nucleic acids of the invention contained in the Sequence Listing. These uses are described in further detail below.

Probes

A nucleic acid isolated or synthesized in accordance with the sequence of the invention contained in the Sequence Listing can be used as a probe to specifically detect S. pneumoniae. With the sequence information set forth in the present application, sequences of twenty or more nucleotides are identified which provide the desired inclusivity and exclusivity with respect to S. pneumoniae, and extraneous nucleic acids likely to be encountered during hybridization conditions. More preferably, the sequence will comprise at least twenty to thirty nucleotides to convey stability to the hybridization product formed between the probe and the intended target molecules.

Sequences larger than 1000 nucleotides in length are difficult to synthesize but can be generated by recombinant DNA techniques. Individuals skilled in the art will readily recognize that the nucleic acids, for use as probes, can be provided with a label to facilitate detection of a hybridization product.

Nucleic acid isolated and synthesized in accordance with the sequence of the invention contained in the Sequence Listing can also be useful as probes to detect homologous regions (especially homologous genes) of other Streptococcus species using appropriate stringency hybridization conditions as described herein.

Capture Ligand

For use as a capture ligand, the nucleic acid selected in the manner described above with respect to probes, can be readily associated with a support. The manner in which nucleic acid is associated with supports is well known. Nucleic acid having twenty or more nucleotides in a sequence of the invention contained in the Sequence Listing have utility to separate S. pneumoniae nucleic acid from the nucleic acid of each other and other organisms. Nucleic acid having twenty or more nucleotides in a sequence of the invention contained in the Sequence Listing can also have utility to separate other Streptococcus species from each other and from other organisms. Preferably, the sequence will comprise at least twenty nucleotides to convey stability to the hybridization product formed between the probe and the intended target molecules. Sequences larger than 1000 nucleotides in length are difficult to synthesize but can be generated by recombinant DNA techniques.

Primers

Nucleic acid isolated or synthesized in accordance with the sequences described herein have utility as primers for the amplification of S. pneumoniae nucleic acid. These nucleic acids may also have utility as primers for the amplification of nucleic acids in other Streptococcus species. With respect to polymerase chain reaction (PCR) techniques, nucleic acid sequences of >10–15 nucleotides of the invention contained in the Sequence Listing have utility in conjunction with suitable enzymes and reagents to create copies of S. pneumoniae nucleic acid. More preferably, the sequence will comprise twenty or more nucleotides to convey stability to the hybridization product formed between the primer and the intended target molecules. Binding conditions of primers greater than 100 nucleotides are more difficult to control to obtain specificity. High fidelity PCR can be used to ensure a faithful DNA copy prior to expression. In addition, amplified products can be checked by conventional sequencing methods.

The copies can be used in diagnostic assays to detect specific sequences, including genes from S. pneumoniae and/or other Streptococcus species. The copies can also be incorporated into cloning and expression vectors to generate polypeptides corresponding to the nucleic acid synthesized by PCR, as is described in greater detail herein.

Antisense

Nucleic acid or nucleic acid-hybridizing derivatives isolated or synthesized in accordance with the sequences described herein have utility as antisense agents to prevent the expression of S. pneumoniae genes. These sequences also have utility as antisense agents to prevent expression of genes of other Streptococcus species.

In one embodiment, nucleic acid or derivatives corresponding to S. pneumoniae nucleic acids is loaded into a suitable carrier such as a liposome or bacteriophage for introduction into bacterial cells. For example, a nucleic acid having twenty or more nucleotides is capable of binding to bacteria nucleic acid or bacteria messenger RNA. Preferably, the antisense nucleic acid is comprised of 20 or more nucleotides to provide necessary stability of a hybridization product of non-naturally occurring nucleic acid and bacterial nucleic acid and/or bacterial messenger RNA. Nucleic acid having a sequence greater than 1000 nucleotides in length is difficult to synthesize but can be generated by recombinant DNA techniques. Methods for loading antisense nucleic acid in liposomes is known in the art as exemplified by U.S. Pat. No. 4,241,046 issued Dec. 23, 1980 to Papahadjopoulos et al.

The present invention encompasses isolated polypeptides and nucleic acids derived from S. pneumoniae that are useful as reagents for diagnosis of bacterial infection, components of effective antibacterial vaccines, and/or as targets for antibacterial drugs, including anti S. pneumoniae drugs.

Expression of S. pneumoniae Nucleic Acids

Table 2 provides a list of open reading frames (ORFs) in both strands. An ORF is a region of nucleic acid which encodes a polypeptide. This region may represent a portion of a coding sequence or a total sequence and was determined from stop to stop codons. The first column lists the ORF designation. The second and third columns list the SEQ ID numbers for the nucleic acid and amino acid sequences corresponding to each ORF, respectively. The fourth and fifth columns list the length of the nucleic acid ORF and the length of the amino acid ORF, respectively. The nucleotide sequence corresponding to each ORF begins at the first nucleotide immediately following a stop codon and ends at the nucleotide immediately preceding the next downstream stop codon in the same reading frame. It will be recognized by one skilled in the art that the natural translation initiation sites will correspond to ATG, GTG, or TTG codons located within the ORFs. The natural initiation sites depend not only on the sequence of a start codon but also on the context of the DNA sequence adjacent to the start codon. Usually, a recognizable ribosome binding site is found within 20 nucleotides upstream from the initiation codon. In some cases where genes are translationally coupled and coordinately expressed together in "operons", ribosome binding sites are not present, but the initiation codon of a downstream gene may occur very close to, or overlap, the stop codon of the an upstream gene in the same operon. The correct start codons can be generally identified without undue experimentation because only a few codons need be tested. It is recognized that the translational machinery in bacteria initiates all polypeptide chains with the amino acid methionine, regardless of the sequence of the start codon. In some cases, polypeptides are post-translationally modified, resulting in an N-terminal amino acid other than methionine in vivo. The sixth and seventh columns provide metrics for assessing the likelihood of the homology match (determined by the BLASTP2 algorithm), as is known in the art, to the genes indicated in the eighth column. Specifically, the sixth column represents the "score" for the match (a higher score is a better match), and the seventh column represents the "P-value" for the match (the probability that such a match could have occurred by chance; the lower the value, the more likely the match is valid). If a BLASTP2 score of less than 46 was obtained, no value is reported in the table the "P-value". The eighth column provides, where available, the accession number (AC) or the Swissprot accession number (SP), the locus name (LN), Superfamily Classification (CL), the Organism (OR), Source of variant (SR), E.C. number (EC), the gene name (GN), the product name (PN), the Function Description (FN), the Map Position (MP), Left End (LE), Right End (RE), Coding Direction (DI), the Database from which the sequence originates (DB), and the description (DE) or notes (NT) for each ORF. This information allows one of ordinary skill in the art to determine a potential use for each identified coding sequence and, as a result, allows to use the polypeptides of the present invention for commercial and industrial purposes.

Using the information provided in SEQ ID NO: 1–SEQ ID NO: 2603 and in Table 2 together with routine cloning and sequencing methods, one of ordinary skill in the art will be able to clone and sequence all the nucleic acid fragments of interest including open reading frames (ORFs) encoding a large variety proteins of S. pneumoniae.

Nucleic acid isolated or synthesized in accordance with the sequences described herein have utility to generate polypeptides. The nucleic acid of the invention exemplified in SEQ ID NO: 1–SEQ ID NO: 2603 and in Table 2 or fragments of said nucleic acid encoding active portions of S. Pneumoniae polypeptides can be cloned into suitable vectors or used to isolate nucleic acid. The isolated nucleic acid is combined with suitable DNA linkers and cloned into a suitable vector.

The function of a specific gene or operon can be ascertained by expression in a bacterial strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression can be accomplished in a mutant strain which lacks the activity of the gene to be tested, or in a strain that does not produce the same gene product(s). This includes, but is not limited to, Eucaryotic species such as the yeast Saccharomyces cerevisiae, Methanobacterium strains or other Archaea, and Eubacteria such as E. coli, B. Subtilis, S. Aureus, S. Pneumonia or Pseudomonas putida. In some cases the expression host will utilize the natural S. pneumoniae promoter whereas in others, it will be necessary to drive the gene with a promoter sequence derived from the expressing organism (e.g., an E. coli beta-galactosidase promoter for expression in E. coli).

To express a gene product using the natural S. pneumoniae promoter, a procedure such as the following can be used. A restriction fragment containing the gene of interest, together with its associated natural promoter element and regulatory sequences (identified using the DNA sequence data) is cloned into an appropriate recombinant plasmid containing an origin of replication that functions in the host organism and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by, for example, electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into an expression plasmid after treating the PCR product with a restriction enzyme or exonuclease to create suitable ends for cloning.

A suitable host cell for expression of a gene can be any procaryotic or eucaryotic cell. For example, an S. pneumoniae polypeptide can be expressed in bacterial cells such as E. coli or B. subtilis, insect cells (baculovirus), yeast, or mammalian cells such as Chinese hamster ovary cell (CHO). Other suitable host cells are known to those skilled in the art.

Expression in eucaryotic cells such as mammalian, yeast, or insect cells can lead to partial or complete glycosylation and/or formation of relevant inter- or intra-chain disulfide bonds of a recombinant peptide product. Examples of vectors for expression in yeast S. cerivisae include pYepSec1 (Baldari. et al., (1987) Embo J. 6:229–234), pMFa (Kurjan and Herskowitz, (1982) Cell 30:933–943), pJRY88 (Schultz et al., (1987) Gene 54:113–123), and pYES2 (Invitrogen Corporation, San Diego, Calif.). Baculovirus vectors available for expression of proteins in cultured insect cells (SF 9 cells) include the pAc series (Smith et al., (1983) Mol. Cell Biol. 3:2156–2165) and the pVL series (Lucklow, V. A., and Summers, M. D., (1989) Virology 170:31–39). Generally, COS cells (Gluzman, Y., (1981) Cell 23:175–182) are used in conjunction with such vectors as pCDM 8 (Aruffo, A. and Seed, B., (1987) Proc. Natl. Acad Sci. USA 84:8573–8577) for transient amplification/expression in mammalian cells, while CHO (dhfr⁻ Chinese Hamster Ovary) cells are used with vectors such as pMT2PC (Kaufman et al. (1987), EMBO J. 6:187–195) for stable amplification/expression in mammalian cells. Vector DNA can be introduced into mammalian cells via conventional techniques such as calcium phosphate or calcium chloride co-precipitation, DEAE-dextran-mediated transfection, or electroporation. Suitable methods for transforming host cells can be found in Sambrook et al. (Molecular Cloning: A Laboratory Manual, 2nd Edition, Cold Spring Harbor Laboratory press (1989)), and other laboratory textbooks.

Expression in procaryotes is most often carried out in E. coli with either fusion or non-fusion inducible expression vectors. Fusion vectors usually add a number of $NH_2$ terminal amino acids to the expressed target gene. These $NH_2$ terminal amino acids often are referred to as a reporter group or an affinity purification group. Such reporter groups usually serve two purposes: 1) to increase the solubility of the target recombinant protein; and 2) to aid in the purification of the target recombinant protein by acting as a ligand in affinity purification. Often, in fusion expression vectors, a proteolytic cleavage site is introduced at the junction of the reporter group and the target recombinant protein to enable separation of the target recombinant protein from the reporter group subsequent to purification of the fusion protein. Such enzymes, and their cognate recognition sequences, include Factor Xa, thrombin and enterokinase. Typical fusion expression vectors include pGEX (Amrad Corp., Melbourne, Australia), pMAL (New England Biolabs, Beverly, Mass.) and pRIT5 (Pharmacia, Piscataway, N.J.) which fuse glutathione S-transferase, maltose E binding protein, or protein A, respectively, to the target recombinant protein. A preferred reporter group is poly(His), which may be fused to the amino or carboxy terminus of the protein and which renders the recombinant fusion protein easily purifiable by metal chelate chromatography.

Inducible non-fusion expression vectors include pTrc (Amann et al., (1988) Gene 69:301–315) and pET11d (Studier et al., Gene Expression Technology: Methods in Enzymology 185, Academic Press, San Diego, Calif. (1990) 60–89). While target gene expression relies on host RNA polymerase transcription from the hybrid trp-lac fusion promoter in pTrc, expression of target genes inserted into pET11d relies on transcription from the T7 gn10-lac 0 fusion promoter mediated by coexpressed viral RNA polymerase (T7 gn1). This viral polymerase is supplied by host strains BL21(DE3) or HMS174(DE3) from a resident x prophage harboring a T7 gn1 under the transcriptional control of the lacUV 5 promoter.

For example, a host cell transfected with a nucleic acid vector directing expression of a nucleotide sequence encoding an S. pneumoniae polypeptide can be cultured under appropriate conditions to allow expression of the polypeptide to occur. The polypeptide may be secreted and isolated from a mixture of cells and medium containing the peptide. Alternatively, the polypeptide may be retained cytoplasmically and the cells harvested, lysed and the protein isolated. A cell culture includes host cells, media and other byproducts. Suitable media for cell culture are well known in the art. Polypeptides of the invention can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such polypeptides.

Additionally, in many situations, polypeptides can be produced by chemical cleavage of a native protein (e.g., tryptic digestion) and the cleavage products can then be purified by standard techniques.

In the case of membrane bound proteins, these can be isolated from a host cell by contacting a membrane-associated protein fraction with a detergent forming a solubilized complex, where the membrane-associated protein is no longer entirely embedded in the membrane fraction and is solubilized at least to an extent which allows it to be chromatographically isolated from the membrane fraction. Several different criteria are used for choosing a detergent suitable for solubilizing these complexes. For example, one property considered is the ability of the detergent to solubilize the S. pneumoniae protein within the membrane fraction at minimal denaturation of the membrane-associated protein allowing for the activity or functionality of the membrane-associated protein to return upon reconstitution of the protein. Another property considered when selecting the detergent is the critical micelle concentration (CMC) of the detergent in that the detergent of choice preferably has a high CMC value allowing for ease of removal after reconstitution. A third property considered when selecting a detergent is the hydrophobicity of the detergent. Typically, membrane-associated proteins are very hydrophobic and therefore detergents which are also hydrophobic, e.g., the triton series, would be useful for solubilizing the hydrophobic proteins. Another property important to a detergent can be the capability of the detergent to remove the i. pneumoniae protein with minimal protein-protein interaction facilitating further purification. A fifth property of the detergent which should be considered is the charge of the detergent. For example, if it is desired to use ion exchange resins in the purification process then preferably detergent should be an uncharged detergent. Chromatographic techniques which can be used in the final purification step are known in the art and include hydrophobic interaction, lectin affinity, ion exchange, dye affinity and immunoaffinity.

One strategy to maximize recombinant S. pneumoniae peptide expression in E. coli is to express the protein in a host bacteria with an impaired capacity to proteolytically cleave the recombinant protein (Gottesman, S., Gene Expression Technology: Methods in Enzymology 185, Academic Press, San Diego, Calif. (1990) 119–128). Another strategy would be to alter the nucleic acid encoding an S. pneumoniae peptide to be inserted into an expression vector so that the individual codons for each amino acid would be those preferentially utilized in highly expressed E. coli proteins (Wada et al., (1992) Nuc. Acids Res. 20:2111–2118). Such alteration of nucleic acids of the invention can be carried out by standard DNA synthesis techniques.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See, e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

The present invention provides a library of S. pneumoniae-derived nucleic acid sequences. The libraries provide probes, primers, and markers which can be used as markers in epidemiological studies. The present invention also provides a library of S. pneumoniae-derived nucleic acid sequences which comprise or encode targets for therapeutic drugs.

Nucleic acids comprising any of the sequences disclosed herein or sub-sequences thereof can be prepared by standard methods using the nucleic acid sequence information provided in SEQ ID NO: 1–SEQ ID NO: 2603. For example, DNA can be chemically synthesized using, e.g., the phosphoramidite solid support method of Matteucci et al., 1981, J. Am. Chem. Soc. 103:3185, the method of Yoo et al., 1989, J. Biol. Chem. 764:17078, or other well known methods. This can be done by sequentially linking a series of oligonucleotide cassettes comprising pairs of synthetic oligonucleotides, as described below.

Of course, due to the degeneracy of the genetic code, many different nucleotide sequences can encode polypeptides having the amino acid sequences defined by SEQ ID NO: 2604–SEQ ID NO: 5206 or sub-sequences thereof. The codons can be selected for optimal expression in prokaryotic or eukaryotic systems. Such degenerate variants are also encompassed by this invention.

Insertion of nucleic acids (typically DNAs) encoding the polypeptides of the invention into a vector is easily accomplished when the termini of both the DNAs and the vector comprise compatible restriction sites. If this cannot be done, it may be necessary to modify the termini of the DNAs and/or vector by digesting back single-stranded DNA overhangs generated by restriction endonuclease cleavage to produce blunt ends, or to achieve the same result by filling in the single-stranded termini with an appropriate DNA polymerase.

Alternatively, any site desired may be produced, e.g., by ligating nucleotide sequences (linkers) onto the termini. Such linkers may comprise specific oligonucleotide sequences that define desired restriction sites. Restriction sites can also be generated by the use of the polymerase chain reaction (PCR). See, e.g., Saiki et al., 1988, *Science* 239:48. The cleaved vector and the DNA fragments may also be modified if required by homopolymeric tailing.

In certain embodiments, the invention encompasses isolated nucleic acid fragments comprising all or part of the individual nucleic acid sequences disclosed herein. The fragments are at least about 8 nucleotides in length, preferably at least about 12 nucleotides in length, and most preferably at least about 15–20 nucleotides in length.

The nucleic acids may be isolated directly from cells. Alternatively, the polymerase chain reaction (PCR) method can be used to produce the nucleic acids of the invention, using either chemically synthesized strands or genomic material as templates. Primers used for PCR can be synthesized using the sequence information provided herein and can further be designed to introduce appropriate new restriction sites, if desirable, to facilitate incorporation into a given vector for recombinant expression.

The nucleic acids of the present invention may be flanked by natural *S. pneumoniae* regulatory sequences, or may be associated with heterologous sequences, including promoters, enhancers, response elements, signal sequences, polyadenylation sequences, introns, 5'- and 3'-noncoding regions, and the like. The nucleic acids may also be modified by many means known in the art. Non-limiting examples of such modifications include methylation, "caps", substitution of one or more of the naturally occurring nucleotides with an analog, internucleotide modifications such as, for example, those with uncharged linkages (e.g., methyl phosphonates, phosphotriesters, phosphoroamidates, carbamates, etc.) and with charged linkages (e.g., phosphorothioates, phosphorodithioates, etc.). Nucleic acids may contain one or more additional covalently linked moieties, such as, for example, proteins (e.g., nucleases, toxins, antibodies, signal peptides, poly-L-lysine, etc.), intercalators (e.g., acridine, psoralen, etc.), chelators (e.g., metals, radioactive metals, iron, oxidative metals, etc.), and alkylators. PNAs are also included. The nucleic acid may be derivatized by formation of a methyl or ethyl phosphotriester or an alkyl phosphoramidate linkage. Furthermore, the nucleic acid sequences of the present invention may also be modified with a label capable of providing a detectable signal, either directly or indirectly. Exemplary labels include radioisotopes, fluorescent molecules, biotin, and the like.

The invention also provides nucleic acid vectors comprising the disclosed *S. pneumoniae*-derived sequences or derivatives or fragments thereof. A large number of vectors, including plasmid and fungal vectors, have been described for replication and/or expression in a variety of eukaryotic and prokaryotic hosts, and may be used for gene therapy as well as for simple cloning or protein expression.

The encoded *S. pneumoniae* polypeptides may be expressed by using many known vectors, such as pUC plasmids, pET plasmids (Novagen, Inc., Madison, Wis.), or pRSET or pREP (Invitrogen, San Diego, Calif.), and many appropriate host cells, using methods disclosed or cited herein or otherwise known to those skilled in the relevant art. The particular choice of vector/host is not critical to the practice of the invention.

Recombinant cloning vectors will often include one or more replication systems for cloning or expression, one or more markers for selection in the host, e.g. antibiotic resistance, and one or more expression cassettes. The inserted *S. pneumoniae* coding sequences may be synthesized by standard methods, isolated from natural sources, or prepared as hybrids, etc. Ligation of the *S. pneumoniae* coding sequences to transcriptional regulatory elements and/or to other amino acid coding sequences may be achieved by known methods. Suitable host cells may be transformed/transfected/infected as appropriate by any suitable method including electroporation, $CaCl_2$ mediated DNA uptake, fungal infection, microinjection, microprojectile, or other established methods.

Appropriate host cells include bacteria, archebacteria, fungi, especially yeast, and plant and animal cells, especially mammalian cells. Of particular interest are *S. pneumoniae, E. coli, B. Subtilis, Saccharomyces cerevisiae, Saccharomyces carlsbergensis, Schizosaccharomyces pombi*, SF9 cells, C129 cells, 293 cells, Neurospora, and CHO cells, COS cells, HeLa cells, and immortalized mammalian myeloid and lymphoid cell lines. Preferred replication systems include M13, ColE1, SV40, baculovirus, lambda, adenovirus, and the like. A large number of transcription initiation and termination regulatory regions have been isolated and shown to be effective in the transcription and translation of heterologous proteins in the various hosts. Examples of these regions, methods of isolation, manner of manipulation, etc. are known in the art. Under appropriate expression conditions, host cells can be used as a source of recombinantly produced *S. pneumoniae*-derived peptides and polypeptides.

Advantageously, vectors may also include a transcription regulatory element (i.e., a promoter) operably linked to the *S. pneumoniae* portion. The promoter may optionally contain operator portions and/or ribosome binding sites. Non-limiting examples of bacterial promoters compatible with *E. coli* include: b-lactamase (penicillinase) promoter; lactose promoter; tryptophan (trp) promoter; araBAD (arabinose) operon promoter; lambda-derived $P_1$ promoter and N gene ribosome binding site; and the hybrid tac promoter derived from sequences of the trp and lac UV5 promoters. Non-limiting examples of yeast promoters include 3-phosphoglycerate kinase promoter, glyceraldehyde-3-phosphate dehydrogenase (GAPDH) promoter, galactokinase (GAL1) promoter, galactoepimerase promoter, and alcohol dehydrogenase (ADH) promoter. Suitable promoters for mammalian cells include without limitation viral promoters such as that from Simian Virus 40 (SV40), Rous sarcoma virus (RSV), adenovirus (ADV), and bovine papilloma virus (BPV). Mammalian cells may also require terminator sequences, polyA addition sequences and enhancer sequences to increase expression. Sequences which cause amplification of the gene may also be desirable. Furthermore, sequences that facilitate secretion of the recombinant product from cells, including, but not limited to, bacteria, yeast, and animal cells, such as secretory signal sequences and/or prohormone pro region sequences, may also be included. These sequences are well described in the art.

Nucleic acids encoding wild-type or variant *S. pneumoniae*-derived polypeptides may also be introduced into cells by recombination events. For example, such a sequence can be introduced into a cell, and thereby effect homologous recombination at the site of an endogenous gene or a sequence with substantial identity to the gene. Other recombination-based methods such as nonhomologous recombinations or deletion of endogenous genes by homologous recombination may also be used.

The nucleic acids of the present invention find use as templates for the recombinant production of S. pneumoniae-derived peptides or polypeptides.

Identification and Use of S. pneumoniae Nucleic Acid Sequences

The disclosed S. pneumoniae polypeptide and nucleic acid sequences, or other sequences that are contained within ORFs, including complete protein-coding sequences, of which any of the disclosed S. pneumoniae-specific sequences forms a part, are useful as target components for diagnosis and/or treatment of S. pneumoniae-caused infection It will be understood that the sequence of an entire protein-coding sequence of which each disclosed nucleic acid sequence forms a part can be isolated and identified based on each disclosed sequence. This can be achieved, for example, by using an isolated nucleic acid encoding the disclosed sequence, or fragments thereof, to prime a sequencing reaction with genomic, S. pneumoniae DNA as template; this is followed by sequencing the amplified product. The isolated nucleic acid encoding the disclosed sequence, or fragments thereof, can also be hybridized to S. pneumoniae genomic libraries to identify clones containing additional complete segments of the protein-coding sequence of which the shorter sequence forms a part. Then, the entire protein-coding sequence, or fragments thereof, or nucleic acids encoding all or part of the sequence, or sequence-conservative or function-conservative variants thereof, may be employed in practicing the present invention.

Preferred sequences are those that are useful in diagnostic and/or therapeutic applications. Diagnostic applications include without limitation nucleic-acid-based and antibody-based methods for detecting bacterial infection. Therapeutic applications include without limitation vaccines, passive immunotherapy, and drug treatments directed against gene products that are both unique to bacteria and essential for growth and/or replication of bacteria.

Identification of Nucleic Acids Encoding Vaccine Components and Targets for Agents Effective Against S. pneumoniae The disclosed S. pneumoniae genome sequence includes segments that direct the a, synthesis of ribonucleic acids and polypeptides, as well as origins of replication, promoters, other types of regulatory sequences, and intergenic nucleic acids. The invention encompasses nucleic acids encoding immunogenic components of vaccines and targets for agents effective against S. pneumoniae. Identification of said immunogenic components involved in the determination of the function of the disclosed sequences, which can be achieved using a variety of approaches. Non-limiting examples of these approaches are described briefly below.

Homology to Known Sequences:

Computer-assisted comparison of the disclosed S. pneumoniae sequences with previously reported sequences present in publicly available databases is useful for identifying functional S. pneumoniae nucleic acid and polypeptide sequences. It will be understood that protein-coding sequences, for example, may be compared as a whole, and that a high degree of sequence homology between two proteins (such as, for example, >80–90%) at the amino acid level indicates that the two proteins also possess some degree of functional homology, such as, for example, among enzymes involved in metabolism, DNA synthesis, or cell wall synthesis, and proteins involved in transport, cell division, etc. In addition, many structural features of particular protein classes have been identified and correlate with specific consensus sequences, such as, for example, binding domains for nucleotides, DNA, metal ions, and other small molecules; sites for covalent modifications such as phosphorylation, acylation, and the like; sites of protein-:protein interactions, etc. These consensus sequences may be quite short and thus may represent only a fraction of the entire protein-coding sequence. Identification of such a feature in an S. pneumoniae sequence is therefore useful in determining the function of the encoded protein and identifying useful targets of antibacterial drugs.

Of particular relevance to the present invention are structural features that are common to secretory, transmembrane, and surface proteins, including secretion signal peptides and hydrophobic transmembrane domains. S. pneumoniae proteins identified as containing putative signal sequences and/or transmembrane domains are useful as immunogenic components of vaccines.

Targets for therapeutic drugs according to the invention include, but are not limited to, polypeptides of the invention, whether unique to S. pneumoniae or not, that are essential for growth and/or viability of S. pneumoniae under at least one growth condition. Polypeptides essential for growth and/or viability can be determined by examining the effect of deleting and/or disrupting the genes, i.e., by so-called gene "knockout". Alternatively, genetic footprinting can be used (Smith et al., 1995, Proc. Natl. Acad Sci. USA 92:5479–6433; Published International Application WO 94/26933; U.S. Pat. No. 5,612,180). Still other methods for assessing essentiality includes the ability to isolate conditional lethal mutations in the specific gene (e.g., temperature-sensitive mutations). Other useful targets for therapeutic drugs, which include polypeptides that are not essential for growth or viability per se but lead to loss of viability of the cell, can be used to target therapeutic agents to cells.

Strain-specific Sequences:

Because of the evolutionary relationship between different S. pneumoniae strains, it is believed that the presently disclosed S. pneumoniae sequences are useful for identifying, and/or discriminating between, previously known and new S. pneumoniae strains. It is believed that other S. pneumoniae strains will exhibit at least 70% sequence homology with the presently disclosed sequence. Systematic and routine analyses of DNA sequences derived from samples containing S. pneumoniae strains, and comparison with the present sequence allows for the identification of sequences that can be used to discriminate between strains, as well as those that are common to all S. pneumoniae strains. In one embodiment, the invention provides nucleic acids, including probes, and peptide and polypeptide sequences that discriminate between different strains of S. pneumoniae. Strain-specific components can also be identified functionally by their ability to elicit or react with antibodies that selectively recognize one or more S. pneumoniae strains.

In another embodiment, the invention provides nucleic acids, including probes, and peptide and polypeptide sequences that are common to all S. pneumoniae strains but are not found in other bacterial species.

S. pneumoniae Polypeptides

This invention encompasses isolated S. pneumoniae polypeptides encoded by the disclosed S. pneumoniae genomic sequences, including the polypeptides of the invention contained in the Sequence Listing. Polypeptides of the invention are preferably at least 5 amino acid residues in length. Using the DNA sequence information provided herein, the amino acid sequences of the polypeptides encompassed by the invention can be deduced using methods well-known in the art. It will be understood that the sequence of an entire nucleic acid encoding an S. pneumoniae polypeptide can be isolated and identified based on an ORF that encodes only a fragment of the cognate protein-coding region. This can be achieved, for example, by using the isolated nucleic acid encoding the ORF, or fragments thereof, to prime a polymerase chain reaction with genomic S. pneumoniae DNA as template; this is followed by sequencing the amplified product.

The polypeptides of the present invention, including function-conservative variants of the disclosed ORFs, may be isolated from wild-type or mutant S. pneumoniae cells, or from heterologous organisms or cells (including, but not limited to, bacteria, fungi, insect, plant, and mammalian cells) including S. pneumoniae into which a S. pneumoniae-derived protein-coding sequence has been introduced and expressed. Furthermore, the polypeptides may be part of recombinant fusion proteins.

S. pneumoniae polypeptides of the invention can be chemically synthesized using commercially automated procedures such as those referenced herein, including, without limitation, exclusive solid phase synthesis, partial solid phase methods, fragment condensation or classical solution synthesis. The polypeptides are preferably prepared by solid phase peptide synthesis as described by Merrifield, 1963, *J. Am. Chem. Soc.* 85:2149. The synthesis is carried out with amino acids that are protected at the alpha-amino terminus. Trifunctional amino acids with labile side-chains are also protected with suitable groups to prevent undesired chemical reactions from occurring during the assembly of the polypeptides. The alpha-amino protecting group is selectively removed to allow subsequent reaction to take place at the amino-terminus. The conditions for the removal of the alpha-amino protecting group do not remove the side-chain protecting groups.

The alpha-amino protecting groups are those known to be useful in the art of stepwise polypeptide synthesis. Included are acyl type protecting groups, e.g., formyl, trifluoroacetyl, acetyl, aromatic urethane type protecting groups, e.g., benzyloxycarbonyl (Cbz), substituted benzyloxycarbonyl and 9-fluorenylmethyloxycarbonyl (Fmoc), aliphatic urethane protecting groups, e.g., t-butyloxycarbonyl (Boc), isopropyloxycarbonyl, cyclohexyloxycarbonyl, and alkyl type protecting groups, e.g., benzyl, triphenylmethyl. The preferred protecting group is Boc. The side-chain protecting groups for Tyr include tetrahydropyranyl, tert-butyl, trityl, benzyl, Cbz, 4-Br-Cbz and 2,6-dichlorobenzyl. The preferred side-chain protecting group for Tyr is 2,6-dichlorobenzyl. The side-chain protecting groups for Asp include benzyl, 2,6-dichlorobenzyl, methyl, ethyl and cyclohexyl. The preferred side-chain protecting group for Asp is cyclohexyl. The side-chain protecting groups for Thr and Ser include acetyl, benzoyl, trityl, tetrahydropyranyl, benzyl, 2,6-dichlorobenzyl and Cbz. The preferred protecting group for Thr and Ser is benzyl. The side-chain protecting groups for Arg include nitro, Tos, Cbz, adamantyloxycarbonyl and Boc. The preferred protecting group for Arg is Tos. The side-chain amino group of Lys may be protected with Cbz, 2-Cl-Cbz, Tos or Boc. The 2-Cl-Cbz group is the preferred protecting group for Lys.

The side-chain protecting groups selected must remain intact during coupling and not be removed during the deprotection of the amino-terminus protecting group or during coupling conditions. The side-chain protecting groups must also be removable upon the completion of synthesis, using reaction conditions that will not alter the finished polypeptide.

Solid phase synthesis is usually carried out from the carboxy-terminus by coupling the alpha-amino protected (side-chain protected) amino acid to a suitable solid support. An ester linkage is formed when the attachment is made to a chloromethyl or hydroxymethyl resin, and the resulting polypeptide will have a free carboxyl group at the C-terminus. Alternatively, when a benzhydrylamine or p-methylbenzhydrylamine resin is used, an amide bond is formed and the resulting polypeptide will have a carboxamide group at the C-terminus. These resins are commercially available, and their preparation was described by Stewart et al., 1984, *Solid Phase Peptide Synthesis* (2nd Edition), Pierce Chemical Co., Rockford, Ill.

The C-terminal amino acid, protected at the side chain if necessary and at the alpha-amino group, is coupled to the benzhydrylamine resin using various activating agents including dicyclohexylcarbodiimide (DCC), N,N'-diisopropyl-carbodiimide and carbonyldiimidazole. Following the attachment to the resin support, the alpha-amino protecting group is removed using trifluoroacetic acid (TFA) or HCl in dioxane at a temperature between 0 and 25° C. Dimethylsulfide is added to the TFA after the introduction of methionine (Met) to suppress possible S-alkylation. After removal of the alpha-amino protecting group, the remaining protected amino acids are coupled stepwise in the required order to obtain the desired sequence.

Various activating agents can be used for the coupling reactions including DCC, N,N'-diisopropyl-carbodiimide, benzotriazol-1-yl-oxy-tris-(dimethylamino)-phosphonium hexa-fluorophosphate (BOP) and DCC-hydroxybenzotriazole (HOBt). Each protected amino acid is used in excess (>2.0 equivalents), and the couplings are usually carried out in N-methylpyrrolidone (NMP) or in DMF, $CH_2Cl_2$ or mixtures thereof. The extent of completion of the coupling reaction is monitored at each stage, e.g., by the ninhydrin reaction as described by Kaiser et al., 1970, *Anal. Biochem.* 34:595. In cases where incomplete coupling is found, the coupling reaction is repeated. The coupling reactions can be performed automatically with commercially available instruments.

After the entire assembly of the desired polypeptide, the polypeptide-resin is cleaved with a reagent such as liquid HF for 1–2 hours at 0° C., which cleaves the polypeptide from the resin and removes all side-chain protecting groups. A scavenger such as anisole is usually used with the liquid HF to prevent cations formed during the cleavage from alkylating the amino acid residues present in the polypeptide. The polypeptide-resin may be deprotected with TFA/dithioethane prior to cleavage if desired.

Side-chain to side-chain cyclization on the solid support requires the use of an orthogonal protection scheme which enables selective cleavage of the side-chain functions of acidic amino acids (e.g., Asp) and the basic amino acids (e.g., Lys). The 9-fluorenylmethyl (Fm) protecting group for the side-chain of Asp and the 9-fluorenylmethyloxycarbonyl (Fmoc) protecting group for the side-chain of Lys can be used for this purpose. In these cases, the side-chain protecting groups of the Boc-protected polypeptide-resin are selectively removed with piperidine in DMF. Cyclization is achieved on the solid support using various activating agents including DCC, DCC/HOBt or BOP. The HF reaction is carried out on the cyclized polypeptide-resin as described above.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the S. pneumoniae protein contains an additional sequence tag that facilitates purification, such as, but not limited to, a polyhistidine sequence. The polypeptide can then be purified from a crude lysate of the host cell by chromatography on an appropriate solid-phase matrix. Alternatively, antibodies produced against a S. pneumoniae protein or against peptides derived therefrom can be used as purification reagents. Other purification methods are possible.

The present invention also encompasses derivatives and homologues of S. pneumoniae-encoded polypeptides. For some purposes, nucleic acid sequences encoding the peptides may be altered by substitutions, additions, or deletions that provide for functionally equivalent molecules, i.e., function-conservative variants. For example, one or more amino acid residues within the sequence can be substituted by another amino acid of similar properties, such as, for example, positively charged amino acids (arginine, lysine, and histidine); negatively charged amino acids (aspartate and glutamate); polar neutral amino acids; and non-polar amino acids. The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds. agents.

To identify S. pneumoniae-derived polypeptides for use in the present invention, essentially the complete genomic sequence of a virulent, methicillin-resistant isolate of Streptococcus pneumoniae isolate was analyzed. While, in very rare instances, a nucleic acid sequencing error may be revealed, resolving a rare sequencing error is well within the art, and such an occurrence will not prevent one skilled in the art from practicing the invention.

Also encompassed are any S. pneumoniae polypeptide sequences that are contained within the open reading frames (ORFs), including complete protein-coding sequences, of which any of SEQ ID NO: 2604–SEQ ID NO: 5206 forms a part. Table 2, which is appended herewith and which forms part of the present specification, provides a putative identification of the particular function of a polypeptide which is encoded by each ORF. As a result, one skilled in the art can use the polypeptides of the present invention for commercial and industrial purposes consistent with the type of putative identification of the polypeptide.

The present invention provides a library of S. Pneumoniae-derived polypeptide sequences, and a corresponding library of nucleic acid sequences encoding the polypeptides, wherein the polypeptides themselves, or polypeptides contained within ORFs of which they form a part, comprise sequences that are contemplated for use as components of vaccines. Non-limiting examples of such sequences are listed by SEQ ID NO in Table 2, which is appended herewith and which forms part of the present specification.

The present invention also provides a library of S. pneumoniae-derived polypeptide sequences, and a corresponding library of nucleic acid sequences encoding the polypeptides, wherein the polypeptides themselves, or polypeptides contained within ORFs of which they form a part, comprise sequences lacking homology to any known prokaryotic or eukaryotic sequences. Such libraries provide probes, primers, and markers which can be used to diagnose S. pneumoniae infection, including use as markers in epidemiological studies. Non-limiting examples of such sequences are listed by SEQ ID NO in Table 2, which is appended The present invention also provides a library of S. pneumoniae-derived polypeptide sequences, and a corresponding library of nucleic acid sequences encoding the polypeptides, wherein the polypeptides themselves, or polypeptides contained within ORFs of which they form a part, comprise targets for therapeutic drugs.

Specific Example: Determination of Candidate Protein Antiaens For Antibody and Vaccine Development The selection of candidate protein antigens for vaccine development can be derived from the nucleic acids encoding S. pneumoniae polypeptides. First, the ORF's can be analyzed for homology to other known exported or membrane proteins and analyzed using the discriminant analysis described by Klein, et al. (Klein, P., Kanehsia, M., and DeLisi, C. (1985) *Biochimica et Biophysica Acta* 815, 468–476) for predicting exported and membrane proteins.

Homology searches can be performed using the BLAST algorithm contained in the Wisconsin Sequence Analysis Package (Genetics Computer Group, University Research Park, 575 Science Drive, Madison, Wis. 53711) to compare each predicted ORF amino acid sequence with all sequences found in the current GenBank, SWISS-PROT and PIR databases. BLAST searches for local alignments between the ORF and the databank sequences and reports a probability score which indicates the probability of finding this sequence by chance in the database. ORF's with significant homology (e.g. probabilities lower than $1 \times 10^{-6}$ that the homology is only due to random chance) to membrane or exported proteins represent protein antigens for vaccine development. Possible functions can be provided to S. pneumoniae genes based on sequence homology to genes cloned in other organisms.

Discriminant analysis (Klein, et al. supra) can be used to examine the ORF amino acid sequences. This algorithm uses the intrinsic information contained in the ORF amino acid sequence and compares it to information derived from the properties of known membrane and exported proteins. This comparison predicts which proteins will be exported, membrane associated or cytoplasmic. ORF amino acid sequences identified as exported or membrane associated by this algorithm are likely protein antigens for vaccine development.

Production of Fragments and Analogs of S. pneumoniae Nucleic Acids and Polypeptides Based on the discovery of the S. pneumoniae gene products of the invention provided in the Sequence Listing, one skilled in the art can alter the disclosed structure (of S. pneumoniae genes), e.g., by producing fragments or analogs, and test the newly produced structures for activity. Examples of techniques known to those skilled in the relevant art which allow the production and testing of fragments and analogs are discussed below. These, or analogous methods can be used to make and screen libraries of polypeptides, e.g., libraries of random peptides or libraries of fragments or analogs of cellular proteins for the ability to bind S. pneumoniae polypeptides. Such screens are useful for the identification of inhibitors of S. pneumoniae.

Generation of Fragments

Fragments of a protein can be produced in several ways, e.g., recombinantly, by proteolytic digestion, or by chemical synthesis. Internal or terminal fragments of a polypeptide can be generated by removing one or more nucleotides from one end (for a terminal fragment) or both ends (for an internal fragment) of a nucleic acid which encodes the polypeptide. Expression of the mutagenized DNA produces polypeptide fragments. Digestion with "end-nibbling" endonucleases can thus generate DNA's which encode an array of fragments. DNA's which encode fragments of a protein can also be generated by random shearing, restriction digestion or a combination of the above-discussed methods.

Fragments can also be chemically synthesized using techniques known in the art such as conventional Merrifield solid phase f-Moc or t-Boc chemistry. For example, peptides of the present invention may be arbitrarily divided into fragments of desired length with no overlap of the fragments, or divided into overlapping fragments of a desired length.

Alteration of Nucleic Acids and Polypeptides: Random Methods

Amino acid sequence variants of a protein can be prepared by random mutagenesis of DNA which encodes a protein or a particular domain or region of a protein. Useful methods include PCR mutagenesis and saturation mutagenesis. A library of random amino acid sequence variants can also be generated by the synthesis of a set of degenerate oligonucleotide sequences. (Methods for screening proteins in a library of variants are elsewhere herein).

PCR Mutagenesis

In PCR mutagenesis, reduced Taq polymerase fidelity is used to introduce random mutations into a cloned fragment of DNA (Leung et al., 1989, *Technique* 1:11–15). The DNA region to be mutagenized is amplified using the polymerase chain reaction (PCR) under conditions that reduce the fidelity of DNA synthesis by Taq DNA polymerase, e.g., by using a dGTP/dATP ratio of five and adding $Mn^{2+}$ to the PCR reaction. The pool of amplified DNA fragments are inserted into appropriate cloning vectors to provide random mutant libraries.

Saturation Mutagenesis Saturation mutagenesis allows for the rapid introduction of a large number of single base substitutions into cloned DNA fragments (Mayers et al., 1985, *Science* 229:242). This technique includes generation of mutations, e.g., by chemical treatment or irradiation of single-stranded DNA in vitro, and synthesis of a complimentary DNA strand. The mutation frequency can be modulated by modulating the severity of the treatment, and essentially all possible base substitutions can be obtained. Because this procedure does not involve a genetic selection for mutant fragments both neutral substitutions, as well as those that alter function, are obtained. The distribution of point mutations is not biased toward conserved sequence elements.

Degenerated Oligonucleotides

A library of homologs can also be generated from a set of degenerate oligonucleotide sequences. Chemical synthesis of a degenerate sequences can be carried out in an automatic DNA synthesizer, and the synthetic genes then ligated into an appropriate expression vector. The synthesis of degenerate oligonucleotides is known in the art (see for example, Narang, S A (1983) *Tetrahedron* 39:3; Itakura et al. (1981) *Recombinant DNA, Proc 3rd Cleveland Sympos. Macromolecules*, ed. A G Walton, Amsterdam: Elsevier pp273–289; Itakura et al. (1984) *Annu. Rev. Biochem.* 53:323; Itakura et al. (1984) *Science* 198:1056; Ike et al. (1983) *Nucleic Acid Res.* 11:477. Such techniques have been employed in the directed evolution of other proteins (see, for example, Scott et al. (1990) *Science* 249:386–390; Roberts et al. (1992) *PNAS* 89:2429–2433; Devlin et al. (1990) *Science* 249: 404–406; Cwirla et al. (1990) *PNAS* 87: 6378–6382; as well as U.S. Pat. Nos. 5,223,409, 5,198,346, and 5,096,815).

Alteration of Nucleic Acids and Polypeptides: Methods for Directed Mutagenesis

Non-random or directed, mutagenesis techniques can be used to provide specific sequences or mutations in specific regions. These techniques can be used to create variants which include, e.g., deletions, insertions, or substitutions, of residues of the known amino acid sequence of a protein. The sites for mutation can be modified individually or in series, e.g., by (1) substituting first with conserved amino acids and then with more radical choices depending upon results achieved, (2) deleting the target residue, or (3) inserting residues of the same or a different class adjacent to the located site, or combinations of options 1–3.

Alanine Scanning Mutagenesis

Alanine scanning mutagenesis is a useful method for identification of certain residues or regions of the desired protein that are preferred locations or domains for mutagenesis, Cunningham and Wells (*Science* 244:1081–1085,1989). In alanine scanning, a residue or group of target residues are identified (e.g., charged residues such as Arg, Asp, His, Lys, and Glu) and replaced by a neutral or negatively charged amino acid (most preferably alanine or polyalanine). Replacement of an amino acid can affect the interaction of the amino acids with the surrounding aqueous environment in or outside the cell. Those domains demonstrating functional sensitivity to the substitutions are then refined by introducing further or other variants at or for the sites of substitution. Thus, while the site for introducing an amino acid sequence variation is predetermined, the nature of the mutation per se need not be predetermined. For example, to optimize the performance of a mutation at a given site, alanine scanning or random mutagenesis may be conducted at the target codon or region and the expressed desired protein subunit variants are screened for the optimal combination of desired activity.

Oligonucleotide-Mediated Mutagenesis

Oligonucleotide-Mediated mutagenesis is a useful method for preparing substitution, deletion, and insertion variants of DNA, see, e.g., Adelman et al., (*DNA* 2:183, 1983). Briefly, the desired DNA is altered by hybridizing an oligonucleotide encoding a mutation to a DNA template, where the template is the single-stranded form of a plasmid or bacteriophage containing the unaltered or native DNA sequence of the desired protein. After hybridization, a DNA polymerase is used to synthesize an entire second complementary strand of the template that will thus incorporate the oligonucleotide primer, and will code for the selected alteration in the desired protein DNA. Generally, oligonucleotides of at least 25 nucleotides in length are used. An optimal oligonucleotide will have 12 to 15 nucleotides that are completely complementary to the template on either side of the nucleotide(s) coding for the mutation. This ensures that the oligonucleotide will hybridize properly to the single-stranded DNA template molecule. The oligonucleotides are readily synthesized using techniques known in the art such as that described by Crea et al. (*Proc. Natl. Acad. Sci.* USA, 75:5765[1978]).

Cassette Mutagenesis

Another method for preparing variants, cassette mutagenesis, is based on the technique described by Wells et al. (*Gene*, 34:315[1985]). The starting material is a plasmid (or other vector) which includes the protein subunit DNA to be mutated. The codon(s) in the protein subunit DNA to be mutated are identified. There must be a unique restriction endonuclease site on each side of the identified mutation site(s). If no such restriction sites exist, they may be generated using the above-described oligonucleotide-mediated mutagenesis method to introduce them at appropriate locations in the desired protein subunit DNA. After the restriction sites have been introduced into the plasmid, the plasmid is cut at these sites to linearize it. A double-stranded oligonucleotide encoding the sequence of the DNA between the restriction sites but containing the desired mutation(s) is synthesized using standard procedures. The two strands are synthesized separately and then hybridized together using standard techniques. This double-stranded oligonucleotide is referred to as the cassette. This cassette is designed to have 3' and 5' ends that are comparable with the ends of the linearized plasmid, such that it can be directly ligated to the plasmid. This plasmid now contains the mutated desired protein subunit DNA sequence.

Combinatorial Mutagenesis

Combinatorial mutagenesis can also be used to generate mutants (Ladner et al., WO 88/06630). In this method, the amino acid sequences for a group of homologs or other related proteins are aligned, preferably to promote the highest homology possible. All of the amino acids which appear at a given position of the aligned sequences can be selected to create a degenerate set of combinatorial sequences. The variegated library of variants is generated by combinatorial mutagenesis at the nucleic acid level, and is encoded by a variegated gene library. For example, a mixture of synthetic oligonucleotides can be enzymatically ligated into gene sequences such that the degenerate set of potential sequences are expressible as individual peptides, or alternatively, as a set of larger fusion proteins containing the set of degenerate sequences.

Other Modifications of S. pneumoniae Nucleic Acids and Polypeptides

It is possible to modify the structure of an S. pneumoniae polypeptide for such purposes as increasing solubility, enhancing stability (e.g., shelf life ex vivo and resistance to proteolytic degradation in vivo). A modified S. pneumoniae protein or peptide can be produced in which the amino acid sequence has been altered, such as by amino acid substitution, deletion, or addition as described herein.

An S. pneumoniae peptide can also be modified by substitution of cysteine residues preferably with alanine, serine, threonine, leucine or glutamic acid residues to minimize dimerization via disulfide linkages. In addition, amino acid side chains of fragments of the protein of the invention can be chemically modified. Another modification is cyclization of the peptide.

In order to enhance stability and/or reactivity, an S. pneumoniae polypeptide can be modified to incorporate one or more polymorphisms in the amino acid sequence of the protein resulting from any natural allelic variation. Additionally, D-amino acids, non-natural amino acids, or non-amino acid analogs can be substituted or added to produce a modified protein within the scope of this invention. Furthermore, an S. pneumoniae polypeptide can be modified using polyethylene glycol (PEG) according to the method of A. Sehon and co-workers (Wie et al., supra) to produce a protein conjugated with PEG. In addition, PEG can be added during chemical synthesis of the protein. Other modifications of S. pneumoniae proteins include reduction/alkylation (Tarr, *Methods of Protein Microcharacterization*, J. E. Silver ed., Humana Press, Clifton N.J. 155–194 (1986)); acylation (Tarr, supra); chemical coupling to an appropriate carrier (Mishell and Shiigi, eds, *Selected Methods in Cellular Immunology*, WH Freeman, San Francisco, Calif. (1980), U.S. Pat. No. 4,939,239; or mild formalin treatment (Marsh, (1971) *Int. Arch. of Allergy and Appl. Immunol.*, 41: 199–215).

To facilitate purification and potentially increase solubility of an S. pneumoniae protein or peptide, it is possible to add an amino acid fusion moiety to the peptide backbone. For example, hexa-histidine can be added to the protein for purification by immobilized metal ion affinity chromatography (Hochuli, E. et al., (1988) *Bio/Technology*, 6:1321–1325). In addition, to facilitate isolation of peptides free of irrelevant sequences, specific endoprotease cleavage sites can be introduced between the sequences of the fusion moiety and the peptide.

To potentially aid proper antigen processing of epitopes within an S. pneumoniae polypeptide, canonical protease sensitive sites can be engineered between regions, each comprising at least one epitope via recombinant or synthetic methods. For example, charged amino acid pairs, such as KK or RR, can be introduced between regions within a protein or fragment during recombinant construction thereof. The resulting peptide can be rendered sensitive to cleavage by cathepsin and/or other trypsin-like enzymes which would generate portions of the protein containing one or more epitopes. In addition, such charged amino acid residues can result in an increase in the solubility of the peptide.

Primary Methods for Screening Polypeptides and Analogs

Various techniques are known in the art for screening generated mutant gene products. Techniques for screening large gene libraries often include cloning the gene library into replicable expression vectors, transforming appropriate cells with the resulting library of vectors, and expressing the genes under conditions in which detection of a desired activity, e.g., in this case, binding to S. pneumoniae polypeptide or an interacting protein, facilitates relatively easy isolation of the vector encoding the gene whose product was detected. Each of the techniques described below is amenable to high through-put analysis for screening large numbers of sequences created, e.g., by random mutagenesis techniques.

Two Hybrid Systems

Two hybrid assays such as the system described above (as with the other screening methods described herein), can be used to identify polypeptides, e.g., fragments or analogs of a naturally-occurring S. pneumoniae polypeptide, e.g., of cellular proteins, or of randomly generated polypeptides which bind to an S. pneumoniae protein. (The S. pneumoniae domain is used as the bait protein and the library of variants are expressed as prey fusion proteins.) In an analogous fashion, a two hybrid assay (as with the other screening methods described herein), can be used to find polypeptides which bind a S. pneumoniae polypeptide.

Display Libraries

In one approach to screening assays, the candidate peptides are displayed on the surface of a cell or viral particle, and the ability of particular cells or viral particles to bind an appropriate receptor protein via the displayed product is detected in a "panning assay". For example, the gene library can be cloned into the gene for a surface membrane protein of a bacterialb cell, and the resulting fusion protein detected by panning (Ladner et al., WO 88/06630; Fuchs et al. (1991) *Bio/Technology* 9:1370–1371; and Goward et al. (1992) *TIBS* 18:136–140). In a similar fashion, a detectably labeled ligand can be used to score for potentially functional peptide homologs. Fluorescently labeled ligands, e.g., receptors, can be used to detect homologs which retain ligand-binding activity. The use of fluorescently labeled ligands, allows cells to be visually inspected and separated under a fluorescence microscope, or, where the morphology of the cell permits, to be separated by a fluorescence-activated cell sorter.

A gene library can be expressed as a fusion protein on the surface of a viral particle. For instance, in the filamentous phage system, foreign peptide sequences can be expressed on the surface of infectious phage, thereby conferring two significant benefits. First, since these phage can be applied to affinity matrices at concentrations well over $10^{13}$ phage per milliliter, a large number of phage can be screened at one time. Second, since each infectious phage displays a gene product on its surface, if a particular phage is recovered from an affinity matrix in low yield, the phage can be amplified by another round of infection. The group of almost identical E. coli filamentous phages M13, fd., and f1 are most often used in phage display libraries. Either of the phage gIII or gVIII coat proteins can be used to generate fusion proteins without disrupting the ultimate packaging of the viral particle. Foreign epitopes can be expressed at the $NH_2$-terminal end of pIII and phage bearing such epitopes recovered from a large excess of phage lacking this epitope (Ladner et al. PCT publication WO 90/02909; Garrard et al., PCT publication WO 92/09690; Marks et al. (1992) *J. Biol. Chem.* 267:16007–16010; Griffiths et al. (1993) *EMBO J* 12:725–734; Clackson et al. (1991) *Nature* 352:624–628; and Barbas et al. (1992) *PNAS* 89:4457–4461).

A common approach uses the maltose receptor of *E. coli* (the outer membrane protein, LamB) as a peptide fusion partner (Charbit et al. (1986) *EMBO* 5, 3029–3037). Oligonucleotides have been inserted into plasmids encoding the LamB gene to produce peptides fused into one of the extracellular loops of the protein. These peptides are available for binding to ligands, e.g., to antibodies, and can elicit an immune response when the cells are administered to animals. Other cell surface proteins, e.g., OmpA (Schorr et al. (1991) *Vaccines* 91, pp. 387–392), PhoE (Agterberg, et al. (1990) *Gene* 88, 37–45), and PAL (Fuchs et al. (1991) *Bio/Tech* 9, 1369–1372), as well as large bacterial surface structures have served as vehicles for peptide display. Peptides can be fused to pilin, a protein which polymerizes to form the pilus-a conduit for interbacterial exchange of genetic information (Thiry et al. (1989) *Appl. Environ. Microbiol.* 55, 984–993). Because of its role in interacting with other cells, the pilus provides a useful support for the presentation of peptides to the extracellular environment. Another large surface structure used for peptide display is the bacterial motive organ, the flagellum. Fusion of peptides to the subunit protein flagellin offers a dense array of many peptide copies on the host cells (Kuwajima et al. (1988) *Bio/Tech.* 6, 1080–1083). Surface proteins of-other bacterial species have also served as peptide fusion partners. Examples include the Staphylococcus protein A and the outer membrane IgA protease of Neisseria (Hansson et al. (1992) *J. Bacteriol.* 174, 4239–4245 and Klauser et al. (1990) *EMBO J.* 9, 1991–1999).

In the filamentous phage systems and the LamB system described above, the physical link between the peptide and its encoding DNA occurs by the containment of the DNA within a particle (cell or phage) that carries the peptide on its surface. Capturing the peptide captures the particle and the DNA within. An alternative scheme uses the DNA-binding protein LacI to form a link between peptide and DNA (Cull et al. (1992) *PNAS USA* 89:1865–1869). This system uses a plasmid containing the LacI gene with an oligonucleotide cloning site at its 3'-end. Under the controlled induction by arabinose, a LacI-peptide fusion protein is produced. This fusion retains the natural ability of LacI to bind to a short DNA sequence known as LacO operator (LacO). By installing two copies of LacO on the expression plasmid, the LacI-peptide fusion binds tightly to the plasmid that encoded it. Because the plasmids in each cell contain only a single oligonucleotide sequence and each cell expresses only a single peptide sequence, the peptides become specifically and stably associated with the DNA sequence that directed its synthesis. The cells of the library are gently lysed and the peptide-DNA complexes are exposed to a matrix of immobilized receptor to recover the complexes containing active peptides. The associated plasmid DNA is then reintroduced into cells for amplification and DNA sequencing to determine the identity of the peptide ligands. As a demonstration of the practical utility of the method, a large random library of dodecapeptides was made and selected on a monoclonal antibody raised against the opioid peptide dynorphin B. A cohort of peptides was recovered, all related by a consensus sequence corresponding to a six-residue portion of dynorphin B. (Cull et al. (1992) *Proc. Natl. Acad. Sci. U.S.A.* 89–1869)

This scheme, sometimes referred to as peptides-on-plasmids, differs in two important ways from the phage display methods. First, the peptides are attached to the C-terminus of the fusion protein, resulting in the display of the library members as peptides having free carboxy termini. Both of the filamentous phage coat proteins, pill and pVIII, are anchored to the phage through their C-termini, and the guest peptides are placed into the outward-extending N-terminal domains. In some designs, the phage-displayed peptides are presented right at the amino terminus of the fusion protein. (Cwirla, et al. (1990) *Proc. Natl. Acad. Sci. U.S.A.* 87, 6378–6382) A second difference is the set of biological biases affecting the population of peptides actually present in the libraries. The LacI fusion molecules are confined to the cytoplasm of the host cells. The phage coat fusions are exposed briefly to the cytoplasm during translation but are rapidly secreted through the inner membrane into the periplasmic compartment, remaining anchored in the membrane by their C-terminal hydrophobic domains, with the N-termini, containing the peptides, protruding into the periplasm while awaiting assembly into phage particles. The peptides in the LacI and phage libraries may differ significantly as a result of their exposure to different proteolytic activities. The phage coat proteins require transport across the inner membrane and signal peptidase processing as a prelude to incorporation into phage. Certain peptides exert a deleterious effect on these processes and are underrepresented in the libraries (Gallop et al. (1994) *J. Med. Chem.* 37(9):1233–1251). These particular biases are not a factor in the LacI display system.

The number of small peptides available in recombinant random libraries is enormous. Libraries of $10^7$–$10^9$ independent clones are routinely prepared. Libraries as large as $10^{11}$ recombinants have been created, but this size approaches the practical limit for clone libraries. This limitation in library size occurs at the step of transforming the DNA containing randomized segments into the host bacterial cells. To circumvent this limitation, an in vitro system based on the display of nascent peptides in polysome complexes has recently been developed. This display library method has the potential of producing libraries 3–6 orders of magnitude larger than the currently available phage/phagemid or plasmid libraries. Furthermore, the construction of the libraries, expression of the peptides, and screening, is done in an entirely cell-free format.

In one application of this method (Gallop et al. (1994) *J. Med. Chem.* 37(9):1233–1251), a molecular DNA library encoding $10^{12}$ decapeptides was constructed and the library expressed in an *E. coli* S30 in vitro coupled transcription/translation system. Conditions were chosen to stall the ribosomes on the mRNA, causing the accumulation of a substantial proportion of the RNA in polysomes and yielding complexes containing nascent peptides still linked to their encoding RNA. The polysomes are sufficiently robust to be affinity purified on immobilized receptors in much the same way as the more conventional recombinant peptide display libraries are screened. RNA from the bound complexes is recovered, converted to cDNA, and amplified by PCR to produce a template for the next round of synthesis and screening. The polysome display method can be coupled to the phage display system. Following several rounds of screening, cDNA from the enriched pool of polysomes was cloned into a phagemid vector. This vector serves as both a peptide expression vector, displaying peptides fused to the coat proteins, and as a DNA sequencing vector for peptide identification. By expressing the polysome-derived peptides on phage, one can either continue the affinity selection procedure in this format or assay the peptides on individual clones for binding activity in a phage ELISA, or for binding specificity in a completion phage ELISA (Barret, et al. (1992) *Anal. Biochem* 204,357–364). To identify the sequences of the active peptides one sequences the DNA produced by the phagemid host.

Secondary Screening of Polypeptides and Analogs

The high through-put assays described above can be followed by secondary screens in order to identify further biological activities which will, e.g., allow one skilled in the art to differentiate agonists from antagonists. The type of a secondary screen used will depend on the desired activity that needs to be tested. For example, an assay can be developed in which the ability to inhibit an interaction between a protein of interest and its respective ligand can be used to identify antagonists from a group of peptide fragments isolated though one of the primary screens described above.

Therefore, methods for generating fragments and analogs and testing them for activity are known in the art. Once the core sequence of interest is identified, it is routine for one skilled in the art to obtain analogs and fragments.

Peptide Mimetics of *S. pneumoniae* Polypeptides

The invention also provides for reduction of the protein binding domains of the subject *S. pneumoniae* polypeptides to generate mimetics, e.g. peptide or non-peptide agents. The peptide mimetics are able to disrupt binding of a polypeptide to its counter ligand, e.g., in the case of an *S. pneumoniae* polypeptide binding to a naturally occurring ligand. The critical residues of a subject *S. pneumoniae* polypeptide which are involved in molecular recognition of a polypeptide can be determined and used to generate *S. pneumoniae*-derived peptidomimetics which competitively or noncompetitively inhibit binding of the *S. pneumoniae* polypeptide with an interacting polypeptide (see, for example, European patent applications EP-412,762A and EP-B31,080A).

For example, scanning mutagenesis can be used to map the amino acid residues of a particular *S. pneumoniae* polypeptide involved in binding an interacting polypeptide, peptidomimetic compounds (e.g. diazepine or isoquinoline derivatives) can be generated which mimic those residues in binding to an interacting polypeptide, and which therefore can inhibit binding of an *S. pneumoniae* polypeptide to an interacting polypeptide and thereby interfere with the function of *S. pneumoniae* polypeptide. For instance, non-hydrolyzable peptide analogs of such residues can be generated using benzodiazepine (e.g., see Freidinger et al. in *Peptides: Chemistry and Biology*, G. R. Marshall ed., ESCOM Publisher: Leiden, Netherlands, 1988), azepine (e.g., see Huffman et al. in *Peptides: Chemistry and Biology*, G. R. Marshall ed., ESCOM Publisher: Leiden, Netherlands, 1988), substituted gama lactam rings (Garvey et al. in *Peptides: Chemistry and Biology*, G. R. Marshall ed., ESCOM Publisher: Leiden, Netherlands, 1988), keto-methylene pseudopeptides (Ewenson et al. (1986) *J Med Chem* 29:295; and Ewenson et al. in *Peptides: Structure and Function* (Proceedings of the 9th American Peptide Symposium) Pierce Chemical Co. Rockland, Ill., 1985), b-turn dipeptide cores (Nagai et al. (1985) *Tetrahedron Lett* 26:647; and Sato et al. (1986) *J Chem Soc Perkin Trans* 1:1231), and b-aminoalcohols (Gordon et al. (1985) *Biochem Biophys Res Commun* 126:419; and et al. (1986) *Biochem Biophys Res Commun* 134:71).

Vaccine Formulations for *S. pneumoniae* Nucleic Acids and Polypeptides

This invention also features vaccine compositions for protection against infection by *S. pneumoniae* or for treatment of *S. pneumoniae* infection, a gram-negative spiral microaerophilic bacterium. In one embodiment, the vaccine compositions contain one or more immunogenic components such as a surface protein from *S. pneumoniae*, or portion thereof, and a pharmaceutically acceptable carrier. Nucleic acids within the scope of the invention are exemplified by the nucleic acids of the invention contained in the Sequence Listing which encode *S. pneumoniae* surface proteins. Any nucleic acid encoding an immunogenic *S. pneumoniae* protein, or portion thereof, which is capable of expression in a cell, can be used in the present invention. These vaccines have therapeutic and prophylactic utilities.

One aspect of the invention provides a vaccine composition for protection against infection by *S. pneumoniae* which contains at least one immunogenic fragment of an *S. pneumoniae* protein and a pharmaceutically acceptable carrier. Preferred fragments include peptides of at least about 10 amino acid residues in length, preferably about 10–20 amino acid residues in length, and more preferably about 12–16 amino acid residues in length.

Immunogenic components of the invention can be obtained, for example, by screening polypeptides recombinantly produced from the corresponding fragment of the nucleic acid encoding the full-length *S. pneumoniae* protein. In addition, fragments can be chemically synthesized using techniques known in the art such as conventional Merrifield solid phase f-Moc or t-Boc chemistry.

In one embodiment, immunogenic components are identified by the ability of the peptide to stimulate T cells. Peptides which stimulate T cells, as determined by, for example, T cell proliferation or cytokine secretion are defined herein as comprising at least one T cell epitope. T cell epitopes are believed to be involved in initiation and perpetuation of the immune response to the protein allergen which is responsible for the clinical symptoms of allergy. These T cell epitopes are thought to trigger early events at the level of the T helper cell by binding to an appropriate HLA molecule on the surface of an antigen presenting cell, thereby stimulating the T cell subpopulation with the relevant T cell receptor for the epitope. These events lead to T cell proliferation, lymphokine secretion, local inflammatory reactions, recruitment of additional immune cells to the site of antigen/T cell interaction, and activation of the B cell cascade, leading to the production of antibodies. A T cell epitope is the basic element, or smallest unit of recognition by a T cell receptor, where the epitope comprises amino acids essential to receptor recognition (e.g., approximately 6 or 7 amino acid residues). Amino acid sequences which mimic those of the T cell epitopes are within the scope of this invention.

Screening immunogenic components can be accomplished using one or more of several different assays. For example, in vitro, peptide T cell stimulatory activity is assayed by contacting a peptide known or suspected of being immunogenic with an antigen presenting cell which presents appropriate MHC molecules in a T cell culture. Presentation of an immunogenic *S. pneumoniae* peptide in association with appropriate MHC molecules to T cells in conjunction with the necessary co-stimulation has the effect of transmitting a signal to the T cell that induces the production of increased levels of cytokines, particularly of interleukin-2 and interleukin-4. The culture supernatant can be obtained and assayed for interleukin-2 or other known cytokines. For example, any one of several conventional assays for interleukin-2 can be employed, such as the assay described in *Proc. Natl. Acad. Sci USA*, 86: 1333 (1989) the pertinent portions of which are incorporated herein by reference. A kit for an assay for the production of interferon is also available from Genzyme Corporation (Cambridge, Mass.).

Alternatively, a common assay for T cell proliferation entails measuring tritiated thymidine incorporation. The proliferation of T cells can be measured in vitro by determining the amount of $^3$H-labeled thymidine incorporated into the replicating DNA of cultured cells. Therefore, the rate of DNA synthesis and, in turn, the rate of cell division can be quantified.

Vaccine compositions of the invention containing immunogenic components (e.g., *S. pneumoniae* polypeptide or fragment thereof or nucleic acid encoding an *S. pneumoniae* polypeptide or fragment thereof) preferably include a pharmaceutically acceptable carrier. The term "pharmaceutically acceptable carrier" refers to a carrier that does not cause an allergic reaction or other untoward effect in patients to whom it is administered. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise minor amounts of auxiliary substances such as wetting or emulsifying agents, preservatives or buffers, which enhance the shelf life or effectiveness of the antibody. For vaccines of the invention containing *S. pneumoniae* polypeptides, the polypeptide is co-administered with a suitable adjuvant.

It will be apparent to those of skill in the art that the therapeutically effective amount of DNA or protein of this invention will depend, inter alia, upon the administration schedule, the unit dose of antibody administered, whether the protein or DNA is administered in combination with other therapeutic agents, the immune status and health of the patient, and the therapeutic activity of the particular protein or DNA.

Vaccine compositions are conventionally administered parenterally, e.g., by injection, either subcutaneously or intramuscularly. Methods for intramuscular immunization are described by Wolff et al. (1990) *Science* 247: 1465–1468 and by Sedegah et al. (1994) *Immunology* 91: 9866–9870. Other modes of administration include oral and pulmonary formulations, suppositories, and transdermal applications. Oral immunization is preferred over parenteral methods for inducing protection against infection by *S. pneumoniae*. Cain et. al. (1993) *Vaccine* 11:637–642. Oral formulations include such normally employed excipients as, for example, pharmaceutical grades of mannitol, lactose, starch, magnesium stearate, sodium saccharine, cellulose, magnesium carbonate, and the like.

The vaccine compositions of the invention can include an adjuvant, including, but not limited to aluminum hydroxide; N-acetyl-muramyl-L-threonyl-D-isoglutamine (thr-MDP); N-acetyl-nor-muramyl-L-alanyl-D-isoglutamine (CGP 11637, referred to as nor-MDP); N-acetylmuramyl-L-alanyl-D-isoglutaminyl-L-alanine-2-(1'-2'-dipalmitoyl-sn-glycero-3-hydroxyphos-phoryloxy)-ethylamine (CGP 19835A, referred to a MTP-PE); RIBI, which contains three components from bacteria; monophosphoryl lipid A; trehalose dimycoloate; cell wall skeleton (MPL+TDM+CWS) in a 2% squalene/Tween 80 emulsion; and cholera toxin. Others which may be used are non-toxic derivatives of cholera toxin, including its B subunit, and/or conjugates or genetically engineered fusions of the *S. pneumoniae* polypeptide with cholera toxin or its B subunit, procholeragenoid, fungal polysaccharides, including schizophyllan, muramyl dipeptide, muramyl dipeptide derivatives, phorbol esters, labile toxin of *E. coli*, non-*S. pneumoniae* bacterial lysates, block polymers or saponins.

Other suitable delivery methods include biodegradable microcapsules or immuno-stimulating complexes (ISCOMs), cochleates, or liposomes, genetically engineered attenuated live vectors such as viruses or bacteria, and recombinant (chimeric) virus-like particles, e.g., bluetongue. The amount of adjuvant employed will depend on the type of adjuvant used. For example, when the mucosal adjuvant is cholera toxin, it is suitably used in an amount of 5 mg to 50 mg, for example 10 mg to 35 mg. When used in the form of microcapsules, the amount used will depend on the amount employed in the matrix of the microcapsule to achieve the desired dosage. The determination of this amount is within the skill of a person of ordinary skill in the art.

Carrier systems in humans may include enteric release capsules protecting the antigen from the acidic environment of the stomach, and including *S. pneumoniae* polypeptide in an insoluble form as fusion proteins. Suitable carriers for the vaccines of the invention are enteric coated capsules and polylactide-glycolide microspheres. Suitable diluents are 0.2 N NaHCO3 and/or saline.

Vaccines of the invention can be administered as a primary prophylactic agent in adults or in children, as a secondary prevention, after successful eradication of *S. pneumoniae* in an infected host, or as a therapeutic agent in the aim to induce an immune response in a susceptible host to prevent infection by *S. pneumoniae*. The vaccines of the invention are administered in amounts readily determined by persons of ordinary skill in the art. Thus, for adults a suitable dosage will be in the range of 10 mg to 10 g, preferably 10 mg to 100 mg. A suitable dosage for adults will also be in the range of 5 mg to 500 mg. Similar dosage ranges will be applicable for children. Those skilled in the art will recognize that the optimal dose may be more or less depending upon the patient's body weight, disease, the route of administration, and other factors. Those skilled in the art will also recognize that appropriate dosage levels can be obtained based on results with known oral vaccines such as, for example, a vaccine based on an *E. coli* lysate (6 mg dose daily up to total of 540 mg) and with an enterotoxigenic *E. coli* purified antigen (4 doses of 1 mg) (Schulman et al., *J. Urol.* 150:917–921 (1993); Boedecker et al., *American Gastroenterological Assoc.* 999: A-222 (1993)). The number of doses will depend upon the disease, the formulation, and efficacy data from clinical trials. Without intending any limitation as to the course of treatment, the treatment can be administered over 3 to 8 doses for a primary immunization schedule over 1 month (Boedeker, *American Gastroenterological Assoc.* 888:A-222 (1993)).

In a preferred embodiment, a vaccine composition of the invention can be based on a killed whole *E. coli* preparation with an immunogenic fragment of an *S. pneumoniae* protein of the invention expressed on its surface or it can be based on an *E. coli* lysate, wherein the killed *E. coli* acts as a carrier or an adjuvant.

It will be apparent to those skilled in the art that some of the vaccine compositions of the invention are useful only for preventing *S. pneumoniae* infection, some are useful only for treating *S. pneumoniae* infection, and some are useful for both preventing and treating *S. pneumoniae* infection. In a preferred embodiment, the vaccine composition of the invention provides protection against *S. pneumoniae* infection by stimulating humoral and/or cell-mediated immunity against *S. pneumoniae*. It should be understood that amelioration of any of the symptoms of *S. pneumoniae* infection is a desirable clinical goal, including a lessening of the dosage of medication used to treat S. pneumoniae-caused disease, or an increase in the production of antibodies in the serum or mucous of patients.

Antibodies Reactive with *S. pneumoniae* Polypeptides

The invention also includes antibodies specifically reactive with the subject S. pneumoniae polypeptide. Antiprotein/anti-peptide antisera or monoclonal antibodies can be made by standard protocols (See, for example, Antibodies: A Laboratory Manualed. by Harlow and Lane (Cold Spring Harbor Press: 1988)). A mammal such as a mouse, a hamster or rabbit can be immunized with an immunogenic form of the peptide. Techniques for conferring immunogenicity on a protein or peptide include conjugation to carriers or other techniques well known in the art. An immunogenic portion of the subject *S. pneumoniae* polypeptide can be administered in the presence of adjuvant. The progress of immunization can be monitored by detection of antibody titers in plasma or serum. Standard ELISA or other immunoassays can be used with the immunogen as antigen to assess the levels of antibodies.

In a preferred embodiment, the subject antibodies are immunospecific for antigenic determinants of the *S. pneumoniae* polypeptides of the invention, e.g. antigenic determinants of a polypeptide of the invention contained in the Sequence Listing, or a closely related human or non-human mammalian homolog (e.g., 90% homologous, more preferably at least 95% homologous). In yet a further preferred embodiment of the invention, the anti-*S. pneumoniae* antibodies do not substantially cross react (i.e., react specifically) with a protein which is for example, less than 80% percent homologous to a sequence of the invention contained in the Sequence Listing. By "not substantially cross react", it is meant that the antibody has a binding affinity for a non-homologous protein which is less than 10 percent, more preferably less than 5 percent, and even more preferably less than 1 percent, of the binding affinity for a protein of the invention contained in the Sequence Listing. In a most preferred embodiment, there is no cross-reactivity between bacterial and mammalian antigens.

The term antibody as used herein is intended to include fragments thereof which are also specifically reactive with *S. pneumoniae* polypeptides. Antibodies can be fragmented using conventional techniques and the fragments screened for utility in the same manner as described above for whole antibodies. For example, F(ab')$_2$ fragments can be generated by treating antibody with pepsin. The resulting F(ab')2 fragment can be treated to reduce disulfide bridges to produce Fab fragments. The antibody of the invention is further intended to include bispecific and chimeric molecules having an anti-*S. pneumoniae* portion.

Both monoclonal and polyclonal antibodies (Ab) directed against *S. pneumoniae* polypeptides or *S. pneumoniae* polypeptide variants, and antibody fragments such as Fab' and F(ab')$_2$, can be used to block the action of *S. pneumoniae* polypeptide and allow the study of the role of a particular *S. pneumoniae* polypeptide of the invention in aberrant or unwanted intracellular signaling, as well as the normal cellular function of the *S. pneumoniae* and by microinjection of anti-*S. pneumoniae* polypeptide antibodies of the present invention.

Antibodies which specifically bind *S. pneumoniae* epitopes can also be used in immunohistochemical staining of tissue samples in order to evaluate the abundance and pattern of expression of *S. pneumoniae* antigens. Anti *S. pneumoniae* polypeptide antibodies can be used diagnostically in immuno-precipitation and immuno-blotting to detect and evaluate *S. pneumoniae* levels in tissue or bodily fluid as part of a clinical testing procedure. Likewise, the ability to monitor *S. pneumoniae* polypeptide levels in an individual can allow determination of the efficacy of a given treatment regimen for an individual afflicted with such a disorder. The level of an *S. pneumoniae* polypeptide can be measured in cells found in bodily fluid, such as in urine samples or can be measured in tissue, such as produced by gastric biopsy. Diagnostic assays using anti-*S. pneumoniae* antibodies can include, for example, immunoassays designed to aid in early diagnosis of S. pneumonide infections. The present invention can also be used as a method of detecting antibodies contained in samples from individuals infected by this bacterium using specific *S. pneumoniae* antigens.

Another application of anti-*S. pneumoniae* polypeptide antibodies of the invention is in the immunological screening of cDNA libraries constructed in expression vectors such as lgt11, lgt18–23, lZAP, and lORF8. Messenger libraries of this type, having coding sequences inserted in the correct reading frame and orientation, can produce fusion proteins. For instance, lgt11 will produce fusion proteins whose amino termini consist of β-galactosidase amino acid sequences and whose carboxy termini consist of a foreign polypeptide. Antigenic epitopes of a subject *S. pneumoniae* polypeptide can then be detected with antibodies, as, for example, reacting nitrocellulose filters lifted from infected plates with anti-*S. pneumoniae* polypeptide antibodies. Phage, scored by this assay, can then be isolated from the infected plate. Thus, the presence of *S. pneumoniae* gene homologs can be detected and cloned from other species, and alternate isoforms (including splicing variants) can be detected and cloned.

Kits Containing Nucleic Acids, Polypeptides or Antibodies of the Invention

The nucleic acid, polypeptides and antibodies of the invention can be combined with other reagents and articles to form kits. Kits for diagnostic purposes typically comprise the nucleic acid, polypeptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose. Kits further can include instructions for use.

Drug Screening Assays Using *S. pneumoniae* Polypeptides

By making available purified and recombinant *S. pneumoniae* polypeptides, the present invention provides assays which can be used to screen for drugs which are either agonists or antagonists of the normal cellular function, in this case, of the subject *S. pneumoniae* polypeptides, or of their role in intracellular signaling. Such inhibitors or potentiators may be useful as new therapeutic agents to combat *S. pneumoniae* infections in humans. A variety of assay formats will suffice and, in light of the present inventions, will be comprehended by the skilled artisan.

In many drug screening programs which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or change in enzymatic properties of the molecular target. Accordingly, in an exemplary screening assay of the present invention, the compound of interest is contacted with an isolated and purified *S. pneumoniae* polypeptide.

Screening assays can be constructed in vitro with a purified *S. pneumoniae* polypeptide or fragment thereof, such as an *S. pneumoniae* polypeptide having enzymatic activity, such that the activity of the polypeptide produces a detectable reaction product. The efficacy of the compound can be assessed by generating dose response curves from data obtained using various concentrations of the test compound. Moreover, a control assay can also be performed to provide a baseline for comparison. Suitable products include those with distinctive absorption, fluorescence, or chemiluminescence properties, for example, because detection may be easily automated. A variety of synthetic or naturally occurring compounds can be tested in the assay to identify those which inhibit or potentiate the activity of the *S. pneumoniae* polypeptide. Some of these active compounds may directly, or with chemical alterations to promote membrane permeability or solubility, also inhibit or potentiate the same activity (e.g., enzymatic activity) in whole, live *S. pneumoniae* cells.

Overexpression Assays

Overexpression assays are based on the premise that overproduction of a protein would lead to a higher level of resistance to compounds that selectively interfere with the function of that protein. Overexpression assays may be used to identify compounds that interfere with the function of virtually any type of protein, including without limitation enzymes, receptors, DNA- or RNA-binding proteins, or any proteins that are directly or indirectly involved in regulating cell growth.

Typically, two bacterial strains are constructed. One contains a single copy of the gene of interest, and a second contains several copies of the same gene. Identification of useful inhibitory compounds of this type of assay is based on a comparison of the activity of a test compound in inhibiting growth and/or viability of the two strains. The method involves constructing a nucleic acid vector that directs high level expression of a particular target nucleic acid. The vectors are then transformed into host cells in single or multiple copies to produce strains that express low to moderate and high levels of protein encoding by the target sequence (strain A and B, respectively). Nucleic acid comprising sequences encoding the target gene can, of course, be directly integrated into the host cell.

Large numbers of compounds (or crude substances which may contain active compounds) are screened for their effect on the growth of the two strains. Agents which interfere with an unrelated target equally inhibit the growth of both strains. Agents which interfere with the function of the target at high concentration should inhibit the growth of both strains. It should be possible, however, to titrate out the inhibitory effect of the compound in the overexpressing strain. That is, if the compound is affecting the particular target that is being tested, it should be possible to inhibit the growth of strain A at a concentration of the compound that allows strain B to grow.

Alternatively, a bacterial strain is constructed that contains the gene of interest under the control of an inducible promoter. Identification of useful inhibitory agents using this type of assay is based on a comparison of the activity of a test compound in inhibiting growth and/or viability of this strain under both inducing and non-inducing conditions. The method involves constructing a nucleic acid vector that directs high-level expression of a particular target nucleic acid. The vector is then transformed into host cells that are grown under both non-inducing and inducing conditions (conditions A and B, respectively).

Large numbers of compounds (or crude substances which may contain active compounds) are screened for their effect on growth under these two conditions. Agents that interfere with the function of the target should inhibit growth under both conditions. It should be possible, however, to titrate out the inhibitory effect of the compound in the overexpressing strain. That is, if the compound is affecting the particular target that is being tested, it should be possible to inhibit growth under condition A at a concentration that allows the strain to grow under condition B.

Lipand-binding Assays

Many of the targets according to the invention have functions that have not yet been identified. Ligand-binding assays are useful to identify inhibitor compounds that interfere with the function of a particular target, even when that function is unknown. These assays are designed to detect binding of test compounds to particular targets. The detection may involve direct measurement of binding. Alternatively, indirect indications of binding may involve stabilization of protein structure or disruption of a biological function. Non-limiting examples of useful ligand-binding assays are detailed below.

A useful method for the detection and isolation of binding proteins is the Biomolecular Interaction Assay (BIAcore) system developed by Pharmacia Biosensor and described in the manufacturer's protocol (LKB Pharmacia, Sweden). The BIAcore system uses an affinity purified anti-GST antibody to immobilize GST-fusion proteins onto a sensor chip. The sensor utilizes surface plasmon resonance which is an optical phenomenon that detects changes in refractive indices. In accordance with the practice of the invention, a protein of interest is coated onto a chip and test compounds are passed over the chip. Binding is detected by a change in the refractive index (surface plasmon resonance).

A different type of ligand-binding assay involves scintillation proximity assays (SPA, described in U.S. Pat. No. 4,568,649).

Another type of ligand binding assay, also undergoing development, is based on the fact that proteins containing mitochondrial targeting signals are imported into isolated mitochondria in vitro (Hurt et al., 1985, *Embo J.* 4:2061–2068; Eilers and Schatz, *Nature*, 1986, 322:228–231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

Another ligand-binding assay is the yeast two-hybrid system (Fields and Song, 1989, *Nature* 340:245–246). The yeast two-hybrid system takes advantage of the properties of the GAL4 protein of the yeast *Saccharomyces cerevisiae*. The GAL4 protein is a transcriptional activator required for the expression of genes encoding enzymes of galactose utilization. This protein consists of two separable and functionally essential domains: an N-terminal domain which binds to specific DNA sequences ($UAS_G$); and a C-terminal domain containing acidic regions, which is necessary to activate transcription. The native GAL4 protein, containing both domains, is a potent activator of transcription when yeast are grown on galactose media. The N-terminal domain binds to DNA in a sequence-specific manner but is unable to activate transcription. The C-terminal domain contains the activating regions but cannot activate transcription because it fails to be localized to $UAS_G$. In the two-hybrid system, a system of two hybrid proteins containing parts of GAL4: (1) a GAL4 DNA-binding domain fused to a protein 'X' and (2) a GAL4 activation region fused to a protein 'Y'. If X and Y can form a protein-protein complex and reconstitute proximity of the GAL4 domains, transcription of a gene regulated by UASG occurs. Creation of two hybrid proteins, each containing one of the interacting proteins X and Y, allows the activation region of $UAS_G$ to be brought to its normal site of action.

The binding assay described in Fodor et al., 1991, *Science* 251:767–773, which involves testing the binding affinity of test compounds for a plurality of defined polymers synthesized on a solid substrate, may also be useful.

Compounds which bind to the polypeptides of the invention are potentially useful as antibacterial agents for use in therapeutic compositions.

Pharmaceutical formulations suitable for antibacterial therapy comprise the antibacterial agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The antibacterial compositions include an antibacterial effective amount of active agent. Antibacterial effective amounts are those quantities of the antibacterial agents of the present invention that afford prophylactic protection against bacterial infections or which result in amelioration or cure of an existing bacterial infection. This antibacterial effective amount will depend upon the agent, the location and nature of the infection, and the particular host. The amount can be determined by experimentation known in the art, such as by establishing a matrix of dosages and frequencies and comparing a group of experimental units or subjects to each point in the matrix.

The antibacterial active agents or compositions can be formed into dosage unit forms, such as for example, creams, ointments, lotions, powders, liquids, tablets, capsules, suppositories, sprays, aerosols or the like. If the antibacterial composition is formulated into a dosage unit form, the dosage unit form may contain an antibacterial effective amount of active agent. Alternatively, the dosage unit form may include less than such an amount if multiple dosage unit forms or multiple dosages are to be used to administer a total dosage of the active agent. Dosage unit forms can include, in addition, one or more excipient(s), diluent(s), disintegrant (s), lubricant(s), plasticizer(s), colorant(s), dosage vehicle (s), absorption enhancer(s), stabilizer(s), bactericide(s), or the like.

For general information concerning formulations, see, e.g., Gilman et al. (eds.), 1990, *Goodman and Gilman's: The Pharmacological Basis of Therapeutics*, 8th ed., ergamon Press; and *Remington's Pharmaceutical Sciences*, 17th ed., 1990, Mack publishing Co., Easton, Pa.; Avis et al. (eds.), 1993, *Pharmaceutical Dosage Forms: parenteral Medications*, Dekker, New York; Liebermnan et al (eds.), 1990, *Pharmaceutical osage Forms: Disperse Systems*, Dekker, New York.

The antibacterial agents and compositions of the present invention are useful for reventing or treating *S. pneumoniae* infections. Infection prevention methods incorporate a prophylactically effective amount of an antibacterial agent or composition. A prophylactically effective amount is an amount effective to prevent *S. pneumoniae* infection and will depend upon the specific bacterial strain, the agent, and the host. These amounts can be determined experimentally by methods known in the art and as described above.

*S. pneumoniae* infection treatment methods incorporate a therapeutically effective amount of an antibacterial agent or composition. A therapeutically effective amount is an amount sufficient to ameliorate or eliminate the infection. The prophylactically and/or therapeutically effective amounts can be administered in one administration or over repeated administrations. Therapeutic administration can be followed by prophylactic administration, once the initial bacterial infection has been resolved.

The antibacterial agents and compositions can be administered topically or systemically. Topical application is typically achieved by administration of creams, ointments, lotions, or sprays as described above. Systemic administration includes both oral and parental routes. Parental routes include, without limitation, subcutaneous, intramuscular, intraperitoneal, intravenous, transderrnal, inhalation and intranasal administration.

EXEMPLIFICATION

I. Cloning and Sequencing of *S. pneumoniae* DNA

*S. pneumoniae* chromosomal DNA was isolated according to a basic DNA protocol outlined in Schleif R. F. and Wensink P. C., Practical Methods in Molecular Biology, p.98, Springer-Verlag, NY., 1981, with minor modifications. Briefly, cells were pelleted, resuspended in TE (10 mM Tris, 1 mM EDTA, pH 7.6) and GES lysis buffer (5.1 M guanidium thiocyanate, 0. 1 M EDTA, pH 8.0, 0.5% N-laurylsarcosine) was added. Suspension was chilled and ammonium acetate (NH4Ac) was added to final concentration of 2.0 M. DNA was extracted, first with chloroform, then with phenol-chloroform, and reextracted with chloroform. DNA was precipitated with isopropanol, washed twice with 70% EtOH, dried and resuspended in TE.

Following isolation whole genomic *S. pneumoniae* DNA was nebulized (Bodenteich et al., Automated DNA Sequencing and Analysis (J. C. Venter, ed.), Academic Press, 1994) to a median size of 2000 bp. After nebulization, the DNA was concentrated and separated on a standard 1% agarose gel. Several fractions, corresponding to approximate sizes 1000–1500 bp, 1500–2000 bp, 2000–2500 bp, 2500–3000bp, were excised from the gel and purified by the GeneClean procedure (Bio101, Inc.).

The purified DNA fragments were then blunt-ended using T4 DNA polymerase. The healed DNA was then ligated to unique BstXI-linker adapters (5' GTCTTCACCACGGGG and 5' GTGGTGAAGAC in 100–1000 fold molar excess). These linkers are complimentary to the BstXI-cut pMPX vectors, while the overhang is not self-complimentary. Therefore, the linkers will not concatemerize nor will the cut-vector religate itself easily. The linker-adopted inserts were separated from the unincorporated linkers on a 1% agarose gel and purified using GeneClean. The linker-adopted inserts were then ligated to each of 20 pMPX vectors to construct a series of "shotgun" subclone libraries. Blunt ended vector was used for cloning into the PUC 19 vector. The vectors contain an out-of-frame lacZ gene at the cloning site which becomes in-frame in the event that an adapter-dimer is cloned, allowing these to be avoided by their blue-color.

All subsequent steps were based either on the multiplex DNA sequencing protocols outlined in Church G. M. and Kieffer-Higgins S., Science 240:185–188, 1988 or by AB1377 automated DNA sequencing methods. Only major modifications to the protocols are highlighted. Briefly, each of the 20 vectors was then transformed into DH5a competent cells (Gibco/BRL, DH5a transformation protocol). The libraries were assessed by plating onto antibiotic plates containing ampicillin, methicillin and IPTG/Xgal. The plates were incubated overnight at 37° C. Successful transformants were then used for plating of clones and pooling into the multiplex pools. The clones were picked and pooled into 40 ml growth medium cultures. The cultures were grown overnight at 37° C. DNA was purified using the Qiagen Midi-prep kits and Tip-100 columns (Qiagen, Inc.). In this manner, 100 mg of DNA was obtained per pool.

These purified DNA samples were then sequenced either using the multiplex DNA sequencing based on chemical degradation methods (Church G. M. and Kieffer-Higgins S., Science 240:185–188,1988) or by Sequithrem (Epicenter Technologies) dideoxy sequencing protocols or by ABI dye-terminator chemistry. For the multiplex portion the sequencing reactions were electrophoresed and transferred onto nylon membranes by direct transfer electrophoresis from 40 cm gels (Richterich P. and Church G. M., Methods in Enzymology 218:187–222, 1993). The DNA was covalently bound to the membranes by exposure to ultraviolet light, and hybridized with labeled oligonucleotides complimentary to tag sequences on the vectors (Church, supra). The nmembranes were washed to rinse off non-specifically bound probe, and exposed to X-ray film to visualize individual sequence ladders. After autoradiography, the hybridized probe was removed by incubation at 65° C., and the hybridization cycle repeated with another tag sequence until the membrane had been probed 41 times. Thus, each gel produced a large number of films, each containing new sequencing information. Whenever a new blot was processed, it was initially probed for an internal standard sequence added to each of the pools. Digital images of the films were generated using a laser-scanning densitometer (Molecular Dynamics, Sunnyvale, Calif.). The digitized images were processed on computer workstations (VaxStation 4000's) using the program REPLICA™ (Church et al., Automated DNA Sequencing and Analysis (J. C. Venter, ed.), Academic Press, 1994). Image processing included lane straightening, contrast adjustment to smooth out intensity differences, and resolution enhancement by iterative gaussian deconvolution. The sequences were then converted to an SCF format so that processing and assembly could proceed on UNIX machines. The ABI dye terminator sequence reads were run on ABI377 machines and the data was directly transferred to UNIX machinnes following lane tracking of the gels. All multiplex and ABI reads were assembled using PHRAP (P. Green, Abstracts of DOE Human Genome Program Contractor-Grantee Workshop V, Jan. 1996, p.157) with default parameters and not using quality scores. The initial assembly was done at 7fold coverage and yielded 511 contigs. Short read length fragments of 200 bp or less found on the ends of contigs facing in the appropriate direction were used to extendoff the end of the contigs. These reads were then resequenced with primers using ABI technology to give sequences with a read length of 500 or more bases. This allowed end extensions to be performed without ordering new primers. In addition, missing mates (sequences from clones that only gave one strand reads) were identified and sequenced with ABI technology to allow the identification of additional overlapping contigs.

End-sequencing of randomly picked genomic lambda was also performed. Sequencing on a both sides was done for all lambda sequences. The lambdalibrary backbone helped to verify the integrity of the assembly and allowed closure of some of the physical gaps.

To identify *S. pneumoniae* polypeptides the complete genomic sequence of *S. pneumoniae* were analyzed essentially as follows: First, all possible stop-to-stop pen reading frames (ORFs) greater than 180 nucleotides in all six reading frames were translated into amino acid sequences. Second, the identified ORFs were analyzed for homology to known (archeabacter, prokaryotic and eukaryotic) protein sequences. Third, the coding potential of non-homologous sequences were evaluated with the program GENEMARK™ (Borodovsky and Mclninch, 1993, Comp. Chem. 17:123).

Identification, Cloning and Expression of *S. pneumoniae* Nucleic Acids

Expression and purification of the *S. pneumoniae* polypeptides of the invention can be performed essentially as outlined below.

To facilitate the cloning, expression and purification of membrane and secreted proteins from *S. pneumoniae*, a gene expression system, such as the pET System (Novagen), for cloning and expression of recombinant proteins in *E. coli*, is selected. Also, a DNA sequence encoding a peptide tag, the His-Tag, is fused to the 3' end of DNA sequences of interest in order to facilitate purification of the recombinant protein products. The 3' end is selected for fusion in order to avoid alteration of any 5' terminal signalsequence.

PCR Amplification and Cloning of Nucleic Acids Containing ORF's Encoding Enzymes Nucleic acids chosen (for example, from the nucleic acids set forth in SEQ ID NO: 1–SEQ ID NO: 2603) for cloning from the 14453 strain of *S. pneumoniae* are prepared for amplification cloning by polymerase chain reaction (PCR). Synthetic oligonucleotide primers specific for the 51 and 31 ends of open reading frames (ORFs) are designed and purchased from GibcoBRL Life Technologies (Gaithersburg, MD, USA). All forward primers (specific for the 5+ end of the sequence) are designed to include an NcoI cloning site at the extreme 5' terminus. These primers are designed to permit initiation of protein translation at a methionine residue followed by a valine residue and the coding sequence for the remainder of the native *S. pneumoniae* DNA sequence. All reverse primers (specific for the 3' end of any *S. pneumoniae* ORF) include a EcoRI site at the extreme 5' terminus to permit cloning of each *S. pneumoniae* sequence into the reading frame of the pET-28b. The pET-28b vector provides sequence encoding an additional 20 carboxy-terminal amino acids including six histidine residues (at the extreme C-terminus), which comprise the His-Tag.

Genomic DNA prepared from strain 14453 of *S. pneumoniae* is used as the source of template DNA for PCR amplification reactions (Current Protocols in Molecular Biology, John Wiley and Sons, Inc., F. Ausubel et al., eds., 1994). To amplify a DNA sequence containing an *S. pneumoniae* ORF, genomic DNA (50 nanograms) is introduced into a reaction vial containing 2 mM $MgCl_2$, 1 micromolar synthetic oligonucleotide primers (forward and reverse primers) complementary to and flanking a defined *S. pneumoniae* ORF, 0.2 mM of each deoxynucleotide triphosphate; dATP, dGTP, dCTP, dTTP and 2.5 units of heat stable DNA polymerase (Amplitaq, Roche Molecular Systems, Inc., Branchburg, N.J., USA) in a final volume of 100 microliters.

Upon completion of thermal cycling reactions, each sample of amplified DNA is washed and purified using the Qiaquick Spin PCR purification kit (Qiagen, Gaithersburg, Md., USA). All amplified DNA samples are subjected to digestion with the restriction endonucleases, e.g., NcoI and EcoRI (New England BioLabs, Beverly, Mass., USA) (Current Protocols in Molecular Biology, John Wiley and Sons, Inc., F. Ausubel et al., eds., 1994). DNA samples are then subjected to electrophoresis on 1.0% NuSeive (FMC BioProducts, Rockland, Me. USA) agarose gels. DNA is visualized by exposure to ethidium bromide and long wave uv irradiation. DNA contained in slices isolated from the agarose gel is purified using the Bio 101 GeneClean Kit protocol (Bio-101 Vista, Calif., USA).

Cloning of *S. pneumoniae* Nucleic Acids into an Expression Vector

The pET-28b vector is prepared for cloning by digestion with endonucleases, e.g., NcoI and EcoRI (Current Protocols in Molecular Biology, John Wiley and Sons, Inc., F. Ausubel et al., eds., 1994). The pET-28a vector, which encodes a His-Tag that can be fused to the 5' end of an inserted gene, is prepared by digestion with appropriate restriction endonucleases.

Following digestion, DNA inserts are cloned (Current Protocols in Molecular Biology, John Wiley and Sons, Inc., F. Ausubel et al., eds., 1994) into the previously digested pET-28b expression vector. Products of the ligation reaction are then used to transform the BL21 strain of *E. coli* (Current Protocols in Molecular Biology, John Wiley and Sons, Inc., F. Ausubel et al., eds., 1994) as described below.

Transformation of Competent Bacteria with Recombinant Plasmids

Competent bacteria, *E coli* strain BL21 or *E. coli* strain BL12(DE3), are transformed with recombinant pET expression plasmids carrying the cloned *S. pneumoniae* sequences according to standard methods (Current Protocols in Molecular, John Wiley and Sons, Inc., F. Ausubel et al., eds., 1994). Briefly, 1 microliter of ligation reaction is mixed with 50 microliters of electrocompetent cells and subjected to a high voltage pulse, after which, samples are incubated in 0.45 milliliters SOC medium (0.5% yeast extract, 2.0% tryptone, 10 mM NaCl, 2.5 mM KCl, 10 mM MgCl2, 10 mM MgSO4 and 20, mM glucose) at 37° C. with shaking for 1 hour. Samples are then spread on LB agar plates containing 25 microgram/ml kanamycin sulfate for growth overnight. Transformed colonies of BL21 are then picked and analyzed to evaluate cloned inserts as described below.

Identification Of Recombinant Expression Vectors with *S. pneumoniae* Nucleic Acids Individual BL21 clones transformed with recombinant pET-28b *S. pneumoniae* ORFs are analyzed by PCR amplification of the cloned inserts using the same forward and reverse primers, specific for each *S. pneumoniae* sequence, that were used in the original PCR amplification cloning reactions. Successful amplification verifies the integration of the *S. pneumoniae* sequences in the expression vector (Current Protocols in Molecular Biology, John Wiley and Sons, Inc., F. Ausubel et al., eds., 1994).

Isolation and Preparation of Nucleic Acids from Transformants

Individual clones of recombinant pET-28b vectors carrying properly cloned *S. pneumoniae* ORFs are picked and incubated in 5 mls of LB broth plus 25 microgram/ml kanamycin sulfate overnight. The following day plasmid DNA is isolated and purified using the Qiagen plasmid purification protocol (Qiagen Inc., Chatsworth, Calif., USA).

Expression Of Recombinant *S. pneumoniae* Sequences In *E. coli*

The pET vector can be propagated in any *E. coli* K-12 strain e.g. HMS174, HB101, JM109, DH5, etc. for the purpose of cloning or plasmid preparation. Hosts for expression include *E. coli* strains containing a chromosomal copy of the gene for T7 RNA polymerase. These hosts are lysogens of bacteriophage DE3, a lambda derivative that carries the lacI gene, the lacUV5 promoter and the gene for T7 RNA polymerase. T7 RNA polymerase is induced by addition of isopropyl-B-D-thiogalactoside (IPTG), and the T7 RNA polymerase transcribes any target plasmid, such as pET-28b, carrying its gene of interest. Strains used include: BL21(DE3) (Studier, F. W., Rosenberg, A. H., Dunn, J. J., and Dubendorff, J. W. (1990) Meth. Enzymol. 185, 60–89).

To express recombinant *S. pneumoniae* sequences, 50 nanograms of plasmid DNA isolated as described above is used to transform competent BL21(DE3) bacteria as described above (provided by Novagen as part of the pET expression system kit). The lacZ gene (beta-galactosidase) is expressed in the pET-System as described for the *S. neumoniae* recombinant constructions. Transformed cells are cultured in SOC medium for 1 hour, and the culture is then plated on LB plates containing 25 micrograms/ml kanamycin sulfate. The following day, bacterial colonies are pooled and grown in LB medium containing kanamycin sulfate (25 micrograms/ml) to an optical density at 600 nM of 0.5 to 1.0 O. D. units, at which point, 1 millimolar IPTG was added to the culture for 3 hours to induce gene expression of the *S. pneumoniae* recombinant DNA constructions .

After induction of gene expression with IPTG, bacteria are pelleted by centrifugation in a Sorvall RC-3B centrifuge at 3500×g for 15 minutes at 4° C. Pellets are resuspended in 50 milliliters of cold 10 mM Tris-HCl, pH 8.0, 0.1 M NaCl and 0.1 mM EDTA (STE buffer). Cells are then centrifuged at 2000×g for 20 min at 4° C. Wet pellets are weighed and frozen at −80° C. until ready for protein purification.

A variety of methodologies known in the art can be utilized to purify the isolated proteins. (Current Protocols in Protein Science, John Wiley and Sons, Inc., J. E. Coligan et al., eds., 1995). For example, the frozen cells may be thawed, resupended in buffer and ruptured by several passages through a small volume microfluidizer (Model M-110S, Microfluidics International Corporation, Newton, Mass.). The resultant homogenate may be centrifuged to yield a clear supernatant (crude extract) and following filtration the crude extract may be fractionated over columns. Fractions may be monitored by absorbance at $0D_{280}$ nm. and peak fractions may analyzed by SDS-PAGE The concentrations of purified protein preparations may be quantified spectrophotometrically using absorbance coefficients calculated from amino acid content (Perkins, S. J. 1986 Eur. J. Biochem. 157, 169–180). Protein concentrations are also measured by the method of Bradford, M. M. (1976) Anal. Biochem. 72, 248–254, and Lowry, O. H., Rosebrough, N., Farr, A. L. & Randall, R. J. (1951) *J. Biol. Chem.* 193, pages 265–275, using bovine serum albumin as a standard.

SDS-polyacrylamide gels of various concentrations may be purchased from BioRad (Hercules, Calif., USA), and stained with Coomassie blue. Molecular weight markers may include rabbit skeletal muscle myosin (200 kDa), *E. coli* (-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

EQUIVALENTS

Those skilled in the art will recognize, or be able to ascertain using no more than routine experimentation, many equivalents to the specific embodiments and methods described herein. The specific embodiments described herein are offered by way of example only, and the invention is to limited only by the terms of the appended claims, along with the full scope of equivalents to which such claims are entitled.

TABLE 2

| Orf | NT Seq ID | AA Seq ID | NT Orf Length | AA Orf Length | Score | Probability | Description |
|---|---|---|---|---|---|---|---|
| 10000807_f1_4 | 1 | 2604 | 261 | 86 | 103 | 5.10E-05 | [ac:p46330] [gn:yxat:e3a] [or:bacillus subtilis] [de:hypothetical 44.3 kd protein in gntr-htpg intergenic region] [sp:p46330] [db:swissprot] |
| 10005340_f1_3 | 2 | 2605 | 309 | 102 | 115 | 1.20E-06 | [ln:vfu65015] [ac:u65015] [pn:pts permease for mannose subunit iipman] [gn:many] [or:vibrio furnissii] [db:genpept-bct] [de:vibrio furnissii pts permease for mannose subunits iipman cterminal domain (manx). iipman (many), iibman (manz), and iii mann-termin |
| 10015950_c2_69 | 3 | 2606 | 192 | 63 | 74 | 0.027 | [ln:cele4208] [ac:u56966] [gn:c4208.4] [or:caenorhabditis elegans] [sr:caenorhabditis elegans strain=bristol n2] [db:genpept-inv] [de:caenorhabditis elegans cosmid c42d8.] [nt:contains strong similarity to ets domains] [le:830:943:1105:2314] [re:895:1052: |
| 10031875_f2_12 | 4 | 2607 | 903 | 300 | 570 | 2.30E-55 | [ln:lcact] [ac:z80834] [pn:lact] [gn:lact] [fn:antiterminator protein] [or:lactobacillus casei] [db:genpept-bct] [de:l.casei lact gene.]-[re:498] [re:1376] [di:direct] |
| 10032760_f2_22 | 5 | 2608 | 696 | 231 | 400 | 2.40E-37 | [ac:p35159] [gn:ypul] [or:bacillus subtilis] [de:hypothetical 26.0 kd protein in spmb-aroc intergenic region (orfx13)] [sp:p35159] [db:swissprot] |
| 10032760_f3_36 | 6 | 2609 | 510 | 169 | 307 | 1.70E-27 | [ac:p36088] [gn:yk1069w:yk1340] [or:saccharomyces cerevisiae] [sr:baker's yeast] [de:hypothetical 19.7 kd protein in lhs1-nup100 intergenic region] [sp:p36088] [db:swissprot] |
| 10035337_f1_1 | 7 | 2610 | 276 | 91 | 105 | 6.10E-06 | [ac:p69844] [pn:hypothetical protein yjbk] [gn:yjbk] [or:bacillus subtilis] [db:pir] |
| 10039713_f3_16 | 8 | 2611 | 369 | 122 | 347 | 9.90E-32 | [ac:p33138] [gn:clpx:lopc] [or:escherichia coli] [de:atp-dependent clp protease atp-binding subunit clpx] [sp:p33138] [db:swissprot] |
| 10042337_f1_1 | 9 | 2612 | 924 | 307 | 559 | 3.40E-54 | [ac:p69998] [pn:hypothetical protein ytoi] [gn:ytoi] [or:bacillus subtilis] [db:pir] |
| 10042937_f1_5 | 10 | 2613 | 432 | 143 | 98 | 0.0028 | [ac:p33322] [gn:cbf5:ylr175w:19470.11] [or:saccharomyces cerevisiae] [sr:;baker's yeast] [de:centromere/microtubule binding protein cbf5 (p64")] [sp:p33322] |
| 10049155_c1_28 | 11 | 2614 | 330 | 109 | 65 | 0.073 | [ac:d69309] [pn:conserved hypothetical protein af0476] [or:archaeoglobus fulgidus] [db:pir] |
| 10049155_c2_27 | 12 | 2615 | 330 | 109 | 65 | 0.073 | [ac:d69309] [pn:conserved hypothetical protein af0476] [or:archaeoglobus fulgidus] [db:pir] |
| 10049155_c3_36 | 13 | 2616 | 330 | 109 | 65 | 0.073 | [ac:d69309] [pn:conserved hypothetical protein af0476] [or:archaeoglobus fulgidus] [db:pir] |
| 10049155_c3_53 | 14 | 2617 | 330 | 109 | 65 | 0.073 | [ac:d69309] [pn:conserved hypothetical protein af0476] [or:archaeoglobus fulgidus] [db:pir] |
| 10054818_f3_9 | 15 | 2618 | 1533 | 510 | 2538 | 6.60E-264 | [ac:p18793] [gn:amic] [or:streptococcus pneumoniae] [de:oligopeptide transport permease protein amic] [sp:p18793] [db:swissprot] |
| 10055437_f3_1 | 16 | 2619 | 1080 | 359 | 131 | 6.10E-06 | [ln:u00796] [ac:u00796] [pn:g5 orf] [or:dictyostelium discoideum] [db:genpept-pln] [de:dictyostelium discoideum plasmid ddp1 d2 orf, d1 orf, g6 orf, g5orf, g1 orf, and g2 orfs, complete cds.] [le:8256:9040] [re:8980:9292] [di:complementjoin] |
| 10156277_f1_15 | 17 | 2620 | 264 | 87 | 70 | 0.024 | [ln:scdnch2] [ac:x79489] [pn:f-131 protein] [gn:yb10831] [or:saccharomyces cerevisiae] [sr:baker's yeast] [db:genpept-pln] [de:s.cerevisiae genomic dna, chromosome ii from y element to ils1gene.] [le:35515] [re:35515] [di:complement] |
| 10172162_c3_24 | 18 | 2621 | 213 | 70 | 91 | 0.00035 | [ac:p69844] [pn:gtp pyrophosphokinase homolog yjbm] [gn:yjbm] [or:bacillus subtilis] [db:pir] |
| 10187632_f1_2 | 19 | 2622 | 375 | 124 | 246 | 5.00E-21 | [ac:h69278] [pn:glutamine abc transporter, permease protein (glnp) homolog] [or:archaeoglobus fulgidus] [db:pir] |
| 10195200_f2_7 | 20 | 2623 | 996 | 331 | 1534 | 1.60E-157 | [ac:p18766] [gn:amif] [or:streptococcus pneumoniae] [de:oligopeptide transport atp-binding protein amif] [sp:p18766] [db:swissprot] |
| 10238201_c3_37 | 21 | 2624 | 309 | 102 | 186 | 3.20E-14 | [ac:p23861] [gn:potd] [or:escherichia coli] [de:spermidine/putrescine-binding periplasmic protein precursor(spbp)] [sp:p23861] [db:swissprot] |
| 10239000_c1_22 | 22 | 2625 | 201 | 66 | 70 | 0.092 | [ln:pfcomplrib] [ac:x95276] [gn:rps5] [or:plasmodium falciparum] [sr:malaria parasite] [db:genpept-inv] [de:p.falciparum complete gene map of plastid-like dna (ir-b).] |

TABLE 2-continued

| Orf | NT Seq ID | AA Seq ID | NT Orf Length | AA Orf Length | Score | Probability | Description |
|---|---|---|---|---|---|---|---|
| 10270313_c2_18 | 23 | 2626 | 390 | 129 | 333 | 3.00E-30 | [ie:6402] [re:7121] [di:direct] [ln:spu11799] [ac:u11799] [or:streptococcus pyogenes] [db:genpept-bct] [de:streptococcus pyogenes insertion sequence is1239 putaivetransposase gene, complete cds.] [nt:putative transposase] [le:379] [re:1359] [di:direct] |
| 10270313_c2_86 | 24 | 2627 | 1107 | 368 | 1143 | 4.40E-116 | [ln:spu11799] [ac:u11799] [or:streptococcus pyogenes] [db:genpept-bct] [de:streptococcus pyogenes insertion sequence is1239 putaivetransposase gene, complete cds.] [nt:putative transposase] [le:379] [re:1359] [di:direct] |
| 10270313_f1_6 | 25 | 2628 | 390 | 129 | 333 | 3.00E-30 | [ln:spu11799] [ac:u11799] [or:streptococcus pyogenes] [db:genpept-bct] [de:streptococcus pyogenes insertion sequence is 1239 putativetransposase gene, complete cds.] [nt:putative transposase] [le:379] [re:1359] [di:direct] |
| 10270313_f3_9 | 26 | 2629 | 456 | 151 | 419 | 2.30E-39 | [ln:spu11799] [ac:u11799] [or:streptococcus pyogenes] [db:genpept-bct] [de:streptococcus pyogenes insertion sequence is 1239 putativetransposase gene, complete cds.] [nt:putative transposase] [le:379] [re:1359] [di:direct] |
| 10275701_f1_3 | 27 | 2630 | 528 | 175 | 251 | 1.50E-21 | [ac:p17893] [gn:ahrc] [or:bacillus subtilis] [de:arginine hydroxamate resistance protein] [sp:p17893] [db:swissprot] |
| 10281883_f3_55 | 28 | 2631 | 234 | 77 | 62 | 0.0032 | [ac:b35136] [pn:hypothetical protein (endoglucanase 5' region)] [or:bacillus polymyxa] [db:pir] |
| 10290678_c3_83 | 29 | 2632 | 1788 | 595 | 1291 | 9.10E-132 | [ac:p17893] [pn:abc transporter (atp-binding protein) homolog yhei] [gn:yhei] [or:bacillus subtilis] [db:pir] |
| 103125l_f3_48 | 30 | 2633 | 309 | 102 | 70 | 0.72 | [ac:p08703] [gn:pcbcips] [or:penicillium chrysogenum] [de:isopenicillin n synthetase (ipns)] [sp:p08703] [db:swissprot] |
| 10318750_c1_35 | 31 | 2634 | 339 | 112 | 294 | 4.10E-26 | [ac:x72967] [or:streptococcus pneumoniae] [db:genpept-bct] [de:s.pneumoniae nana gene.] [nt:orf2] [le:193] [re:495] [di:direct] |
| 10329191_c2_30 | 32 | 2635 | 474 | 157 | 321 | 5.60E-29 | [ln:lpplsabkr] [ac:y15127] [pn:response regulator protein] [gn:plsr] [or:lactobacillus plantarum] [db:genpept-bct] [de:lactobacillus plantarum plsa, plsb, plsk & plsr genes.] [le:3837] [re:4598] [di:direct] |
| 103325_c2_22 | 33 | 2636 | 771 | 256 | 663 | 3.20E-65 | [ac:p41006] [gn:pyrp] [or:bacillus caldolyticus] [de:uracil permease (uracil transporter)] [sp:p41006] [db:swissprot] |
| 10350262_f3_26 | 34 | 2637 | 204 | 67 | 64 | 0.16 | [ac:e69073] [pn:nadp-reducing hydrogenase, subunit a] [gn:mth1548] [or:methanobacterium thermoautotrophicum] [db:pir] |
| 10350800_c2_103 | 35 | 2638 | 465 | 154 | 102 | 0.0013 | [ac:e69878] [pn:rna-binding sun protein homolog ylom] [gn:ylom] [or:bacillus subtilis] [db:pir] |
| 10351687_c1_48 | 36 | 2639 | 768 | 255 | 1130 | 1.10E-114 | [ac:s49544] [pn:response regulator] [cl:response regulator homology] [or:streptococcus pneumoniae] [db:pir] |
| 10353402_f2_8 | 37 | 2640 | 954 | 317 | 394 | 1.00E-36 | [ln:af015453] [ac:af015453] [pn:unknown] [or:lactobacillus rhamnosus] [db:genpept-bct] [de:lactobacillus rhamnosus 6-phospho-beta-glucosidase homolog gene,partial cds; gntr transcriptional regulator homolog and surfacelocated protein genes, complete cds.] |
| 10354500_c3_137 | 38 | 2641 | 198 | 65 | 164 | 2.50E-12 | [ln:shu75349] [ac:u75349] [pn:putative permease shie] [or:serpulina hyodysenteriae] [db:genpept-bct] [de:serpulina hyodysenteriae shi operon, periplasmic-iron-bindingproteins shia and shib, putative abc transporter shic, and putativepermeases shid and shi] |
| 1037580_c1_54 | 39 | 2642 | 1764 | 587 | 514 | 2.00E-49 | [ac:g70002] [pn:hypothetical protein ytwp] [gn:ytwp] [or:bacillus subtilis] [db:pir] |
| 10391450_f2_6 | 40 | 2643 | 273 | 90 | 83 | 0.00093 | [ln:ehy14328] [ac:y14328] [pn:3e1 protein] [or:entamoeba histolytica] [db:genpept-inv] [de:entamoeba histolytica mrna for 3e1 protein.] [le:32] [re:418] [di:direct] |
| 10391530_f1_2 | 41 | 2644 | 231 | 76 | 62 | 0.18 | [ln:ehy14328] [ac:y14328] [pn:3e1 protein] [or:entamoeba histolytica] [db:genpept-inv] [de:entamoeba histolytica mrna for 3e1 protein.] [le:32] [re:418] [di:direct] |
| 10398436_c2_56 | 42 | 2645 | 225 | 74 | 67 | 0.28 | [ac:ab003175] [pn:alternative oxidase] [gn:aox1c] [or:arabidopsis thaliana] [sr:arabidopsis thaliana (strain:columbia) 4.5-week-old leaves an] [db:genpept-pln] [de:arabidopsis thaliana dna for alternative oxidase (aox1c gene),complete cds.] |

TABLE 2-continued

| Orf | NT Seq ID | AA Seq ID | NT Orf Length | AA Orf Length | Score | Probability | Description |
|---|---|---|---|---|---|---|---|
| 10401931_f3_41 | 43 | 2646 | 1080 | 359 | 326 | 1.70E-29 | [ln:ae001169] [ac:ae001169:ae000783] [pn:mevalonate pyrophosphate decarboxylase] [gn:bb0686] [or:borrelia burgdorferi] [sr:lyme disease spirochete] [db:genpept-bct] [de:borrelia burgdorferi (section 55 of 70) of the complete genome.] [nt:similar to spp32 |
| 10429651_f1_10 | 44 | 2647 | 402 | 133 | 40 | 0.12 | [ac:p14073] [or:butyribacterium methylotrophicum] [de:ferredoxin] [sp:p14073] [db:swissprot] |
| 10431169_c1_15 | 45 | 2648 | 324 | 107 | 238 | 1.00E-19 | [ln:af044978] [ac:af044978] [pn:putative uracil permease] [gn:pyrp] [or:enterococcus faecalis] [db:genpept] [de:enterococcus faecalis pyr operon: attenuation regulatory protein(pyrr) and putative uracil permease (pyrp) genes, complete cds; andaspartate tr |
| 10442057_f1_12 | 46 | 2649 | 918 | 305 | 528 | 6.50E-51 | [ac:p37565] [gn:yacc] [or:bacillus subtilis] [de:hypothetical 31.8 kd protein in fish-cysk intergenic region] [sp:p37565] [db:swissprot] |
| 10443750_f2_2 | 47 | 2650 | 606 | 201 | 117 | 1.90E-05 | [ac:d69991] [pn:conserved hypothetical protein yteu] [gn:yteu] [or:bacillus subtilis] [db:pir] |
| 104557_c1_42 | 48 | 2651 | 924 | 307 | 1361 | 3.50E-139 | [ln:af036951] [ac:af036951] [pn:choline kinase] [gn:pck] [or:streptococcus pneumoniae] [db:genpept-bct] [de:streptococcus pneumoniae choline kinase (pck) gene, complete cds.] [nt:similar to lica, the choline kinase of haemophilus] [le:92] [re:880] |
| 1048537_f1_8 | 49 | 2652 | 318 | 105 | 202 | 2.30E-16 | [ac:a69881] [pn:conserved hypothetical protein ylua] [gn:ylua] [or:bacillus subtilis] [db:pir] |
| 1050911_c2_29 | 50 | 2653 | 234 | 77 | 66 | 0.3 | [ln:s82314] [ac:s82314] [pn:prm 3] [gn:prm 3] [or:zea mays] [sr:maize leaves cv. inra 258 mercuric chloride-treated] [db:genpept-pln] [de:prm 3=chitinase {clone chem 5} {zea mays=maize, cv. inra 258,mercuric chloride-treated, leaves, mrna partial, 945 nt] |
| 1053328_c2_13 | 51 | 2654 | 225 | 74 | 320 | 7.20E-29 | [ac:q03159] [gn:epua] [or:streptococcus pneumoniae] [de:epua protein] [sp:q03159] [db:swissprot] |
| 1048517_f1_1 | 52 | 2655 | 648 | 215 | 616 | 3.10E-60 | [ac:p50854] [gn:ribe:ribb] [or:actinobacillus pleuropneumoniae] [sr:haemophilus pleuropneumoniae] [ec:2.5.1.9] [de:riboflavin synthase alpha chain,] [sp:p50854] [db:swissprot] |
| 10549082_f1_2 | 53 | 2656 | 396 | 131 | 454 | 4.50E-43 | [ac:p23532] [gn:lacf] [or:lactococcus lactis] [sr:subsplactis:streptococcus lactis] [ec:2.7.1.69] [de:(ec 2.7.1.69) (eiii-lac)] [sp:p23532] [db:swissprot] |
| 10550837_f2_6 | 54 | 2657 | 546 | 181 | 359 | 5.30E-33 | [ac:p42904:p76669] [gn:agav] [or:escherichia coli] [ec:2.7.1.69] [de:enzyme ii, b component 2),] [sp:p42904:p76669] [db:swissprot] |
| 10552163_f3_20 | 55 | 2658 | 1413 | 470 | 65 | 0.58 | [ac:p34859] [gn:nd41] [or:apis mellifera] [sr:,honeybee] [ec:1.6.5.3] [de:nadh-ubiquinone oxidoreductase chain 41,] [sp:p34859] [db:swissprot] |
| 10554711_c3_51 | 56 | 2659 | 309 | 102 | 215 | 9.60E-18 | [ac:p32726] [gn:ylxs] [or:bacillus subtilis] [de:hypothetical 17.6 kd protein in nusa 5'region (p15a) (orf1)] [sp:p32726] [db:swissprot] |
| 10554712_f1_4 | 57 | 2660 | 372 | 123 | 62 | 0.17 | [ac:q32643] [gn:mtatp8:atp8] [or:capra hircus] [sr:,goat] [ec:3.6.1.34] [de:atp synthase protein 8, (a61)] [sp:q32643] [db:swissprot] |
| 10555417_f3_44 | 58 | 2661 | 228 | 75 | 196 | 1.50E-15 | [ac:p06653] [gn:lyta] [or:streptococcus pneumoniae] [ec:3.5.1.28] [de:hydrolase) (mucopeptide aminohydrolase) (cell wall hydrolase)] [sp:p06653] [db:swissprot] |
| 10558150_f3_10 | 59 | 2662 | 999 | 332 | 576 | 5.30E-56 | [ln:atceld] [ac:z77855] [pn:sugar-binding transport protein] [or:anaerocellum thermophilum] [db:genpept-bct] [de:a.thermophilum celd gene.] [nt:putative] [le:3925] [re:4836] [di:direct] |
| 10563175_f3_20 | 60 | 2663 | 921 | 306 | 1291 | 9.10E-132 | [ac:q04699] [gn:mald] [or:streptococcus pneumoniae] [de:maltodextrin transport system permease protein mald] [sp:q04699] [db:swissprot] |
| 10570200_f1_9 | 61 | 2664 | 1272 | 423 | 1336 | 1.60E-136 | [ac:f70019] [pn:nifs protein homolog homolog yurw] [gn:yurw] [or:bacillus subtilis] [db:pir] |
| 10572212_c3_25 | 62 | 2665 | 213 | 70 | 56 | 0.63 | [ac:p54806] [or:methanosarcina barkeri] [de:nitrogen fixation nifhd2 region glnb-like protein 2 (orf-125)] [sp:p54806] [db:swissprot] |
| 10578257_c2_16 | 63 | 2666 | 195 | 64 | 162 | 1.80E-11 | [ac:p17556] [or:bacillus sphaericus] [ec:1.4.1.1] [de:alanine dehydrogenase,] [sp:p17556] [db:swissprot] |

TABLE 2-continued

| Orf | NT Seq ID | AA Seq ID | NT Orf Length | AA Orf Length | Score | Probability | Description |
|---|---|---|---|---|---|---|---|
| 1057950_f1_4 | 64 | 2667 | 330 | 109 | 213 | 1.60E-17 | [ac:a64499] [pn:phosphoserine phosphatase,] [cl:phosphoserine phosphatase] [or:*methanococcus jannaschii*] [ec:3.1.3.3] [db:pir] [mp:for1565667-1566302] |
| 1059443l_f2_27 | 65 | 2668 | 267 | 88 | 80 | 0.026 | [ac:s16594] [pn:regulatory protein b-peru] [or:*zea mays*] [sr:, maize] [db:pir] |
| 1060233_f2_2 | 66 | 2669 | 609 | 202 | 91 | 0.044 | [ac:p37082] [gn:sora] [or:*klebsiella pneumoniae*] [de:permease iic component) (phosphotransferase enzyme ii, c component)] [sp:p37082] [db:swissprot] |
| 1060318_f2_8 | 67 | 2670 | 357 | 118 | 66 | 1 | [ln:ljrab11g] [ac:z73955] [pn:rab11] [gn:rab11g] [fn:gtp-binding protein] [or:*lotus japonicus*] [db:genpept-pln] [de:*l.japonicus* mrna for small gtp-binding protein, rab11g.] [le:83] [re:742] [di:direct] |
| 1060353_f2_6 | 68 | 2671 | 231 | 77 | 58 | 0.89 | [ac:p36278] [gn:v2] [or:tomato yellow leaf curl virus] [sr:australia,tylcv] [de:coat protein] [sp:p62278] [db:swissprot] |
| 1062530_c3_150 | 69 | 2672 | 294 | 97 | 90 | 0.0014 | [ln:af013583] [ac:af013583] [pn:putative o-antigen translocase] [gn:wzx] [or:*escherichia coli*] [db:genpept-bct] [de:*escherichia coli* putative o-antigen polymerase (wzy), putativeo-antigen translocase (wzx), putative glcnac transferase, and n andc |
| 1062530_c2_95 | 70 | 2673 | 216 | 71 | 55 | 0.58 | [ln:peu34351] [ac:u34351] [pn:glycoprotein a] [or:*pneumocystis carinii*] [db:genpept-pln] [de:*pneumocystis carinii* human isolate glycoprotein a gene, partialcds.] [nt:gpa] [le:<1] [re: |
| 1062630_c3_103 | 71 | 2674 | 315 | 104 | 47 | 1 | [ln:hivenv30a] [ac:121822] [pn:envelope glycoprotein] [gn:env] [or:human immunodeficiency virus type 1] [sr:human immunodeficiency virus type 1 (individual_isolate patient a] [db:genpept-vrl] [de:human immunodeficiency virus type 1 (30) envelope glycoprot |
| 1062652_c2_15 | 72 | 2675 | 405 | 134 | 250 | 1.90E-21 | [ac:q45399] [gn:cela] [or:*bacillus stearothermophilus*] [ec:2.7.1.69] [de(ec 2.7.1.69)] [sp:q45399] [db:swissprot] |
| 1063118_f3_7 | 73 | 2676 | 702 | 233 | 390 | 2.70E-36 | [ac:p54176] [or:*bacillus cereus*] [de:hemolysin iii (hly-iii)] [sp:p54176] [db:swissprot] |
| 1063271_c3_88 | 74 | 2677 | 453 | 150 | 114 | 150E-06 | [ln:sa1234] [ac:x97985] [or:*staphylococcus aureus*] [db:genpept-bct] [de:*s.aureus* orfs 1,2,3 & 4.] [nt:orf1] [le:537] [re:1304] [di:direct] |
| 1063508_f1_9 | 75 | 2678 | 843 | 280 | 479 | 1.00E-45 | [ac:g69597] [pn:phosphatidate cytidylyltransferase cdsa] [gn:cdsa] [or:*bacillus subtilis*] [db:pir] |
| 1064042_c2_28 | 76 | 2679 | 246 | 81 | 62 | 0.12 | [ln:cicos41] [ac:z83760] [or:*ciona intestinalis*] [db:genpept-inv] [de:*ciona intestinalis* dna sequence from cosmid cos41.] [nt:similar to dna excision repair protein] [le:5005] [re:7386] [di:direct] |
| 1064068l_c1_5O | 77 | 2680 | 420 | 139 | 71 | 0.5 | [ln:ehy14328] [ac:y14328] [pn:3e1 protein] [or:*entamoeba histolytica*] [db:genpept-inv] [de:*entamoeba histolytica* mrna for 3e1 protein.] [le:32] [re:418] [di:direct] |
| 1065020_f2_2 | 78 | 2681 | 507 | 169 | 594 | 6.60E-58 | [ac:q07636] [gn:pfka:pfk] [or:*lactococcus lactis*] [sr:,subsplactis:*streptococcus lactis* ec:2.7.1.11] [de:(phosphohexokinase)] [sp:p07636] [db:swissprot] |
| 1065713_c1_67 | 79 | 2682 | 552 | 183 | 153 | 1.20E-10 | [ac:p20665] [gn:piv] [or:*moraxella bovis*] [de:pilin gene inverting protein (pivml)] [sp:p20665] [db:swissprot] |
| 1066409_f2_21 | 80 | 2683 | 333 | 110 | 154 | 8.70E-111 | [ac:p39140] [gn:deor] [or:*bacillus subtilis*] [de:deoxyribonucleoside regulator] [sp:p39140] [db:swissprot] |
| 1068312_f3_35 | 81 | 2684 | 459 | 152 | 119 | 2.70E-06 | [ln:tnaf000605] [ac:af000605] [pn:insect intestinal mucin iim14] [or:trichoplusia ni] [sr:cabbage looper] [db:genpept-inv] [de:trichoplusia ni insect intestinal mucin iim14 mrna, complete cds.] [le:38] [re:2404] [di:direct] |
| 1070277_f2_33 | 82 | 2685 | 555 | 184 | 479 | 1.00E-45 | [ac:s62019] [pn:hypothetical protein ydr540c:hypothetical protein d3703.8] [or:*saccharomyces cerevisiae*] [db:pir] [mp:4r] |
| 1072138_c3_65 | 83 | 2686 | 1293 | 430 | 881 | 2.60E-88 | [ac:h69627] [pn:signal recognition particle ftsy] [gn:ftsy] [or:*bacillus subtilis*] [db:pir] |
| 1072885_c1_9 | 84 | 2687 | 381 | 126 | 210 | 3.30E-17 | [ac:p46319] [gn:celc] [or:*bacillus subtilis*] [ec:2.7.1.69] [de(ec 2.7.1.69) (eiii-cel)] [sp:p46319] [db:swissprot] |
| 1073766l_f3_14 | 85 | 2688 | 585 | 194 | 264 | 6.20E-23 | [ac:p42313] [gn:yxjb:n15l] [or:*bacillus subtilis*] [de:hypothetical 31.5 kd protein in katb 3'region] [sp:p42313] [db:swissprot] |
| 1073778_f1_47 | 86 | 2689 | 183 | 60 | 74 | 0.041 | [ln:celf3866] [ac:u40060] [gn:yxjb:n15l] [or:*caenorhabditis elegans*] [sr:*caenorhabditis* |

TABLE 2-continued

| Orf | NT Seq ID | AA Seq ID | NT Orf Length | AA Orf Length | Score | Probability | Description |
|---|---|---|---|---|---|---|---|
| 10738758_f3_26 | 87 | 2690 | 198 | 65 | 50 | 0.72 | elegans strain=bristol n2] [db:genpept-inv] [de:caenorhabditis elegans cosmid f38b6.] [ie:25381:26844:27050:27814] [re:25476:26998:27138:27926] [di:directjoin] [ln:cef49e11] [ac:z70308] [pn:f49e11.1] [or:caenorhabditis elegans] [db:genpept-inv] [de:caenorhabditis elegans cosmid f49e11, complete sequence.] [nt:similarity to s.pombe serine/threonine protein] [ie:3290:3550:4496:4868] [re:3338:3724:4811:5131] [di:di |
| 10740875_c2_18 | 88 | 2691 | 375 | 124 | 215 | 9.60E-18 | [ac:p25614] [gn:ycr13c] [or:saccharomyces cerevisiae] [sr:baker's yeast] [de:very hypothetical 22.8 kd protein in pgk1 region] [sp:p25614] [db:swissprot] |
| 10740937_f1_1 | 89 | 2692 | 330 | 109 | 69 | 0.028 | [ac:p37188] [gn:gatb] [or:escherichia coli] [ec:2.7.1.69] [de:(ec 2.7.1.69)] [sp:p37188] [db:swissprot] |
| 10740937_f2_2 | 90 | 2693 | 327 | 108 | 72 | 0.014 | [ac:p37188] [gn:gatb] [or:escherichia coli] [ec:2.7.1.69] [de:(ec 2.7.1.69)] [sp:p37188] [db:swissprot] |
| 10741542_c3_109 | 91 | 2694 | 252 | 83 | 63 | 0.3 | [ac:f64569] [pn:hypothetical protein hp0398] [or:helicobacter pylori] [db:pir] |
| 10744551_f3_7 | 92 | 2695 | 231 | 76 | 182 | 3.00E-14 | [ac:d69868] [pn:conserved hypothetical protein ykvm] [gn:ykvm] [or:bacillus subtilis] [db:pir] |
| 10745937_f3_29 | 93 | 2696 | 621 | 206 | 233 | 1.20E-19 | [ac:p96707] [gn:ydgi] [or:bacillus subtilis] [ec:1.-.-.-] [de:putative nad(p)h nitroreductase,] [sp:p96707] [db:swissprot] |
| 10761062_c1_10 | 94 | 2697 | 1620 | 539 | 2010 | 5.90E-208 | [ac:p13242] [gn:ctra] [or:bacillus subtilis] [ec:6.3.4.2] [de:ctp synthase, (utp-ammonia ligase) (ctp synthetase)] [sp:p13242] [db:swissprot] |
| 10804062_f2_6 | 95 | 2698 | 1107 | 368 | 766 | 3.90E-76 | [ac:p77212] [or:escherichia coli] [de:intergenic region] [sp:p77212] [db:swissprot] |
| 10817943_f2_4 | 96 | 2699 | 864 | 287 | 661 | 5.30E-65 | [ac:f70016] [pn:purine permease homolog yunk] [gn:yunk] [or:bacillus subtilis] [db:pir] |
| 10937882_f2_36 | 97 | 2700 | 2334 | 777 | 2200 | 4.30E-228 | [ac:p50849] [gn:pnpa:comr] [or:bacillus subtilis] [ec:2.7.7.8] [de:phosphorylase] (pnpase)] [sp:p50849] [db:swissprot] |
| 10939413_c3_87 | 98 | 2701 | 1074 | 357 | 396 | 6.30E-37 | [ac:a64433] [pn:spore coat polysaccharide biosynthesis protein c homolog] [cl:erythromycin resistance protein] [or:methanococcus jannaschii] [db:pir] |
| 10941387_c3_86 | 99 | 2702 | 510 | 169 | 94 | 0.013 | [ac:h64431] [pn:glycosyl transferase,] [or:methanococcus jannaschii] [ec:2.4.-.-] [db:pir] [mp:for996513–997385) |
| 10944035_f3_29 | 100 | 2703 | 399 | 132 | 246 | 5.00E-21 | [ln:soorfs] [ac:z79691] [pn:orfb] [gn:yorfb] [or:streptococcus pneumoniae] [db:genpept-bct] [de:s.pneumoniae yorf[a,b,c,d,e], fts1, pbpx and regr genes.] [ie:1914] [re:2372] [di:complement) |
| 10956442_c2_90 | 101 | 2704 | 519 | 172 | 139 | 3.80E-09 | [ln:llpfmg13] [ac:aj000325] [pn:putative membrane protein] [gn:orfa] [or:lactococcus lactis] [db:genpept-bct] [de:lactococcus lactis pfl gene (strain mg1363).] [ie:270] [re:1187] [di:direct] |
| 10964383_c1_11 | 102 | 2705 | 819 | 272 | 89 | 0.36 | [ac:p37963] [gn:spovid] [or:bacillus subtilis] [de:stage vi sporulation protein d] [sp:p37963] [db:swissprot] |
| 10969461_f3_2 | 103 | 2706 | 474 | 157 | 301 | 7.40E-27 | [ac:b53293] [pn:flm3 region hypothetical protein 2] [or:synechococcus sp.] [db:pir] |
| 10970338_c1_75 | 104 | 2707 | 294 | 97 | 76 | 0.031 | [ac:d87074] [gn:kiaa0237] [or:homo sapiens] [sr:homo sapiens male bone marrow myeloblast cell line:kg-1 cdna t] [db:genpept-pri2] [de:human mrna for kiaa0237 gene, complete cds.] [nt:similar to a e.elegans protein encoded in cosmid] [ie:476] |
| 10970968_c1_22 | 105 | 2708 | 1284 | 427 | 155 | 4.40E-08 | [ln:af017983] [ac:af017983] [pn:gamma-glutamylcysteine synthetase] [gn:gsh1] [or:lycopersicon esculentum] [sr:tomato] [db:genpept-pln] [de:lycopersicon esculentum gamma-glutamylcysteine synthetase (gsh1)mrna, complete cds.] [ie:239] [re:1810] [di:direct] |
| 10975167_c1_24 | 106 | 2709 | 717 | 238 | 677 | 1.10E-66 | [ac:p30294] [gn:ilvf:ilvg] [or:salmonella typhimurium] [de:ilvf(liv-i protein f)] [sp:p30294] [db:swissprot] |
| 10975292_f2_10 | 107 | 2710 | 750 | 249 | 299 | 1.20E-26 | [ln:syngip3124] [ac:m77279] [pn:alpha-amylase] [or:unidentified cloning vector] |

TABLE 2-continued

| Orf | NT Seq ID | AA Seq ID | NT Orf Length | AA Orf Length | Score | Probability | Description |
|---|---|---|---|---|---|---|---|
| 10976587_c1_52 | 108 | 2711 | 375 | 124 | 87 | 0.00052 | [sr:cloning vector (sub_species cloning vector pgip3124) dna] [db:genpept-syn] [de:cloning vector pgip3124 with inserted enterococcus faecalisalpha-amylase fusion protein gene [acp37471] [gn:divic/diva] [or:bacillus subtilis] [de:cell division protein divic] [sp:p37471] [db:swissprot] |
| 10977307_f2_34 | 109 | 2712 | 510 | 169 | 116 | 1.60E-O5 | [acp22560] [or:mus musculus] [sr;mouse] [de:ifn-response binding factor 1 (irebf-1)] [sp:p22560] [db:swissprot] |
| 10979678_f2_12 | 110 | 2713 | 357 | 118 | 268 | 2.30E-23 | [ac:f70009] [pn:conserved hypothetical protein yufq] [gn:yufq] [or:bacillus subtilis] [db:pir] |
| 10985215_f3_4 | 111 | 2714 | 1044 | 347 | 60 | 0.87 | [ln:pbu42580] [ac:u42580\u17055\u32570] [or:paramecium bursaria chlorella virus 1] [db:genpept-vrl] [de:paramecium bursaria chlorella virus 1, complete genome.] [le:204610] [re:204822] [di:complement] |
| 10991461_c3_85 | 112 | 2715 | 1131 | 376 | 853 | 2.40E-85 | [ln:lplargene] [ac:y08941] [pn:alanine racemase] [gn:alr] [or:actobacillus plantarum] [db:genpept-bct] [ec:5.1.1.1] [de:l.plantarum alr gene.] [le:226] [re:1353] [di:direct] |
| 10992127_c1_37 | 113 | 2716 | 375 | 124 | 63 | | [ac:s75993] [pn:hypothetical protein] [or:synechocystis sp. ] [sr:pcc 6803, pcc 6803] [sr:pcc 6803,] [db:pir] |
| 10995340_f3_3 | 114 | 2717 | 243 | 80 | 171 | 5.60E-12 | [acp22976] [gn:recp] [or:streptococcus pneumoniae] [ec:2.2.1.1] [de:probable transketolase, (tk)] [sp:p22976] [db:swissprot] |
| 11016376_f1_3 | 115 | 2718 | 996 | 331 | 586 | 4.70E-57 | [ac:b70032] [pn:conserved hypothetical protein yvcl] [gn:yvcl] [or:bacillus subtilis] [db:pir] |
| 11016576_f2_8 | 116 | 2719 | 1620 | 539 | 139 | 1.10E-08 | [ln:spnana] [ac:x72967] [or:streptococcus pneumoniae] [db:genpept-bct] [de:s.pneumonia nana gene.] [nt:orf2] [le:193] [re:495] [di:direct] |
| 11019406_f3_7 | 117 | 2720 | 243 | 80 | 65 | 0.076 | [ac:p38190] [gn:yb1053w;yb10514] [or:saccharomyces cerevisiae] [sr;baker's yeast] [de:very hypothetical 13.2 kd protein in ptc3-sas3 intergenic region] [sp:p38190] [db:swissprot] |
| 11021088_f1_12 | 118 | 2721 | 201 | 66 | 112 | 1.80E-08 | [ac:c69992] [pn:abc transporter (atp-binding protein) homolog ytgb] [gn:ytgb] [or:bacillus subtilis] [db:pir] |
| 11040942_c1_70 | 119 | 2722 | 237 | 78 | 87 | 0.00035 | [ln:ehy14328] [ac:y14328] [pn:3e1 protein] [or:entamoeba histolytica] [db:genpept-inv] [de:entamoeba histolytica mrna for 3e1 protein.] [le:32] [re:418] [di:direct] |
| 11053302_f2_3 | 120 | 2723 | 291 | 96 | 56 | 0.57 | [ac:o05239] [gn:yugl] [or:bacillus subtilis] [ec:1.1.1.-] [de:probable nadh-dependent butanol dehydrogenase 1,) [sp:o05239] [db:swissprot] |
| 11054812_f3_15 | 121 | 2724 | 219 | 72 | 69 | 0.16 | [ln:scua11g] [ac:z03261] [pn:ubiquitin activating enzyme el-like protein] [gn:ua11] [or:saccharomyces cerevisiae] [sr:baker's yeast] [db:genpept-pln] [de:s.cerevisiae genes for ubiquitin activating enzyme-like protein andtransfer rna-gly.] [nt:homology wi |
| 11062917_c3_99 | 122 | 2725 | 840 | 279 | 188 | 7.00E-15 | [ac:q57425-p96338] [gn:hi1077.1] [or:haemophilus influenzae] [de:hypothetical protein hi1077.1) [sp:q57425-p96338] [db:swissprot] |
| 11063166_c1_21 | 123 | 2726 | 237 | 78 | 63 | 0.14 | [ac:s53584] [pn:probable membrane protein yal065c] [or:saccharomyces cerevisiae] [db:pir] [mp:11] |
| 11068762_c3_108 | 124 | 2727 | 702 | 233 | 163 | 7.40E-20 | [acp16313] [or:glycine max] [sr;soybean] [de:nodulin 21 (n-21)] [sp:p16313] [db:swissprot] |
| 11072187_c1_45 | 125 | 2728 | 240 | 79 | 60 | 0.12 | [ln:ddmybs] [ac:aj002383] [pn:mybs protein] [gn:mybs] [or:dictyostelium discoideum] [db:genpept-inv] [de:dictyostelium discoideum mybs gene,] [nt:myb-related gene] [le:316] [re:2415] [di:direct] |
| 110952_f2_29 | 126 | 2729 | 303 | 100 | 199 | 4.50E-15 | [acjs0673] [pn:neopullulanase,) [cl:neopullulanase:alpha-amylase core homology] [or:bacillus sp.] [ec:3.2.1.135] [db:pir] |
| 11111376_f3_15 | 127 | 2730 | 249 | 82 | 77 | 0.004 | [ln:spz82001] [ac:z82001] [pn:unknown] [or:streptococcus pneumoniae] [db:genpept-bct] [de:s.pneumoniae pcpa gene and open reading frames.] [le:<1] [re:174] [di:direct] |
| 11111561_f3_51 | 128 | 2731 | 276 | 91 | 68 | 0.17 | [acu67851] [acu67851] [gn:chtk] [or:agrobacterium chtg] [db:genpept-bct] [de:agrobacterium sp. chrysopine transport region chtg (chtg) gene,partial cds, chth |

TABLE 2-continued

| Orf | NT Seq ID | AA Seq ID | NT Orf Length | AA Orf Length | Score | Probability | Description |
|---|---|---|---|---|---|---|---|
| 11114442_f1_12 | 129 | 2732 | 927 | 308 | 113 | 2.90E-06 | (chth), chti (chti), chtj (chtj), and chtk (chtk)genes, complete cds.] [nt:putative [ac:e69786] [pn:ribosomal-protein-alanine n-acetyltransfer homolog ydid] [gn:ydid] [or:bacillus subtilis] [db:pir] |
| 111254_c1_20 | 130 | 2733 | 686 | 228 | 117 | 6.20E-05 | [n:ae001175:ae000783] [pn:b. burgdorferi predicted coding region bb0759] [gn:bb0759] [ac:ae001175:ae000783] [or:borrelia burgdorferi] [sr:lyme disease spirochete] [db:genpept-bct] [de:borrelia burgdorferi (section 61 of 70) of the complete genome.] [nt:hypothetic |
| 11133290_f1_4 | 131 | 2734 | 240 | 79 | 122 | 2.20E-07 | [ac:p39593] [gn:thim:thik:ipa-25d] [or:bacillus subtilis] [ec:2.7.1.50] [de:hydroxyethylthiazole kinase) (thz kinase) (th kinase)] [sp:p39593] [dbsswissprot) |
| 11175208_f2_2 | 132 | 2735 | 198 | 65 | 64 | 0.41 | [ac:d69308] [pn:2-ketoglutarate ferredoxin oxidoreductase, subunit beta (korb) homolog] [or:archaeoglobus fulgidus] [db:pir] |
| 11177318_c2_73 | 133 | 2736 | 675 | 224 | 317 | 1.50E-28 | [ac:p39147] [gn:comfc:comf3] [or:bacillus subtilis] [de:comf operon protein 3] [sp:p39147] [dbsswissprot] |
| 11178760_f3_8 | 134 | 2737 | 1017 | 338 | 701 | 3.00E-69 | [ac:e69981] [pn:nifs protein homolog homolog yrvo] [gn:yrvo] [or:bacillus subtilis] [db:pir] |
| 11180177_f3_24 | 135 | 2738 | 774 | 257 | 433 | 7.60E-41 | [ac:c69049] [pn:abc transporter (atp-binding protein)] [gn:mth137O] [or:methanobacterium thermoautotrophicum] [db:pir] |
| 11208168_f3_10 | 136 | 2739 | 216 | 71 | 66 | 0.057 | [n:spz82001] [ac:z82001] [pn:unknown] [or:streptococcus pneumoniae] [db:genpept-bct] [de:s.pneumoniae pcpa gene and open reading frames.] [le:<1] [re:174] [di:direct] |
| 113430_c1_172 | 137 | 2740 | 309 | 102 | 67 | 0.5 | [ac:c69368] [pn:conserved hypothetical protein af0947] [or:archaeoglobus fulgidus] [db:pir] |
| 11718926_c1_19 | 138 | 2741 | 1512 | 503 | 1144 | 3.50E-116 | [ac:p39651] [gn:ywfo:ipa-93d] [de:hypothetical 51.0 kd protein in pta 3' region] [sp:p39651] [dbsswissprot] |
| 11719786_f3_32 | 139 | 2742 | 510 | 169 | 224 | 8.50E-21 | [n:ehu42211] [acu42211] [pn:psr] [fn:involved in the regulation of penicillin] [or:enterococcus hirae] [sr:enterococcus strain=atcc 9790] [db:genpept-bct] [de:enterococcus hirae psr gene, complete cds.] [le:746] [re:1627] [di:direct] |
| 11719818_c3_147 | 140 | 2743 | 984 | 327 | 58 | 0.96 | [ac:d64596] [pn:hypothetical protein hp0612] [or:helicobacter pylori] [db:pir] |
| 11723500_c1_23 | 141 | 2744 | 216 | 71 | 71 | 0.017 | [ac:s64781] [pn:hypothetical protein yll030c:hypothetical protein 10932] [or:saccharomyces cerevisiae] [db:pir] [mp:121] |
| 11726452_f1_2 | 142 | 2745 | 1308 | 435 | 425 | 4.70E-44 | [ac:p76273:o07980] [gn:yebu] [or:escherichia coli] [de:hypothetical 53.4 kd protein in prc-pppa intergenic region] [sp:p76273:o07980] [dbsswissprot] |
| 11728801_f2_24 | 143 | 2746 | 360 | 119 | 79 | 0.37 | [ac:p51234] [or:porphyra purpurea] [de:hypothetical 73.8 kd protein in ycf10-psbi intergenic region (orf621)] [sp:p51234] [dbsswissprot] |
| 11733331_c1_143 | 144 | 2747 | 183 | 60 | 63 | 0.57 | [ac:q60276] [gn:mjec114] [or:methanococcus jannaschii] [de:hypothetical protein mjec114] [sp:q60276] [dbsswissprot] |
| 11745462_f2_20 | 145 | 2748 | 768 | 255 | 904 | 9.30E-91 | [ac:q58418] [gn:pstb:mj1012] [or:methanococcus jannaschii] [de:probable phosphate transport atp-binding protein pstb] [sp:q58418] [dbsswissprot] |
| 11754625_f2_10 | 146 | 2749 | 207 | 68 | 71 | 0.045 | [n:ata002391] [ac:ac002391] [pn:putative proline-rich protein] [gn:t20o16.24] [or:arabidopsis thaliana] [sr:thale cress] [db:genpept-pln] [de:arabidopsis thaliana chromosome ii bac t20d16 genomic sequence,complete sequence.] [le:106251:106553] [re:10633 |
| 11760212_c3_28 | 147 | 2750 | 888 | 295 | 344 | 2.10E-31 | [ac:he69800] [pn:hypothetical protein yfhg] [gn:yfhg] [or:bacillus subtilis] [db:pir] |
| 11772183_c3_23 | 148 | 2751 | 186 | 61 | 67 | 0.3 | [ac:c69674] [pn:pectate lyase pelb] [gn:pelb] [or:bacillus subtilis] [db:pir] |
| 11802281_c3_83 | 149 | 2752 | 1080 | 359 | 695 | 1.30E-68 | [ac:p55975] [gn:tsf:hp1555] [or:helicobacter pylori] [sr:,campylobacter pylori] [sp:p55975] [dbsswissprot] [de:elongation factor ts (ef-ts)] |
| 1181593_c1_50 | 150 | 2753 | 189 | 62 | 75 | 0.0066 | [n:ecu19577] [ac:u19577] [pn:galactonate dehydratase] [gn:dgod] [or:escherichia coli] [db:genpept-bct] [de:escherichia coli galactonate dehydratase (dgod) gene, partial cds.] [le:97] [re: |
| 11830030_c1_6 | 151 | 2754 | 600 | 199 | 159 | 8.00E-11 | [n:celw03d2] [ac:af000298] [or:caenorhabditis elegans] [sr:caenorhabditis elegans strain=bristol n2] [db:genpept-inv] [de:caenorhabditis |

TABLE 2-continued

| Orf | NT Seq ID | AA Seq ID | NT Orf Length | AA Orf Length | Score | Probability | Description |
|---|---|---|---|---|---|---|---|
| 11831303_c1_8 | 152 | 2755 | 252 | 83 | 62 | 0.3 | elegans cosmid w03d2.] [nt:weak similarity to collagens; glycine- and] [ac:p49944] [gn:bfr] [or:brucella melitensis] [de:bacterioferritin (bfr)] [sp:p49944] [db:swissprot] |
| 11831307_f2_10 | 153 | 2756 | 225 | 74 | 244 | 8.10E-21 | [ac:p42060] [gn:rplv] [or:bacillus subtilis] [de:50s ribosomal protein 122] [sp:p42060] [db:swissprot] |
| 11834678_c1_82 | 154 | 2757 | 348 | 115 | 66 | 0.93 | [ln:ss55290] [ac:ss55290] [pn:anti-tetanus antibody heavy chain variable] [gn:anti-tetanus antibody heavy chain variable region] [or:homo sapiens] [sr:human hybridoma heteromyeloma gli-h7 cell line ttl17 b cells] [db:genpept-pri2] [de:anti-tetanus antibody |
| 11850125_c2_29 | 155 | 2758 | 465 | 154 | 94 | 0.0042 | [ac:p23614] [or:gallus gallus] [sr:;chicken] [de:23 kd cortical cytoskeleton-associated protein (cap-23)] [sp:p23614] [db:swissprot] |
| 11852063_c1_52 | 156 | 2759 | 537 | 178 | 99 | 0.011 | [ln:yscs22] [ac:m16165] [or:saccharomyces cerevisiae] [sr:yeast (s.cerevisiae, strain ah22) dna, clone pscm6] [db:genpept-pln] [de:yeast (s.cerevisiae) s1 protein gene, partial.] [nts:1 protein] [le:<1] [re: |
| 11875075_c1_51 | 157 | 2760 | 198 | 65 | 78 | 0.0085 | [ac:p22819:p19207] [gn:bioy] [or:bacillus sphaericus] [de:bioy protein precursor] [sp:p22819:p19207] [db:swissprot] |
| 11875325_c1_22 | 158 | 2761 | 399 | 132 | 380 | 3.10E-35 | [ac:s52544] [pn:is12 protein] [or:lactobacillus helveticus] [db:pir] |
| 11880437_c2_47 | 159 | 2762 | 258 | 85 | 182 | 3.00E-14 | [ac:su35635] [ln:shu35635] [pn:unknown] [or:staphylococcus haemolyticus] sr:staphylococcus haemolyticus strain=y176] [db:genpept-bct] [de:staphylococcus haemolyticus is1272 orf1 and orf2 genes, completecds.] [nt:orf1] [le:1101] [re:1922] [di:complement] |
| 11880437_c3_65 | 160 | 2763 | 531 | 176 | 213 | 7.80E-17 | [ln:af015453] [ac:af015453] [pn:unknown] [or:lactobacillus rhamnosus] [db:genpept-bct] [de:lactobacillus rhamnosus 6-phospho-beta-glucosidase homolog gene,partial cds; gntr transcriptional regulator homolog and surfaceolocated protein genes, complete cds.] |
| 118825_c3_65 | 161 | 2764 | 183 | 60 | 122 | 6.90E-08 | [ln:spnana1] [ac:x72967] [or:streptococcus pneumoniae] [de:s.pneumoniae nana gene.] [nt:orf2] [le:193] [re:495] [di:direct] |
| 11894225_f3_35 | 162 | 2765 | 627 | 208 | 57 | 0.016 | [ac:d49786] [pn:bacteriocin precursor a1] [or:lactococcus lactis subsp. cremoris] |
| 11895808_c3_9 | 163 | 2766 | 396 | 131 | 168 | 5.80E-12 | [ac:s51939:s72315:s45025] [pn:chitinase, precursor] [or:beta vulgaris] [sr:, beet] [ec:3.2.1.14] [db:pir] |
| 11909681_f3_27 | 164 | 2767 | 1107 | 368 | 808 | 1.40E-80 | [ac:c70009] [pn:abc transporter (lipoprotein) homolog yufn] [gn:yufn] [or:bacillus subtilis] [db:pir] |
| 11915936_f1_16 | 165 | 2768 | 1281 | 426 | 273 | 1.30E-21 | [ac:f69762] [pn:transporter homolog ycli] [gn:ycli] [or:bacillus subtilis] [db:pir] |
| 11932801_c3_115 | 166 | 2769 | 1176 | 391 | 118 | 0.00097 | [ac:p37609] [gn:lcndr2] [or:lactococcus lactis] [sr:,subsplactis.streptococcus lactis] [de:lactiocin 481 lactococcin biosynthesis protein lcndr2] [sp:p37609] [db:swissprot] |
| 11990962_f1_3 | 167 | 2770 | 447 | 148 | 228 | 8.30E-19 | [ac:p12045] [gn:purk] [or:bacillus subtilis] [de:(air carboxylase) (airc)] [sp:p12045] [db:swissprot] |
| 11995803_f1_1 | 168 | 2771 | 300 | 99 | 327 | 9.70E-29 | [ac:p18667] [gn:fus] [or:anacystis nidulans] [de:elongation factor g (ef-g)] [sp:p18667] [db:swissprot] |
| 12000436_f2_1 | 169 | 2772 | 225 | 74 | 102 | 9.00E-06 | [ac:c69874] [pn:conserved hypothetical protein ylbh] [gn:ylbh] [or:bacillus subtilis] [db:pir] |
| 120252_c2_65 | 170 | 2773 | 549 | 182 | 229 | 9.00E-09 | [ac:h69812] [pn:conserved hypothetical protein yfmi] [gn:yfmi] [or:bacillus subtilis] [db:pir] |
| 1204403_f3_27 | 171 | 2774 | 903 | 300 | 647 | 1.60E-63 | [ac:p17894:p19671] [gn:recn] [or:bacillus subtilis] [de:dna repair protein recn (recombination protein n)] [sp:p17894:p19671] [db:swissprot] |
| 1205252_f3_36 | 172 | 2775 | 1995 | 664 | 477 | 1.70E-45 | [ac:b70001] [pn:abc transporter (permease) homolog tsyd] [gn:tsyd] [or:bacillus subtilis] [db:pir] |
| 1206307_f1_7 | 173 | 2776 | 192 | 63 | 113 | 6.20E-07 | [ln:soorfs] [ac:z79691] [pn:orfb] [or:streptococcus pneumoniae] [db:genpept-bct] [de:s.pneumonia yorf[a,b,c,d,e], fts1, pbpx and regr genes.] [le:1914] [re:2372] [di:complement] |
| 1206927_f2_9 | 174 | 2777 | 213 | 70 | 66 | 0.057 | [ln:hiu89633] [ac:u89633] [pn:major outer membrane protein p2-type 2] |

TABLE 2-continued

| Orf | NT Seq ID | AA Seq ID | NT Orf Length | AA Orf Length | Score | Probability | Description |
|---|---|---|---|---|---|---|---|
| 1209455_c2_36 | 175 | 2778 | 348 | 115 | 567 | 4.80E-55 | [or:*haemophilus influenzae*] [db:genpept-bct] [de:*haemophilus influenzae* major outer membrane protein p2-type 2 gene, partial cds.] [nt:loops 4 to 6] [le:<1] [re:1] [ns:sparacetp] [ac:z67739] [pn:dna type s transposase genes and unknown orf.] |
| 12111256_c1_22 | 176 | 2779 | 789 | 262 | 864 | 1.60E-86 | [db:genpept-bct] [de:*s.pneumoniae* parc, pare and transposase genes and unknown orf.] [nt:novel insertion sequence related to is861 of group] [le:<1] [re:435] [di:direct] [ns:pdexcap] [ac:z47210] [pn:unknown] [gn:orf1] [or:*streptococcus pneumoniae*] |
| 12112812_f2_17 | 177 | 2780 | 831 | 276 | 214 | 5.40E-17 | [db:genpept-bct] [de:*s.pneumoniae* dexb, cap3a, cap3b and cap3c genes and orfs.] [nt:the deduced amino acid sequence contains a sugar] [le:3649] [re:4341] [di:direct] [ac:p39365] [gn:sgcc] [or:*escherichia coli*] [de:putative phosphotransferase enzyme ii, c component sgcc] [sp:p39365] [db:swissprot] |
| 12135007_f1_6 | 178 | 2781 | 198 | 65 | 52 | 0.077 | [ac:s17298:s37706] [pn:alpha-amylase;;cyclomaltodextrin glucanotransferase homolog] [gn:amya] [cl:cyclomaltodextrin glucanotransferase:alpha-amylase core homology] [or:*thermoanaerobacterium thermosulfurigenes*] [ec:3.2.1.1] [db:pir] |
| 1214017_f2_13 | 179 | 2782 | 636 | 211 | 441 | 1.10E-41 | [ac:p39594] [gn:thie;thic;ipa-26d] [or:*bacillus-subtilis*] [ec:2.5.1.3] [de:pyrophosphorylase] (tmp-ppase) (thiamin-phosphate synthase)] [sp:p39594] [db:swissprot] |
| 12145927_c2_189 | 180 | 2783 | 1332 | 443 | 473 | 4.40E-45 | [ac:p54308] [gn:2] [or:bacteriophage sp1] [de:terminase large subunit (g2p)] [sp:p54308] [db:swissprot] |
| 12148337_c2_49 | 181 | 2784 | 393 | 130 | 148 | 9.90E-10 | [ac:p06990] [gn:hsds;lhss] [or:*escherichia coli*] [de:type i restriction enzyme ecobi specificity protein (s protein)] [sp:p06990] [db:swissprot] |
| 12149092_c2_66 | 182 | 2785 | 1566 | 521 | 1281 | 1.00E-130 | [ac:p35854] [gn:dlt:dae] [or:*lactobacillus casei*] [ec:6.3.2.-] [de:carrier protein ligase) (dcl)] [sp:p35854] [db:swissprot] |
| 1220036_f3_25 | 183 | 2786 | 3093 | 1030 | 95 | 0.18 | [ln:bs;tyrs1g] [ac:x52480;s93287] [gn:orf2] [or:*bacillus subtilis*] [db:genpept-bct] [de:*bacillus subtilis* tyrs1 gene for tyrosine trna synthetase, sacx, andsacy genes, and three orfs.] [sp:p25148] [le:1286] [re:2128] [di:complement] |
| 12207031_c3_39 | 184 | 2787 | 282 | 93 | 228 | 4.00E-19 | [ac:p21260;p21261] [or:*owenia fusiformis*] [de:hypothetical proline-rich protein (fragment)] [sp:p21260;p21261] [db:swissprot] |
| 12207034_c1_23 | 185 | 2788 | 209 | 69 | 236 | 5.70E-20 | [ac:p21260;p21261] [or:*owenia fusiformis*] [de:hypothetical proline-rich protein (fragment)] [sp:p21260;p21261] [db:swissprot] |
| 12269127_f1_2 | 186 | 2789 | 624 | 207 | 96 | 9.00E-05 | [ln:d78257] [ac:d78257] [pn:orf8] [gn:orf8] [or:*enterococcus faecalis*] [sr:*enterococcus faecalis* plasmid pyi17 dna] [db:genpept-bct] [de:*enterococcus faecalis* plasmid pyi17 genes for baca, bacb, orf3,orf4, orf5, orf6, orf7, orf8, orf9, orf10, orf11,partia |
| 12273277_c1_13 | 187 | 2790 | 1110 | 369 | 1582 | 1.30E-162 | [ac:a42963:b42963;t0750] [pn:glyceraldehyde-3-phosphate dehydrogenase;;plasmin receptor] [cl:glyceraldehyde-3-phosphate dehydrogenase] [or:*streptococcus sp.*] [ec:1.2.1.12] [db:pir] |
| 12285407_c3_14 | 188 | 2791 | 963 | 320 | 703 | 1.90E-69 | [ln:af010151] [ac:af010151] [pn:psco] [gn:psco] [or:*pseudomonas aeruginosa*] [db:genpept-bct] [de:*pseudomonas aeruginosa* pscn (pscn) gene, complete cds, and psco(psco) gene, partial cds.] [le:1413] [re: |
| 12296883_c1_69 | 189 | 2792 | 204 | 67 | 52 | 0.27 | [ac:i49019] [pn:retinoid x receptor interacting protein no.3] [gn:rip14-2(3)] [or:*mus musculus*] [sr:, house mouse] [db:pir] |
| 12301556_f1_1 | 190 | 2793 | 459 | 152 | 102 | 4.20E-05 | [ac:p37187:p76413] [gn:gata] [or:*escherichia coli*] [ec:(ec 2.7.1.69) [sp:p37187;p76413] [db:swissprot] |
| 12303882_f3_8 | 191 | 2794 | 747 | 248 | 326 | 1.70E-29 | [ln:mtv003] [ac:a1008883] [pn:hypothetical protein mtvOO3.05c] [gn:mtvOO3.05c] [or:*mycobacterium tuberculosis*] [db:genpept-bct] [de:*mycobacterium tuberculosis* sequence v003.] [nt:mtv003.05c, unknown, len: 308 aa; similar to e.] [le:3006] [re:3932] [di:com |
| 12384653_c2_63 | 192 | 2795 | 996 | 331 | 1716 | 8.40E-177 | [ln:af030367] [ac:af030367] [pn:maturase-related protein] [or:*streptococcus pneumoniae*] [db:genpept-bct] [de:*streptococcus pneumoniae* strain nctc11906 alpha, 1-6-glucosidase(dexb) gene, partial cds; maturase-related protein, putativeregulatory |

TABLE 2-continued

| Orf | NT Seq ID | AA Seq ID | NT Orf Length | AA Orf Length | Score | Probability | Description |
|---|---|---|---|---|---|---|---|
| 12503215_f2_6 | 193 | 2796 | 666 | 221 | 595 | 5.20E−58 | protein (cp [ln:cju93169] [ac:u93169] [pn:outer membrane protein] [gn:omph1] [or:campylobacter jejuni] [db:genpept-bct] [de:campylobacter jejuni outer membrane protein (omph1) gene, completecds.] [nt:glutamine binding protein analog] [1e:164] [re:1003] [di:direct] |
| 12511087_c1_32 | 194 | 2797 | 1179 | 392 | 137 | 3.50E−06 | [ac:q58626] [gn:accs:mj1229] [or:methanococcus jannaschii] [ec:6.3.4.14:6.4.1.2] [de:carboxylase,) (acc)] [sp:q58626] [db:swissprot] |
| 12525781_f2_20 | 195 | 2798 | 795 | 264 | 275 | 4.20E−24 | [ac:s22456:s18964] [pn:hydroxyproline-rich glycoprotein] [or:zea diploperennis] [sr:, perennial teosinte] [db:pir] |
| 1253405_c1_25 | 196 | 2799 | 351 | 116 | 73 | 0.34 | [ln:ae001168] [ac:ae001168:ae000783] [pn:conserved hypothetical protein [gn:bb0673] [or:borrelia burgdorferi] [sr:lyme disease spirochete] [db:genpept-bct] [de:borrelia burgdorferi (section 54 of 70) of the complete genome.] [nt:similar to |
| 12537525_f1_49 | 197 | 2800 | 228 | 75 | 71 | 0.086 | [ln:af042001] [ac:af042001] [pn:zinc finger protein slug] [gn:slug] [or:homo sapiens] [sr:human] [db:genpept-pri2] [de:homo sapiens zinc finger protein slug (slug) gene, complete cds.] [nt:similar to mouse slug protein encoded by genbank] [1e:447:1271 :272 |
| 12537525_f2_17 | 198 | 2801 | 432 | 143 | 77 | 0.93 | [ac:q24739] [gn:bw] [or:drosophila virilis] [sr:,fruit fly] [de:brown protein] [sp:q24739] [db:swissprot] |
| 12538312_c2_91 | 199 | 2802 | 222 | 73 | 58 | 0.34 | [ac:p34494] [gn:k02d10.3] [or:caenorhabditis elegans] [de:hypothetical 11.0 kd protein k02d10.3 in chromosome iii] [sp:p34494] [db:swissprot] |
| 12539086_f2_20 | 200 | 2803 | 384 | 127 | 122 | 6.90E−08 | [ac:q69828] [pn:hypothetical protein yhea] [gn:yhea] [or:bacillus subtilis] [db:pir] |
| 12541307_f1_9 | 201 | 2804 | 1839 | 612 | 1841 | 4.80E−190 | [ac:q45493] [gn:ykqc] [or:bacillus subtilis] [de:hypothetical 61.5 kd protein in adec-pdha intergenic region] [sp:q45493] [db:swissprot] |
| 12547167_f3_60 | 202 | 2805 | 246 | 81 | 66 | 0.06 | [ac:p12354] [gn:psae-1,psae-2] [or:spinacia oleracea] [sr:spinach] [de:photosystem i reaction centre subunit iv precursor (psi-e)] [sp:p12354] [db:swissprot] |
| 1254818_c3_78 | 203 | 2806 | 744 | 247 | 357 | 8.60E−33 | [ac:p94424] [gn:yend] [or:bacillus subtilis] [de:hypothetical 27.9 kd protein in phrc-gdh intergenic region] [sp:p94424] [db:swissprot] |
| 12553792_c3_21 | 204 | 2807 | 477 | 158 | 186 | 1.10E−14 | [ac:b69832] [pn:biotin biosynthesis homolog yhfu] [gn:yhfu] [or:bacillus subtilis] [db:pir] |
| 12595013_f1_1 | 205 | 2808 | 468 | 155 | 333 | 3.00E−30 | [ln:ae001166] [ac:ae001166:ae000783] [pn:conserved hypothetical protein [gn:bb0644] [or:borrelia burgdorferi] [sr:lyme disease spirochete] [db:genpept-bct] [de:borrelia burgdorferi (section 52 of 70) of the complete genome.] [nt:similar to |
| 125952_f2_6 | 206 | 2809 | 906 | 301 | 656 | 1.80E−64 | [ac:e60759] [pn:hypothetical protein ycgr] [gn:ycgr] [or:bacillus subtilis] [db:pir] |
| 1260000_c1_19 | 207 | 2810 | 357 | 118 | 92 | 0.00057 | [ln:spbc3d5] [ac:q95620] [pn:unknown] [gn:spbc3d5.14c] [or:schizosaccharomyces pombe] [sr:fission yeast] [db:genpept-pln] [de:s.pombe chromosome ii cosmid c3d5.] nt:spbc3d5.14c, unknown; partial; serine rich,] [1e:31398] [re: |
| 12616575_c1_34 | 208 | 2811 | 1572 | 523 | 2111 | 1.20E−218 | [ac:p37949] [gn:lepa] [or:bacillus subtilis] [de:gtp-binding protein lepa] [sp:p37949] [db:swissprot] |
| 12751305_f1_15 | 209 | 2812 | 192 | 63 | 114 | 2.90E−06 | [ac:p39300] [gn:yifi] [or:escherichia coli] [de:hypothetical 40.3 kd protein in aidb-rpsf intergenic region (f356)] [sp:39300] [db:swissprot] |
| 12761688_c3_14 | 210 | 2813 | 519 | 172 | 308 | 1.30E−27 | [ac:e69840] [pn:hypothetical protein yitl] [gn:yitl] [or:bacillus subtilis] [db:pir] |
| 12772818_c1_43 | 211 | 2814 | 519 | 172 | 252 | 1.20E−21 | [ac:s76312] [pn:hypothetical protein] [or:synechocystis sp.] [sr:pcc 6803,, pcc 6803] [sr:pcc 6803,] [db:pir] |
| 12789812_f3_8 | 212 | 2815 | 396 | 131 | 279 | 1.60E−24 | [ac:b64666] [pn:glutamine abc transporter, permease protein] [or:helicobacter pylori] [db:pir] |
| 12791466_c2_66 | 213 | 2816 | 222 | 73 | 92 | 0.0017 | [ac:h69828] [pn:abc transporter (atp-binding protein) homolog yheh] [gn:yheh] [or:bacillus subtilis] [db:pir] |
| 128431_c2_70 | 214 | 2817 | 288 | 95 | 69 | 0.028 | [ln:spz83001] [ac:z83001] [pn:unknown] [or:streptococcus pneumoniae] [db:genpept-bct] [de:s.pneumoniae pcpa gene and open reading frames,] [1e:<1] [re:174] [di:direct] |
| 12891427_c2_33 | 215 | 2818 | 198 | 65 | 71 | 0.017 | [ln:spnana] [ac:x72967] [or:streptococcus pneumoniae] [db:gebpept-bct] [de:s.pneumoniae nana gene,] [nt:orf2] [1e:193] [re:495] [di:direct] |

TABLE 2-continued

| Orf | NT Seq ID | AA Seq ID | NT Orf Length | AA Orf Length | Score | Probability | Description |
|---|---|---|---|---|---|---|---|
| 12898587_f1_3 | 216 | 2819 | 2166 | 721 | 2482 | 5.70E-258 | [ac:q03727] [gn:coma] [or:streptococcus pneumoniae] [de:transport atp-binding protein coma] [sp:q03727] [db:swissprot] |
| 12931888_c3_92 | 217 | 2820 | 747 | 248 | 133 | 9.90E-07 | [ac:p10020] [gn:tnpi] [or:bacillus thuringiensis] [de:tnp i resolvase] [sp:p10020] [db:swissprot] |
| 12969208_f3_7 | 218 | 2821 | 666 | 221 | 829 | 8.30E-83 | [ac:p10539] [gn:asd] [or:streptococcus mutans] [ec:1.2.1.11] [de:dehydrogenase] [sp:p10539] [db:swissprot] |
| 12971883_f1_3 | 219 | 2822 | 207 | 68 | 52 | 0.072 | [ln:celf53g12] [ac:af003139] [gn:f53g12.6] [or:caenorhabditis elegans] [sr:caenorhabditis elegans strain=bristol n2] [dbgenpept-inv] [de:caenorhabditis elegans cosmid f53g12.] [nt:similar to protein-tyrosine kinase; coded for by c.] |
| 13025450_c3_52 | 220 | 2823 | 936 | 311 | 449 | 1.50E-42 | [ac:d70008] [pn:nicotinate phosphoribosyltransferase homolog yuek] [gn:yuek] [or:bacillus subtilis] [db:pir] |
| 13066430_c1_16 | 221 | 2824 | 432 | 143 | 66 | 0.58 | [ac:jh0205] [pn:hypothetical 11.8k protein] [or:enterococcus faecalis] [db:pir] |
| 13074056_f2_30 | 222 | 2825 | 594 | 197 | 480 | 8.00E-46 | [ac:a69881] [pn:conserved hypothetical protein ylua] [gn:ylua] [or:bacillus subtilis] [db:pir] |
| 13080005_f2_23 | 223 | 2826 | 507 | 168 | 435 | 4.70E-41 | [ac:g70022] [pn:iron(iii) dicitrate transport permease homolog yusv] [gn:yusv] [or:bacillus subtilis] [db:pir] |
| 13080277_c1_20 | 224 | 2827 | 348 | 115 | 66 | 0.94 | [ln:af037955] [ac:af037955] [or:neisseria meningitidis] [db:genpept-bct] [de:neisseria meningitidis 3-phosphoserine aminotransferase (serc)gene, serc-3 allele, partial cds.] [le:<1] [re:aminotransferase [gn:serc] [pn:3-phosphoserine aminotransferase] |
| 13084442_c3_26 | 225 | 2828 | 246 | 81 | 61 | 0.6 | [ac:s23314] [pn:hypothetical protein 2] [cl:retrovirus-related polyprotein] [or:arabidopsis thaliana] |
| 13104161_f3_43 | 226 | 2829 | 690 | 229 | 263 | 1.90E-22 | [ac:s51939:s72315:s45025] [pn:chitinase, precursor] [or:beta vulgaris] [sr; mouse-ear cress] [db:pir] [ec:3.2.1.14] |
| 1311_c3_50 | 227 | 2830 | 1218 | 405 | 1399 | 3.30E-143 | [ac:p50307] [or:staphylococcus aureus] [ec:2.5.1.6] [de:adenosyltransferase] (adomet synthetase) [sp:p50307] [db:swissprot] |
| 13131930_c2_10 | 228 | 2831 | 762 | 253 | 544 | 1.30E-52 | [ac:g69663] [pn:nicotinate-nucleotide pyrophosphorylase nadc] [gn:nadc] [or:bacillus subtilis] [db:pir] |
| 131388_c1_11 | 229 | 2832 | 207 | 68 | 109 | 1.60E-06 | [ln:spnana1] [ac:x72967] [or:streptococcus pneumoniae] [db:genpept-bct] [de:s.pneumoniae nana gene.] [nt:orf2] [le:193] [re:495] [di:direct] |
| 13159576_f2_17 | 230 | 2833 | 384 | 127 | 140 | 1.50E-09 | [ac:p46719:p76294] [gn:cutc] [or:escherichia coli] [de:copper homeostasis protein cutc] [sp:p46719:p76294] [db:swissprot] |
| 13176885_c2_31 | 231 | 2834 | 951 | 316 | 981 | 6.50E-99 | [ac:h69681] [pn:peptide chain release factor 2 prfb] [gn:prfb] [or:bacillus subtilis] [db:pir] |
| 1359388_f2_11 | 232 | 2835 | 2073 | 690 | 3396 | 0 | [ac:p10524] [gn:pena] [or:streptococcus pneumoniae] [de:penicillin-binding protein 2b] [sp:p10524] [db:swissprot] |
| 1360910_f1_7 | 233 | 2836 | 207 | 68 | 69 | 0.067 | [ac:p03924] [gn:mtnd6:nd6] [or:bos taurus] [sr:bovine] [ec:1.6.5.3] [de:nadh-ubiquinone oxidoreductase chain 6,] [sp:p03924] [db:swissprot] |
| 1362653_c2_99 | 234 | 2837 | 243 | 80 | 71 | 0.017 | [ac:a25020] [pn:t-cell receptor alpha chain v-j region (bdf1 alpha-1) / cl:immunoglobulin v region:immunoglobulin homology] [or:mus musculus] [sr; house |
| 13675311_c3_74 | 235 | 2838 | 300 | 99 | 302 | 5.80E-27 | [ac:67936] [pn:glycerol-3-phosphate dehydrogenase homolog glpd] [gn:glpd] [or:streptococcus pneumoniae] [sr:strain p13, strain p13,] [db:pir] |
| 13676575_f2_13 | 236 | 2839 | 1725 | 574 | 2224 | 1.20E-230 | [ac:p23531] [gn:lace] [or:lactococcus lactis] [sr:,subsplactis:streptococcus lactis] [ec:2.7.1.69] [de: (ec 2.7.1.69) (eii-lac)] [sp:p23531] [db:swissprot] |
| 13678452_f1_10 | 237 | 2840 | 222 | 73 | 75 | 0.059 | [ac:p55340] [gn:ecsb:pstl] [or:bacillus subtilis] [de:protein ecsb] [sp:p55340] [db:swissprot] |
| 13681955_c2_39 | 238 | 2841 | 573 | 190 | 219 | 3.00E-17 | [ac:s66651:s58356] [pn:pept protein] [gn:pept] [cl:unassigned atp-binding cassette proteins:malk protein homology] [or:staphylococcus epidermidis] [db:pir] |
| 13683437_c1_35 | 239 | 2842 | 792 | 263 | 115 | 0.00023 | [ac:e69463] [pn:type i restriction-modification enzyme, s subunit homolog] [or:archaeoglobus fulgidus] [db:pir] |

TABLE 2-continued

| Orf | NT Seq ID | AA Seq ID | NT Orf Length | AA Orf Length | Score | Probability | Description |
|---|---|---|---|---|---|---|---|
| 13688377_c2_44 | 240 | 2843 | 471 | 156 | 306 | 9.30E-29 | [ac:a41971:a60282:a33134] [pn:surface protein pspa precursor:pneumococcal surface protein a] [cl:cpl repeat homology] [or:streptococcus pneumoniae] [db:pir] |
| 1369002_c1_22 | 241 | 2844 | 543 | 180 | 196 | 2.30E-15 | [ac:p70036] [pn:spore coat polysaccharide biosynthesis homolog yver] [gn:yver] [or:bacillus subtilis] [db:pir] |
| 13697812_f2_5 | 242 | 2845 | 1956 | 651 | 1400 | 2.60E-143 | [ac:p39118] [gn:glgb] [or:bacillus subtilis] [ec:2.4.1.18] [de:enzyme] [sp:p39118] [db:swissprot] |
| 13703817_f3_136 | 243 | 2846 | 183 | 60 | 49 | 0.38 | [ac:p46975] [gn:t12a2.2] [or:caenorhabditis elegans] [de:oligosaccharyl transferase st3 subunit homolog] [sp:p46975] [db:swissprot] |
| 13709394_c2_45 | 244 | 2847 | 1385 | 461 | 1151 | 6.30E-117 | [ac:p22250] [gn:gltx] [or:bacillus subtilis] [ec:6.1.1.17] [de:(glurs)] [sp:p22250] [db:swissprot] |
| 13709688_c3_46 | 245 | 2848 | 438 | 145 | 58 | 0.57 | [n:ae000785] [ac:ae000785] [pn:b. burgdorferi predicted coding region bbeO3] [gn:bbeO3] [or:borrelia burgdorferi] [sr:lyme disease spirochete] [db:genpept-bct] [de:borrelia burgdorferi plasmid lp25, complete plasmid sequence.] [nt:hypothetical protein; i |
| 13714063_f1_1 | 246 | 2849 | 1707 | 568 | 99 | 0.0022 | [n:cec33a12] [ac:z68493] [pn:caenorhabditis elegans] [db:genpept-inv] [de:caenorhabditis elegans cosmid c33a12, complete sequence.] [re:3295.3806:4032:4399] [re:3747.3964:4241:4593] [di:directjoin] |
| 13750192_c1_38 | 247 | 2850 | 237 | 78 | 58 | 0.34 | [ac:p45967] [gn:t09a5.7] [or:caenorhabditis elegans] [de:hypothetical 12.5 kd protein t09a5.7 in chromosome iii] [sp:p45967] [db:swissprot] |
| 13750917_f3_14 | 248 | 2851 | 243 | 80 | 60 | 0.52 | [ac:q29408] [gn:i110] [or:ovis aries] [sr:sheep] [de:factor] (csif) [sp:q29408] [db:swissprot] |
| 13751917_c3_8 | 249 | 2852 | 243 | 80 | 67 | 0.4 | [ac:s29851:s27760] [pn:protein kinase homology] [or:glycine max] [sr:, soybean] [cl:unassigned ser/thr or tyr-specific protein kinases:protein kinase 6,] [cl:unassigned ser/thr or tyr-specific protein kinases:protein kinase homology] [ec:2.7.1.-] [db:pir] |
| 13752167_f1_5 | 250 | 2853 | 243 | 80 | 66 | 0.48 | [ac:s29851:s27760] [pn:protein kinase homology] [or:glycine max] [sr:, soybean] [cl:unassigned ser/thr or tyr-specific protein kinases:protein kinase homology] [ec:2.7.1.-] [db:pir] |
| 13752167_f3_12 | 251 | 2854 | 252 | 83 | 66 | 0.48 | [ac:s29851:s27760] [pn:protein kinase homology] [or:glycine max] [sr:, soybean] [cl:unassigned ser/thr or tyr-specific protein kinases:protein kinase 6,] [cl:unassigned ser/thr or tyr-specific protein kinases:protein kinase homology] [ec:2.7.1.-] [db:pir] |
| 13752167_f3_28 | 252 | 2855 | 243 | 80 | 63 | 0.75 | [ac:s29851:s27760] [pn:protein kinase 6,] [cl:unassigned ser/thr or tyr-specific protein kinases:protein kinase homology] [or:glycine max] [sr:, soybean] [ec:2.7.1.-] [db:pir] |
| 13752253_f1_20 | 253 | 2856 | 318 | 105 | 85 | 0.0058 | [n:spac23a1] [ac:al021813] [pn:hypothetical protein] [gn:spac23a1.01c] [or:schizosaccharomyces pombe] [sr:fission yeast] [db:genpept] [de:s.pombe chromosome i cosmidc23a1.] [nt:spaC23a1.01c, partial; unknown; serine/threonine] [te:1] [re:1370] [di:compl] |
| 13754035_c1_45 | 254 | 2857 | 228 | 75 | 62 | 0.15 | [ac:b39777] [pn:hypothetical protein (blood stage antigen 41-3 3'region)] [or:plasmodium falciparum] [db:pir] |
| 13754035_c3_103 | 255 | 2858 | 261 | 86 | 66 | 0.18 | [n:celb0507] [ac:u64833] [gn:b0507.4] [or:caenorhabditis elegans] [sr:caenorhabditis elegans strain=bristol n2] [db:genpept-inv] [de:caenorhabditis elegans cosmid b0507.] [re:9388:9614:9908] [re:9540:9793:10177] [di:directjoin] |
| 13757160_c3_8 | 256 | 2859 | 192 | 63 | 65 | 0.47 | [ac:q33568] [gn:cyb] [or:trypanoplasma borreli] [ec:1.10.2.2] [de:cytochrome b,] [sp:q33568] [db:swissprot] |
| 135931_c1_46 | 257 | 2860 | 2586 | 861 | 233 | 4.40E-15 | [ac:q69801] [pn:hypothetical protein yfho] [gn:yfho] [or:bacillus subtilis] [db:pir] |
| 13765967_c3_122 | 258 | 2861 | 192 | 63 | 69 | 0.028 | [ac:p07133] [gn:rp120] [or:euglena gracilis] [de:chloroplast 50s ribosomal protein 120] [sp:p07133] [db:swissprot] |
| 1378452_c3_8 | 259 | 2862 | 936 | 311 | 981 | 6.50E-99 | [ac:p20429] [gn:rpoa] [or:bacillus subtilis] [ec:2.7.7.6] [de:alpha chain] (rna polymerase alpha subunit) [sp:p20429] [db:swissprot] |
| 13789140_c2_64 | 260 | 2863 | 1323 | 440 | 612 | 8.2E-60 | [ac:g69885] [pn:processing proteinase homolog ymfh] [gn:ymfh] [or:bacillus subtilis] [db:pir] |
| 13792062_c2_200 | 261 | 2864 | 942 | 313 | 1674 | 2.40E-172 | [ac:p32762] [gn:hbl] [or:streptococcus pneumoniae phage hb-3] [ec:3.5.1.28] [de:lytic amidase, n-acetylmuramoyl-1-alanine amidase)] [sp:p32762] [db:swissprot] |

TABLE 2-continued

| Orf | NT Seq ID | AA Seq ID | NT Orf Length | AA Orf Length | Score | Probability | Description |
|---|---|---|---|---|---|---|---|
| 1379237_c2_68 | 262 | 2865 | 1254 | 417 | 2059 | 3.80E−213 | [ln:spdacao] [ac:x99400] [pn:d-carboxypeptidase] [gn:daca] [or:streptococcus pneumoniae] [db:genpept-bct] [de:s.pneumoniae daca gene and orf.] [le:1921] [re:3162] [di:direct] |
| 13829551_f2_21 | 263 | 2866 | 405 | 134 | 392 | 1.70E−36 | [ac:p55339] [gn:ecsa;ptst] [or:bacillus subtilis] [de:abc-type transporter atp-binding protein ecsa] [sp:p55339] [db:swissprot] |
| 13832812_c1_44 | 264 | 2867 | 339 | 112 | 86 | 0.0018 | [ln:mhu56828] [ac:u56828] [pn:vaa surface lipoprotein adhesin] [gn:vaa] [or:mycoplasma hominis] [sr:mycoplasma hominis strain=pg21] [db:genpept-bct] [de:mycoplasma hominis vaa surface lipoprotein adhesin (vaa) gene,partial cds.] [le:<1] [re:759] [di:direc |
| 13834555_c2_72 | 265 | 2868 | 330 | 109 | 186 | 1.10E−14 | [ln:axu22323] [ac:u22323] [pn:unknown] [or:acetobacter xylinum] [db:genpept-bct] [de:acetobacter xylinum insertion sequence element is1238 orfa gene,complete cds, and orfb gene, partial cds.] [nt:orfb] [le:<585] [re:1154] [di:direct] |
| 1383501_f1_6 | 266 | 2869 | 348 | 115 | 73 | 0.8 | [ln:ce09e8] [ac:z78065] [pn:t09e8.4] [or:caenorhabditis elegans] [db:genpept-inv] [de:caenorhabditis elegans cosmid t09e8, complete sequence.] [le:12185:12596:12818] [re:12541:12770:12947] [di:complementjoin] |
| 13835750_f3_8 | 267 | 2870 | 282 | 93 | 78 | 0.0027 | [ln:cpvp1hom] [ac:aj000552] [pn:vp1 protein homologue] [gn:vp1] [fn:seed-specific transcriptional activator] [or:craterostigma plantagineum] [db:genpept-pln] [de:craterostigma plantagineum mrna for vp1 protein homologue.] [le:1] [re:2067] [di:direct] |
| 13836558_f1_3 | 268 | 2871 | 822 | 273 | 272 | 4.30E−23 | [ln:lhptlsabc] [ac:z307091] [pn:abc transporter] [or:lactobacillus helveticus] [db:genpept-bct] [de:l.helveticus genes for prolinase and putative abc transporter.] [nt:putative] [le:132] [re:1736] [di:complement] |
| 13839057_f1_1 | 269 | 2872 | 1506 | 501 | 464 | 3.90E−44 | [ac:p32683] [gn:yjbb] [or:escherichia coli] [de:hypothetical 59.5 kd protein in methpepe intergenic region] [sp:p32683] [db:swissprot] |
| 13843775_f1_9 | 270 | 2873 | 201 | 66 | 59 | 0.88 | [ln:rcsmap] [ac:d318791] [pn:rna polymerase] [or:rice stripe virus] [sr:rice stripe virus (isolate:t) cdna to genomic rna] [db:genpept-vrl] [de:rice stripe virus gene for rna polymerase, complete cds.] [le:58] [re:8817] [di:direct] |
| 13846521_c3_77 | 271 | 2874 | 1254 | 417 | 288 | 1.80E−25 | [ac:f69885] [pn:processing proteinase homolog ymfg] [gn:ymfg] [or:bacillus subtilis] [db:pir] |
| 1385061_f2_11 | 272 | 2875 | 336 | 111 | 320 | 7.20E−29 | [ac:s52544] [pn:is12 protein] [or:lactobacillus helveticus] [db:pir] |
| 13851375_c1_21 | 273 | 2876 | 192 | 63 | 58 | 0.35 | [ac:g64622] [pn:conserved hypothetical protein hp0823] [or:helicobacter pylori] [db:pir] |
| 13855011_f2_4 | 274 | 2877 | 561 | 186 | 181 | 3.80E−14 | [ac:q06242] [gn:vanz] [or:enterococcus faecium] [sr:;streptococcus faecium] [de:vanz protein] [sp:q06242] [db:swissprot] |
| 13859251_c3_114 | 275 | 2878 | 624 | 207 | 517 | 9.50E−50 | [ln:11u23376] [ac:u23376] [or:lactococcus lactis] [db:genpept-bct] [de:lactococcus lactis n5-(1-carboxyethyl)-1-ornithine synthase (ceo)gene, complete cds.] [nt:putative 20-kda protein] [le:374] [re:925] [di:direct] |
| 1385927_f1_6 | 276 | 2879 | 237 | 78 | 81 | 0.0065 | [ac:q60367] [gn:mj0060] [or:methanococcus jannaschii] [de:hypothetical protein mjOO6O] [sp:q60367] [db:swissprot] |
| 13860885_f2_26 | 277 | 2880 | 753 | 250 | 141 | 9.90E−08 | [ac:af005098] [ac:af005098] [pn:positive regulator gadr] [gn:gadr] [fn:activates chloride dependent transcription of] [or:lactococcus lactis] [db:genpept-bct] [de:lactococcus lactis masch ii (rmhb) gene, partial cds, positiveregulator gadr (gadr), gadc ( |
| 13860956_f2_5 | 278 | 2881 | 255 | 84 | 65 | 0.7 | [ac:jc5721] [pn:vacuolar protein sorting protein 33b] [or:rattus norvegicus] [sr:, norway rat] [db:pir] |
| 13866285_f1_11 | 279 | 2882 | 438 | 145 | 210 | 3.60E−17 | [ac:d69999] [pn:conserved hypothetical protein ytqa] [gn:ytqa] [or:bacillus subtilis] [db:pir] |
| 13866385_c3_114 | 280 | 2883 | 354 | 117 | 97 | 0.00076 | [ac:q09457] [gn:c09g5.6] [or:caenorhabditis elegans] [de:putative cuticle collagen c09g5.6] [sp:q09457] [db:swissprot] |
| 13867332_c2_22 | 281 | 2884 | 279 | 92 | 67 | 0.59 | [ln:sau73374] [ac:u73374] [pn:cap8k] [gn:cap8k] [or:staphylococcus aureus] [db:genpept-bct] [de:staphylococcus aureus type 8 capsule genes, cap8a, cap8b, |

TABLE 2-continued

| Orf | NT Seq ID | AA Seq ID | NT Orf Length | AA Orf Length | Score | Probability | Description |
|---|---|---|---|---|---|---|---|
| 13869003_f2_29 | 282 | 2885 | 576 | 191 | 195 | 4.20E-15 | cap8c,cap8d, cap8e, cap8f, cap8g, cap8h, cap8i, cap8j, cap8k, cap8l,cap8m, cap8n, [1n:bju33883] [accu33883] [gn:orf3] [or:bradyrhizobium japonicum] [sr:bradyrhizobium japonicum strain=usda 110] [db:genpept-bct] [de:bradyrhizobium japonicum signal peptidase sips (sips) gene,complete cds.] [le:1617] [re:2747] |
| 13869007_f2_11 | 283 | 2886 | 267 | 88 | 118 | 6.00E-07 | [ac:p36999] [gn:yebh] [or:escherichia coli] [de:hypothetical 30.4 kd protein in manz-cspc intergenic region (or30)] [sp:p36999] [db:swissprot] |
| 13877267_f1_14 | 284 | 2887 | 1242 | 413 | 607 | 2.80E-59 | [ac:q47866] [gn:ftsw] [or:enterococcus hirae] [de:probable cell division protein ftsw] [sp:q47866] [db:swissprot] |
| 13881575_c1_72 | 285 | 2888 | 1512 | 503 | 119 | 0.00026 | [ac:b544971] [pn:surface membrane protein p26 precursor] [or:babesia rodhaini] [db:pir] |
| 13883507_c3_84 | 286 | 2889 | 222 | 73 | 71 | 0.064 | [ac:s16652] [pn:hypothetical protein 223] [or:escherichia coli] [db:pir] |
| 13884438_f2_5 | 287 | 2890 | 258 | 85 | 125 | 1.20E-07 | [1n:tu2ciprsr] [ac:126219] [pn:repressor protein] [gn:ci] [or:bacteriophage tuc2O09] [sr:bacteriophage tuc2009 dna] [db:genpept-phg] [de: bacteriophage tuc2O09 repressor protein (ci) gene, complete cds.] [le:1] [re:861] [di:direct] |
| 13884711_f1_1 | 288 | 2891 | 243 | 80 | 144 | 3.20E-10 | [ac:c69880] [pn:conserved hypothetical protein ylqc] [gn:ylqc] [or:bacillus subtilis] [db:pir] |
| 13953467_f1_2 | 289 | 2892 | 441 | 146 | 387 | 5.70E-36 | [ac:d70065] [pn:hydroxymyristoyl-(acyl carrier protein) de homolog ywpb] [gn:ywpb] [or:bacillus subtilis] [db:pir] |
| 13961062_c3_85 | 290 | 2893 | 564 | 187 | 458 | 1.70E-43 | [ac:p28368] [gn:yvyd] [or:bacillus subtilis] [sp:p28368] [db:swissprot] |
| 14068965_f1_1 | 291 | 2894 | 837 | 278 | 457 | 2.20E-43 | [ac:e69864] [pn:myo-inositol-1(or 4)-monophosphatase homolog yktc] [gn:yktc] [or:bacillus subtilis] [db:pir] |
| 14074087_c2_113 | 292 | 2895 | 966 | 321 | 854 | 1.90E-85 | [1n:shu75349] [accu75349] [pn:putative abc transporter shic] [de:serpulina hyodysenteriae] [db:genpept-bct] [de:serpulina hyodysenteriae shi operon, periplasmic iron-bindingproteins shia and shib, putative abc transporter shic, and putativepermeases shid |
| 1409437_c2_26 | 293 | 2896 | 315 | 104 | 64 | 0.092 | [ac:p4273] [pn:lytb protein] [gn:lytb] [or:campylobacter jejuni] [db:pir] |
| 14095953_c2_185 | 294 | 2897 | 1194 | 397 | 82 | 0.57 | [ac:p56005] [gn:ffh:hp1152] [or:helicobacter pylori] [sr:campylobacter pylori] [de:signal recognition particle.protein (fifty-four homolog)] [sp:p56005] [db:swissprot] |
| 1411416_f1_1 | 295 | 2898 | 1095 | 364 | 538 | 5.70E-52 | [ac:p14940] [gn:adh] [or:alcaligenes eutrophus] [de:alcohol dehydrogenase,] [sp:p14940] [db:swissprot] [ec:1.1.1.1] |
| 1412583_c1_9 | 296 | 2899 | 252 | 83 | 79 | 0.015 | [1n:cec47a10] [ac:z81484] [pn:c47a10.2] [or:caenorhabditis elegans] [de:caenorhabditis elegans cosmid c47a10, complete sequence.] [le:9360:9843:10577] [re:9669:10261:10792] [di:direct:join] |
| 14141468_f3_11 | 297 | 2900 | 801 | 266 | 443 | 6.60E-42 | [ac:p18579:p16669:p37581] [gn:murb] [or:bacillus subtilis] [de:acetylmuramate dehydrogenase)] [sp:p18579:p16669:p37581] [db:swissprot] |
| 14142167_c1_84 | 298 | 2901 | 210 | 69 | 55 | 0.08 | [1n:cp07244] [accu07244] [pn:nadh dehydrogenase subunit 2] [or:chalinochromis popeleni] [sr:chalinochromis popeleni] [db:genpept-vrt] [de:chalinochromis popeleni t4a mitochondrion nadh dehydrogenasesubunit 2 gene, completecds.] [le:1] [re: |
| 14142175_f3_32 | 299 | 2902 | 219 | 72 | 68 | 0.071 | [1n:bbu45424] [acu45424] [gn:rep-] [or:borrelia burgdorferi] [sr:lyme disease spirochete strain=297] [db:genpept-bct] [de:borrelia burgdorferi 2.9-4 locus, orf-c gene, partial cds, orf-d,rep+, rep-, and lipoprotein (lp) genes, complete cds.] [nt:minus st |
| 14145687_c3_39 | 300 | 2903 | 1377 | 458 | 1695 | 1.40E-174 | [ac:ab000830] [ac:ab000830] [pn:alpha-amylase precursor] [or:streptococcus bovis] [sr:streptococcus bovis (strain:148) dna] [db:genpept-bct] [de:streptococcus bovis gene for alpha-amylase, partial cds.] [nt:intracellular alpha-amylase precursor] [le:<669] |
| 14127841_f1_1 | 301 | 2904 | 1536 | 511 | 898 | 4.00E-90 | [ac:p13522] [gn:scrb] [or:streptococcus mutans] [ec:3.2.1.26] [de:sucrose-6-phosphate hydrolase, (sucrase) (invertase)] [sp:p13522] [db:swissprot] |
| 14220052_c3_63 | 302 | 2905 | 1650 | 549 | 1913 | 1.10E-197 | [ac:e69861] [pn:abc transporter (atp-binding protein) homolog ykpa] [gn:ykpa] [or:bacillus subtilis] [db:pir] |

TABLE 2-continued

| Orf | NT Seq ID | AA Seq ID | NT Orf Length | AA Orf Length | Score | Probability | Description |
|---|---|---|---|---|---|---|---|
| 14223451_f3_31 | 303 | 2906 | 270 | 89 | 121 | 8.80E-08 | [ac:b30868] [pn:hypothetical protein 1 (insertion sequence is861)] [gn:is861-orf1] [or:streptococcus agalactiae] [db:pir] |
| 14226375_c3_23 | 304 | 2907 | 219 | 72 | 57 | 0.2 | [ac:f69774] [pn:transposon protein homolog ydcq] [gn:ydcq] [or:bacillus subtilis] [db:pir] |
| 14226377_c2_71 | 305 | 2908 | 384 | 127 | 58 | 0.46 | [ln:lmu58160] [acu58160] [gn:mhc class i] [or:lepidodactylus moestus] [db:genpept-vrt] [de:lepidodactylus moestus mhc class i mrna, peptide binding region alpha-2 domain, partial cds.] [nt:encodes peptide binding region alpha-2 domain] [le:<1] [re:] |
| 14230313_c1_26 | 306 | 2909 | 885 | 294 | 1364 | 1.70E-139 | [ln:sput09239] [acu09239] [pn:glucose-1-phosphate thymidyl transferase] [gn:cps19f] [or:streptococcus pneumoniae] [db:genpept-bct] [de:streptococcus pneumoniae type 19f capsular polysaccharidebiosynthesis operon, (cps19fabcdefghijklmno) genes, complete cds.] |
| 14242842_c1_27 | 307 | 2910 | 822 | 273 | 798 | 1.60E-79 | [ac:p46354] [gn:deod/pnp] [or:bacillus subtilis] [ec:2.4.2.1] [de(pnp)] [sp:p46354] [db:swissprot] |
| 14257963_c1_20 | 308 | 2911 | 201 | 66 | 222 | 1.70E-18 | [ac:p37807] [gn:rpmb] [or:bacillus subtilis] [de:50s ribosomal protein 128] [sp:p37807] [db:swissprot] |
| 14258567_c3_73 | 309 | 2912 | 1548 | 515 | 2041 | 3.10E-211 | [ln:efu94356] [acu94356] [pn:glycerol kinase] [gn:glpk] [or:enterococcus faecalis] [db:genpept-bct] [de:enterococcus faecalis glycerol kinase (glpk) gene, complete cds.] [nt:atp-dependent glycerol kinase] [le:17] [re:15221] [di:direct] |
| 14259687_c2_199 | 310 | 2913 | 207 | 68 | 72 | 0.042 | [ln:cet24b8] [acz68338] [pn:t24b8.6] [or:caenorhabditis elegans] [db:genpept-inv] [de:caenorhabditis elegans cosmid t24b8, complete sequence.] [nt:protein predicted using genefinder; similarity to] [le:35567:36199:36888] [re:35662:36396:37205] [di:direct] |
| 14301576_c3_40 | 311 | 2914 | 270 | 89 | 135 | 2.90E-09 | [ac:b30868] [pn:hypothetical protein 1 (insertion sequence is861)] [gn:is861-orf1] [or:streptococcus agalactiae] [db:pir] |
| 14301577_c3_106 | 312 | 2915 | 573 | 190 | 422 | 1.10E-39 | [ac:b30868] [pn:hypothetical protein 1 (insertion sequence is861)] [gn:is861-orf1] [or:streptococcus agalactiae] [db:pir] |
| 14301577_c3_43 | 313 | 2916 | 192 | 63 | 62 | 0.34 | [ln:ae001137] [ac:ae001137:ae000783] [pn:b. burgdorferi predicted coding region bb0265] [gn:bb0265] [or:borrelia burgdorferi] [sr:lyme disease spirochete] [db:genpept-bct] [de:borrelia burgdorferi (section 23 of 70) of the complete genome,] [nt:hypothetic |
| 14303400_c3_117 | 314 | 2917 | 2787 | 928 | 273 | 4.30E-22 | [ac:c69477] [pn:hypothetical protein af1820] [or:archaeoglobus fulgidus] [db:pir] |
| 14329062_f3_20 | 315 | 2918 | 798 | 265 | 286 | 1.10E-31 | [ln:humorf006] [ac:d38552] [gn:kiaa0073] [or:homo sapiens] [sr:homo sapiens male myeloblast cell-line kg-1 cdna to mrna] [db:genpept-pri2] [de:human mrma for kiaaOO73 gene, partial cds.] [nt:the ha1539 protein is related to cyclophilin.] [le:<1] [re:1939] |
| 14329687_c2_73 | 316 | 2919 | 504 | 167 | 417 | 3.80E-39 | [ac:s52544] [pn:is12 protein] [or:lactobacillus helveticus] [db:pir] |
| 14351463_f3_39 | 317 | 2920 | 468 | 155 | 202 | 1.90E-15 | [ac:p50360] [gn:y4hp] [or:rhizobium sp] [sr:ngr234,] [de:hypothetical 61.7 kd protein y4hp] [sp:p50360] [db:swissprot] |
| 14353302_f2_7 | 318 | 2921 | 336 | 111 | 56 | 0.52 | [ln:bmu46757] [acu46757] [pn:p74] [gn:p74] [or:bomyx mori nuclear polyhedrosis virus] [sr:bomyx mori nuclear polyhedrosis virus strain=bangalore (bgl)] [db:genpept-vrl] [de:bombyx mori nuclear polyhedrosis virus p26 (p26) and p7.5 (p10)genes, complete |
| 1442212_f2_8 | 319 | 2922 | 309 | 102 | 63 | 0.12 | [ln:mgu02228] [acu02228] [pn:unknown] [fn:unknown] [or:mycoplasma genitalium] [db:genpept-bct] [de:mycoplasma genitalium random genomic clone xa9, partial cds.] [le:73] [re:304] [di:complement] |
| 14458518_c2_89 | 320 | 2923 | 1212 | 403 | 1556 | 7.60E-160 | [ac:p96993] [gn:galk] [or:streptococcus mutans] [ec:2.7.1.6] [de:galactokinase,] [sp:p96993] [db:swissprot] |
| 14460312_f1_4 | 321 | 2924 | 234 | 77 | 65 | 0.1 | [ac:p06859] [or:trimeresurus flavoviridis] [sr:.habu] [ec:3.1.1.4] [de:(phosphatidylcholine 2-acylhydrolase)] [sp:p06859] [db:swissprot] |
| 14460965_c2_25 | 322 | 2925 | 801 | 266 | 1165 | 2.10E-118 | [ln:af030373] [ac:af030373] [pn:cpsb] [gn:cpsb] [or:streptococcus pneumoniae] [db:genpept-bct] [de:streptococcus pneumoniae strain sp-264 alpha, 1-6-glucosidase(dexb) gene, partial cds; putative regulatory protein (cpsa) andcpsb (cpsb) |

TABLE 2-continued

| Orf | NT Seq ID | AA Seq ID | NT Orf Length | AA Orf Length | Score | Probability | Description |
|---|---|---|---|---|---|---|---|
| 14472557_c2_13 | 323 | 2926 | 948 | 315 | 1082 | 1.30E-109 | genes, complete cds [ac:q07637] [gn:pyk] [or:lactococcus lactis] [sr,subsplactis:streptococcus lactis] [ec:2.7.1.40] [de:pyruvate kinase,] [sp:q07637] [db:swissprot] |
| 14447812_f3_17 | 324 | 2927 | 243 | 80 | 180 | 4.90E-14 | [ac:p37545] [gn:yabd] [or:bacillus subtilis] [de:hypothetical 29.2 kd protein in mets-ksga intergenic region] [sp:p37545] [db:swissprot] |
| 14448437_f3_31 | 325 | 2928 | 1266 | 421 | 1397 | 7.30E-152 | [ac:q02145] [gn:ilva] [or:lactococcus lactis] [sr,subsplactis:streptococcus lactis] [ec:4.2.1.16] [de:deaminase] [sp:q02145] [db:swissprot] |
| 14485036_f1_4 | 326 | 2929 | 201 | 66 | 59 | 0.28 | [ln:s4406806] [acs:s44109] [gn:2c/3a] [or:hepatitis a virus] [sr:hepatitis a virus lsh/s] [db:genpept-vr1] [devyp1 . . . 3c/3d [hepatitis a virus hav, lsh/s, genomic, 6 genes, 293nt, segment 6 of 7.] [nt:this sequence comes from FIG. 3. author-given] [le:1] [-] |
| 14485908_f1_1 | 327 | 2930 | 345 | 114 | 276 | 3.30E-24 | [ac:p14949] [gn:trxa:trx] [or:bacillus subtilis] [de:thioredoxin (trx)] [sp:p14949] [db:swissprot] |
| 14486437_c2_31 | 328 | 2931 | 537 | 178 | 262 | 3.40E-22 | [ac:p11990] [gn:ply] [or:streptococcus pneumoniae] [de:pneumolysin (thiol-activated cytolysin)] [sp:p11990] [db:swissprot] |
| 14449063_f1_3 | 329 | 2932 | 471 | 156 | 773 | 7.10E-77 | [ln:spu43526] [acu43526] [or:streptococcus pneumoniae] [db:genpept-bct] [de:streptococcus pneumoniae neuraminidase b (nanb) gene, complete cds,and neuraminidase (nana) gene, partial cds.] [nt:orf-1] [le:1480] [di:direct] |
| 14532630_c3_42 | 330 | 2933 | 240 | 79 | 96 | 3.90E-05 | [ln:cet01b7] [acz66499] [pn:t01b7.8] [or:caenorhabditis elegans] [db:genpept-inv] [de:caenorhabditis elegans cosmid t01b7, complete sequence,] [le:25192:25559:25822] [re:25417:25767:25881] [di:complementjoin] |
| 14532813_f2_13 | 331 | 2934 | 669 | 222 | 323 | 3.40E-29 | [ac:a69988] [pn:conserved hypothetical protein ytag] [gn:ytag] [or:bacillus subtilis] [db:pir] |
| 14537557_f2_5 | 332 | 2935 | 414 | 137 | 128 | 2.50E-07 | [ac:p43752] [gn:nrdd:hi0075] [or:haemophilus influenzae] [ec:1.17.4.2] [de:anaerobic ribonucleoside-triphosphate reductase,] [sp:p43752] [db:swissprot] |
| 14542337_c3_136 | 333 | 2936 | 639 | 212 | 510 | 5.30E-49 | [ln:shu75349] [acu75349] [pn:putative permease.shid] [de:serpulina hyodysenteriae shi operon, periplasmic-iron-bindingproteins shia and shib, putative abc transporter shic, and putativepermeases shid and shi [db:genpept-bct] |
| 14554687_f3_37 | 334 | 2937 | 792 | 263 | 304 | 3.90E-26 | [ac:p32399] [gn:yhge] [or:bacillus subtilis] [de:hypothetical 84.1 kd protein in hemy-gltt intergenic region (orfb)] [sp:p32399] [db:swissprot] |
| 14456517_c1_165 | 335 | 2938 | 219 | 72 | 52 | 0.38 | [ac:p19030] [gn:env] [or:feline immunodeficiency virus] [sr:isolate san diegofiv] [de:gp100 and gp-36]] [sp:p19030] [db:swissprot] |
| 14586692_c1_18 | 336 | 2939 | 1377 | 458 | 2436 | 4.20E-253 | [ac:p29851] [gn:malm] [or:streptococcus pneumoniae] [ec:2.4.1.25] [de:(disproportionating enzyme) (d-enzyme)] [sp:p29851] [db:swissprot] |
| 14459437_f1_42 | 337 | 2940 | 198 | 65 | 58 | 0.34 | [ac:q03440] [gn:caad] [or:bacillus ps3] [sr:thermophilic bacterium ps-3] [ec:1.9.3.1] [de:subunit 4b]] [sp:q03440] [db:swissprot] |
| 14625378_c2_25 | 338 | 2941 | 480 | 159 | 136 | 8.50E-09 | [ln:u91581] [acu91581:u04057] [fn:unknown] [or:lactococcus lactis lactis] [db:genpept-bct] [de:lactococcus lactis lactis lacticin 481 operon, preprolacticin 481(lcta), lctm (lctm), lctt (lctt), lctf (lctf), lcte (lcte), andlctg (lctg) genes, complete cds |
| 14627263_c1_11 | 339 | 2942 | 357 | 118 | 319 | 9.20E-29 | [ac:q08352] [gn:ald:spovn] [or:bacillus subtilis] [ec:1.4.1.1] [de:alanine dehydrogenase, (stage v sporulation protein n)] [sp:q08352] [db:swissprot] |
| 14636303_c1_10 | 340 | 2943 | 375 | 124 | 372 | 2.20E-34 | [ac:p05657] [gn:rpma] [or:bacillus subtilis] [de:50s ribosomal protein 127 (b130) (b124)] [sp:p05657] [db:swissprot] |
| 14641917_f2_34 | 341 | 2944 | 2421 | 806 | 1677 | 1.10E-172 | [ac:s57636:s65957] [pn:5-methyltetrahydropteroyltriglutamate--homocysteine s-methyltransferase,:cobalamin-independent methionine synthase:tetrahydropteroylglutamate methyltransferase:cobalamin-independent methionine synthase:tetrahydropteroylglutamate met |
| 14642885_f1_3 | 342 | 2945 | 1611 | 536 | 512 | 3.20E-49 | [ln:ae001183] [ac:ae000783] [pn:conserved hypothetical integral membrane] [gn:bb0843] [or:borrelia burgdorferi] [sr:lyme disease spirochete] [db:genpept-bct] |

TABLE 2-continued

| Orf | NT Seq ID | AA Seq ID | NT Orf Length | AA Orf Length | Score | Probability | Description |
|---|---|---|---|---|---|---|---|
| 14644437_f1_1 | 343 | 2946 | 225 | 74 | 96 | 3.90E-05 | [de:borrelia burgdorferi (section 69 of 70) of the complete genome.] [nt:similar to gb:1] [ln:spz82001] [ac:z82001] [pn:unknown] [or:streptococcus pneumoniae] [db:genpept-bct] [de:s.pneumoniae pcpa gene and open reading frames.] [le:<1] [re: 174] [di: :direct] |
| 14647627_f1_4 | 344 | 2947 | 363 | 120 | 495 | 2.00E-47 | [ln:spz82001] [ac:z82001] [pn:unknown] [or:streptococcus pneumoniae] [db:genpept-bct] [de:s.pneumoniae pcpa gene and open reading frames.] [le:396] [re:671] [di:direct] |
| 14648452_f2_9 | 345 | 2948 | 1926 | 641 | 2987 | 0 | [ln:spz82001] [ac:z82001] [pn:pepa] [gn:pepa] [or:streptococcus pneumoniae] [db:genpept-bct] [de:s.pneumoniae pcpa gene and open reading frames.] [nt:the n-terminal domain of pepa is similar to] [le:2064] [re:4190] [di:direct] |
| 14649015_c2_12 | 346 | 2949 | 483 | 160 | 180 | 5.60E-13 | [ln:sc7b7] [ac:a1009199] [pn:hypothetical atp/gtp binding protein] [gn:sc7b7.01c] [or:streptomyces coelicolor] [db:genpept-bct] [de:streptomyces coelicolor cosmid 7b7.] [nt:sc7b7.01c, unknown atp/gtp binding protein, partial] [le:<1] [re:1878] [di:complem] |
| 14649018_f1_2 | 347 | 2950 | 1965 | 654 | 1093 | 8.80E-111 | [ac:h69626] [pn:pts fructose-specific enzyme iibc component frua] [gn:frua] [or:bacillus subtilis] [db:pir] |
| 14649062_c1_45 | 348 | 2951 | 249 | 82 | 157 | 1.30E-11 | [ln:spz82001] [ac:z82001] [pn:unknown] [or:streptococcus pneumoniae] [db:genpept-bct] [de:s.pneumoniae pcpa gene and open reading frames.] [le:<1] [re:174] [di:direct] |
| 14650312_c1_58 | 349 | 2952 | 396 | 131 | 62 | 0.2 | [ac:q59450] [gn:rpme] [or:haemophilus ducreyi] [de:50s ribosomal protein 131] [sp:q59450] [db:swissprot] |
| 14651712_f3_25 | 350 | 2953 | 384 | 127 | 534 | 1.50E-51 | [ac:p12875] [gn:rpln] [or:bacillus subtilis] [de:50s ribosomal protein 114] [sp:p12875] [db:swissprot] |
| 14656952_f3_10 | 351 | 2954 | 213 | 70 | 83 | 0.00011 | [ac:p51241] [gn:ycf16] [or:porphyra purpurea] [de:probable atp-dependent transporter ycf16] [sp:p51241] [db:swissprot] |
| 14657877_c3_12 | 352 | 2955 | 447 | 148 | 245 | 6.40E-21 | [ac:s76382:s77050] [pn:hypothetical protein] [or:synechocystis sp.] [sr:pcc 6803, pcc 6803] [db:pir] |
| 14657877_f2_4 | 353 | 2956 | 249 | 82 | 138 | 1.40E-09 | [ac:75211] [pn:transposase:protein sll1930:protein sll1930] [or:synechocystis sp.] [sr:pcc 6803, pcc 6803] [db:pir] |
| 14661002_c2_82 | 354 | 2957 | 447 | 148 | 243 | 1.00E-20 | [ac:s76382:s77050] [pn:hypothetical protein] [or:synechocystis sp.] [sr:pcc 6803, pcc 6803] [db:pir] |
| 14661002_c3_85 | 355 | 2958 | 450 | 149 | 239 | 2.70E-20 | [ac:s76382:s77050] [pn:hypothetical protein] [or:synechocystis sp.] [sr:pcc 6803, pcc 6803] [db:pir] |
| 14664135_f2_26 | 356 | 2959 | 708 | 235 | 146 | 8.80E-09 | [ln:ae001161] [ac:ae001161:ae000783] [pn:b. burgdorferi predicted coding region bb0592] [gn:bb0592] [or:borrelia burgdorferi] [sr:lyme disease spirochete] [db:genpept-bct] [de:borrelia burgdorferi (section 47 of 70) of the complete genome,] [nt:hypothe tic |
| 14664638_f2_1 | 357 | 2960 | 1077 | 358 | 325 | 4.30E-32 | [ac:h69762] [pn:two-component sensor histidine kinase [ycl homolog yclk] [gn:yclk] [or:bacillus subtilis] [db:pir] |
| 14665887_f3_6 | 358 | 2961 | 300 | 99 | 192 | 2.60E-15 | [ac:p54510] [gn:yqhl] [or:bacillus subtilis] [de:hypothetical 14.6 kd protein in gvt-spoiiiaa intergenic region] [sp:p54510] [db:swissprot] |
| 14667267_f2_25 | 359 | 2962 | 1020 | 339 | 1008 | 8.90E-102 | [ac:q02000] [gn:trpd] [or:lactococcus lactis] [sr:subsplactis:streptococcus lactis] [cc:2.4.2.18] [de:anthranilate phosphoribosyltransferase,] [sp:q02000] [db:swissprot] |
| 14730012_f1_6 | 360 | 2963 | 585 | 194 | 574 | 8.70E-56 | [ac:q02003] [gn:trpg] [or:lactococcus lactis] [sr:subsplactis:streptococcus lactis] [ec:4.1.3.27] [de:transferase)] [sp:q02003] [db:swissprot] |
| 14730300_f1_2 | 361 | 2964 | 2667 | 888 | 2946 | 0 | [ac:q05873] [gn:vals] [or:bacillus subtilis] [ec:6.1.1.9] [de:valyl-trna synthetase, (vaiine-trna ligase) (valrs)] [sp:q05873] [db:swissprot] |
| 14730343_f1_8 | 362 | 2965 | 939 | 312 | 117 | 0.00013 | [ac:p44018] [gn:hi0585] [or:haemophilus influenzae] [de:hypothetical protein hi0585] [sp:p44018] [db:swissprot] |
| 14740652_f3_13 | 363 | 2966 | 1047 | 348 | 98 | 0.033 | [ln:llabihgen] [ac:x97651] [gn:abih] [or:lactococcus lactis] [db:genpept-bct] [de:l.lactis abih gene.] [nt:abortive phage resistance mechanism] [le:1095] [re:2135] [di:direct] |
| 14742938_c2_29 | 364 | 2967 | 783 | 260 | 631 | 7.90E-62 | [ac:p30293] [gn:ilvg:livf] [or:salmonella typhimurium] [de:ilvg (liv-i protein g)] [sp:p30293] [db:swissprot] |
| 14742942_c3_133 | 365 | 2968 | 792 | 263 | 299 | 2.00E-45 | [ac:a69431] [pn:pyruvate formate-lyase2 activating enzyme (pflc) homolog] |

TABLE 2-continued

| Orf | NT Seq ID | AA Seq ID | NT Orf Length | AA Orf Length | Score | Probability | Description |
|---|---|---|---|---|---|---|---|
| 14812883_c1_6 | 366 | 2969 | 828 | 275 | 950 | 1.20E-95 | [or:archaeoglobus fulgidus] [db:pir] |
| 14844191_c2_71 | 367 | 2970 | 453 | 150 | 120 | 4.50E-97 | [ac:p45872] [gn:prfa] [or:bacillus subtilis] [de:peptide chain release factor 1 (rf-1)] [sp:p45872] [db:swissprot] |
| 14844427_f1_4 | 368 | 2971 | 744 | 247 | 635 | 3.00E-62 | [ac:p49330] [gn:rgg] [or:streptococcus gordonii challis] [de:rgg protein] [sp:p49330] [db:swissprot] |
| 14845252_f1_2 | 369 | 2972 | 462 | 153 | 131 | 3.80E-08 | [ac:p46339] [gn:yqgh] [or:bacillus subtilis] [de:region (orf72)] [sp:46339] [db:swissprot] |
| 14845252_f3_23 | 370 | 2973 | 258 | 85 | 64 | 0.7 | [ac:q08695] [gn:mst101(1)] [or:drosophila hydei] [sr:fruit fly] [de:axoneme-associated protein mst101(1)] [sp:q08695] [db:swissprot] |
| 14849093_c1_23 | 371 | 2974 | 294 | 97 | 147 | 1.50E-10 | [ac:js0722] [pn:cytochrome p450 alk4, alkane-inducible] [gn:alk4] [cl:cytochrome p450] [or:candida maltosa] [db:pir] |
| 14849093_c1_43 | 372 | 2975 | 294 | 97 | 147 | 1.50E-10 | [ln:mtcgnme] [ac:z47547] [gn:putative orf79.1] [fn:unknown] [or:mitochondrion chondrus crispus] [sr:carragheen] [db:genpept-pln] [de:c.crispus complete mitochondrial genome.] [nt:unique orf] [le:5713] [re:5952] [di:direct] |
| 14849093_c2_37 | 373 | 2976 | 294 | 97 | 147 | 1.50E-10 | [ln:mtcgnme] [ac:z47547] [gn:putative orf79.1] [fn:unknown] [or:mitochondrion chondrus crispus] [sr:carragheen] [db:genpept-pln] [de:c.crispus complete mitochondrial genome.] [nt:unique orf] [le:5713] [re:5952] [di:direct] |
| 14849093_c3_31 | 374 | 2977 | 294 | 97 | 147 | 1.50E-10 | [ln:mtcgnme] [ac:z47547] [gn:putative orf79.1] [fn:unknown] [or:mitochondrion chondrus crispus] [sr:carragheen] [db:genpept-pln] [de:c.crispus complete mitochondrial genome.] [nt:unique orf] [le:5713] [re:5952] [di:direct] |
| 14850633_c2_51 | 375 | 2978 | 237 | 78 | 37 | 0.12 | [ln:mmu29078] [ac:u29078] [pn:t-cell antigen-receptor beta chain v beta 8.1] [or:mus musculus] [sr:house mouse] [db:genpept-rod] [de:mus musculus clone b6-8-6 v beta 8.1 t-cell antigen-receptor betachain mrna, partial cds.] [le:<1] [re: |
| 14853437_c1_50 | 376 | 2979 | 738 | 245 | 363 | 2.00E-33 | [ac:s70678] [pn:bpl protein] [gn:bplg] [or:bordetella pertussis] [db:pir] |
| 14865702_c3_27 | 377 | 2980 | 186 | 61 | 162 | 4.00E-12 | [ln:spnana] [ac:x72967] [or:streptococcus pneumoniae] [db:genpept-bct] [de:s.pneumoniae nana gene.] [nt:orf2] [le:193] [re:495] [di:direct] |
| 14867137_c1_25 | 378 | 2981 | 1002 | 333 | 895 | 8.40E-90 | [ac:b70015] [pn:thioredoxin reductase homolog yume] [gn:yume] [or:bacillus subtilis] [db:pir] |
| 14867262_f3_20 | 379 | 2982 | 270 | 89 | 124 | 4.20E-08 | [ac:b30868] [pn:hypothetical protein 1 (insertion sequence is861)] [gn:is861-orf I] [or:streptococcus agalactiae] [db:pir] |
| 14867302_c2_31 | 380 | 2983 | 294 | 97 | 63 | 0.9 | [ln:atu90439] [ac:u90439] [gn:t06d20.6] [or:arabidopsis thaliana] [sr:thale cress] [db:genpept-pln] [de:arabidopsis thaliana chromosome ii bac t06d20 genomic sequence,complete sequence.] [nt:fmrfamide precursor isolog] [le:16754] [re:17173] [di:direct] |
| 14867802_f2_9 | 381 | 2984 | 384 | 127 | 78 | 0.16 | [ln:dbrapoliaa] [ac:125278] [pn:apolipophorin-iii] [or:derobrachus geminatus] [sr:derobrachus geminatus cdna to mrna] [db:genpept-inv] [de:derobrachus geminatus apolipophorin-iii mrna, 3' end.] [le:<1] [re:570] [di:direct] |
| 14875150_f3_14 | 382 | 2985 | 411 | 136 | 159 | 2.60E-11 | [ac:q30286;s06431:a64943] [pn:phosphotransferase system enzyme ii,, mannose-specific, factor iii:mannose permease, factor iii:phosphotransferase system enzyme ii-a, mannose-specific:phosphotransferase system enzyme iii, mannose-specific:protein-npi-phosph |
| 14867507_c3_121 | 383 | 2986 | 456 | 151 | 90 | 0.049 | [ac:p74635] [gn:slr0753] [or:synechocystis sp] [sr:pcc 6803,] [de:hypothetical 48.0 kd protein slr0753] [sp:p74635] [db:swissprot] |
| 14876687_f3_4 | 384 | 2987 | 2751 | 916 | 849 | 5.20E-167 | [gn:pacl] [or:synechocystis sp.] [sr:pcc 6803,, pcc 6803] [ec:3.6.1.-] [db:pir] |

TABLE 2-continued

| Orf | NT Seq ID | AA Seq ID | NT Orf Length | AA Orf Length | Score | Probability | Description |
|---|---|---|---|---|---|---|---|
| 14880087_f2_8 | 385 | 2988 | 705 | 234 | 293 | 5.20E-26 | [ln:d88121] [ac:d88121] [pn:cprd12 protein] [or:vigna unguiculata] [sr:vigna unguiculata one-month-old cdna to mrna] [dbgenpept-pln] [de:vigna unguiculata mrna for cprd12 protein, complete cds.] [le:76] [rc:879] [di:direct] |
| 14881563_f3_8 | 386 | 2989 | 534 | 177 | 469 | 1.20E-44 | [ac:h69334] [pn:glutamine abc transporter, atp-binding protein (glnq) homolog] [or:archaeoglobus fulgidus] [db:pir] |
| 14881692_c1_23 | 387 | 2990 | 1491 | 496 | 682 | 3.10E-67 | [ac:q42598] [gn:thrc] [or:arabidopsis thaliana] [sr:mouse-ear cress] [ec:4.2.99.2] [de:threonine synthase,] [sp:q42598] [db:swissprot] |
| 14882950_f1_4 | 388 | 2991 | 303 | 100 | 55 | 0.58 | [ln:bmophbrc] [ac:d38443] [pn:br-c homologue] [or:bombyx mori] [sr:bombyx mori (strain:daizo) day 4 third instar fat body cdna t] [db:genpept-inv] [de:silkworm mrna for br-c homologue, partial cds.] [le:<1] [re: |
| 14890687_c3_29 | 389 | 2992 | 822 | 273 | 502 | 3.70E-48 | [ac:a69756] [pn:adhesion protein homolog ycdh] [gn:ycdh] [or:bacillus subtilis] [db:pir] |
| 14929776_f2_4 | 390 | 2993 | 963 | 321 | 99 | 0.094 | [ac:p47047] [gn:mtr4:yj1050w;j1158] [or:saccharomyces cerevisiae] [sr:baker's yeast] [de:mrna transport regulator mtr4] [sp:p47047] [db:swissprot] |
| 14932701_f2_10 | 391 | 2994 | 747 | 248 | 550 | 3.00E-53 | [ln:af001926] [ac:af001926] [pn:xylan esterase 1] [gn:axe1] [or:thermoanaerobacterium sp. 'jw/sl ys485'] [de:thermoanaerobacterium sp. jw/sl ys485' beta-xylosidase (xylb) andxylan esterase 1 (axe1) genes, complete cds.) [le:1788] [re:275 |
| 14957812_f3_5 | 392 | 2995 | 210 | 69 | 71 | 0.27 | [ac:p36033] [gn:fre2;ykl220c] [or:saccharomyces cerevisiae] [sr:baker's yeast] [de:ferric reductase transmembrane component 2 precursor] [sp:p36033] [db:swissprot] |
| 14960402_f2_1 | 393 | 2996 | 1566 | 521 | 95 | 0.26 | [ac:q60181] [gn:rpob1.mj1041] [or:methanococcus jannaschii] [ec:2.7.7.6] [de:dna-directed rna polymerase subunit b',) [sp:q60181] [db:swissprot] |
| 14962788_f2_21 | 394 | 2997 | 1014 | 337 | 424 | 6.80E-40 | [ac:h69162] [pn:conserved hypothetical protein mth48] [gn:mth48] [or:methanobacterium thermoautotrophicum] [db:pir] |
| 14968783_c3_5 | 395 | 2998 | 606 | 201 | 240 | 2.20E-20 | [ac:e69826] [pn:1-acylglycerol-3-phosphate o-acyltransfera homolog yhdo] [gn:yhdo] [or:bacillus subtilis] [db:pir] |
| 15016562_f1_7 | 396 | 2999 | 798 | 265 | 810 | 8.50E-81 | [ac:q01999] [gn:trpc] [or:lactococcus lactis] [sr:subsplactis:streptococcus lactis] [cc:4.1.1.48] [de:indole-3-glycerol phosphate synthase, (igps)] [sp:q01999] [db:swissprot] |
| 15032817_c2_26 | 397 | 3000 | 2292 | 763 | 1053 | 7.30E-152 | [ln:ecoglgpa] [ac:j03966] [or:escherichia coli] [sr:e.coli dna] [db:genpept-bct] [de:e.coli glgp gene encoding alpha-glucan phosphorylase, complete cds.] [nt:alpha-glucan phosphorylase (ec 2.4.1.1)] [le:61] [re:2490] [di:direct] |
| 15032962_c2_40 | 398 | 3001 | 1182 | 393 | 748 | 3.20E-74 | [ac:q08432] [gn:patb] [or:bacillus subtilis] [ec:2.6.1.-] [de:putative aminotransferase b,] [sp:q08432] [db:swissprot] |
| 15037512_c1_16 | 399 | 3002 | 288 | 95 | 63 | 0.71 | [ac:s43481] [pn:maturase homolog] [or:escherichia coli] [db:pir] |
| 15039700_c3_56 | 400 | 3003 | 1041 | 346 | 158 | 5.30E-09 | [ac:p39346] [gn:yjgv] [or:escherichia coli] [de:intergenic region] [sp:p39346] [db:swissprot] |
| 15041062_f1_6 | 401 | 3004 | 1116 | 371 | 645 | 2.60E-63 | [ac:a70019] [pn:opine catabolism homolog yurr] [gn:yurr] [or:bacillus subtilis] [db:pir] |
| 15041592_c1_25 | 402 | 3005 | 636 | 211 | 880 | 3.30E-88 | [ac:q07296] [gn:purc] [or:streptococcus pneumoniae] [ec:6.3.2.6] [de:(saicar synthetase)] [sp:q07296] [db:swissprot] |
| 15042693_f1_2 | 403 | 3006 | 1671 | 556 | 1617 | 2.10E-206 | [ln:ssu35633] [ac:u35633] [pn:dextran glucosidase dexs] [gn:dexs] [or:streptococcus suis] [db:genpept-bct] [de:streptococcus suis dextran glucosidase dexs (dexs) gene, completecds.] [le:372] [re:2000] [di:direct] |
| 15048442_f3_7 | 404 | 3007 | 291 | 96 | 315 | 2.40E-28 | [ac:47154:s11366] [pn:ribosomal protein s16:ribosomal protein bs17] [cl:escherichia coli ribosomal protein s16] [or:bacillus subtilis] [db:pir] |
| 15057811_c1_24 | 405 | 3008 | 219 | 72 | 138 | 1.40E-09 | [ac:q48509] [gn:lafx] [or:lactobacillus johnsonii] [de:bacteriocin lactacin f, subunit lafx precursor] [sp:q48509] [db:swissprot] |
| 15057817_f1_4 | 406 | 3009 | 855 | 284 | 461 | 8.20E-44 | [ac:c69588] [pn:l-arabinose transport (integral membrane protein) araq] [gn:araq] [or:bacillus subtilis] [db:pir] |
| 15078880_c2_18 | 407 | 3010 | 231 | 76 | 71 | 0.034 | [ac:i53641] [pn:mucin] [gn:muc5ac] [or:homo sapiens] [sr:,man] [db:pir] [mp:11p15.5-11p15.5] |

TABLE 2-continued

| Orf | NT Seq ID | AA Seq ID | NT Orf Length | AA Orf Length | Score | Probability | Description |
|---|---|---|---|---|---|---|---|
| 15085936_c3_64 | 408 | 3011 | 402 | 133 | 234 | 9.30E-20 | [ac:p54510] [gn:yqhI] [or:bacillus subtilis] [de:hypothetical 14.6 kd protein in gcvt-spoiiiaa intergenic region] [sp:p54510] [db:swissprot] |
| 15086077_f3_63 | 409 | 3012 | 402 | 133 | 299 | 2.6E-26 | [ac:s68598] [pn:sucrose-6-phosphate hydrolase scrb] [gn:scrb] [or:streptococcus sobrinus] [sr:strain 6715,, strain 6715] [sr:strain 6715,] [db:pir] |
| 15094392_c3_109 | 410 | 3013 | 1410 | 469 | 759 | 2.20E-75 | [ac:p96613] [gn:murf] [or:bacillus subtilis] [ec:6.3.2.15] [de:(d-alanyl-d-alanine-adding enzyme)] [sp:p96613] [db:swissprot] |
| 15102052_c1_56 | 411 | 3014 | 306 | 101 | 65 | 0.41 | [ac:s57388:s50423] [pn:hypothetical protein orf00958] [or:saccharomyces cerevisiae] [db:pir] [mp:151] |
| 15125911_c3_36 | 412 | 3015 | 1104 | 367 | 1337 | 1.20E-136 | [ln:1lu80410] [ac:u80410] [pn:phosphopentomutase] [gn:deob] [or:lactococcus lactis cremoris] [db:genpept-bct] [de:lactococcus lactis cremoris phosphopentomutase (deob) and purinenucleoside phosphorylase (deod) genes, complete cds.] [nt:deob; deob mutant i |
| 156313_f2_23 | 413 | 3016 | 867 | 288 | 225 | 8.40E-19 | [ln:stu40830] [ac:u40830] [pn:epsf] [or:streptococcus thermophilus] [db:genpept-bct] [de:streptococcus thermophilus deod gene, partial cds and epsa, epsb,epsc, epsd, epse, epsf, epsg, epsh, epsi, epsj, epsk, epsl, epsm,orf14.9 protein genes, com |
| 15662763_f3_39 | 414 | 3017 | 309 | 102 | 68 | 0.88 | [ac:p50236] [gn:sta2:ssth2] [or:mus musculus] [sr:,mouse] [sp:p50236] [de:sulfotransferase) (st)] [db:swissprot] |
| 15662843_f1_3 | 415 | 3018 | 1113 | 370 | 86 | 0.4 | [ac:q49412] [gn:mg310] [or:mycoplasma genitalium] [ec:3.1.-.-] [de:putative esterase/lipase 1,] [sp:q49412] [db:swissprot] |
| 15657827_f2_13 | 416 | 3019 | 768 | 255 | 678 | 8.30E-67 | [ln:bacpk] [ac:d13095] [pn:undefined open reading frame] [or:bacillus stearothermophilus] [sr:bacillus stearothermophilus (strain:nca1503) dna] [db:genpept-bct] [de:b. stearothermophilus phosphofructokinase and pyruvate kinasegenes.] [le:<1] [re:963] [di: |
| 15657910_f1_2 | 417 | 3020 | 612 | 203 | 61 | 0.52 | [ln:hscrbp12] [ac:x07437] [pn:cellular retinol binding protein (crbp)] [or:homo sapiens] [sr:human] [db:genpept-pri1] [de:human dna for cellular retinol binding protein (erbp) exons 1 and2.] [sp:p09455] [le:671:1244] [re:743:1422] [di:directjoin] |
| 15660381_f1_8 | 418 | 3021 | 186 | 61 | 52 | 0.031 | [ac:s69320] [pn:probable membrane protein yl:428c:hypothetical protein 19576.3-a] [or:saccharomyces cerevisiae] [db:pir] [mp:12r] |
| 15662712_f3_40 | 419 | 3022 | 1074 | 357 | 710 | 3.40E-70 | [ac:s77268] [pn:hypothetical protein] [or:synechocystis sp.] [sr:pcc 6803,, pcc 6803] [sr:pcc 6803,] [db:pir] |
| 15664702_f3_21 | 420 | 3023 | 873 | 290 | 783 | 6.20E-78 | [ac:p37468] [gn:ksgA] [or:bacillus subtilis] [ec:2.1.1.-] [de:dimethyltransferase)] [sp:p37468] [db:swissprot] |
| 15665881_f3_55 | 421 | 3024 | 852 | 283 | 1149 | 1.00E-116 | [ac:p42361] [or:streptococcus gordonii challis] [de:29 kd membrane protein in psaa 5' region (orf1)] [sp:p42361] [db:swissprot] |
| 15665956_c1_62 | 422 | 3025 | 465 | 154 | 129 | 1.20E-08 | [ac:p42861] [pn:hypothetical protein ykuI] [gn:ykuI] [or:bacillus subtilis] [db:pir] |
| 15673387_f3_15 | 423 | 3026 | 393 | 130 | 207 | 1.40E-16 | [ac:p23861] [gn:potd] [or:escherichia coli] [de:spermidine/putrescine-binding periplasmic protein precursor (spbp)] [sp:p23861] [db:swissprot] |
| 15682680_f1_3 | 424 | 3027 | 222 | 73 | 75 | 0.21 | [ac:a48467] [pn:myosin heavy chain] [cl:myosin heavy chain:myosin head homology] [or:brugia malayi] [db:pir] |
| 15682706_f3_32 | 425 | 3028 | 201 | 66 | 63 | 0.12 | [ac:s74531] [pn:hypothetical protein ss11326] [or:synechocystis sp.] [sr:pcc 6803,, pcc 6803] [db:pir] |
| 15683575_c1_24 | 426 | 3029 | 201 | 66 | 511 | 0.034 | [ln:mmpax4gen] [ac:y09584] [gn:pax-4] [or:mus musculus] [sr:house mouse] [db:genpept-rod] [de:m.musculus pax-4 mrna, partial.] [le:<1] [re: |
| 15683575_c2_38 | 427 | 3030 | 201 | 66 | 51 | 0.034 | [ln:mmpax4gen] [ac:y09584] [gn:pax-4] [or:mus musculus] [sr:house mouse] [db:genpept-rod] [de:m.musculus pax-4 mrna, partial.] [le:<1] [re: |
| 15683575_c3_32 | 428 | 3031 | 249 | 82 | 69 | 0.053 | [ln:fmu60399] [ac:u60399] [pn:envelope glycoprotein e1] [or:fort morgan virus] [db:genpept-vrl] [de:fort morgan virus envelope glycoprotein e1 gene, partial cds.] [le:<1] [re: |

TABLE 2-continued

| Orf | NT Seq ID | AA Seq ID | NT Orf Length | AA Orf Length | Score | Probability | Description |
|---|---|---|---|---|---|---|---|
| 156952_f1_2 | 429 | 3032 | 2928 | 975 | 4577 | 0 | [ln:spnana] [ac:x72967] [pn:neuraminidase] [gn:nana] [or:streptococcus pneumoniae] [db:genpept-bct] [ec:3.2.1.18] [de:s.pneumoniae nana gene.] [le:1239] [re:4346] [di:direct] |
| 15709567_f3_8 | 430 | 3033 | 1968 | 655 | 3338 | 0 | [ac:p18791;p18792] [gn:amia] [or:streptococcus pneumoniae] [de:oligopeptide-binding protein amia precursor] [sp:p18791;p18792] [db:swissprot] |
| 157202_c2_64 | 431 | 3034 | 807 | 268 | 549 | 3.90E-53 | [ac:p44697] [gn:thid;hi0416] [or:haemophilus influenzae] [ec:2.7.4.7] [de:(hmp p kinase)] [sp:p44697] [db:swissprot] |
| 15727067_f2_3 | 432 | 3035 | 927 | 308 | 125 | 4.60E-O5 | [ln:bsu43200] [ac:u43200] [pn:antifreeze glycopeptide afgp polyprotein] [or:boreogadus saida] [db:genpept-vrt] [de:boreogadus saida antifreeze glycopeptide afgp polyprotein precursorgene, complete cds.] [nt:cleavage of polyprotein at conserved |
| 15734632_f1_6 | 433 | 3036 | 207 | 68 | 58 | 0.31 | [ac:s74698] [pn:udp-glucose dehydrogenase;protein slr1299] [sr:pcc 6803,; pcc 6803,] [db:pir] [or:synechocystis sp.] [ac:ae001181;ae000783] [pn:xylose operon regulatory protein (xylr-2)] |
| 15740813_f1_2 | 434 | 3037 | 909 | 302 | 293 | 5.20E-26 | [ln:ae001181] [or:borrelia burgdorferi] [sr:lyme disease spirochete] [db:genpept-bct] [de:borrelia burgdorferi (section 67 of 70) of the complete genome.] [nt:similar to pid |
| 15741566_c2_5 | 435 | 3038 | 204 | 67 | 60 | 0.23 | [ac:s72692] [pn:probable membrane protein q0320] [or:mitochondrion saccharomyces cerevisiae] [db:pir] |
| 15745293_f3_18 | 436 | 3039 | 2385 | 794 | 2020 | 5.10E-209 | [ac:q69584] [pn:alanyl-trna synthetase alas] [n:alas] [or:bacillus subtilis] [db:pir] |
| 157760_c3_17 | 437 | 3040 | 930 | 309 | 808 | 1.40E-80 | [ln:sau92073] [ac:u92073] [pn:macrolide-efflux protein] [gn:mrea] [fn:resistance to 14- and 15-membered macrolides] [or:streptococcus agalactiae] [db:genpept-bct] [de:streptococcus agalactiae macrolide-efflux protein (mrea) gene,complete cds.] [le:119] [r |
| 157778_c3_12 | 438 | 3041 | 603 | 200 | 335 | 1.80E-30 | [ac:q57127;o05062] [gn:hi1453] [or:haemophilus influenza] [de:hypothetical protein hi1453 precursor] [sp:q57127;o05062] [db:swissprot] |
| 15781287_c1_58 | 439 | 3042 | 192 | 63 | 69 | 0.088 | [ac:s38922] [pn:hypothetical protein 10] [or:phage phi-c31] [db:pir] |
| 15781287_c1_8 | 440 | 3043 | 234 | 77 | 78 | 0.0077 | [ln:af001782] [ac:af001782] [pn:agrb] [or:staphylococcus aureus] [db:genpept-bct] [de:staphylococcus aureus strain sa502a agrb (agrb), agrd (agrd) andagrc (agrc) genes, complete cds.] [le:1] [re:564] [di:direct] |
| 15781577_c2_47 | 441 | 3044 | 708 | 235 | 285 | 9.60E-5 | [ac:s60902;s49238;s44071] [pn:cdp-ribitol pyrophosphorylase] [or:haemophilus influenzae] [db:pir] |
| 15806563_f2_21 | 442 | 3045 | 1023 | 340 | 562 | 1.60E-54 | [ac:p23876;p77097] [gn:fepd] [or:escherichia coli] [de:ferric enterobactin transport protein fepd] [sp:p23876;p77097] [db:pir] |
| 15829580_c2_37 | 443 | 3046 | 543 | 180 | 128 | 4.00E-07 | [ac:a54527] [pn:110k antigen;pk110] [or:plasinodium knowlesi] [db:pir] |
| 15833456_f3_9 | 444 | 3047 | 303 | 100 | 102 | 3.20E-05 | [ln:spu40453] [ac:u40453;m19350] [pn:repressor] [or:streptococcus pyogenes phage t12] [db:genpept-phg] [de:streptococcus pyogenes phage t12 repressor, excisionase (xis),integrase (int) and erythrogenic toxin a precursor (spea) genes,complete cds.] [nt:lam |
| 15863812_c3_71 | 445 | 3048 | 756 | 251 | 225 | 8.40E-19 | [ac:d69219] [pn:integrase-recombinase protein] [gn:mth893] [or:methanobacterium thermoautotrophicum] [db:pir] |
| 159712_f1_2 | 446 | 3049 | 450 | 149 | 207 | 6.80E-17 | [ac:p54520] [gn:yqhz] [or:bacillus subtilis] [sp:p54520] [db:swissprot] [de:n utilization substance protein b homolog (nusb protein)] |
| 16022202_f1_3 | 447 | 3050 | 849 | 282 | 99 | 0.0091 | [ac:b70039] [pn:hypothetical protein yvfs] [gn:yvfs] [or:bacillus subtilis] [db:pir] |
| 16036263_c3_83 | 448 | 3051 | 273 | 90 | 74 | 0.077 | [ac:b70242] [pn:beta-glucosidase] [gn:bglt] [fn:hydrolyses aryl-beta-glucosides] [or:thermococcus sp.] [db:genpept-bct] [de:thermococcus sp. al662 bglt gene.] [nt:belongs to family1 of glycosyl hydrolases |
| 16053812_c1_18 | 449 | 3052 | 378 | 125 | 303 | 4.50E-27 | [ac:s52544] [pn:is12 protein] [or:lactobacillus helveticus] [db:pir] |
| 16053812_c2_53 | 450 | 3053 | 450 | 149 | 398 | 3.90E-37 | [ac:s52544] [pn:is12 protein] [or:lactobacillus helveticus] [db:pir] |
| 16053812_c3_89 | 451 | 3054 | 450 | 149 | 400 | 2.40E-37 | [ac:s52544] [pn:is12 protein] [or:lactobacillus helveticus] [db:pir] |
| 16072127_f2_23 | 452 | 3055 | 969 | 322 | 1137 | 1.90E-115 | [ac:q54430] [gn:scrr] [or:streptococcus mutans] [de:sucrose operon regulatory protein] |

TABLE 2-continued

| Orf | NT Seq ID | AA Seq ID | NT Orf Length | AA Orf Length | Score | Probability | Description |
|---|---|---|---|---|---|---|---|
| 16072903_f2_14 | 453 | 3056 | 993 | 330 | 551 | 2.40E-53 | [sp:q54430] [db:swissprot] [in:rcu23145] [ac:u23145] [pn:pentose-5-phosphate-3-epimerase] [gn:cbbe] [or:rhodobacter capsulatus] [db:genpept-bct] [ec:5.1.3.1] [de:rhodobacter capsulatus calvin cycle carbon dioxide fixation operon:fructose-1,6-/sedoheptulose-1,7-bisphosphate aldolase |
| 160907_c1_35 | 454 | 3057 | 513 | 170 | 64 | 0.22 | [in:spu31811] [ac:u31811] [or:streptococcus pyogenes] [db:genpept-bct] [de:streptococcus pyogenes immunogenic secreted protein precursor (isp)gene, complete cds.] [nt:orf] [le:1816] [re:2067] [di:direct] |
| 16112750_f3_21 | 455 | 3058 | 183 | 60 | 60 | 0.23 | [in:spz82001] [ac:z82001] [pn:unknown] [or:streptococcus pneumoniae] [db:genpept-bct] [de:s.pneumoniae pcpa gene and open reading frames.] [le:<1] [re:174] [di:direct] |
| 16130393_f1_4 | 456 | 3059 | 198 | 65 | 53 | 0.17 | [ac:s73583] [pn:probable lipoprotein d02_orf302:mg068 homolog d02_orf302:mg068 homolog d02_orf302] [or:mycoplasma pneumoniae] [sr:atcc 29342,, atcc 29342, sr:atcc 29342,] [db:pir] |
| 16172562_c2_9 | 457 | 3060 | 507 | 169 | 115 | 3.80E-07 | [in:bc332ab] [ac:y09323] [pn:hypothetical protein] [gn:332b] [fn:unknown] [or:bacillus cereus] [db:genpept-bct] [de:b.cereus dna, two genes with unknown function.] [le:761] [re:1198] [di:direct] |
| 16176563_f2_36 | 458 | 3061 | 399 | 132 | 556 | 7.00E-54 | [in:spdnagcpo] [ac:yl1463] [or:streptococcus pneumoniae] [db:genpept-bct] [de:streptococcus pneumoniae dnag, rpod, cpoa genes and orf3 and orf5.] [nt:orf3] [le:1689] [re:2018] [di:direct] |
| 16210952_c1_58 | 459 | 3062 | 333 | 110 | 56 | 0.51 | [in:mtcegnme] [ac:z47547] [gn:putative orf75] [db:genpept-pln] [de:c.crispus complete mitochondrial genome.] [nt:unique orf] [le:17892] [or:chondrus crispus] [sr:carragheen] [re:18119] [di:complement] |
| 16250802_c2_32 | 460 | 3063 | 1005 | 334 | 508 | 8.60E-49 | [ac:g69627] [pn:cell-division protein ftsx] [gn:ftsx] [or:bacillus subtilis] [db:pir] |
| 16252030_f3_6 | 461 | 3064 | 369 | 122 | 101 | 7.30E-05 | [ac:p20186] [or:streptomyces fradiae] [de:hypothetical 35.5 kd protein in transposon tn4556] [sp:p20186] [db:swissprot] |
| 16417880_c3_57 | 462 | 3065 | 477 | 158 | 273 | 6.90E-24 | [ac:p54536] [gn:yqiy] [or:bacillus subtilis] [de:intergenic region] [sp:p54536] [db:swissprot] |
| 16423778_f2_18 | 463 | 3066 | 1569 | 522 | 122 | 0.00026 | [ac:a40813] [pn:protein kinase tik] [c1:protein kinase tik:double-stranded rna-binding repeat homology] [or:mus musculus] [sr:, house mouse] [ec:2.7.1.-] [db:pir] |
| 16430313_f3_37 | 464 | 3067 | 930 | 309 | 954 | 4.70E-96 | [ac:h70019] [pn:abc transporter (atp-binding protein) homolog yury] [gn:yury] [or:bacillus subtilis] [db:pir] |
| 16437511_f1_1 | 465 | 3068 | 393 | 130 | 92 | 0.0045 | [ac:g70007] [pn:conserved hypothetical protein yuef] [gn:yuef] [or:bacillus subtilis] [db:pir] |
| 16486458_f2_19 | 466 | 3069 | 831 | 276 | 610 | 1.30E-59 | [ac:a70001] [pn:abc transporter (atp-binding protein) homolog yitsc] [gn:yitsc] [or:bacillus subtilis] [db:pir] |
| 16492202_c1_74 | 467 | 3070 | 1038 | 345 | 718 | 4.80E-71 | [in:hvu95372] [ac:u95372] [pn:dehydrogenase] [or:haloferax volcanii] [db:genpept-bct] [de:haloferax volcanii plasmid phv3 aminotransferase gene, partial cds,dehydrogenase and hydantoinase genes, complete cds, andoligopeptide abc transporter gene, partial |
| 16519833_c1_12 | 468 | 3071 | 441 | 147 | 127 | 1.10E-07 | [in:r75conop] [ac:113688] [gn:kfra] [or:plasmid r751] [sr:plasmid r751 dna] [db:genpept-bct] [de:plasmid r751 central control/partitioning operon (including incc,kfra, kora, and korb genes), complete cds s.] [le:2408] [di:direct] |
| 16522192_f1_7 | 469 | 3072 | 261 | 86 | 151 | 1.20E-10 | [in:lllpk214] [ac:x92946;y10522] [pn:transposase] [gn:tnpa] [or:lactococcus lactis] [db:genpept-bct] [de:lactobacillus lactis plasmid pk214, complete sequence.] [le:13438] [re:14256] [di:complement] |
| 16525312_c3_220 | 470 | 3073 | 849 | 282 | 656 | 1.80E-64 | [in:bbp9011] [ac:x84706] [pn:major head protein] [gn:mhp] [or:bacteriophage b1] [db:genpept-phg] [de:bacteriophage tp901-1 genomic region.] [le:360] [re:1181] [di:direct] |
| 16526937_f2_27 | 471 | 3074 | 465 | 154 | 136 | 2.30E-09 | [ac:p51192] [or:porphyra purpurea] [de:hypothetical 20.1 kd protein in ycf37-psaf intergenic region (orf174)] [sp:p51192] [db:swissprot] |

TABLE 2-continued

| Orf | NT Seq ID | AA Seq ID | NT Orf Length | AA Orf Length | Score | Probability | Description |
|---|---|---|---|---|---|---|---|
| 16682592_f2_6 | 472 | 3075 | 216 | 71 | 67 | 0.57 | [ln:cef36g9] [ac:z81533] [pn:f36g9.1] [or:caenorhabditis elegans] [db:genpept-inv] [de:caenorhabditis elegans cosmid f36g9, complete sequence.] [le:365:569:1280:1476] [re:524:1006:1429:1796] [di:complementjoin] |
| 16585937_c2_45 | 473 | 3076 | 576 | 191 | 116 | 0.00054 | [ln:pcu43145] [ac:u43145] [pn:repeat organellar protein] [or:plasmodium chabaudi] [db:genpept-inv] [de:plasmodium chabaudi repeat organellar protein gene, complete cds.] [nt:rope] [le:2158] [re:7977] [di:direct] |
| 16587812_c3_106 | 474 | 3077 | 201 | 66 | 65 | 0.073 | [ln:ddi1093a] [ac:m19469] [or:dictyostelium discoideum] [sr:dictyostelium discoideum (strain b or ax3) dna] [db:genpept-pln] [de:dictyostelium 109 gene 3, complete cds.] [nt:orf] [le:3334] [re:<1:200] |
| 165936_c3_72 | 475 | 3078 | 1431 | 476 | 97 | 0.013 | [ac:jc5040] [pn:positive regulatory protein mga] [gn:mga4] [or:streptococcus pyogenes] [db:pir] |
| 16601053_c2_6 | 476 | 3079 | 1536 | 511 | 256 | 4.10E-19 | [ln:spspsa2] [ac:aj002054] [pn:spsa protein] [fn:iga binding protein] [or:streptococcus pneumoniae] [db:genpept-bct] [de:streptococcus pneumoniae siga binding.] [le:1] [re:1620] [di:direct] |
| 16664127_fl_1 | 477 | 3080 | 312 | 103 | 237 | 4.50E-20 | [ac:p02395] [gn:rpl] [or:micrococcus lysodeikticus] [de:50s ribosomal protein 17/112 (ma1/ma2)] [sp:p02395] [db:swissprot] |
| 16664717_c1_19 | 478 | 3081 | 660 | 219 | 72 | 0.049 | [ln:vupfe2a] [ac:x67755] [pn:ferritin 2] [gn:pfe2] [or:vigna unguiculata] [sr:cowpea] [db:genpept-pln] [de:v.unguiculata pfe2 gene for plant ferritin exons 1 and 2, partial.] [le:<1:200] [re:119: |
| 16673385_f1_7 | 479 | 3082 | 1011 | 336 | 1027 | 8.60E-104 | [ac:p44631] [gn:ruvb:hi0312] [or:haemophilus influenzae] [de:holliday junction dna helicase ruvb] [sp:p44631] [db:swissprot] |
| 16676575_f2_5 | 480 | 3083 | 285 | 94 | 68 | 0.089 | [ln:efu25095] [ac:u25095] [pn:pyrimidine biosynthesis protein p] [gn:pyrp] [or:enterococcus faecalis] [db:genpept-bct] [de:enterococcus faecalis plasmid pkv48 pyrimidine biosynthesis proteinp (pyrp) gene, partial cds.] [le:<1] [re: |
| 16681580_c3_86 | 481 | 3084 | 795 | 264 | 647 | 1.60E-63 | [ac:h69828] [pn:abc transporter (atp-binding protein) homolog yheh] [gn:yheh] [or:bacillus subtilis] [db:pir] |
| 16695162_f1_13 | 482 | 3085 | 243 | 80 | 173 | 2.70E-13 | [ac:p26832] [or:clostridium perfringens] [de:hypothetical protein in nagh 5'region (orfa) (fragment)] [sp:p26832] [db:swissprot] |
| 16696063_f3_14 | 483 | 3086 | 693 | 230 | 467 | 1.90E-44 | [ac:p23861] [gn:pod] [or:escherichia coli] [de:spermidine/putrescine-binding periplasmic protein precursor (spbp)] [sp:p23861] [db:swissprot] |
| 16797928_c2_10 | 484 | 3087 | 222 | 73 | 189 | 1.50E-14 | [ac:c69830] [pn:glucanase homolog yhfe] [gn:yhfe] [or:bacillus subtilis] [db:pir] |
| 16800652_c2_67 | 485 | 3088 | 1134 | 377 | 447 | 1.40E-48 | [ac:p20708] [gn:sucb:odhb] [or:azotobacter vinelandii] [ec:2.3.1.61] [de:dehydrogenase complex,] [sp:p20708] [db:swissprot] |
| 16800697_c2_36 | 486 | 3089 | 834 | 277 | 409 | 2.70E-38 | [ac:p54535] [gn:yqix] [or:bacillus subtilis] [de:intergenic region precursor] [sp:p54535] [db:swissprot] |
| 16823757_c3_18 | 487 | 3090 | 282 | 93 | 72 | 0.14 | [ac:p34579] [gn:t20g5.6] [or:caenorhabditis elegans] [de:hypothetical 51.6 kd protein in c20g5.6 in chromosome iii] [sp:p34579] [db:swissprot] |
| 16824056_c3_155 | 488 | 3091 | 285 | 94 | 387 | 5.70E-36 | [ln:spparcetp] [ac:z67739] [de:s.pneumoniae parc, pare and transposase] [or:streptococcus pneumoniae] [db:genpept-bct] [de:s.pneumoniae parc, pare and transposase genes and unknown orf.] [nt:novel insertion sequence related to is861 of group] [le:<1] [re:435] [di:direct] |
| 16828438_c1_54 | 489 | 3092 | 1317 | 438 | 1544 | 1.40E-58 | [ac:p50743] [gn:yphc] [or:bacillus subtilis] [de:region] [sp:p50743] [db:swissprot] |
| 16828811_f3_6 | 490 | 3093 | 291 | 96 | 267 | 3.00E-23 | [ac:e69993] [pn:conserved hypothetical protein ytia] [gn:ytia] [or:bacillus subtilis] [db:pir] |
| 16835063_f2_18 | 491 | 3094 | 822 | 273 | 702 | 2.40E-69 | [ac:p19672] [gn:yqxc:yqif] [or:bacillus subtilis] [de:hypothetical 29.7 kd protein in fold-ahrc intergenic region] [sp:p19672] [db:swissprot] |
| 16835937_c3_212 | 492 | 3095 | 489 | 162 | 371 | 2.80E-34 | [ln:af004379] [ac:af004379] [or:streptococcus thermophilus bacteriophage sfi21] [db:genpept-phg] [de:streptococcus thermophilus bacteriophage sfi121 dna replicationmodule.] [nt:orf157] [le:16] [re:489] [di:direct] |
| 16917202_c1_68 | 493 | 3096 | 501 | 166 | 161 | 5.00E-12 | [ac:g69776] [pn:conserved hypothetical protein yddq] [gn:yddq] [or:bacillus subtilis] |

TABLE 2-continued

| Orf | NT Seq ID | AA Seq ID | NT Orf Length | AA Orf Length | Score | Probability | Description |
|---|---|---|---|---|---|---|---|
| 16922711_c1_39 | 494 | 3097 | 255 | 84 | 78 | 0.0032 | [db:pir] [in:spz82001] [ac:z82001] [pn:unknown] [or:streptococcus pneumoniae] [db:genpept-bct] [de:s.pneumoniae pcpa gene and open reading frames.] [le:<1] [re:174] [di:direct] |
| 16929030_c1_13 | 495 | 3098 | 1848 | 615 | 1041 | 2.80E-105 | [ac:p54719] [gn:yhfc] [or:bacillus subtilis] [de:hypothetical abc transporter atp-binding protein 2 in glvbc 3'region] [sp:p54719] [dbswissprot] |
| 16969387_c1_64 | 496 | 3099 | 210 | 69 | 66 | 0.19 | [in:bbpbrgea] [ac:x87127] [gn:orf-e] [or:borrelia burgdorferi] [sr:lyme disease spirochete] [db:genpept-bct] [de:b.burgdorferi repeated dna element, 30.5 kb circular plasmid copy.] [le:3707] [re:4339] [di:direct] |
| 16987803_f3_18 | 497 | 3100 | 615 | 204 | 43 | 0.4 | [in:humachea] [ac:m76539] [pn:acetylcholinesterase] [gn:ache] [or:homo sapiens] [sr:homo sapiens (tissue library: cosmid) placenta dna] [db:genpept-pr1]] [de:human acetylcholinesterase (ache) gene, exons 2 and 3h, partialcds.] [le:<1:102] [re:31: |
| 17000438_f1_1 | 498 | 3101 | 558 | 185 | 472 | 5.60E-45 | [ac:p37545] [gn:yabd] [or:bacillus subtilis] [de:hypothetical 29.2 kd protein in mets-ksga intergenic region] [sp:p37545] [dbswissprot] |
| 17010927_f2_23 | 499 | 3102 | 501 | 166 | 371 | 2.80E-34 | [ac:p39303] [gn:sgaa] [or:escherichia coli] [ec:2.7.1.69] [de:(ec 2.7.1.69)] [sp:p39303] [dbswissprot] |
| 17072162_f1_15 | 500 | 3103 | 888 | 295 | 378 | 5.10E-35 | [ac:q54087] [gn:lrp] [or:streptococcus equisimilis] [de:leucine rich protein] [sp:q54087] [dbswissprot] |
| 17073437_c1_8 | 501 | 3104 | 411 | 136 | 224 | 1.10E-18 | [ac:p54721] [gn:yfie] [or:bacillus subtilis] [de:hypothetical 31.5 kd protein in glvbc 3'region] [sp:p54721] [dbswissprot] |
| 17088594_c2_7 | 502 | 3105 | 398 | 132 | 164 | 1.90E-11 | [in:mh68repr] [ac:y09060] [pn:serine threonine rich glycoprotein] [gn:bprf1] [or:murine herpesvirus 68] [db:genpept-vrl] [de:murine herpesvirus type 68 dna, representative region.] [nt:positional homologue to ebv bllf1] [le:9583] [re:11034] [di:direct] |
| 175080_f1_6 | 503 | 3106 | 1119 | 372 | 1036 | 9.60E-105 | [ac:p32816] [gn:gldagld] [or:bacillus stearothermophilus] [ec:1.1.1.6] [de:glycerol dehydrogenase, (g/dh)] [sp:p32816] [dbswissprot] |
| 179027_c1_21 | 504 | 3107 | 189 | 62 | 65 | 0.12 | [ac:p24873] [gn:nd6] [or:ascaris suum] [sr:,pig roundworm:ascaris lumbricoides] [ec:1.6.5.3] [de:nadh-ubiquinone oxidoreductase chain 6,] [sp:p24373] [dbswissprot] |
| 18089418_f3_5 | 505 | 3108 | 368 | 123 | 123 | 3.50E-07 | [in:cee02a10] [ac:z81053] [pn:e02a10.2] [or:caenorhabditis elegans] [db:genpept-inv] [de:caenorhabditis elegans cosmid e02a10 complete sequence.] [nt:protein predicted using genefinder] [le:11007:11551:11984] [re:11504:11813:12016] |
| 189388_c3_81 | 506 | 3109 | 1092 | 363 | 415 | 6.10E-39 | [ac:g69979] [pn:proteinase homolog yrrn] [gn:yrrn] [or:bacillus subtilis] [db:pir] |
| 1900_f2_15 | 507 | 3110 | 261 | 86 | 77 | 0.004 | [in:sptana] [acx:72967] [or:streptococcus pneumoniae] [db:genpept-bct] [de:s.pneumoniae nana gene,] [nt:orf2] [le:193] [re:495] [di:direct] |
| 193962_c1_25 | 508 | 3111 | 222 | 73 | 57 | 0.0045 | [in:ae001150] [ac:ae001150:ae000783] [pn:b. burgdorferi predicted coding region bb0452] [gn:bb0452] [or:borrelia burgdorferi] [sr:lyme disease spirochete] [db:genpept-bct] [de:borrelia burgdorferi (section 36 of 70) of the complete genome.] [nt:hypothetic |
| 195302_f3_12 | 509 | 3112 | 1032 | 343 | 1212 | 2.10E-123 | [in:llu92974] [ac:u92974:m90760:m90761] [pn:unknown] [or:lactococcus lactis] [db:genpept-bct] [de:lactococcus lactis unknown gene, partial cds, and hisc (hisc),unknown, hisg (hisg), unknown, hisb (hisb), unknown, hish (hish),hisa (hisa), hisf (hisf), hisi |
| 19532650_f1_12 | 510 | 3113 | 984 | 327 | 1580 | 2.20E-162 | [in:spdacao] [ac:x99400] [pn:membrane protein] [or:streptococcus pneumoniae] [db:genpept-bct] [de:s.pneumoniae daca gene and orf.] [le:709] [re:1818] [di:complement] |
| 19538212_f3_46 | 511 | 3114 | 348 | 115 | 157 | 5.10E-11 | [ac:p15039] [gn:purr] [or:escherichia coli] [de:purine nucleotide synthesis repressor] [sp:p15039] [dbswissprot] |
| 19539007_f2_8 | 512 | 3115 | 309 | 102 | 167 | 1.20E-12 | [in:af036720] [ac:af036720] [pn:unknown] [or:lactococcus lactis] [db:genpept-bct] [de:lactococcus lactis n-acetylmuramidase (acma) gene, complete cds.] [nt:orfa; similar to sequence encoded by genbank] [le:2043] [re:2327] [di:complement] |
| 1954587_c3_17 | 513 | 3116 | 690 | 229 | 417 | 3.80E-39 | [ac:p54592] [gn:yhch] [or:bacillus subtilis] [de:intergenic region] [sp:p54592] [dbswissprot] |

TABLE 2-continued

| Orf | NT Seq ID | AA Seq ID | NT Orf Length | AA Orf Length | Score | Probability | Description |
|---|---|---|---|---|---|---|---|
| 19547127_f1_10 | 514 | 3117 | 468 | 155 | 99 | 0.0036 | [ac:b26696] [pn:hypothetical protein 1 (cyb-coii intergenic region)] [or:mitochondrion leishmania tarentolae] [db:pir] |
| 19547153_c3_21 | 515 | 3118 | 618 | 205 | 229 | 3.20E-19 | [ac:c69661] [pn:transcriptional activator of multidrug-efflux transporter genes mta] [gn:mta] [or:bacillus subtilis] [db:pir] |
| 19548126_c1_94 | 516 | 3119 | 198 | 65 | 61 | 0.051 | [ac:jc2125:a28007:a05320:ph1825] [pn:chymase, precursor:chymotrypsin-like proteinase:mast cell proteinase i:skeletal muscle protease] [cl:trypsin:trypsin homology] [or:rattus norvegicus] [sr, norway rat] [ec:3.4.21.39] [db:pir] |
| 19557826_c2_84 | 517 | 3120 | 189 | 62 | 52 | 0.83 | [ac:p47724] [gn:deod] [or:mycoplasma pirum] [ec:2.4.2.1] [de:(pnp) (fragment)] [sp:p47724] [db:swissprot] |
| 19566888_f2_28 | 518 | 3121 | 948 | 315 | 376 | 8.30E-05 | [ac:f69795] [pn:conserved hypothetical protein yerq] [gn:yerq] [or:bacillus subtilis] [db:pir] |
| 19570006_c3_215 | 519 | 3122 | 198 | 65 | 55 | 0.063 | [ac:p32558] [gn:cdc68:sp16:ssf1:tg11207w] [or:saccharomyces cerevisiae] [sr,baker's yeast] [de:cell division control protein 68] [sp:p32558] [db:swissprot] |
| 19572162_c2_40 | 520 | 3123 | 1146 | 381 | 905 | 7.30E-91 | [ac:p31672] [or:lactobacillus delbrueckii] [sr,subspbulgaricus] [de:nifs protein homolog (fragment)] [sp:p31672] [db:swissprot] |
| 19581_c1_27 | 521 | 3124 | 1113 | 370 | 1325 | 2.30E-135 | [1n:af014460] [ac:af014460] [pn:cepa] [fn:regulator] [or:streptococcus mutans] [db:denpept-bct] [de:streptococcus mutans pepq and cepa genes, complete cds.] [le:1295] [re:2296] [di:direct] |
| 19583111_c1_82 | 522 | 3125 | 216 | 71 | 224 | 1.10E-18 | [ac:s52544] [pn:is12 protein] [or:lactobacillus helveticus] [db:pir] |
| 19583_f2_10 | 523 | 3126 | 399 | 132 | 604 | 5.80E-59 | [1n:spparcetp] [ac:z67739] [pn:dna transposase] [or:streptococcus pneumoniae] [db:genpept-bct] [de:s.pneumoniae parc, pare and transposase genes and unknown orf.] [nt:novel insertion sequence related to is861 of group] [le:<1] [re:435] [di:direct] |
| 19596_f1_1 | 524 | 3127 | 390 | 129 | 165 | 9.90E-12 | [ac:b70048] [pn:conserved hypothetical protein yvrp] [gn:yvrp] [or:bacillus subtilis] [db:pir] |
| 19602_f2_9 | 525 | 3128 | 672 | 223 | 266 | 3.80E-23 | [ac:p12045] [gn:purk] [or:bacillus subtilis] [de:(air carboxylase) (airc)] [sp:p12045] [db:swissprot] |
| 19608_f3_45 | 526 | 3129 | 852 | 283 | 602 | 9.40E-59 | [ac:p39805] [gn:lict:n15a] [or:bacillus subtilis] [de:transcription antiterminator lict] [sp:p39805] [db:swissprot] |
| 19609375_c3_17 | 527 | 3130 | 1359 | 452 | 1740 | 2.40E-179 | [ac:p30053] [gn:thiss] [or:streptococcus equisimilis] [ec:6.1.1.21] [de:(hisrs)] [sp:p30053] [db:swissprot] |
| 19610887_f3_27 | 528 | 3131 | 735 | 244 | 78 | 0.00095 | [1n:ab010961] [ac:ab010961] [pn:mifr-1] [gn:mifr-1] [or:homo sapiens] [sr:homo sapiens female uterus cdna to mrna] [db:genpept] [de:homo sapiens mrna for mifr-1, complete cds.] [nt:metalloproteinase in the female reproductive] [le:28] [re:1200] |
| 19615_f3_22 | 529 | 3132 | 282 | 93 | 97 | 0.00011 | [ac:jq0133] [pn:hypothetical 26.4k protein] [or:pseudomonas aeruginosa] [db:pir] |
| 19617307_c3_89 | 530 | 3133 | 810 | 269 | 262 | 7.90E-22 | [ac:a41971:a60282:a33134] [pn:surface protein pspa precursor:pneumococcal surface protein a] [gn:pspa] [cl:cpl repeat homology] [or:streptococcus pneumoniae] [db:pir] |
| 19645327_f2_13 | 531 | 3134 | 468 | 155 | 546 | 8.10E-53 | [ac:p50856] [gn:ribh] [or:actinobacillus pleuropneumoniae] [sr,haemophilus pleuropneumoniae] [ec:2.5.1.9] [de:(lumazine synthase) (riboflavin synthase beta chain)] [sp:p50856] [db:swissprot] |
| 19647553_f2_19 | 532 | 3135 | 297 | 98 | 48 | 0.99 | [1n:celf28f5] [ac:u00045] [gn:f28f5.4] [or:caenorhabditis elegans] [sr:caenorhabditis elegans strain=bristol n2] [db:genpept-inv] [de:caenorhabditis elegans cosmid f28f5.] [le:14481:14590] [re:14540:14653] [di:complementjoin] |
| 19648577_c2_46 | 533 | 3136 | 963 | 320 | 881 | 2.60E-88 | [ac:u41100] [acu41100] [pn:ribonucleotide reductase r2-2 small subunit] [or:mycobacterium tuberculosis] [db:genpept-bct] [de:mycobacterium tuberculosis ribonucleotide reductase r2-2 smallsubunit gene, partial cds.] [le:1] [re: |
| 19652215_f1_5 | 534 | 3137 | 291 | 96 | 181 | 3.80E-14 | [ac:d64631] [pn:conserved hypothetical protein hp0892] [or:helicobacter pylori] [db:pir] |
| 19687_f3_37 | 535 | 3138 | 996 | 331 | 113 | 0.00079 | [ac:s23345] [pn:hypothetical protein 9.6] [or:salmonella choleraesuis] [db:pir] |
| 19689_f1_5 | 536 | 3139 | 378 | 125 | 61 | 0.22 | [ac:s77762:s48585] [pn:hypothetical protein mc030] [or:mycoplasma capricolum] [db:pir] |

TABLE 2-continued

| Orf | NT Seq ID | AA Seq ID | NT Orf Length | AA Orf Length | Score | Probability | Description |
|---|---|---|---|---|---|---|---|
| 19689762_c3_59 | 537 | 3140 | 207 | 68 | 62 | 0.75 | [ln:giapermeas] [ac:111576] [pn:permease] [gn:tpt1] [fn:nucleoside transporter] [or:giardia intestinalis] [sr:giardia lamblia (individual_isolate ad-1) (library:sau3a and bamh] [db:genpept-inv] [de:giardia lamblia (clones p10ud and pbc2) permease (tpt1) [ln:spu09239] [ac:u09239] [pn:putative polysaccharide polymerase] [gn:cps19f] [or:streptococcus pneumoniae] [db:genpept-bct] [de:streptococcus pneumoniae type 19f capsular polysaccharide biosynthesis operon, (cps19fabcdefghijklmno) genes, complete cds,and |
| 19694062_c3_37 | 538 | 3141 | 1371 | 456 | 435 | 4.70E-41 | |
| 19703305_f1_2 | 539 | 3142 | 879 | 292 | 515 | 1.6E-49 | [ac:d69759] [pn:hypothetical protein ycgq] [gn:ycgq] [or:bacillus subtilis] [db:pir] [ln:scmalrefg] [ac:y07706] [pn:putative maltose-binding pootein] [gn:male] [or:streptomyces coelicolor] [db:genpept-bct] [de:s.coelicolor malr, male, malf and malg genes.] [le:1620] [re:2891] [di:direct] |
| 19704067_f2_5 | 540 | 3143 | 1377 | 458 | 217 | 3.70E-15 | |
| 19711028_f2_14 | 541 | 3144 | 609 | 202 | 252 | 1.20E-21 | [ac:a69859] [pn:hypothetical protein ykoe] [gn:ykoe] [or:bacillus subtilis] [db:pir] [ac:p55454] [gn:y4fp] [or:rhizobium sp] [srngr234.] [de:probable abc transporter periplasmic binding protein y4fp precursor] [sp:p55454] [db:swissprot] |
| 19720441_f3_43 | 542 | 3145 | 675 | 224 | 302 | 5.80E-27 | |
| 19728387_c1_21 | 543 | 3146 | 264 | 87 | 65 | 0.073 | [ac:s69295] [pn:probable membrane protein ylr217w:hypothetical protein 18167.25] [or:saccharomyces cerevisiae] [db:pir] [mp:12r] |
| 19733336_f3_13 | 544 | 3147 | 855 | 284 | 375 | 1.10E-34 | [ac:p08188] [gn:manz:ptsm:gptb] [or:escherichia coli] [de:(eii-m-man)] [sp:p08188] [db:swissprot] |
| 19755062_c1_42 | 545 | 3148 | 1533 | 510 | 1650 | 8.30E-170 | [ln:ab003927] [ac:ab003927] [pn:phospho-beta galactosidase 1] [gn:pbg1] [or:lactobacillus gasseri] [sr:lactobacillus gasseri (strain:jcm 1031, isolate:human intestine] [db:genpept-bct] [de:lactobacillus gasseri dna for phospho-beta galactosidase 1,complete |
| 19755949_c1_13 | 546 | 3149 | 196 | 65 | 58 | 0.052 | [ac:p40693] [gn:rpl7:rlp7:ynl002c:n2014] [or:saccharomyces cerevisiae] [sr:baker's yeast] [de:60s ribosomal protein 17] [sp:p40693] [db:swissprot] |
| 19773932_c2_10 | 547 | 3150 | 936 | 311 | 174 | 8.20E-11 | [ac:p19780] [or:streptomyces coelicolor] [de:insertion element is110 hypothetical 43.6 kd protein] [sp:p19780] [db:swissprot] |
| 19782765_f1_1 | 548 | 3151 | 210 | 69 | 60 | 0.48 | [ac:p12204] [gn:ycf3] [or:nicotiana tabacum] [sr:,common tobacco] [de:hypothetical 19 kd protein (orf168)] [sp:p12204] [db:swissprot] |
| 19779530_f2_17 | 549 | 3152 | 288 | 95 | 54 | 0.67 | [ac:35762.s78079] [pn:hypothetical protein ybr109w-a] [or:saccharomyces cerevisiae] [db:pir] [mp:2r] |
| 19880340_c3_33 | 550 | 3153 | 567 | 188 | 234 | 9.30E-20 | [ln:u91581] [ac:u91581:u04057] [fn:unknown] [or:lactococcus lactis] [db:genpept-bct] [de:lactococcus lactis lactis lacticin 481 operon, preprolacticin 481(lcta), lctm (lctm), lctt (lctt), lctf (lctf), lcte (lcte), andlcg (lcg) genes, complete cds |
| 19880340_f2_29 | 551 | 3154 | 684 | 227 | 234 | 9.30E-20 | [ln:u91581] [ac:u91581:u04057] [fn:unknown] [or:lactococcus lactis] [db:genpept-bct] [de:lactococcus lactis lactis lacticin 481 operon, preprolacticin 481(lcta), lctm (lctm), lctt (lctt), lctf (lctf), lcte (lcte), andlcg (lcg) genes, complete cds |
| 19880340_f2_34 | 552 | 3155 | 789 | 262 | 247 | 3.90E-21 | [ac:b47342] [pn:transposase homolog, lct 5′-region] [or:lactococcus lactis subsp. lactis] [db:pir] |
| 19880340_f2_7 | 553 | 3156 | 789 | 262 | 247 | 3.90E-21 | [ac:b47342] [pn:transposase homolog, lct 5′-region] [or:lactococcus lactis subsp. lactis] [db:pir] |
| 19804837_f3_11 | 554 | 3157 | 1077 | 358 | 986 | 1.90E-99 | [ln:llpepgen] [ac:y08842] [pn:aminopeptidase p] [gn:pepp] [or:lactococcus lactis] [db:genpept-bct] [ec:3.4.1.9] [de:l.lactis pepp gene.] [le:14] [re:1072] [di:direct] |
| 19823260_c1_22 | 555 | 3158 | 1053 | 350 | 166 | 1.10E-09 | [ac:h69839] [pn:multidrug resistance protein homolog yitg] [gn:yitg] [or:bacillus subtilis] [db:pir] |
| 19884691_c2_22 | 556 | 3159 | 420 | 139 | 386 | 7.30E-36 | [ac:s52544] [pn:is12 protein] [or:lactobacillus helveticus] [db:pir] |
| 19889092_c3_82 | 557 | 3160 | 2556 | 851 | 2585 | 6.90E-269 | [ac:p47847] [gn:seca] [or:listeria monocytogenes] [de:preprotein translocase seca subunit] [sp:p47847] [db:swissprot] |
| 19889763_f1_2 | 558 | 3161 | 402 | 133 | 82 | 0.14 | [ac:s76881] [pn:hypothetical protein] [or:synechocystis sp.] [sr:pcc 6803,, pcc 6803] [sr:pcc 6803,] [db:pir] |

TABLE 2-continued

| Orf | NT Seq ID | AA Seq ID | NT Orf Length | AA Orf Length | Score | Probability | Description |
|---|---|---|---|---|---|---|---|
| 199062_c2_91 | 559 | 3162 | 1122 | 373 | 1214 | 1.30E-123 | [ac:p54453] [gn:yqeh] [or:bacillus subtilis] [de:hypothetical 41.0 kd protein in nucb-arod intergenic region] [sp:p54453] [db:swissprot] |
| 199087_c1_20 | 560 | 3163 | 819 | 272 | 660 | 6.70E-65 | [ac:p09997:p76737] [gn:yida] [or:escherichia coli] [de:hypothetical 29.7 kd protein in ibpa-gyrb intergenic region] [sp:p09997:p76737] [db:swissprot] |
| 19938778_c3_17 | 561 | 3164 | 195 | 64 | 53 | 0.055 | [ac:p22375] [or:ascobolus immersus] [de:hypothetical 19.7 kd protein (orf2)] [sp:p22375] [db:swissprot] |
| 19938778_f1_4 | 562 | 3165 | 195 | 64 | 43 | 0.094 | [ac:p15936] [gn:uvib] [or:clostridium perfringens] [de:bacteriocin uvib precursor] [sp:p15936] [db:swissprot] |
| 19938778_f1_6 | 563 | 3166 | 195 | 64 | 53 | 0.055 | [ac:p22375] [or:ascobolus immersus] [de:hypothetical 19.7 kd protein (orf2)] [sp:p22375] [db:swissprot] |
| 19938778_f3_36 | 564 | 3167 | 195 | 64 | 43 | 0.039 | [ac:p15936] [gn:uvib] [or:clostridium perfringens] [de:bacteriocin uvib precursor] [sp:p15936] [db:swissprot] |
| 19942250_c1_7 | 565 | 3168 | 183 | 60 | 45 | 0.028 | [ln:hivu56361] [acu56361] [pn:p17] [gn:gag] [or:human immunodeficiency virus type 1] [sr:human immunodeficiency virus type 1 strain=et3099] [db:genpept-vrl] [de:human immunodeficiency virus type 1 matrix protein p17 (gag) gene,partial cds.] [nt:matrix pr |
| 19962511_c2_39 | 566 | 3169 | 1914 | 637 | 97 | 0.0058 | [ln:lmu77367] [acu77367] [pn:internalin] [gn:inlf] [or:listeria monocytogenes] [db:genpept-bct] [de:listeria monocytogenes internalin (inlf) gene, complete cds.] [le:373] [re:2838] [di:direct] |
| 20000394_c2_25 | 567 | 3170 | 1244 | 414 | 595 | 5.20E-58 | [ac:q08792] [gn:yexd] [or:bacillus subtilis] [de:hypothetical 50.8 kd protein in srfa4-sfp intergenic region (orf83)] [sp:q08792] [db:swissprot] |
| 2000405_c1_I5 | 568 | 3171 | 381 | 126 | 74 | 0.063 | [ac:s17200] [pn:protein kinase ospk4.4,] [or:oryza sativa] [sr:, rice] [ec:2.7.1.-] [db:pir] |
| 20002277_f1_5 | 569 | 3172 | 498 | 165 | 285 | 3.70E-25 | [ln:mtv030] [ac:al021428] [pn:abc-transporter atp-binding subunit] [gn:mtv030.17] [or:mycobacterium tuberculosis] [db:genpept-bct] [de:mycobacterium tuberculosis sequence v030.] [nt:mtv030.17, abc-transporter atp-binding subunit,] [le:20047] [re:21039] [d |
| 20025330_f2_25 | 570 | 3173 | 474 | 157 | 354 | 1.80E-32 | [ac:c70019] [pn:nifu protein homolog homolog yurv] [gn:yurv] [or:bacillus subtilis] [db:pir] |
| 20047575_f1_9 | 571 | 3174 | 864 | 287 | 808 | 1.40E-80 | [ac:q01997] [gn:trpa] [or:lactococcus lactis] [sr:,subsplactis:streptococcus lactis] [ec:4.2.1.20] [de:tryptophan synthase alpha chain,] [sp:q01997] [db:swissprot] |
| 20095277_f2_28 | 572 | 3175 | 666 | 221 | 242 | 1.30E-20 | [ln:d89902] [ac:d89902] [pn:high-glycine tyrosine keratin type ii.4] [or:mus musculus] [sr:mus musculus skin cdna to mrna, clone:7y9(2)] [db:genpept-rod] [de:mouse mrna for high-glycine tyrosine keratin type ii.4, completecds.] [le:35] [re:514] [di:direct |
| 2009687_f3_7 | 573 | 3176 | 708 | 235 | 84 | 0.099 | [ln:lpmito4sl] [ac:af002648] [pn:nadh dehydrogenase 6] [gn:nd6] [or:mitochondrion limulus polyphemus] [sr:atlantic horseshoe crab] [db:genpept-inv] [de:limulus polyphemus nadh dehydrogenase 41 (nd41) gene, partial cds,trna-thr, trna-pro genes, complete se |
| 20116261_f2_2 | 574 | 3177 | 1557 | 518 | 774 | 5.60E-77 | [ac:p34001] [or:streptococcus mutans] [de:hypothetical protein in wapa 3'region (fragment)] [sp:p34001] [db:swissprot] |
| 20134562_c1_49 | 575 | 3178 | 189 | 62 | 108 | 7.60E-06 | [ac:s52544] [pn:is12 protein] [or:lactobacillus helveticus] [db:pir] |
| 20134702_c2_21 | 576 | 3179 | 672 | 223 | 373 | 2.20E-40 | [ac:s53579] [gn:slr0918] [or:synechocystis sp] [sr:pcc 6803,] [ec:3.4.11.18] [de:m] |
| 20117702_f2_18 | 577 | 3180 | 1332 | 443 | 524 | 1.70E-50 | [ac:p23545] [gn:phor] [or:bacillus subtilis] [ec:2.7.3.-] [de:alkaline phosphatase synthesis sensor protein phor,] [sp:p23545] [db:swissprot] |
| 20203137_f3_43 | 578 | 3181 | 507 | 168 | 75 | 0.75 | [ac:c69780] [pn:hypothetical protein ydfe] [gn:ydfe] [or:bacillus subtilis] [db:pir] |
| 20314083_c1_42 | 579 | 3182 | 1800 | 599 | 616 | 3.10E-60 | [ac:q11018] [gn:mtcy02b10.12] [or:mycobacterium tuberculosis] [de:hypothetical abc transporter atp-binding protein cy02b10.12] [sp:q11018] [db:swissprot] |
| 203441_c2_32 | 580 | 3183 | 897 | 298 | 748 | 3.20E-74 | [ac:e64608] [pn:conserved hypothetical protein hp0709] [or:helicobacter pylori] [db:pir] |
| 20315817_c2_52 | 581 | 3184 | 213 | 70 | 62 | 0.15 | [ac:i54359] [pn:apo-dystrophin-2] [gn:dmd] [cl:dystrophin:alpha-actinin actin-binding domain homology:spectrin/dystrophin repeat homology] [or:rattus |

TABLE 2-continued

| Orf | NT Seq ID | AA Seq ID | NT Orf Length | AA Orf Length | Score | Probability | Description |
|---|---|---|---|---|---|---|---|
| 20333385_f3_12 | 582 | 3185 | 195 | 64 | 55 | 0.58 | sp.] [sr;, rat] [db:pir] [ac:p49494] [gn:rps6] [or:odontella sinensis] [de:chloroplast 30s ribosomal protein s6] [sp:p49494] [db:swissprot] |
| 20334642_f2_33 | 583 | 3186 | 1806 | 601 | 1163 | 3.30E-118 | [ac:q04505] [gn:nag;dnae] [or:lactococcus lactis] [sr:subsplactis:streptococcus lactis] [ec:2.7.7.-] [de:dna primase,] [sp:q04505] [db:swissprot] |
| 20345626_c3_64 | 584 | 3187 | 198 | 65 | 54 | 0.45 | [in:mtcy180] [ac:z97193] [pn:hypothetical protein mtcy180.41c] [gn:mtcy180.41c] [or:mycobacterium tuberculosis] [db:genpept-bct] [de:mycobacterium tuberculosis cosmid y180.] [nt:mtcy180.41c, unknown, len: 687. integral membrane] [le:37327] [re:39390] [di: |
| 2035092_f3_9 | 585 | 3188 | 474 | 157 | 83 | 0.13 | [ac:p40239] [gn:cd9] [or:felis silvestris catus] [sr:,cat] [de:cd9 antigen] [sp:p40239] [db:swissprot] |
| 20353562_c1_26 | 586 | 3189 | 249 | 82 | 68 | 0.055 | [ac:f27577:f27557] [pn:t-cell receptor beta chain v region (8/10-2)] [cl:immunoglobulin v region:immunoglobulin homology] [or:mus musculus] [sr;, house mouse] [db:pir] |
| 20366513_f2_26 | 587 | 3190 | 2589 | 862 | 2404 | 0 | [ac:069650] [pn:leucyl-trna synthetase leus] [gn:leus] [or:bacillus subtilis] [db:pir] |
| 20338181_f2_6 | 588 | 3191 | 1212 | 403 | 555 | 9.00E-54 | [ac:p37631:p76705] [gn:yhin] [or:escherichia coli] [de:hypothetical 43.8 kd protein in rhsb-pit intergenic region (f400)] [sp:p37631:p76705] [db:swissprot] |
| 2039087_c3_51 | 589 | 3192 | 465 | 154 | 112 | 7.90E-07 | [ac:p19079] [gn:cdd] [or:bacillus subtilis] [ec:3.5.4.5] [de:cytidine deaminase, (cytidine aminohydrolase) (cda)] [sp:p19079] [db:swissprot] |
| 20390950_f2_5 | 590 | 3193 | 441 | 146 | 88 | 0.0074 | [ac:a49391] [pn:erythroid transcription factor nf-e2 chain p18] [cl:maf homology] [or:mus musculus] [sr;,house mouse] [db:pir] |
| 20392517_f2_30 | 591 | 3194 | 300 | 99 | 173 | 8.40E-13 | [in:abu09349] [ac:093349] [pn:udp-glucose 4-epimerase] [gn:exob2] [fn:udp-glucose to udp-galactose] [or:azospirillum brasilense] [db:genpept-bct] [ec:5.1.3.2] [de:azospirillum brasilense sp7 udp-glucose 4-epimerase (exob2) gene,complete cds.] [le:65] [re: |
| 20397912_c3_75 | 592 | 3195 | 315 | 104 | 536 | 9.30E-52 | [in:spu12567] [acu12567] [pn:orf3] [or:streptococcus pneumoniae] [db:genpept-bct] [de:streptococcus pneumoniae p13 glycerol-3-phosphate dehydrogenase(glpd)gene, partial cds, and glycerol uptake facilitator (glpf)and orf3 genes, complete cds.] [nt:putai |
| 2040875_f2_32 | 593 | 3196 | 2700 | 899 | 1556 | 7.60E-160 | [in:d89668] [ac:d89668:d50554] [pn:phosphoenolpyruvate carboxylase] [gn:ppc] [or:rhodopseudomonas palustris] [sr:rhodopseudomonasp alustris dna] [db:genpept-bct] [ec:4.1.1.31] [de:rhodopseudomonas palustris gene for phosphoenolpyruvatecarboxylase, complet |
| 20431562_c3_38 | 594 | 3197 | 1446 | 481 | 1482 | 5.30E-152 | [ac:p00497] [gn:purf] [or:bacillus subtilis] [ec:2.4.2.14] [de:phosphoribosylpyrophosphate amidotransferase) (atase)] [sp:p00497] [db:swissprot] |
| 20433158_f2_16 | 595 | 3198 | 192 | 63 | 67 | 0.45 | [in:atmlohl] [ac:295352] [pn:atmlo-hl] [gn:atmlo-hl] [fn:unknown] [or:arabidopsis thaliana] [sr:thale cress] [db:genpept-pln] [de:a.thaliana atmlo-hl gene.] [le:93] [re:1673] [di:direct] |
| 20447167_f3_49 | 596 | 3199 | 1227 | 408 | 1671 | 4.90E-172 | [ac:q01998] [gn:trph] [or:lactococcus lactis] [sr:subsplactis:streptococcus lactis] [ec:4.2.1.20] [de:tryptophan synthase beta chain,] [sp:q101998] [db:swissprot] |
| 20501029_c2_31 | 597 | 3200 | 290 | 96 | 309 | 1.10E-27 | [ac:p21468] [gn:rpsf] [or:bacillus subtilis] [de:30s ribosomal protein s6 (bs9)] [sp:p21468] [db:swissprot] |
| 20506561_f3_4 | 598 | 3201 | 1104 | 367 | 1181 | 4.10E-120 | [ac:p39148] [gn:glya;glyc;ipc-34d] [or:bacillus subtilis] [ec:2.2.2.1] [de:(shmt)] [sp:p39148] [db:swissprot] |
| 20507805_c3_34 | 599 | 3202 | 225 | 74 | 66 | 0.061 | [in:af012657] [ac:af012657] [pn:putative potassium transporter atkt2p] [gn:atk2] [or:arabidopsis thaliana] [sr:thale cress] [db:genpept-pln] [de:arabidopsis thaliana putative potassium transporter atkt2p (atkt2)mrna, complete cds.] [le:4] [re:2388] [di:d |
| 20507878_f3_38 | 600 | 3203 | 1464 | 487 | 843 | 2.70E-84 | [ac:e69793] [pn:rna methyltransferase homolog yefa] [gn:yefa] [or:bacillus subtilis] [db:pir] |
| 20508568_f1_1 | 601 | 3024 | 1242 | 413 | 1796 | 2.80E-185 | [ac:p16962] [gn:sagp] [or:streptococcus pyogenes] [de:streptococcal acid glycoprotein] [sp:p16962] [db:swissprot] |

TABLE 2-continued

| Orf | NT Seq ID | AA Seq ID | NT Orf Length | AA Orf Length | Score | Probability | Description |
|---|---|---|---|---|---|---|---|
| 20511590_f3_43 | 602 | 3205 | 237 | 78 | 75 | 0.013 | [ac:p24515] [gn:cp18:s18] [or:drosophila virilis] [sr:,fruit fly] [de:chorion protein s18] [sp:p24515] [db:swissprot] |
| 20522586_c2_12 | 603 | 3206 | 192 | 63 | 48 | 0.7 | [In:cek10d3] [ac:z75545] [pn:k10d3.1] [or:caenorhabditis elegans] [db:genpept-inv] [de:caenorhanditis elegans cosmid k10d3, complete sequence.] [nt:similar to glutamate receptor.] [le:3060:3173:3546:3888] [ac:jc4754] [pn:hypothetical 13.6k protein] [gn:recf] [or:lactococcus lactis] [db:pir] |
| 20525252_f1_15 | 604 | 3207 | 372 | 123 | 246 | 5.00E-21 | |
| 20564376_f3_14 | 605 | 3208 | 1995 | 664 | 93 | 0.45 | [In:cek14c11] [ac:cu53141] [or:caenorhabditis elegans] [gn:c14c11.3] [or:caenorhabditis elegans strain=bristol n2] [db:genpept-inv] [de:caenorhabditis elegans cosmid c14c11.] [le:12418:12568:13331:13832] [re:12513:12651:13783:13962] [di:directjoin] |
| 20588018_c2_48 | 606 | 3209 | 294 | 97 | 62 | 0.67 | [ln:shu27488] [ac:u27488] [pn:glycoprotein gx] [or:suid herpesvirus 1] [db:genpept-vrl] [de:suid herpesvirus 1 glycoprotein gx mrna, partial cds.] [le:<1] [re: |
| 20589692_f1_1 | 607 | 3210 | 1698 | 565 | 163 | 1.80E-09 | [ac:p10901] [gn:alfa] [or:dictyostelium discoideum] [sr:,slime mold] [ec:3.2.1.51] [de:fucohydrolase)] [sp:p10901] [db:swissprot] |
| 20562893_c1_155 | 608 | 3211 | 471 | 156 | 77 | 0.85 | [ln:ae001170] [ac:ae001170:ae000783] [pn:xylose operon regulatory protein (xylr-1)] [gn:bb0693] [or:borrelia burgdorferi] [sr:lyme disease spirochete] [db:genpept-bct] [de:borrelia burgdorferi (section 56 of 70) of the complete genome.] [nt:similar to gb: |
| 20634272_c2_32 | 609 | 3212 | 294 | 97 | 378 | 5.10E-35 | [ln:spu09239] [ac:u09239] [pn:possible polysaccharide transport protein] [gn:cps19f] [or:streptococcus pneumoniae] [db:genpept-bct] [de:streptococcus pneumoniae type 19f capsular polysaccharidesynthesis operon, (cps19fabcdefghijklmno) genes, complete |
| 20640302_f2_6 | 610 | 3213 | 183 | 60 | 125 | 3.30E-08 | [ln:spnana] [ac:x72967] [nt:orf2] [le:193] [re:495] [di:direct] [de:,pneumoniae nana gene.] [or:streptococcus pneumoniae] [db:genpept-bct] |
| 20640007_c1_19 | 611 | 3214 | 216 | 71 | 178 | 8.00E-14 | [ln:spnana] [ac:x72967] [nt:orf2] [le:193] [re:495] [di:direct] [de:,pneumoniae nana gene.] [or:streptococcus pneumoniae] [db:genpept-bct] |
| 20669090_f2_12 | 612 | 3215 | 1284 | 427 | 1266 | 4.10E-129 | [ac:p50855] [gn:riba] [or:actinobacillus pleuropneumoniae] [sr:haemophilus pleuropneumoniae] [ec:3.5.4.25] [de:phosphate synthase (dhbp synthase)] [sp:p50855] [db:swissprot] |
| 20698277_c2_197 | 613 | 3216 | 3654 | 1217 | 299 | 1.70E-24 | [ln:af011378] [ac:af011378] [pn:unknown] [or:bacteriophage sk1] [db:genpept-phg] [de:bacteriophage sk1 complete genome.] [nt:orf14] [le:8582] [re:11581] [di:direct] |
| 20703387_f2_30 | 614 | 3217 | 1461 | 486 | 1318 | 1.30E-134 | [ac:f70033] [pn:glucan 1,4-alpha-maltohydrolase homolog yvdf] [gn:yvdf] [or:bacillus subtilis] [db:pir] |
| 20709802_c1_52 | 615 | 3218 | 1257 | 418 | 524 | 1.70E-50 | [ac:p39604] [gn:ywcfipa-42d] [or:bacillus subtilis] [de:hypothetical 43.3 kd protein in qoxd-vpr intergenic region] [sp:p39604] [db:swissprot] |
| 20710412_c1_14 | 616 | 3219 | 576 | 191 | 307 | 1.70E-27 | [ac:s52544] [pn:is12 protein] [or:lactobacillus helveticus] [db:pir] |
| 20735952_f1_2 | 617 | 3220 | 372 | 123 | 468 | 1.50E-44 | [ln:sgu81957] [ac:81957] [pn:putative dna binding protein] [or:streptococcus gordonii] [db:genpept-bct] [de:streptococcus gordonii rna polymerase beta' subunit (rpoc),putative dna binding protein, putative abc transporter subunit(cpmya ,comya), putative a |
| 20759688_f2_17 | 618 | 3221 | 360 | 119 | 391 | 2.10E-36 | [ln:soorfs] [ac:z79691] [pn:orfb] [gn:orfb] [or:streptococcus pneumoniae] [db:genpept-bct] [des,pneumoniae yorf[a,b,c,d,e], ftsl, pbpx and regr genes.] [le:1914] [re:2372] [di:complement] |
| 207836_c2_17 | 619 | 3222 | 765 | 254 | 170 | 5.50E-11 | [ac:s40407] [pn:oleoyl-[acyl-carrier-protein] hydrolase] [or:brassica napus] [sr:,rape] [ec:3.1.2.14] [db:pir] |
| 207838_c1_77 | 620 | 3223 | 537 | 178 | 333 | 3.00E-30 | [ac:p94464] [gn:sun] [or:bacillus subtilis] [de:sun protein (fragment)] [sp:p94464] [db:swissprot] |
| 20787663_c2_42 | 621 | 3224 | 429 | 142 | 80 | 0.035 | [ac:p55192] [gn:ywcfipa-42d] [or:bacillus subtilis] [de:hypothetical 14.3 kd protein in rng-feuc intergenic region] [sp:p55192] [db:swissprot] |
| 208375_c1_44 | 622 | 3225 | 696 | 231 | 270 | 1.00E-22 | [ac:s74882] [pn:hypothetical protein sll151] [or:synechocystis sp.] [sr:pcc 6803,, pcc 6803] [db:pir] |
| 20878208_f3_5 | 623 | 3226 | 333 | 110 | 193 | 2.10E-15 | [ac:s52544] [pn:is12 protein] [or:lactobacillus helveticus] [db:pir] |
| 20898562_f1_3 | 624 | 3227 | 1638 | 545 | 1318 | 1.30E-134 | [ac:d69772] [pn:atp-dependent rna helicase homolog ydbr] [gn:ydbr] [or:bacillus |

TABLE 2-continued

| Orf | NT Seq ID | AA Seq ID | NT Orf Length | AA Orf Length | Score | Probability | Description |
|---|---|---|---|---|---|---|---|
| 20902160_c1_30 | 625 | 3228 | 843 | 280 | 96 | 0.063 | subtilis] [db:pir] [ac:q10479] [gn:spac17c9.07] [or:schizosaccharomyces pombe] [sr:fission yeast] [ec:2.4.1.-] [de:putative glucosyltransferase c17c9.07.] [sp:q10479] [db:swissprot] |
| 20917202_f3_29 | 626 | 3229 | 876 | 291 | 336 | 1.40E-30 | [ac:c69808] [pn:transporter homolog yfkh] [gn:yfkh] [or:bacillus subtilis] [db:pir] |
| 20917212_c2_69 | 627 | 3230 | 1200 | 399 | 515 | 1.60E-49 | [ac:jn0097] [pn:secreted 45k protein precursor] [or:lactococcus lactis] [db:pir] |
| 20939052_c1_26 | 628 | 3231 | 471 | 156 | 106 | 9.20E-05 | [ln:mtci65] [ac:z95584] [pn:unknown] [gn:mtci65.21c] [or:mycobacterium tuberculosis] [db:genpept-bct] [de:mycobacterium tuberculosis cosmid i65.] [nt:mtci65.01, unknown, len:213. tbparse score is] [le:19042] [re:19683] |
| 20943938_f3_6 | 629 | 3232 | 879 | 292 | 119 | 3.60E-05 | [ac:s32215] [pn:hypothetical protein 1] [or:bacillus megaterium] [db:pir] |
| 20945 2_c1_36 | 630 | 3233 | 1131 | 376 | 888 | 4.60E-89 | [ac:g69866] [pn:hippurate hydrolase homolog ykur] [gn:ykur] [or:bacillus subtilis] [db:pir] |
| 20947876_f3_18 | 631 | 3234 | 642 | 213 | 411 | 1.60E-38 | [ac:p37547] [gn:yabf] [or:bacillus subtilis] [de:hypothetical 20.7 kd protein in metsksga intergenic region] [sp:p37547] [db:swissprot] |
| 20979688_f2_9 | 632 | 3235 | 564 | 187 | 190 | 4.30E-15 | [ac:s71704] [acs:71704] [pn:mip] [gn:mip] [or:legionella pneumophila] [sr:legionella pneumophila philadelphia-1] [db:genpept-bct] [de:mip-24 kda macrophage infectivity potentiator protein [legionellapneumophila, philadelphia-1, genomic, 854 nt.]] [nt:24 k |
| 20980002_c1_33 | 633 | 3236 | 1110 | 369 | 932 | 1.00E-93 | [ac:a69847] [pn:cystathionine gamma-synthase homolog yjci] [gn:yjci] [or:bacillus subtilis] [db:pir] |
| 210433_f1_4 | 634 | 3237 | 606 | 201 | 222 | 5.70E-18 | [ac:p19579] [gn:capa] [or:bacillus anthracis] [de:capa protein] [sp:p19579] [db:swissprot] |
| 21125283_f2_4 | 635 | 3238 | 831 | 276 | | | [ac:p08187] [gn:many:ptsp:pel] [or:escherichia coli] [de:(eii-p-man)] [sp:p08187] [db:swissprot] |
| 2117012_f1_3 | 636 | 3239 | 783 | 260 | 632 | 6.20E-62 | [ac:d64564] [pn:hypothetical protein hp0356] [or:helicobacter pylori] [db:pir] |
| 2119063_c1_20 | 637 | 3240 | 306 | 101 | 80 | 0.013 | [ln:seu77778] [ac:u77778:u29130] [pn:putative membrane protein] [gn:epih] [de:involved in epidermin secretion] [or:staphylococcus epidermidis] [db:genpept-bct] [de:staphylococcus epidermidis plasmid ptue32 putative abc transportersubunits (epig, (epie). |
| 212811_c3_63 | 638 | 3241 | 873 | 290 | 969 | 1.20E-97 | [ac:p22094] [or:lactococcus lactis:lactococcus lactis] [sr:subspcremoris:streptococcus cremoris:subsplactis:streptococcus lactis] [de:hypothetical 30.9 kd protein in pepx 5'region (orf1)] [sp:p22094] [db:swissprot] |
| 2129587_f1_7 | 639 | 3242 | 255 | 84 | 135 | 2.90E-09 | [ac:s28486] [pn:hypothetical protein 2] [or:vibrio cholerae] [db:pir] |
| 214000_c2_84 | 640 | 3243 | 510 | 169 | 160 | 4.40E-11 | [ln:yspphhy] [ac:137084] [pn:phosphopyruvate hydratase] [or:schizosaccharomyces pombe] [sr:schizosaccharomyces pombe cdna to mrna] [de:genpept-pln] [ec:4.2.1.11] [de:schizosaccharomyces pombe phosphopyruvate hydratase mrna, completeceds.] [le:2] [re:1342] |
| 2145308_f3_56 | 641 | 3244 | 792 | 263 | 365 | 1.20E-33 | [ln:smu75471] [acu:75471] [pn:high affinity branched chain amino acid] [gn:livg] [or:streptococcus mutans] [db:genpept-bct] [de:streptococcus mutans putative high affinity branched chain aminoacid transport protein (livg) gene, partial cds.] [le:<1] [re: |
| 2147338_f3_26 | 642 | 3245 | 282 | 93 | 325 | 2.10E-29 | [ac:f69835] [pn:ribosomal protein s14 homolog yhza] [gn:yhza] [or:bacillus subtilis] [db:pir] |
| 21484375_f2_12 | 643 | 3246 | 342 | 113 | 155 | 2.20E-11 | [ln:vumext26] [ac:x86030] [pn:extensin-like protein] [de:v.unguiculata mrna for extensine-like protein, ext26.] [sr:cowpea] [db:genpept-pln] [or:vigna unguiculata] [le:<1] [re:495] [di:direct] |
| 2148503_c1_24 | 644 | 3247 | 1305 | 434 | 360 | 4.10E-33 | [ac:h69837] [pn:conserved hypothetical protein yisq] [gn:yisq] [or:bacillus subtilis] [db:pir] |
| 2148577_c2_38 | 645 | 3248 | 915 | 304 | 1009 | 7.00E-12 | [ln:cau76387] [acu:76387] [pn:prpp synthetase] [gn:prs] [or:corynebacterium ammoniagenes] [db:genpept-bct] [ec:2.7.6.1] [de:corynebacterium ammoniagenes n-acetyl glucoseamine 1-phosphateuridyltransferase (glmu) gene, partial cds, and prpp-synthetase(prs) |

TABLE 2-continued

| Orf | NT Seq ID | AA Seq ID | NT Orf Length | AA Orf Length | Score | Probability | Description |
|---|---|---|---|---|---|---|---|
| 21487643_f2_3 | 646 | 3249 | 648 | 215 | 90 | 0.42 | [1n:ac000784] [ac:ac000784] [pn:b. burgdorferi predicted coding region bbh09] [gn:bbh09] [or:borrelia burgdorferi] [sr:lyme disease spirochete] [db:genpept-bct] [de:borrelia burgdorferi plasmid lp28-3, complete plasmid sequence.] [nt:hypothetical protein; |
| 21489512_c3_107 | 647 | 3250 | 1932 | 643 | 2004 | 2.50E-207 | [ac:s68599] [pn:phosphotransferase system enzyme ii., sucrose-specific:sucrose-specific enzyme ii:sucrose-specific enzyme ii] [gn:scra] [cl:phosphotrotransferase system glucose-specific enzyme ii, factor iii homology] [or:streptococcus sobrinus] [sr:strain 6 |
| 21490627_f3_39 | 648 | 3251 | 5919 | 1972 | 9473 | 0 | [1n:spu47687] [ac:u47687] [pn:immunoglobulin a1 protease] [gn:iga] [or:streptococcus pneumoniae] [sr:streptococcus pneumoniae strain=r6] [db:genpept-bct] [ec:3.4.24.13] [de:streptococcus pneumoniae immunoglobulin a1 protease (iga) gene, complete cds.] [e. |
| 2150417_f1_1 | 649 | 3252 | 882 | 293 | 680 | 5.10E-67 | [ac:f69999] [pn:conserved hypothetical protein ytqi] [gn:ytqi] [or:bacillus subtilis] [db:pir] |
| 2151635_f1_6 | 650 | 3253 | 885 | 294 | 431 | 1.20E-40 | [ac:d70018] [pn:sugar permease homolog yurm] [gn:yurm] [or:bacillus subtilis] [db:pir] |
| 2151575_f3_33 | 651 | 3254 | 735 | 244 | 534 | 1.50E-51 | [acp:39304] [gn:sgah] [or:escherichia coli] [ec:4.1.2.-] [de:3-hexulose 6-phosphate formaldehyde lyase]] [sp:p39304] [dbs:swissprot] |
| 2157543_c1_44 | 652 | 3255 | 186 | 61 | 58 | 0.38 | [acp:39628] [gn:spsh:ipa-70d] [or:bacillus subtilis] [de:spore coat polysaccharide biosynthesis protein spsh] [sp:p39628] [dbs:swissprot] |
| 21517543_f1_1 | 653 | 3256 | 186 | 61 | 56 | 0.49 | [ac:q04703] [gn:ns7] [or:canine enteric coronavirus] [sr:k378,ccv] [de:nonstructural protein 7(11 kd protein) (x3 protein) (6a protein)] [sp:q04703] [dbs:swissprot] |
| 21539687_f1_12 | 654 | 3257 | 1011 | 336 | 1189 | 5.90E-121 | [acq59935] [gn:pmi] [or:streptococcus mutans] [ec:5.3.1.8] [de(pmi) (phosphohexomutase)] [sp:q59935] [dbs:swissprot] |
| 21540626_c1_39 | 655 | 3258 | 381 | 126 | 245 | 6.40E-21 | [acp:32731] [gn:rbfa] [or:bacillus subtilis] [de:ribosome-binding factor a(p15b protein)] [sp:p32731] [dbs:swissprot] |
| 21572212_c3_66 | 656 | 3259 | 1953 | 650 | 3286 | 0 | [acp:14160] [gn:hexb] [or:streptococcus pneumoniae] [de:dna mismatch repair protein hexb] [sp:p14160] [dbs:swissprot] |
| 21581638_c2_62 | 657 | 3260 | 321 | 106 | 470 | 9.10E-45 | [1n:af030367] [ac:af030367] [pn:maturase-related protein] [or:streptococcus pneumoniae] [db:genpept-bct] [de:streptococcus pneumoniae strain nctc11906 alpha, 1-6-glucosidase(dexb) gene, partial cds; maturase-related protein, putativeregulatory protein (cp |
| 21585012_c3_97 | 658 | 3261 | 966 | 321 | 1444 | 5.60E-148 | [1n:spu93576] [ac:93576] [pn:ribonuclease hii] [gn:rnhb] [or:streptococcus pneumoniae] [db:genpept-bct] [de:streptococcus pneumoniae ribonuclease hii (rnhb) gene, complete cds.] [nt:mase hii; ribonuclease h] [le:117] [re:989] [di:direct] |
| 21602312_c1_25 | 659 | 3262 | 705 | 234 | 801 | 7.70E-80 | [ac:d69627] [pn:cell-division atp-binding protein ftse] [gn:ftse] [or:bacillus subtilis] [db:pir] |
| 21609512_f1_16 | 660 | 3263 | 183 | 60 | 74 | 0.0084 | [1n:cet04f8] [ac:z66565] [pn:t04f8.8] [or:caenorhabditis elegans] [db:genpept-inv] [de:caenorhabditis elegans cosmid t04f8, complete sequence.] [nt:cdna est yk12lf1.5 comes from this gene] [le:34969] [re:35259] [di:direct] |
| 21616412_c1_8 | 661 | 3264 | 1725 | 574 | 300 | 4.70E-37 | [1n:mtv039] [ac:a1021942] [pn:hypothetical protein] [gn:mtv039.22] [or:mycobacterium tuberculosis] [db:genpept] [de:mycobacterium tuberculosis protein ps00699] [1e:25221] [re:27854] [di:direct] [nt:mtv039.22, len:877. unknown. contains ps00699] [le:25221] [re:27854] [di:direct] |
| 21617902_c2_15 | 662 | 3265 | 219 | 72 | 239 | 3.00E-20 | [ac:74638] [pn:alanine dehydrogenase:hypothetical protein sll1682:hypothetical protein sll1682] [cl:alanine dehydrogenase:alanine dehydrogenase homology] [or:synechocystis sp.] [srppc 6803,, pcc 6803] [srppc 6803,] [db:pir] |
| 21618765_f3_32 | 663 | 3266 | 192 | 63 | 127 | 2.00E-08 | [1n:spnana] [ac:72967] [or:streptococcus pneumoniae] [db:genpept-bct] [des.pneumoniae nana gene.] [nt:orf2] [1e:193] [re:495] [di:direct] |
| 21619006_f3_18 | 664 | 3267 | 423 | 140 | 498 | 9.80E-48 | [acp:95790] [gn:atpc] [or:streptococcus mutans] [ec:3.6.1.34] [de:atp synthase epsilon chain.] [sp:p95790] [dbs:swissprot] |
| 21640961_c3_125 | 665 | 3268 | 675 | 224 | 356 | 1.10E-32 | [ac:h69278] [pn:glutamine abc transporter, permease protein (glnp) homolog] |

TABLE 2-continued

| Orf | NT Seq ID | AA Seq ID | NT Orf Length | AA Orf Length | Score | Probability | Description |
|---|---|---|---|---|---|---|---|
| 21641687_c1_34 | 666 | 3269 | 186 | 61 | 72 | 0.026 | [or:archaeoglobus fulgidus] [db:pir] [ac:d69439] [pn:conserved hypothetical protein af1517] [or:archaeoglobus fulgidus] [db:pir] |
| 2164187_f2_15 | 667 | 3270 | 654 | 217 | 109 | 7.90E-05 | [ac:d43258] [pn:galactose-6-phosphate isomerase subunit lacb] [or:streptococcus mutans] [db:pir] |
| 21642135_f2_6 | 668 | 3271 | 267 | 88 | 332 | 3.80E-30 | [ac:q00752] [gn:msmk] [or:streptococcus mutans] [de:multiple sugar-binding transport atp-binding protein msmk] [sp:q00752] [db:swissprot] |
| 21645262_c2_92 | 669 | 3272 | 342 | 113 | 221 | 2.20E-18 | [ac:p54454] [gn:yyqei] [or:bacillus subtilis] [de:hypothetical 10.8 kd protein in arod-comer intergenic region] [sp:p54454] [db:swissprot] |
| 21650055_c1_29 | 670 | 3273 | 1422 | 473 | 222 | 1.00E-35 | [ac:c69862] [pn:conserved hypothetical protein ykra] [gn:ykra] [or:bacillus subtilis] [db:pir] |
| 216092_c2_103 | 671 | 3274 | 714 | 237 | 642 | 5.40E-63 | [ac:b69477] [pn:abc transporter, atp-binding protein homolog] [or:archaeoglobus fulgidus] [db:pir] |
| 21675412_f1_2 | 672 | 3275 | 567 | 188 | 198 | 6.10E-16 | [ac:d69868] [pn:conserved hypothetical protein ykvm] [gn:ykvm] [or:bacillus subtilis] [db:pir] |
| 21679837_f1_4 | 673 | 3276 | 831 | 276 | 509 | 6.70E-49 | [ac:d69098] [pn:phosphate transporter permease pstc homolog] [gn:mth1730] [or:metanobacterium thermoautophicum] [db:pir] |
| 21743842_c2_45 | 674 | 3277 | 198 | 65 | 54 | 0.67 | [acs43824] [pn:hypothetical protein] [or:escherichia coli] [db:pir] |
| 21745790_c3_41 | 675 | 3278 | 192 | 63 | 104 | 6.80E-05 | [ac:p50360] [gn:y4hp] [or:rhizobium sp] [sr:ng:r234,] [de:hypothetical 61.7 kd protein y4hp] [sp:p50360] [db:swissprot] |
| 21876816_f3_32 | 676 | 3279 | 972 | 323 | 220 | 2.30E-16 | [ac:p55340] [gn:ecsb:prsti] [or:bacillus subtilis] [de:protein ecsb] [sp:p55340] [db:swissprot] |
| 21882936_c3_16 | 677 | 3280 | 207 | 68 | 59 | 0.0021 | [ac:p02928] [gn:male] [or:escherichia coli] [de:protein] (mmbp)] [sp:p02928] [db:swissprot] |
| 21914057_c1_5 | 678 | 3281 | 720 | 239 | 738 | 3.60E-73 | [ln:ldgappgk] [ac:aj000339] [pn:triseshophate isomerase] [gn:tpi] [or:lactobacillus delbrueckii] [db:genpept-bct] [ec:5.3.1.1] [de:lactobacillus delbrueckii ygap, gap, pgk, tpi, and ycse genes.] [le:3599] [re:4357] [di:direct] |
| 21914717_c1_84 | 679 | 3282 | 708 | 235 | 784 | 4.90E-78 | [ac:p44865] [gn:gpma:hi0757] [or:haemophilus influenzae] [ec:5.4.2.1] [de:(bpg-dependent pgam)] [sp:p44865] [db:swissprot] |
| 21915942_c2_105 | 680 | 3283 | 861 | 286 | 781 | 1.00E-77 | [ac:h69878] [pn:protein kinase homolog ylop] [gn:ylop] [or:bacillus subtilis] [db:pir] |
| 21953208_f2_22 | 681 | 3284 | 1089 | 362 | 180 | 9.10E-12 | [ac:q47141:p76583:p77167] [gn:yfht] [or:escherichia coli] [de:hypothetical transcriptional regulator in csie-glya intergenic region] [sp:q47141:p76583:p77167] [db:swissprot] |
| 21954401_f2_26 | 682 | 3285 | 228 | 75 | 55 | 0.39 | [ln:ac001156] [ac:ae000783] [pn:xylulokinase (xylb)] [gn:bb0545] [or:borrelia burgdorferi] [sr:lyme disease spirochete] [db:genpept-bct] [de:borrelia burgdorfeti (section 42 of 70) of the complete genome.] [nt:similar to gp:1750125 |
| 21955188_f1_1 | 683 | 3286 | 216 | 71 | 58 | 0.34 | [ln:af037218] [ac:af037218] [pn:unknown] [gn:u13] [or:human gerpesvirus 7] [db:genpept-vrl] [de:human herpesvirus 7 strain rk, complete genome.] [le:23742] [re:24038] [di:direct] |
| 21958403_f3_60 | 684 | 3287 | 189 | 62 | 48 | 0.6 | [ln:ac002396] [ac:ac002396] [or:arabidopsis thaliana] [se:thale cress] [db:genpept-pln] [de:arabidopsis thaliana chromosome i bac f3i6 genomic sequence, complete sequence.] [nt:hypothetical protein] [le:36763] [re:37944] [di:complement] |
| 2196926_c3_29 | 685 | 3288 | 759 | 252 | 800 | 9.80E-80 | [ac:37478] [gn:yycf] [or:bacillus subtilis] [de:intergenic region] [sp:p37478] [db:swissprot] |
| 22003537_f2_15 | 686 | 3289 | 1104 | 367 | 648 | 1.30E-63 | [ac:q45539] [gn:csbb] [or:bacillus subtilis] [de:csbb protein] [sp:q45539] [db:swissprot] |
| 22031641_f1_5 | 687 | 3290 | 726 | 241 | 311 | 6.40E-28 | [ln:d89963] [ac:d89963] [pn:negative regulatory protein of pho regulon] [gn:phou] [or:enterobacter cloacae] [sr:enterobacter cloacae (strain:ifo3320) dna] [db:genpept-bct] [de:enterobacter cloacae psts, pstc, psta, pstb and phou genes, complete cds.] [nt:t |

TABLE 2-continued

| Orf | NT Seq ID | AA Seq ID | NT Orf Length | AA Orf Length | Score | Probability | Description |
|---|---|---|---|---|---|---|---|
| 22031938_f1_1 | 688 | 3291 | 354 | 117 | 138 | 1.40E-09 | [ac:p39044] [gn:x] [or:bacillus sphaericus] [de:30s ribosomal protein s14 homolog] [sp:p39044] [db:swissprot] |
| 22031952_f1_7 | 689 | 3292 | 1719 | 572 | 1712 | 2.20E-176 | [ln:spdexcap] [ac:z47210] [pn:unknown] [gn:orf3] [or:streptococcus pneumoniae] [db:genpept-bct] [de:s.pneumoniae dexb, cap3a, cap3b and cap3c genes and orfs.] [nt:this reading frame is extended at its 3' end by a] [le:9579] [re:10796] [di:direct] |
| 22033311_f3_16 | 690 | 3293 | 447 | 148 | 179 | 6.30E-14 | [ac:a69220] [pn:conserved hypothetical protein mth898] [gn:mth898] [or:methanobacterium thermoautotrophicum] [db:pir] |
| 22050166_f3_34 | 691 | 3294 | 270 | 89 | 64 | 0.19 | [ln:mpmura] [ac:x99776] [pn:udp-n-acetylglucosamine] [gn:mura] [or:mycobacterium phlei] [db:genpept-bct] [ec:2.5.1.7] [de:m.phlei mura gene, and rmaf operon promoter region.] [le:<1] [re:339] [di:direct] |
| 22051281_f1_5 | 692 | 3295 | 876 | 291 | 310 | 8.20E-28 | [ac:e64128] [pn:lic-1 homolog] [gn:lice] [or:haemophilus influenzae] [db:pir] |
| 22062757_f1_1 | 693 | 3296 | 876 | 291 | 77 | 0.0022 | [ac:p34859] [gn:nd41] [or:apis mellifera] [sr:honeybee] [ec:1.6.5.3] [de:nadh-ubiquinone oxidoreductase chain 41,] [sp:p34859] [db:swissprot] |
| 22070285_c1_20 | 694 | 3297 | 237 | 78 | 60 | 0.0029 | [ac:p20498] [gn:i11] [or:vaccinia virus] [sr:copenhagen,] [de:protein i1] [sp:p20498] [db:swissprot] |
| 22110665_f1_12 | 695 | 3298 | 1174 | 392 | 632 | 6.20E-62 | [ac:c69596] [pn:branched-chain amino acid transporter brab] [gn:barb] [or:bacillus subtilis] [db:pir] |
| 22113576_c3_20 | 696 | 3299 | 675 | 224 | 101 | 0.01 | [ac:q01608] [gn:spe-4:zk524.1] [or:caenorhabditis elegans] [de:integral membrane protein spe-4] [sp:q01608] [db:pir] |
| 22147543_c3_97 | 697 | 3300 | 696 | 231 | 100 | 0.0011 | [ln:af013216] [ac:af013216:u81372] [pn:unknown] [or:myxococcus xanthus] [db:genpept-bct] [de:myxococcus xanthus dog (dog), isocitrate lyase (icl), mls (mls),ufo (ufo), fumarate hydratase (fhy), and proteosome major subunit(clpp) genes, complete cds; and a |
| 22219375_c3_39 | 698 | 3301 | 498 | 165 | 100 | 0.0025 | [ln:tipis866a] [acm25805] [pn:unknown protein] [or:plasmid ti] [srplasmid ti dna] [db:genpept-bct] [de:a.tumefaciens ti plasmid is866 insertion sequence in ta-iaah auxinsynthesis gene dna.] [nt:orf1, putative] [le:1427] [re:2395] [di:direct] |
| 22220057_c3_64 | 699 | 3302 | 576 | 191 | 106 | 0.0012 | [ac:p46330] [gn:yxat:e3a] [or:bacillus subtilis] [de:hypothetical 44.3 kd protein in gntr-htpg intergenic region] [sp:46330] [db:swissprot] |
| 22265702_f3_88 | 700 | 3303 | 228 | 75 | 55 | 0.58 | [ac:s27893] [pn:119jr protein] [or:african swine fever virus:asfv] [db:pir] |
| 22268927_f1_18 | 701 | 3304 | 198 | 65 | 290 | 1.10E-25 | [ln:spdnagcpo] [ac:y11463] [gn:pod] [or:streptococcus pneumoniae] [db:genpept-bct] [de:streptococcus pneumoniae dnag, rpod, cpoa genes and orf3 and orf5.] [le:566] [re:1675] [di:direct] |
| 22227302_c3_44 | 702 | 3305 | 1035 | 344 | 1533 | 2.10E-157 | [ac:s47979:s42857] [pn:alib protein precursor] [gn:alib] [or:streptococcus pneumoniae] [db:pir] |
| 22227318_f1_1 | 703 | 3306 | 330 | 109 | 283 | 6.00E-25 | [ac:69998] [pn:thioredoxin h1 homolog yttpp] [or:bacillus subtilis] [db:pir] |
| 22275187_f3_33 | 704 | 3307 | 513 | 170 | 482 | 4.90E-46 | [ln:llaj109] [acaj000109] [pn:gluthatione peroxidase] [gn:gpo] [or:lactococcus lactis] [db:genpept-bct] [de:lactococcus lactis carb and gpo genes.] [le:163] [re:636] [di1.direct] |
| 22228155_c3_22 | 705 | 3308 | 996 | 331 | 71 | 0.13 | [ac:p28319] [gn:cwp1:ykl096w:yk1443:yjul] [or:saccharomyces cerevisiae] [sr:baker's yeast] [de:cell wall protein cwp1 precursor] [sp:p28319] [db:swissprot] |
| 22297253_f1_7 | 706 | 3309 | 891 | 296 | 653 | 3.70E-64 | [ac:37544] [gn:yabc] [or:bacillus subtilis] [de:hypothetical 33.0 kd protein in xpac-abrb intergenic region] [sp:37544] [db:swissprot] |
| 22229837_c1_26 | 707 | 3310 | 843 | 280 | 450 | 1.20E-42 | [ac:a70039] [pn:abc transporter (atp-binding protein) homolog yvfr] [gn:yvfr] [or:bacillus subtilis] [db:pir] |
| 22304756_c2_26 | 708 | 3311 | 327 | 108 | 135 | 2.90E-09 | [ac:b47342] [pn:transposase homolog, lct 5'-region] [or:lactococcus lactis subsp. lactis] [db:pir] |
| 22304758_c1_27 | 709 | 3312 | 195 | 64 | 53 | 0.21 | [ln:atac002505] [ac:ac003008] [pn:putative pectinesterase] [gn:t9j22.11] [or:arabidopsis thaliana] [sr:thale cress] [db:genpept-pln] [de:arabidopsis thaliana chromosome ii bac t9j22 genomic sequence, complete sequence.] [le:33072:34384] [re:34026: |

TABLE 2-continued

| Orf | NT Seq ID | AA Seq ID | NT Orf Length | AA Orf Length | Score | Probability | Description |
|---|---|---|---|---|---|---|---|
| 22305342_c1_152 | 710 | 3313 | 519 | 172 | 66 | 0.97 | [ac:jc5482] [pn:hypothetical 13.2k protein] [or:*staphylococcus xylosus*] [db:pir] |
| 22345642_f2_16 | 711 | 3314 | 399 | 132 | 56 | 0.69 | [ln:mmu91573] [ac:u91573] [pn:glucose-6-phosphatase] [gn:g6pase] [or:*mus musculus*] [sr:house mouse] [db:genpept-rod] [de:*mus musculus* glucose-6-phosphatase (g6pase) gene, exon 1 andpartial cds.] [le:834] [re: |
| 22347125_c3_62 | 712 | 3315 | 369 | 122 | 391 | 2.10E−26 | [ln:d64071] [ac:d64071] [pn:putative protein of unknown function] [or:*actinobacillus actinomycetemcomitans*] [sr:*actinobacillus actinomycetemcomitans* (strain:y4) dna] [db:genpept-bct] [de:*actinobacillus actinomycetemcomitans* dna for ribosomal proteins,part |
| 22350093_f2_15 | 713 | 3316 | 315 | 104 | 402 | 1.50E−37 | [ac:p45596] [gn:ptsh] [or:*streptococcus mutans*] [de:phosphocarrier protein hpr (histidine-containing protein)] [sp:p45596] [db:swissprot] |
| 2235806_c1_49 | 714 | 3317 | 249 | 82 | 81 | 0.0015 | [ln:cbanb] [ac:x92973] [gn:bont] [or:*clostridium botulinum* a] [db:genpept-bct] [de:*c.botulinum* a ntnh and bont genes.] [le:3626] [re: |
| 22375025_f3_29 | 715 | 3318 | 987 | 328 | 451 | 9.40E−43 | [ac:a61607] [pn:probable hemolysin precursor] [or:*streptococcus agalactiae*] [db:pir] |
| 22386526_c2_57 | 716 | 3319 | 561 | 186 | 184 | 1.90E−14 | [ln:cef46b3] [ac:z81540] [pn:f46b3.o] [or:*caenorhabditis* elegans] [db:genpept-inv] [de:*caenorhabditis elegans* cosmid f46b3, complete sequence.] [nt:protein predicted using genefinder, preliminary] [le:28586:28938] [re:28597:29456] [di:directjoin] |
| 22398381_f3_47 | 717 | 3320 | 435 | 144 | 62 | 0.76 | [ln:beumtrps13] [ac:d73380] [pn:ribosomal protein s13] [gn:rps13] [or:mitochondrion beta vulgaris] [sr:beta vulgaris (strain:tk81-ms) leaf mitochondrion dna] [db:genpept-pln] [de:sugar beet mitochondrial dna for ribosomal protein s13, completeand partial |
| 22400312_f3_8 | 718 | 3321 | 575 | 192 | 354 | 1.80E−32 | [ac:p39779] [gn:cody] [or:*bacillus subtilis*] [de:cody protein] [sp:p39779] [db:swissprot] |
| 22444052_c1_51 | 719 | 3322 | 576 | 191 | 400 | 2.40E−37 | [ac:d69989] [pn:hypothetical protein ytcg] [gn:ytcg] [or:*bacillus subtilis*] [db:pir] |
| 22455301_c1_16 | 720 | 3323 | 2133 | 710 | 2281 | 1.10E−236 | [ln:bovclpab] [ac:134677] [pn:clp-like atp-dependent protease binding subunit] [or:bos taurus] [sr:bos taurus calf thymus cdna to mrna] [db:genpept-mam] [de:bovine putative clp-like atp-dependent protease binding subunit(clpa/clpb) mrna, partial cds.] [nt |
| 22457527_f2_17 | 721 | 3324 | 366 | 121 | 55 | 0.7 | [ln:aau87543] [ac:u87543] [pn:steroid hormone receptor homolog] [gn:aahr3-1] [or:*aedes aegypti*] [sr:yellow fever mosquito] [db:genpept-inv] [de:*aedes aegypti* steroid hormone receptor homolog (aahr3-1) gene,partial cds, and lian-aa1 retrotransposon protein |
| 22460040_c1_28 | 722 | 3325 | 525 | 174 | 107 | 0.0018 | [ln:mmu67916] [ac:u67916] [pn:dentin sialophosphoprotein precursor] [gn:dspp] [or:*mus musculus*] [sr:house mouse] [db:genpept] [de:*mus musculus* dentin sialophosphoprotein precursor (dspp) mrna,complete cds.] [nt:encodes dentin sialoprotein, dentin phosphop |
| 22460327_f2_17 | 723 | 3326 | 708 | 235 | 648 | 1.30E−63 | [ac:f69676] [pn:two-component response regulator involved in phosphate regulat phop] [gn:phop] [or:*bacillus subtilis*] [db:pir] |
| 22460451_f3_5 | 724 | 3327 | 1245 | 414 | 311 | 6.40E−28 | [ac:p54535] [gn:yqix] [or:*bacillus subtilis*] [de:intergenic region precursor] [sp:p54535] [db:swissprot] |
| 22462812_c1_36 | 725 | 3328 | 621 | 206 | 94 | 0.015 | [ac:q09202] [gn:ah6.3] [or:*caenorhabditis elegans*] [de:hypothetical 25.9 kd protein ah6.3 in chromosome ii] [sp:q09202] [db:swissprot] |
| 22469576_c1_23 | 726 | 3329 | 477 | 158 | 57 | 0.72 | [ac:b70043] [pn:hypothetical protein yvkn] [gn:yvkn] [or:*bacillus subtilis*] [db:pir] |
| 22475053_c1_41 | 727 | 3330 | 261 | 86 | 109 | 1.60E−06 | [ac:a69271] [pn:hypothetical protein af0169] [or:*archaeoglobus fulgidus*] [db:pir] |
| 22478212_c1_31 | 728 | 3331 | 984 | 327 | 592 | 1.10E−57 | [ac:s77512] [pn:hypothetical protein] [cl:malk protein homology] [or:synechocystis sp.] [sr:pcc 6803,, pcc 6803] [sr:pcc 6803,] [db:pir] |
| 22536061_f3_9 | 729 | 3332 | 567 | 188 | 983 | 4.00E−99 | [ac:p38O34] [or:*streptococcus pneumoniae*] [*de:hypothetical 23.1 kd protein in pona* 5'region] [sp:p38034] [db:swissprot] |
| 22536532_c1_168 | 730 | 3333 | 375 | 124 | 53 | 0.89 | [ln:af003349] [ac:af003349] [pn:npc1] [gn:npc1] [or:*mus musculus*] [sr:house mouse] [db:genpept-rod] [de:*mus musculus* npc1 gene, partial cds and wild type intron containingmalr insertion site.] [le:<1:2116] [re:139: |
| 22542163_f3_13 | 731 | 3334 | 405 | 134 | 67 | 0.059 | [ac:69441] [pn:glutaredoxin (grx-1) homolog] [or:*archaeoglobus fulgidus*] [db:pir] |

TABLE 2-continued

| Orf | NT Seq ID | AA Seq ID | NT Orf Length | AA Orf Length | Score | Probability | Description |
|---|---|---|---|---|---|---|---|
| 22551911_f1_1 | 732 | 3335 | 840 | 279 | 866 | 9.90E-87 | [ac:h69789] [pn:1-iditol 2-dehydrogenase homolog ydjl] [gn:ydjl] [or:bacillus subtilis] |
| 22665883_c3_40 | 733 | 3336 | 210 | 69 | 51 | 0.27 | [n:rumcettu1] [ac:104563] [pn:cellulase] [gn:cela] [fn:endo-beta-1,4 glucanase] [or:ruminococcus albus] [db:genpept-bct] [de:ruminococcus albus cellulase (ceta) gene, complete cds.] [le:404] [re:1639] [di:direct] |
| 22675212_c3_98 | 734 | 3337 | 981 | 326 | 464 | 3.90E-44 | [ac:d69670] [pn:glycine betaine/carnitine/choline abc transporter (membrane p) opucb] [gn:opucb] [or:bacillus subtilis] [db:pir] |
| 22689010_c3_90 | 735 | 3338 | 450 | 149 | 166 | 3.20E-12 | [ac:p49330] [gn:rgg] [or:streptococcus gordonii challis] [de:rgg protein] [sp:p49330] [db:swissprot] |
| 22745637_c2_36 | 736 | 3339 | 588 | 196 | 426 | 4.20E-40 | [ac:p12040] [gn:purn] [or:bacillus subtilis] [ec:2.1.2.2] [de:transformylase] (5'-phosphoribosylglycinamide transformylase) [sp:p12040] [db:swissprot] |
| 22792168_f2_4 | 737 | 3340 | 2838 | 945 | 3452 | 0 | [ac:f69729] [pn:excinuclease abc (subunit a) uvra] [n:uvra] [or:bacillus subtilis] |
| 22792963_c2_75 | 738 | 3341 | 555 | 185 | 173 | 2.70E-13 | [ac:c65048] [pn:hypothetical protein b2682] [or:escherichia coli] [db:pir] |
| 22832637_f3_6 | 739 | 3342 | 1608 | 535 | 747 | 4.00E-74 | [ac:g69992] [pn:spore cortex protein homolog ytgp] [gn:ytgp] [or:bacillus subtilis] [db:pir] |
| 22837811_c3_234 | 740 | 3343 | 336 | 111 | 83 | 0.00093 | [n:cer11d1] [ac:z75547] [pn:r11d1.8] [or:caenorhabditis elegans] [db:genpept-inv] [de:caenorhabditis elegans cosmid r11d1, complete sequence.] [nt:protein predicted using genefinder; similarity to] [le:25319:25544] [re:25497:25745] [di:complementjoin] |
| 22845183_c1_13 | 741 | 3344 | 660 | 219 | 787 | 2.30E-78 | [n:spu11799] [ac:u11799] [or:streptococcus pyogenes] [db:genepept-bct] [de:streptococcus pyogenes insertion sequence is1239 putativetransposase gene, complete cds.] [nt:putative transposase] [le:379] [re:1359] [di:direct] |
| 22845183_f3_17 | 742 | 3345 | 660 | 219 | 788 | 1.80E-78 | [n:spu11799] [ac:u11799] [or:streptococcus pyogenes] [db:genpept-bct] [de:streptococcus pyogenes insertion sequence is1239 putativetransposase gene, complete cds.] [nt:putative transposase] [le:379] [re:1359] [di:direct] |
| 22848265_c1_40 | 743 | 3346 | 393 | 130 | 338 | 8.90E-31 | [ac:p07842] [gn:rpsi] [or:bacillus stearothermophilus] [de:30s ribosomal protein s9 (bs10)] [sp:p07842] [db:swissprot] |
| 22850201_f1_1 | 744 | 3347 | 240 | 79 | 117 | 1.40E-06 | [ac:p55454] [gn:y4fp] [or:rhizobium sp] [srngr234;] [de:probable abc transporter periplasmic binding protein y4fp precursor] [sp:p55454] [db:swissprot] |
| 22851577_f1_8 | 745 | 3348 | 876 | 291 | 551 | 2.40E-53 | [ac:q08291] [or:bacillus stearothermophilus] [ec:2.5.1.10] [de:(fpp synthase)] [sp:q08291] [db:swissprot] |
| 22852217_c3_32 | 746 | 3349 | 1281 | 426 | 775 | 4.40E-77 | [ac:p48795] [gn:pyrc] [or:lactobacillus leichmanii] [ec:3.5.2.3] [de:dihydroorotase, (dhoase)] [sp:p48795] [db:swissprot] |
| 22855342_c3_47 | 747 | 3350 | 834 | 277 | 443 | 6.60E-42 | [n:ecouw67] [ac:u18997] [or:escherichia coli] [db:genpept-bct] [de:escherichia coli k-12 chromosomal region from 67.4 to 76.0 minutes.] [nt:orf_o290; geneplot suggests frameshift linking to] [le:66149] [re:67021] [di:direct] |
| 22867337_f2_11 | 748 | 3351 | 1548 | 515 | 1623 | 6.00E-167 | [ac:d70009] [pn:abc transporter (atp-binding protein) homolog yufo] [gn:yufo] [or:bacillus subtilis] [db:pir] |
| 22898576_c1_13 | 749 | 3352 | 348 | 115 | 59 | 0.3 | [ac:i40760:s47318] [pn:hypothetical protein 3] [or:campylobacter jejuni] [db:pir] |
| 22899142_f3_21 | 750 | 3353 | 1434 | 477 | 1351 | 4.00E-138 | [ac:a69581] [pn:acetyl-coa carboxylase (biotin carboxylase subunit) accc] [gn:accc] [or:bacillus subtilis] [db:pir] |
| 22902200_f2_24 | 751 | 3354 | 1464 | 487 | 1283 | 6.40E-131 | [ac:q02001] [gn:trpe] [or:lactococcus lactis] [sr:subsplactis:streptococcus lactis] [ec:4.1.3.27] [de:anthranilate synthase component i.,] [sp:q02001] [db:swissprot] |
| 22902311_c2_193 | 752 | 3355 | 354 | 117 | 89 | 0.013 | [ac:p08799] [gn:mhca] [or:dictyostelium discoideum] [sr:slime mold] [de:myosin ii heavy chain, non muscle] [sp:p08799] [db:swissprot] |
| 22927187_c2_56 | 753 | 3356 | 714 | 237 | 145 | 1.70E-08 | [ac:c69159] [pn:conserved hypothetical protein mth453] [gn:mth453] [or:methanobacterium thermautotrophicum] [db:pir] |
| 22933438_f2_6 | 754 | 3357 | 942 | 313 | 1564 | 1.10E-160 | [ac:p18794] [gn:amid] [or:streptococcus pneumoniae] [de:oligopeptide transport permease protein amid] [sp:p18794] [db:swissprot] |
| 22938463_f2_11 | 755 | 3358 | 390 | 129 | 73 | 0.011 | [n:spnana] [ac:x72967] [or:streptococcus pneumoniae] [db:genpept-bct] [de:s.pneumoniae nana gene,] [nt:orf2] [le:193] [re:495] [di:direct] |

TABLE 2-continued

| Orf | NT Seq ID | AA Seq ID | NT Orf Length | AA Orf Length | Score | Probability | Description |
|---|---|---|---|---|---|---|---|
| 22948387_f1_10 | 756 | 3359 | 966 | 321 | 1579 | 2.80E-162 | [ln:spu53509][ac:u53509][pn:surface adhesin a precursor][gn:psaa][or:*streptococcus pneumoniae*][db:genpept-bct][de:*streptococcus pneumoniae* surface adhesin a precursor (psaa) gene,complete cds.][nt:fimbrial adhesin][le:189][re:1118][di:direct] |
| 23438577_f3_10 | 757 | 3360 | 741 | 246 | 306 | 2.40E-26 | [ac:e69602][pn:late competence operon required for dna binding and uptake comec][gn:comec][or:*bacillus subtilis*][db:pir] |
| 23442262_f3_22 | 758 | 3361 | 903 | 300 | 702 | 2.40E-69 | [ac:q54776][gn:accd][or:synechococcus sp][sr:pcc 7942,anacystis nidulans r2][ec:6.4.1.2][de(ec 6.4.1.2)][sp:q54776][db:swissprot] |
| 23442888_c3_139 | 759 | 3362 | 228 | 75 | 59 | 0.011 | [ac:a64678][pn:hypothetical protein hp1265][or:*helicobacter pylori*][db:pir] |
| 23447177_f3_5 | 760 | 3363 | 618 | 205 | 246 | 5.00E-21 | [ac:f69900][pn:transposon-related protein homolog yoca][gn:yoca][or:*bacillus subtilis*][db:pir] |
| 2345336_f1_2 | 761 | 3364 | 357 | 118 | 172 | 3.20E-12 | [ln:ab007465][ac:ab007465][pn:dna gyrase subunit a][gn:gyra coding region encoding for dna gyrase subunit][or:*streptococcus thermophilus*][sr:*streptococcus thermophilus* (strain:m-192) dna][db:genpept-bct][de:*streptococcus thermophilus* gene for dna g |
| 2345442_c3_22 | 762 | 3365 | 609 | 202 | 113 | 0.00034 | [ac:s76167][pn:hypothetical protein][or:synechocystis sp.][sr:pcc 6803,, pcc 6803][sr:pcc 6803.][db:pir] |
| 23470327_c3_51 | 763 | 3366 | 240 | 79 | 152 | 4.60E-11 | [ln:soonrfs][ac:z79691][gn:yorfe][fn:putative transcription regulator][or:*streptococcus pneumoniae*][db:genpept-bct][de:*s.pneumoniae* yorf[a,b,c,d,e], ftsl, pbpx and regr genes,][le:2388][re:2582][di:complement] |
| 234705_f2_3 | 764 | 3367 | 222 | 73 | 58 | 0.00024 | [ln:af017754][ac:af017754][pn:resistance protein candidate][gn:rgc4a][or:*lactuca sativa*][sr:garden lettuce][db:genpept-pln][de:*lactuca sativa* resistance protein candidate (rgc4a) gene, partialcds.][le:<1][re: |
| 23470967_f2_23 | 765 | 3368 | 1641 | 546 | 322 | 1.30E-26 | [ln:ae001139][ac:ae001139:ae000783][pn:oligopeptide abc transporter, periplasmic]-[gn:bb00328][or:*borrelia burgdorferi*][sr:lyme disease spirochete][db:genpept-bct][de:*borrelia burgdorferi* (section 25 of 70) of the complete genome.][nt:similar to gp: |
| 23472652_f1_11 | 766 | 3369 | 228 | 75 | 59 | 0.21 | [ln:celc10a4][ac:u23454][gn:c10a4.1][or:*caenorhabditis elegans*][db:genpept-inv][de:*caenorhabditis elegans* cosmid c10a4.][*elegans* strain=bristol n2][gn:ylyb][or:*bacillus subtilis*][db:swissprot] |
| 23476702_f3_45 | 767 | 3370 | 888 | 295 | 899 | 3.20E-90 | [ac:q45480][gn:ylyb][or:*bacillus subtilis*][de:hypothetical 33.7 kd protein in lsp-pyrr intergenic region (orf-x)][sp:q45480][db:swissprot] |
| 23478375_f3_59 | 768 | 3371 | 1347 | 448 | 1099 | 2.00E-111 | [ac:q06752][gn:cyss:spna][or:*bacillus subtilis*][ec:6.1.1.16][det:cysrs]][sp:q06752][db:swissprot] |
| 23478382_c1_18 | 769 | 3372 | 474 | 157 | 444 | 5.20E-42 | [ac:p37455][gn:ssb][or:*bacillus subtilis*][de:single-strand binding protein (ssb) (helix-destabilizing protein)][sp:p37455][db:swissprot] |
| 23478426_f2_5 | 770 | 3373 | 1572 | 523 | 1585 | 6.40E-163 | [ac:p12048][gn:purh:purh][or:*bacillus subtilis*][ec:2.1.2.3:3.5.4.10][de(inosinicase)(imp synthetase) (atic)][sp:p12048][db:swissprot] |
| 23478452_f2_25 | 771 | 3374 | 828 | 275 | 389 | 3.50E-36 | [ac:f64819][pn:hypothetical protein b0822][or:*escherichia coli*][db:pir] |
| 23480333_f1_2 | 772 | 3375 | 2256 | 751 | 221 | 1.30E-14 | [ln:ecu23723][ac:u23723][fn:unknown][or:*escherichia coli*][db:genpept-bct][de:*escherichia coli* orf300 and orf732 genes, complete cds.][nt:torf732][re:3870][di:direct] |
| 23484787_f3_7 | 773 | 3376 | 321 | 106 | 54 | 0.67 | [1h:bpjt5][ac:x97994][pn:1-aminocyclopropane-1-carboxylate oxidase][gn:acoh5][or:*betula pendula*][sr:european white birch][db:genpept-pln][de:*h.pendula* mrna for 1-aminocyclopropane-1-carboxylate oxidasehomolog, acoh5.][le:<1][re:175][di:direct] |
| 23485012_f2_10 | 774 | 3377 | 2370 | 789 | 1124 | 4.50E-114 | [ac:o08365][gn:mtcy21cl2.02][or:*mycobacterium tuberculosis*][sp:o08365][dbswissprot][de:putative cation-transporting atpase cy21c12.02,][sp:o08365][dbswissprot] |
| 23490630_c1_41 | 775 | 3378 | 471 | 56 | 76 | 0.0082 | [ac:p23939][or:*bacillus amyloliquefaciens*][de:bamhi control element][sp:p23939][db:swissprot] |
| 23490882_f1_15 | 776 | 3379 | 570 | 189 | 221 | 2.20E-18 | [ln:u91581][ac:u91581:u04057][fn:unknown][or:*lactococcus lactis* lactis][db:genpept-bct][de:*lactococcus lactis* lactis lactcin 481 operon, preprolacticin 481(lcta), lctm (lctm), lctt (lctt), lctf (lctf), lcte (lcte), andlctg (lctg) genes, complete cds |

TABLE 2-continued

| Orf | NT Seq ID | AA Seq ID | NT Orf Length | AA Orf Length | Score | Probability | Description |
|---|---|---|---|---|---|---|---|
| 23490882_f1_17 | 777 | 3380 | 570 | 189 | 221 | 2.20E-18 | [ln:u91581] [ac:u91581;u04057] [fn:unknown] [or:lactococcus lactis lactis] [db:genpept-bct] [de:lactococcus lactis lactis lactic 481 operon, preprolacticin 481(lcta), lctm (lctm), lctt (lctt), lctf (lctf), lcte (lcte), andlctg (lctg) genes, complete cds |
| 23490882_f1_3 | 778 | 3381 | 570 | 189 | 221 | 2.20E-18 | [ln:u91581] [ac:u91581;u04057] [fn:unknown] [or:lactococcus lactis lactis] [db:genpept-bct] [de:lactococcus lactis lactis lactic 481 operon, preprolacticin 481(lcta), lctm (lctm), lctt (lctt), lctf (lctf), lcte (lcte), andlctg (lctg) genes, complete cds |
| 23491555_f2_1 | 779 | 3382 | 2061 | 687 | 2242 | 1.50E-232 | [ac:p39814] [gn:topa;topi] [or:bacillus subtilis] [ec:5.99.1.2] [de:(untwisting enzyme) (swivelase)] [sp:p39814] [db:swissprot] |
| 23493467_c2_81 | 780 | 3383 | 645 | 214 | 342 | 3.30E-31 | [ln:scu96166] [ac:u96166] [pn:atp-binding cassette protein] [gn:tptc] [or:streptococcus crista] [db:genpept-bct] [de:streptococcus crista atp-binding cassette lipoprotein (tpta),atp-binding cassette transporter-like protein (tptb), atp-bindingcassette pro |
| 23496000_c2_94 | 781 | 3384 | 600 | 199 | 283 | 6.00E-25 | [ac:h69850] [pn:mutator mutt protein homolog yjhb] [gn:yjhb] [or:bacillus subtilis] [db:pir] |
| 23517127_c1_140 | 782 | 3385 | 366 | 121 | 160 | 9.70E-11 | [ln:cabtran] [ac:147121] [pn:atp-dependent translocator] [gn:cbnt] [or:carnobacterium piscicola] [db:genpept-bct] [de:carnobacterium piscicola transposase, bacteriocin, histidineprotein kinase, atp dependent transloactor, accessory protein, and carnobacter |
| 23518758_c3_87 | 783 | 3386 | 231 | 76 | 64 | 0.092 | [ln:spnana] [ac:x72967] [or:streptococcus pneumoniae] [de:s.pneumoniae nana gene.] [nt:orf2] [le:193] [re:495] [di:direct] |
| 23522530_c1_41 | 784 | 3387 | 393 | 130 | 80 | 0.0019 | [ac:o69764] [pn:conserved hypothetical protein yene] [gn:yene] [or:bacillus subtilis] [db:pir] |
| 23522577_f1_1 | 785 | 3388 | 1488 | 495 | 1240 | 2.30E-126 | [ac:p54547] [gn:zwf] [or:bacillus subtilis] [ec:1.1.1.49] [de:glucose-6-phosphate 1-dehydrogenase, (g6pd)] [sp:p54547] [db:swissprot] |
| 23525250_f2_6 | 786 | 3389 | 1065 | 354 | 684 | 1.90E-67 | [ac:o69856] [pn:conserved hypothetical protein ykgb] [gn:ykgb] [or:bacillus subtilis] [db:pir] |
| 23525261_f2_7 | 787 | 3390 | 1086 | 361 | 1305 | 3.00E-133 | [ln:af014460] [ac:af014460] [pn:pepq] [gn:pepq] [fn:hydrolysis of leu-pro] [or:streptococcus mutans] [db:genpept-bct] [de:streptococcus mutans pepq and ccpa gencs, complete cds.] [nt:dipeptidase] [le:53] [re:1132] [di:complement) |
| 23525327_c2_19 | 788 | 3391 | 678 | 225 | 141 | 2.30E-07 | [ac:s76167] [pn:hypothetical protein] [or:synechocystis sp.] [sr:pcc 6803, pcc 6803] [sr:pcc 6803,] [db:pir] |
| 23526933_c1_42 | 789 | 3392 | 345 | 114 | 110 | 1.30E-06 | [ac:s75475] [pn:transposase;protein slr1524] [or:synechocystis sp.] [sr:pcc 6803,, pcc 6803] [sr:pcc 6803] [db:pir] |
| 23540831_f3_14 | 790 | 3393 | 825 | 274 | 796 | 2.60E-79 | [ac:58418] [gn:pstb;mj1012] [or:methanococcus jannaschii] [de:probable phosphate transport atp-binding protein pstb] [sp:q58518] [db:swissprot] |
| 23540902_f3_17 | 791 | 3394 | 966 | 321 | 423 | 8.70E-40 | [ac:p30363] [gn:ansa] [or:bacillus licheniformis] [ec:3.5.1.1] [de:1-asparaginase,(1-asparagine amidohydrolase)] [sp:p30363] [db:swissprot] |
| 23541687_f1_2 | 792 | 3395 | 1296 | 431 | 1353 | 2.50E-138 | [ln:stis1193] [ac:y13713] [pn:transposase] [or:streptococcus thermophilus] [db:genpept-bct] [de:streptococcus thermophilus insertion sequence is1193 transposasegene.] [le:130] [re:1386] [di:direct] |
| 23551282_f2_6 | 793 | 3396 | 510 | 169 | 285 | 3.70E-25 | [ac:p26380] [gn:leve;sac1] [or:bacillus subtilis] [ec:2.7.1.69] [de:(ec 2.7.1.69) (p18)] [sp:p2630] [db:swissprot] |
| 23556563_f2_9 | 794 | 3397 | 924 | 307 | 674 | 2.20E-66 | [ac:h69620] [pn:malonyl coa-acyl carrier protein transacylase fabd] [gn:fabd] [or:bacillus subtilis] [db:pir] |
| 23572150_f1_9 | 795 | 3398 | 480 | 159 | 322 | 4.40E-29 | [ac:p43906] [gn:arok] [or:lactococcus lactis] [sr:,subsplactis::streptococcus lactis] [ec:2.7.1.71] [de:shikimate kinase, (sk)] [sp:p43906] [db:swissprot] |
| 23573883_f2_15 | 796 | 3399 | 477 | 158 | 561 | 2.10E-54 | [ln:strcomaa] [ac:m36180:115190] [pn:transposase] [or:streptococcus pneumoniae] [sr:streptococcus pneumoniae (strain rx1).dna] [db:genpept-bct] [de:streptococcus pneumoniae transposase, (coma and comb) and saicarsynthetase (purc) genes, complete cds.] [nt |
| 23559027_c1_72 | 797 | 3400 | 918 | 305 | 374 | 1.40E-34 | [ln:d87026] [ac:d87026;s28136] [pn:membrane protein] [or:bacillus |

TABLE 2-continued

| Orf | NT Seq ID | AA Seq ID | NT Orf Length | AA Orf Length | Score | Probability | Description |
|---|---|---|---|---|---|---|---|
| 23597692_c3_23 | 798 | 3401 | 351 | 116 | 552 | 1.90E-53 | stearothermophilus [sr:bacillus stearothermophilus (strain:trbe14) dna] [db:genpept-bct] [de:bacillus stearothermophilus dna for glycogen operon, complete cds.] [nt:the orf is similar to t |
| 23598187_c1_14 | 799 | 3402 | 2040 | 679 | 3359 | 0 | [in:strcomaa] [ac:m36180:1159190] [pn:transposase] [or:streptococcus pneumoniae] [sr:streptococcus pneumoniae (strain rx1) dna] [db:genpept-bct] [de:streptococcus pneumoniae transposase, (coma and comb) and saicarsynthetase (pure) genes, complete cds.] [nt |
| 23598752_c1_22 | 800 | 3403 | 279 | 92 | 181 | 3.80E-14 | [ac:q54986] [gn:uvrb:uvs402] [or:streptococcus pneumoniae] [de:exinuclease abc subunit b] [sp:q54986] [db:swissprot] |
| 23598752_f1_1 | 801 | 3404 | 1599 | 532 | 200 | 2.90E-15 | [ac:p37543] [gn:yabb] [or:bacillus subtilis] [de:hypothetical 28.3 kd protein in xpac-abrb intergenic region] [sp:p37543] [db:swissprot] |
| 23600636_f3_25 | 802 | 3405 | 726 | 241 | 231 | 1.90E-19 | [ac:e69827] [pn:glycerophosphodiester phosphodiesterase homolog yhdw] [gn:yhdw] [or:bacillus subtilis] [db:pir] |
| 23601553_f1_11 | 803 | 3406 | 438 | 145 | 298 | 1.50E-26 | [in:d90848] [ac:d90848:ab001340] [pn:pts system, galacitol-specific iic component] [gn:gatc] [or:escherichia coli] [sr:escherichia coli (strain:k12) dna, clone_lib:kohara lambda minise] [db:genpept-bct] [de:e.coli genomic dna, kohara clone #359(46.8-47.2 |
| 23603437_c3_29 | 804 | 3407 | 2283 | 760 | 880 | 3.30E-88 | [ac:p19079] [gn:cdd] [or:bacillus subtilis] [ec:3.5.4.5] [de:cytidine deaminase, (cytidine aminohydrolase) (cda)] [sp:p19079] [db:swissprot] |
| 23605062_c3_57 | 805 | 3408 | 456 | 152 | 174 | 6.50E-12 | [in:btu67061] [ac:u67061] [pn:pullulanase] [gn:puli] [or:bacteroides thetaiotamicron] [db:genpept-bct] [de:bacteroides thetaiotamicron pullulanase (puli) gene, complete cds.] [le:402] [re:2408] [di:direct] |
| 23609628_c1_53 | 806 | 3409 | 615 | 204 | 90 | 0.092 | [ac:d69617] [pn:dna polymerase iii (alpha subunit) dnae] [gn:dnae] [or:bacillus subtilis] [db:pir] |
| 23610958_f1_13 | 807 | 3410 | 972 | 323 | 424 | 6.80E-40 | [ac:h64446] [pn:hypothetical protein homolog mj1178] [or:methanococcus jannaschii] [db:pir] [mp:rev1117459-1116404] |
| 23611517_c1_51 | 808 | 3411 | 234 | 77 | 156 | 1.70E-11 | [ac:p29823] [gn:lacf] [or:agrobacterium radiobacter] [de:lactose transport system permease protein lacf] [sp:p29823] [db:swissprot] |
| 23620638_f1_6 | 809 | 3412 | 726 | 241 | 680 | 5.10E-67 | [in:ssu34305] [ac:u34305] [or:shigella sonnei] [sr:shigella sonnei strain=53g] [db:genpept-bct] [de:shigella sonnei form i operon of protein genes, complete cds, insertion sequence is630 protein gene, complete cds.] [nt:orf8; method: conceptual translatio |
| 23632827_c3_205 | 810 | 3413 | 273 | 90 | 73 | 0.025 | [in:lllvsfpep] [acx:997101] [pn:methyltransferase] [or:lactococcus lactis] [db:genpept-bct] [de:l.lactis orf, genes homologous to vsf-1 and pep2 and gene encoding protein homologous to methyltransferase.] [nt:homology with (db4004)] [le:3803] [re:4486] [di |
| 23632962_f1_6 | 811 | 3414 | 654 | 217 | 330 | 6.30E-30 | [ac:b64505] [pn:hypothetical protein mj1644] [or:methanococcus jannaschii] [db:pir] [mp:for1627138-1627671] |
| 23633443_f1_2 | 812 | 3415 | 1062 | 353 | 689 | 5.70E-68 | [ac:d69433] [pn:abc transporter, atp-binding protein homolog] [or:archaeoglobus fulgidus] [db:pir] |
| 23633568_c3_36 | 813 | 3416 | 291 | 96 | 69 | 0.052 | [in:ae001165] [ac:ae001165:ae000783] [pn:spermidine/putrescine abc transporter,] [gn:bb0642] [or:borrelia burgdorferi] [sr:lyme disease spirochete] [db:genpept-bct] [de:borrelia burgdorferi (section 51 of 70) of the complete genome.] [nt:similar to gb:m64 |
| 23634632_f3_17 | 814 | 3417 | 432 | 143 | 126 | 2.60E-08 | [ac:p17162] [gn:ptsn] [or:klebsiella pneumoniae] [ec:2.7.1.69] [de:(phosphotransferase enzyme ii, a component)] [sp:p17162] [db:swissprot] |
| 23634687_f2_12 | 815 | 3418 | 1443 | 480 | 694 | 1.70E-68 | [ac:g69354] [pn:trk potassium uptake system protein (trkh) homolog] [or:archaeoglobus |

TABLE 2-continued

| Orf | NT Seq ID | AA Seq ID | NT Orf Length | AA Orf Length | Score | Probability | Description |
|---|---|---|---|---|---|---|---|
| 23634691_f2_7 | 816 | 3419 | 414 | 138 | 282 | 7.60E-25 | *fulgidus*] [db:pir] [ac:p45080] [gn:mrdg:hi1155] [or:*haemophilus influenzae*] [ec:1.97.1.-] [de:(ec 1.97.1.-)] [sp:p45080] [dbswissprot] |
| 23640750_c2_32 | 817 | 3420 | 771 | 256 | 526 | 1.10E-50 | [ac:f69726] [pn:pseudouridylate synthase i trua] [gn:trua] [or:*bacillus subtilis*] [db:*pir*] |
| 23640783_c2_57 | 818 | 3421 | 183 | 60 | 109 | 1.60E-06 | [ac:p55614] [gn:y4pe,y4sa] [or:*rhizobium sp*] [sr:ngr234,] [de:hypothetical 15.5 kd protein y4pe/y4sa] [sp:p55614] [dbswissprot] |
| 23641630_f1_2 | 819 | 3422 | 2001 | 666 | 2177 | 1.20E-225 | [ac:p18255:p06570] [gn:thrs:thrsv] [or:*bacillus subtilis*] [ec:6.1.1.3] [de:(thrrs)] [sp:p18255:p06570] [dbswissprot] |
| 23641684_c2_38 | 820 | 3423 | 719 | 239 | 1193 | 2.20E-121 | [ac:s47979:s42857] [pn:alib protein precursor] [gn:alib] [or:*streptococcus pneumoniae*] [db:pir] |
| 23642512_f1_1 | 821 | 3424 | 1734 | 577 | 987 | 1.50E-99 | [ac:q05506] [gn:ydr341c:d9651.10] [or:*saccharomyces cerevisiae*] [sr,:baker's yeast] [ec:6.1.1.19] [de:-tma ligase) (argrs)] [sp:q05506] [dbswissprot] |
| 23642687_f3_11 | 822 | 3425 | 282 | 93 | 366 | 9.60E-34 | [ac:p35593] [gn:msra:exp3] [or:*streptococcus pneumoniae*] [de:(exported protein 3)] [sp:p35593] [dbswissprot] |
| 23647577_c1_27 | 823 | 3426 | 597 | 198 |  |  | [ln:af030360] [ac:af030360] [pn:dtdp-4-keto-6-deoxyglucose-3,5-epimerase] [gn:cpsm] [or:*streptococcus pneumoniae*] [db:genepept-bct] [de:*streptococcus pneumonia* strain sp-496 glucose-1-phosphate thymidyltransferase (cps) gene, partial cds; anddtp-4-keto- |
| 23648388_f3_33 | 824 | 3427 | 189 | 62 | 55 | 0.47 | [ln:ddu61403] [ac:u61403] [pn:pn:pn:prla] [or:*dictyostelium discoideum*] [db:genepept-inv] [de:*dictyostelium discoideum* prla (prla) mrna, partial cds.] [nt:proliferation-associated protein; similar to] [le:<1] [re:1142] [di:direct] |
| 23651658_c3_5 | 825 | 3428 | 573 | 191 | 967 | 2.00E-97 | [ac:p77432:q98894] [gn:ydev] [or:*escherichia coli*] [de:hypothetical sugar kinase in hipb-uxab intergenic region] [sp:p77432:q98894] [dbswissprot] |
| 23671912_f3_7 | 826 | 3429 | 720 | 239 | 477 | 1.70E-45 | [ac:p24247] [gn:pfs] [or:*escherichia coli*] [de:pfs protein (p46)] [sp:p24247] [dbswissprot] |
| 23673561_c3_87 | 827 | 3430 | 252 | 83 | 147 | 1.20E-09 | [ac:p37469] [dn:dnac] [or:*bacillus subtilis*] [ec:3.6.1.-] [de:replicative dna helicase,] [sp:p37469] [dbswissprot] |
| 23676288_c2_42 | 828 | 3431 | 1404 | 467 | 1095 | 5.40E-111 | [ac:p54475] [gn:yqfr] [or:*bacillus subtilis*] [de:abc transporter, atp-binding protein intergenic region] [sp:p54475] [dbswissprot] |
| 23676443_c3_229 | 829 | 3432 | 918 | 305 | 87 | 0.052 | [ln:ae001158] [ac:ae001158:ae000783] [pn:abc transporter, atp-binding protein] [gn:bb0573] [or:*borrelia burgdorferi*] [sr:lyme disease spirochete] [db:genepept-bct] [de:*borrelia burgdorferi* (section 44 of 70) of the complete genome.] [nt:similar to sp:p4690 |
| 23679692_f3_10 | 830 | 3433 | 2058 | 685 | 1450 | 1.30E-148 | [ac:p54381] [gn:glys] [or:*bacillus subtilis*] [ec:6.1.1.14] [de:beta chain) (glyrs)] [sp:p54381] [dbswissprot] |
| 23688782_c2_114 | 831 | 3434 | 1074 | 357 | 532 | 2.50E-51 | [ln:shu75349] [ac:u75349] [pn:putative permease shie] [or:*serpulina hydodysenteriae* [db:genpept-bct] [de:*serpulina hydodysenteriae* shi operon, periplasmic-iron-bindingproteins shia and shib, putative abc transporter shic, and putativepermeases shid and shi |
| 23704058_f2_9 | 832 | 3435 | 366 | 121 | 407 | 4.30E-38 | [ac:b69701] [pn:ribosomal protein s19 (bs19) rpss] [gn:rpss] [or:*bacillus subtilis*] [db:pir] |
| 23709388_f1_2 | 833 | 3436 | 343 | 115 | 87 | 0.00035 | [ac:b54545] [pn:hypothetical protein] [or:*lactococcus lactis* subsp. lactis] [db:pir] |
| 23713562_c3_23 | 834 | 3437 | 483 | 160 | 164 | 2.40E-12 | [ac:70031] [pn:mutator mutt protein homolog yvci] [gn:jyci] [or:*bacillus subtilis*] [db:pir] |
| 23713876_f2_10 | 835 | 3438 | 192 | 63 | 136 | 2.00E-08 | [ac:q00565] [gn:lcnd] [or:*lactococcus lactis*:*lactococcus lactis* sr,:subsplactis:*streptococcus*:*streptococcus cremoris* [de:lactococcin a secretion protein lend] [sp:q00565] [dbswissprot] |
| 23725302_f1_10 | 836 | 3439 | 288 | 95 | 74 | 0.063 | [ln:scyb1028c] [ac:z35789,y13134] [or:*saccharomyces cerevisiae*] [sr:baker'yeast] [db:genpept-pln] [de:*s. cerevisiae* chromosome ii reading frame orfyb1028c.] [nt:orf yb1029w] [le:<1] [re:1077] [di:direct] |

TABLE 2-continued

| Orf | NT Seq ID | AA Seq ID | NT Orf Length | AA Orf Length | Score | Probability | Description |
|---|---|---|---|---|---|---|---|
| 23728550_f2_22 | 838 | 3441 | 1326 | 441 | 776 | 3.40E-77 | [ac:q45400] [gn:celb] [or:bacillus stearothermophilus] [de:permease iic component) (phosphotransferase enzyme ii, c component)] [sp:q45400] [dbs:swissprot] |
| 23730000_f2_15 | 839 | 3442 | 525 | 174 | 57 | 0.79 | [ac:e57256] [pn:hypothetical protein (leua 5′ region)] [or:haemophilus influenzae] [db:pir] |
| 237750_c2_97 | 840 | 3443 | 861 | 286 | 394 | 1.00E-36 | [ac:h69876] [pn:cell-division protein homolog ylmh] [gn:ylmh] [or:bacillus subtilis] [db:pir] |
| 23878750_c3_25 | 841 | 3444 | 723 | 240 | 488 | 1.10E-46 | [ac:q02170] [gn:ysxa] [or:bacillus subtilis] [de:dna repair protein radc homolog (orfb)] [sp:q02170] [dbs:swissprot] |
| 23879063_f3_31 | 842 | 3445 | 828 | 275 | 65 | 0.72 | [ln:oscore12] [ac:z75507] [pn:reverse transcriptase] [or:oryza sativa] [sr:rice] [db:genpept-pln] [de:o.sativa reverse transcriptase gene of copia-like retrotransposon(ret12).] [le:<1] [re: |
| 23828537_c3_33 | 843 | 3446 | 819 | 272 | 583 | 9.70E-57 | [ac:p43751] [gn:pfla:act:hi0179] [or:haemophilus influenzae] [ee:1.97.1.4] [de:pyruvate formate-lyase 1 activating enzyme.] [spp:p43751] [dbs:swissprot] |
| 23829407_f1_1 | 844 | 3447 | 192 | 63 | 60 | 0.23 | [ac:p48264] [gn:psbw] [or:cyanophora paradoxa] [de:photosystem ii reaction centre w protein] [sp:p48264] [dbs:swissprot] |
| 23829508_f2_82 | 845 | 3448 | 204 | 67 | 69 | 0.2 | [ln:spbc16e9] [ac:z99759] [pn:hypothetical protein] [gn:spbc16e9.08] [or:schizosaccharomyces pombe] [sr:fission yeast] [db:genpept-pln] [des.pombe chromosome ii cosmid c16e9.] [nt:spbc16e9.08, unknown, len:355aa] [le:12550] [re:13617] [di:direct] |
| 23832950_f2_3 | 846 | 3449 | 1188 | 395 | 926 | 4.40E-93 | [ac:p50889] [gn:rps1] [or:homo sapiens] [sr:human] [de:40s ribosomal protein s1 (fragment)] [spp:p50889] [dbs:swissprot] |
| 23833467_f3_42 | 847 | 3450 | 531 | 176 | 176 | 1.30E-13 | [ac:p46854] [gn:yhhy] [or:escherichia coli] [de:hypothetical 18.8 kd protein in gntr-ggt intergenic region (o162)] [sp:p46854] [dbs:swissprot] |
| 23835005_c3_32 | 848 | 3451 | 435 | 144 | 98 | 2.40E-05 | [ln:rnmdg2] [ac:y08769] [pn:microvascular endothelial differentiation gene] [gn:mdg2] [or:rattus norvegicus] [sr:norway rat] [db:genpept-rod] [de:r.norvegicus mrna for microvascular endothelial differentiationgene 2.] [le:57] [re:446] [di:direct] |
| 23836552_f2_22 | 849 | 3452 | 828 | 275 | 894 | 1.10E-89 | [ln:d78182] [ac:d78182] [gn:orf4] [or:streptococcus mutans] [sr:streptococcus mutans (strain:xc) dna] [de:streptococcus mutans dna for dtdp-rhamnose synthesis pathway,complete cds.] [le:1708] [re:2496] [di:direct] |
| 23861077_f2_6 | 850 | 3453 | 960 | 319 | 726 | 6.80E-72 | [ln:atceld] [ac:z77855] [pn:sugar-binding transport protein] [or:anaerocellum thermophilum] [db:genpept-bct] [de:a.thermophilum celd gene.] [nt:putative] [le:2944] [re:3882] [di:direct] |
| 23861592_f1_2 | 851 | 3454 | 309 | 102 | 84 | 0.00073 | [ac:s68955] [pn:polyphenolic adhesive protein 3b:foot protein 3b] [or:mytilus galloprovincialis] [db:pir] |
| 23863528_f2_6 | 852 | 3455 | 279 | 92 | 35 | 0.5 | [ac:p12143] [gn:rp136] [or:oryza sativa:zea mays] [sr:rice:maize] [de:chloroplast 50s ribosomal protein 136] [spp:p12143] [dbs:swissprot] |
| 23869036_c2_11 | 853 | 3456 | 1302 | 433 | 1678 | 8.90E-173 | [ac:p12047] [gn:purb:pure] [or:bacillus subtilis] [ec:4.3.2.2] [de:adenylosuccinate lyase, (adenylosuccinase) (asl)] [spp:p12047] [dbs:swissprot] |
| 23875052_f3_84 | 854 | 3457 | 441 | 146 | 53 | 0.96 | [ac:i39482] [pn:msl leader peptide 2] [cl:msl leader peptide] [or:streptococcus agalactiae] [db:pir] |
| 23876468_f3_10 | 855 | 3458 | 240 | 79 | 132 | 6.00E-09 | [ac:p39667] [gn:yrxa] [or:bacillus subtilis] [de:hypothetical 19.7 kd protein in phea-nifs intergenic region (orf1)] [sp:p39667] [dbs:swissprot] |
| 23877186_f2_3 | 856 | 3459 | 189 | 62 | 77 | 0.004 | [ac:e70002] [pn:conserved hypothetical protein ytwf] [gn:ytwf] [or:bacillus subtilis] [db:pir] |
| 23881927_c2_186 | 857 | 3460 | 882 | 293 | 660 | 6.70E-65 | [ln:us88974] [ac:us88974] [pn:orf12] [or:streptococcus thermophilus] [db:genpept-bct] [de:streptococcus thermophilus bacteriophage 01205 dna sequence.] [le:6564] [re:7373] [di:direct] |
| 23882057_f3_41 | 858 | 3461 | 234 | 77 | 64 | 0.092 | [ln:af004649] [ac:af004649] [pn:nadh dehydrogenase subunit 1] [or:mitochondrion nesticus stygius] [sr:nesticus stygius] [db:genpept-inv] [de:nesticus stygius 16s |

TABLE 2-continued

| Orf | NT Seq ID | AA Seq ID | NT Orf Length | AA Orf Length | Score | Probability | Description |
|---|---|---|---|---|---|---|---|
| 23884836_c1_46 | 859 | 3462 | 603 | 200 | 137 | 2.20E-07 | ribosomal rna gene, partial sequence, trna-leugene, complete sequence, and nadh dehydrogenase [ac:p05719] [gn:hsds:hss] [or:escherichia coli] [de:type i restriction enzyme ecoki specificity protein (s protein)] [sp:p05719] [db:swissprot] |
| 23885416_f2_3 | 860 | 3463 | 219 | 72 | 113 | 1.90E-06 | [ac:p54535] [gn:yyqix] [or:bacillus subtilis] [de:intergenic region precursor] [sp:p54535] [db:swissprot] |
| 23906385_f2_80 | 861 | 3464 | 234 | 77 | 68 | 0.094 | [ln:celf33d11] [ac:af039720] [gn:f33d11.9b] [or:caenorhabditis elegans] [sr:caenorhabditis elegans strain=bristol n2] [db:genpept-inv] [de:caenorhabditis elegans cosmid f33d11.] [nt:coded for by c. elegans cdna yk355d7.5; coded for] [ie:24524:26060:26702] |
| 23909388_c3_208 | 862 | 3465 | 189 | 62 | 64 | 0.3 | [ln:hsu46010] [ac:u46010] [pn:hgf agonist/antagonist] [or:homo sapiens] [sr:human] [db:genpept-pri2] [de:human hgf agonist/antagonist mrna, complete cds.] [nt:hepatocyte growth factor agonist/antagonist] [ie:55] [re:687] [di:direct] |
| 23911055_f2_14 | 863 | 3466 | 999 | 332 | 397 | 5.00E-37 | [ln:bsu20445] [ac:u20445] [pn:bira protein] [gn:bira] [fn:biotin protein ligase, biotin operon repressor] [or:bacillus subtilis] [db:genpept-bct] [de:bacillus subtilis biotin protein ligase, biotin operon repressor(bira) gene, complete cds.] [ie:97] [re:1 |
| 23912561_f1_6 | 864 | 3467 | 336 | 111 | 86 | 0.0021 | [ln:plu03982] [acu03982] [pn:presumed viral infectivity factor] [gn:vif] [or:puma lentivirus 14] [db:genpept-vrl] [de:puma lentivirus 14 (gag), polyprotein (pol), viral infectivityfactor (vif), and envelope precursor (env) genes, complete cds.] [ie:5419 |
| 23922207_c2_15 | 865 | 3468 | 216 | 71 | 69 | 0.2 | [ac:p31958] [gn:leub] [or:clostridium pasteurianum] [ec:1.1.1.85] [de:(imdh) (3-ipm-dh)] [sp:p31958] [db:swissprot] |
| 23922512_f2_4 | 866 | 3469 | 189 | 62 | 63 | 0.18 | [ac:s61385] [pn:icmx protein precursor] [gn:icmx] [or:legionella pneumophila] [db:pir] |
| 23937902_c2_48 | 867 | 3470 | 927 | 308 | 258 | 2.70E-22 | [ac:c64128] [pn:lic-1 protein b] [gn:iicb] [or:haemophilus influenzae] [db:pir] |
| 23940638_f2_23 | 868 | 3471 | 720 | 239 | 189 | 9.70E-15 | [ac:p80057] [gn:blase] [or:bacillus licheniformis] [ec:3.4.21.19] [de:endopeptidase) (gse)] [sp:p80057] [db:swissprot] |
| 23941555_f3_28 | 869 | 3472 | 423 | 140 | 415 | 6.10E-39 | [ac:p46899:p70969] [gn:rplr] [or:bacillus subtilis] [de:50s ribosomal protein 118] [sp:p46899:p70969] [db:swissprot] |
| 23941687_c1_33 | 870 | 3473 | 231 | 76 | 74 | 0.029 | [ac:p08286] [or:gallus gallus] [sr:,chicken] [de:histone h1.10] [sp:p08286] [db:swissprot] |
| 23944155_f1_2 | 871 | 3474 | 870 | 289 | 1162 | 4.30E-118 | [ln:spadca] [ac:z71552] [pn:hydrophobic membrane protein] [gn:adcb] [or:streptococcus pneumoniae] [db:genpept-bct] [de:streptococcus pneumoniae adccba operon.] [ie:714] [re:1517] [di:direct] |
| 23944813_f3_7 | 872 | 3475 | 282 | 93 | 171 | 3.20E-12 | [ac:p36672] [gn:treb] [or:escherichia coli] [ec:2.7.1.69] [de:(ec 2.7.1.69) (eii-tre)] [sp:p36672] [db:swissprot] |
| 23947937_f3_6 | 873 | 3476 | 552 | 183 | 875 | 1.10E-87 | [ln:strcromaa] [ac:m36180:115190] [pn:transposase] [or:streptococcus pneumoniae] [sr:streptococcus pneumoniae (strain rx1) dna] [db:genpept-bct] [de:streptococcus pneumoniae transposase, (coma and comb) and saicarsynthetase (pure) genes, complete cds.] [nt |
| 23953257_f2_18 | 874 | 3477 | 630 | 209 | 87 | 0.3 | [ln:af005720] [ac:af005720] [pn:chloride channel 2] [gn:clc-2] [or:rattus norvegicus] [sr:norway rat] [db:genpept] [de:rattus norvegicus chloride channel (clc-2) gene, alternativelyspliced products, complete cds.] [nt:clc-2sb; alternatively spliced produc |
| 23955027_f3_50 | 875 | 3478 | 480 | 159 | 437 | 2.90E-41 | [ln:spu11799] [ac:u11799] [or:streptococcus pyogenes] [db:genpept-bct] [de:streptococcus pyogenes insertion sequence is 1239 putativetransposase gene, complete cds.] [nt:putative transposase] [ie:379] [re:1359] [di:direct] |
| 23960137_f3_13 | 876 | 3479 | 1719 | 572 | 901 | 1.90E-90 | [ac:q11047] [gn:mtcy50.10] [or:mycobacterium tuberculosis] [de:hypothetical abc transporter atp-binding protein cy50.10] [sp:q11047] [db:swissprot] |
| 2398253_c3_41 | 877 | 3480 | 246 | 81 | 59 | 0.28 | [ac:p10175] [gn:cox8h] [or:bos taurus] [sr:;bovine] [ec:1.9.3.1] [de:(viiib) (ix)] [sp:p10175] [db:swissprot] |
| 2398580_f1_1 | 878 | 3481 | 189 | 62 | 133 | 3.50E-08 | [ac:p37869] [gn:eno] [or:bacillus subtilis] [ec:4.2.1.11] [de:glycerate hydro-lyase)] |

TABLE 2-continued

| Orf | NT Seq ID | AA Seq ID | NT Orf Length | AA Orf Length | Score | Probability | Description |
|---|---|---|---|---|---|---|---|
| 23992082_f2_12 | 879 | 3482 | 186 | 61 | 57 | 0.41 | [sp:p37869] [db:swissprot] [In:spnana] [ac:x72967] [or:streptococcus pneumoniae] [db:genpept-bct] [de:s.pneumoniae nana gene,] [nt:orf2] [le:193] [re:495] [di:direct] |
| 23993925_f2_10 | 880 | 3483 | 1083 | 360 | 1668 | 1.00E-171 | [In:strmalr] [ac:121856] [pn:repressor protein] [gn:malr] [fn:maltose operon transcriptional repressor] [or:streptococcus pneumoniae] [db:genpept-bct] [de:streptococcus pneumoniae mala protein and repressor protein (malr)genes, complete cds.] [nt:putative |
| 2400711_f2_3 | 881 | 3484 | 411 | 136 | 358 | 6.70E-33 | [In:listms] [ac:m92842] [gn:tms] [or:listeria monocytogenes] [sr:listeria monocytogenes (strain 1028) dna] [db:genpept-bct] [de:listeria monocytogenes tms and prs genes, partial cds.] [le:<1] [re:757] [di:direct] |
| 24021877_f1_3 | 882 | 3485 | 366 | 121 | 601 | 1.20E-58 | [In:strcomaa] [ac:m36180:115190] [pn:transposase] [or:streptococcus pneumoniae] [sr:streptococcus pneumoniae (strain rx1) dna] [db:genpept-bct] [de:streptococcus pneumoniae transposase, (coma and comb) and saicarsynthetase (pure) genes, complete cds.] [nt |
| 24022326_f3_18 | 883 | 3486 | 513 | 170 | 166 | 1.50E-12 | [ac:b70044] [pn:conserved hypothetical protein yvna] [gn:yvna] [or:bacillus subtilis] [db:pir] |
| 24025252_f1_6 | 884 | 3487 | 1140 | 379 | 1885 | 1.00E-194 | [In:spu72720] [ac:u72720] [pn:dnaj] [gn:dnaj] [or:streptococcus pneumoniae] [db:genpept-bct] [de:streptococcus pneumoniae heat shock protein 70 (dnak) gene,complete cds and dnaj (dnaj) gene, partial cds.] [le:3265] [re: |
| 24025675_f3_26 | 885 | 3488 | 216 | 71 | 64 | 0.11 | [In:olu63651] [ac:u63651] [pn:envelope glycoprotein] [gn:env] [or:ovine lentivirus] [db:genpept-vrl] [de:ovine lentivirus envelope glycoprotein (env) gene, partial cds.] [le:<1] [re: |
| 24026635_c2_18 | 886 | 3489 | 525 | 174 | 521 | 3.60E-50 | [ac:e69844] [pn:gtp pyrophosphokinase homolog yjbm] [gn:yjbm] [or:bacillus subtilis] [db:pir] |
| 24031713_f1_9 | 887 | 3490 | 1995 | 664 | 565 | 3.10E-120 | [ac:s75333] [pn:hypothetical protein] [cl:unassigned atp-binding cassette proteins:malk protein homology] [or:synechocystis sp.] [sr:pcc 6803, , pcc 6803] [sr:pcc 6803,] [db:pir] |
| 24032512_f3_30 | 888 | 3491 | 237 | 78 | 75 | 0.02 | [ac:p45103] [gn:hi1198] [or:haemophilus influenzae] [de:hypothetical protein hi1198] [sp:p45103] [db:swissprot] |
| 24063330_c1_158 | 889 | 3492 | 507 | 168 | 260 | 1.60E-22 | [ac:q38627] [gn:1] [or:bacteriophage sf6:bacteriophage rho-15] [de:terminase small subunit (glp] [sp:q38627] [db:swissprot] |
| 24066015_c2_1 | 890 | 3493 | 264 | 87 | 206 | 5.30E-16 | [ac:o08328] [gn:glgA] [or:bacillus stearothermophilus] [ec:2.4.1.21] [de:synthase] [sp:o08328] [db:swissprot] |
| 24068818_f3_40 | 891 | 3494 | 240 | 79 | 68 | 0.16 | [In:asu13767] [ac:u13767] [or:anabaena sp.] [sr:anabaena sp] [db:genpept-bct] [de:anabaena sp. strain pcc 7120 hlyA (hlyA) gene, partial cds andtransposase (tnpa) gene, complete cds.] [nt:orf2] [le:5070] [di:complement] |
| 24070318_f1_7 | 892 | 3495 | 462 | 153 | 117 | 1.40E-06 | [In:cet26e3] [ac:z82053] [pn:t26e3.2] [or:caenorhabditis elegans] [db:genpept-inv] [de:caenorhabditis elegans cosmid t26e3, complete sequence,] [nt:protein predicted using genefinder; similar to mutl] [le:23985:24138:24323:24497] [re:24090:24215:24405:247 |
| 24079383_f3_85 | 893 | 3496 | 219 | 72 | 66 | 0.38 | [ac:p34316] [gn:c07a9.5] [or:caenorhabditis elegans] [de:hypothetical 41.7 kd protein c07a9.5 in chromosome iii] [sp:p34316] [db:swissprot] |
| 24089665_f2_9 | 894 | 3497 | 1221 | 406 | 582 | 1.20E-56 | [In:sgu40139] [ac:u40139] [pn:comb] [gn:comb] [or:streptococcus gordonii] [sr:streptococcus gordonii strain=challis] [db:genpept-bct] [de:streptococcus gordonii abc transporter coma (coma) gene, partialcds and abc transporter comb (comb) and comx (comx) g |
| 24089675_c3_30 | 895 | 3498 | 192 | 63 | 246 | 5.00E-21 | [ac:p23379] [gn:ung] [or:streptococcus pneumoniae] [ec:3.2.2.—] [de:uracil-dna glycosylase,] [sp:p23379] [db:swissprot] |
| 2410026_f2_2 | 896 | 3499 | 921 | 306 | 686 | 1.20E-67 | [ac:e69879] [pn:conserved hypothetical protein ylov] [gn:ylov] [or:bacillus subtilis] |

TABLE 2-continued

| Orf | NT Seq ID | AA Seq ID | NT Orf Length | AA Orf Length | Score | Probability | Description |
|---|---|---|---|---|---|---|---|
| 24105312_f3_28 | 897 | 3500 | 297 | 98 | 60 | 0.23 | [db:pir] [ln:af005898] [ac:af005898] [or:homo sapiens] [sr:human] [db:genpept-pri2] [de:homo sapiens na,k-atpase beta-3 subunit pseudogene, completesequence.] [nt:orf] [le:357] [re:548] [di:direct] |
| 2421 8753_f2_13 | 898 | 3501 | 216 | 71 | 76 | 0.047 | [ac:s43527:s42401] [pn:gene p protein] [or:phage hk022] [db:pir] |
| 2421 8758_f3_38 | 899 | 3502 | 210 | 69 | 76 | 0.047 | [ac:s43527:s42401] [pn:gene p protein] [or:phage hk022] [db:pir] |
| 2420327_f1_9 | 900 | 3503 | 348 | 115 | 77 | 0.03 | [ac:h69970] [pn:conserved hypothetical protein yrah] [gn:yrah] [or:bacillus subtilis] [db:pir] |
| 2420377_f3_18 | 901 | 3504 | 192 | 63 | 55 | 0.099 | [ln:celc48b6] [acu97189] [gn:c48b6.5] [or:caenorhabditis elegans] [sr:caenorhabditis elegans strain=bristol n2] [db:genpept-inv] [de:caenorhabditis elegans cosmid c48b6.] [le:11188:12453:12768] [re:11358:12583:12885] [di:complementjoin] |
| 2422186_c3_35 | 902 | 3505 | 804 | 267 | 500 | 6.00E-48 | [ac:g70000] [pn:two-component response regulator [ytsb] homolog ytsa] [gn:ytsa] [or:bacillus subtilis] [db:pir] |
| 2424062_f1_5 | 903 | 3506 | 1392 | 463 | 327 | 2.50E-27 | [ac:p39695] [gn:come:come3] [or:bacillus subtilis] [de:come operon protein 3] [sp:p39695] [db:swissprot] |
| 2426387_c3_119 | 904 | 3507 | 204 | 67 | 66 | 0.068 | [ln:eespc] [acx01563] [or:escherichia coli] [db:genpept-bct] [de:escherichia coli spc ribosomal protein operon.] [nt:s8 (rpsh) (aa 1-130)] [sp:p02361] [le:1846] [re:2238] [di:direct] |
| 2426537_c2_66 | 905 | 3508 | 579 | 192 | 304 | 3.60E-27 | [ln:aae001163] [ac:ae000783] [pn:4-methyl-5(b-hydroxyethyl)-thiazole] [gn:bb0621] [or:borrelia burgdorferi] [sr:lyme disease spirochete] [db:genpept-bct] [de:borrelia burgdorferi (section 49 of 70) of the complete genome.] [nt:similar to pid:11008 |
| 2427188_c2_18 | 906 | 3509 | 750 | 249 | 915 | 6.40E-92 | [ac:a64963] [pn:hypothetical protein b1983] [or:escherichia coli] [db:pir] |
| 2428387_f3_52 | 907 | 3510 | 288 | 95 | 89 | 0.00022 | [ac:p45911] [gn:yqan] [or:bacillus subtilis] [de:hypothetical 16.1 kd protein in spoiiic-cwla intergenic region] [sp:p45911] [db:swissprot] |
| 2428427_c1_20 | 908 | 3511 | 288 | 95 | 76 | 0.0051 | [ac:p39302] [gn:sgab] [or:escherichia coli] [ec:2.7.1.69] [de:(ec 2.7.1.69)] [sp:p39302] [db:swissprot] |
| 2428462_c1_55 | 909 | 3512 | 201 | 66 | 71 | 0.22 | [ln:celf19c7] [ac:u42439] [gn:f19c7.4] [or:caenorhabditis elegans] [sr:caenorhabditis elegans strain=bristol n2] [db:genpept-inv] [de:caenorhabditis elegans cosmid f19c7.] [nt:similar to human lysosomal pro-x carboxypeptidase] [le:8537:8966:9776:9934] [re |
| 2429202_c2_196 | 910 | 3513 | 381 | 126 | 55 | 0.74 | [ln:humighwmb] [ac:m63030] [pn:immunoglobulin heavy chain j region] [gn:jh6] [or:homo sapiens] [sr:human adult peripheral blood dna] [db:genpept-pri1] [de:human ig germline h-chain j6-region, partial cds.] [nt:putative] [le:<59] [re: |
| 2429692_c1_151 | 911 | 3514 | 345 | 114 | 51 | 0.95 | [ac:s47281] [pn:hypothetical protein 1] [or:williopsis suaveolens] [db:pir] |
| 2423325_c3_121 | 912 | 3515 | 1953 | 650 | 2194 | 1.90E-227 | [ac:p42359] [or:streptococcus gordonii challis] [ec:3.4.24.—] [de:(orf6) (fragment)] [sp:p42359] [db:swissprot] |
| 2424063 l_c3_78 | 913 | 3516 | 573 | 190 | 407 | 4.30E-38 | [ac:p46322] [gn:pgsa] [or:bacillus subtilis] [ec:2.7.8.5] [de:(ec 2.7.8.5) (phosphatidylglycerophosphate synthase) (pgp synthase)] [sp:p46322] [db:swissprot] |
| 2424 5256_c1_29 | 914 | 3517 | 234 | 77 | 68 | 0.036 | [ac:s43483] [pn:hypothetical protein] [or:escherichia coli] [db:pir] |
| 2425153 7_c2_14 | 915 | 3518 | 1338 | 445 | 2219 | 4.20E-230 | [ln:spu16156] [ac:u16156:m17362:m58706] [pn:dihydrofolate synthetase] [gn:sulb] [fn:folate biosynthesis] [or:streptococcus pneumoniae] [db:genpept-bct] [de:streptococcus pneumoniae dihydropteroate synthase (sula),dihydrofolate synthetase |
| 2425340 7_c2_58 | 916 | 3519 | 357 | 118 | 147 | 1.70E-09 | [ac:p35649] [or:eikenella corrodens] [de:hypothetical 66.3 kd protein in hag2 5'region] [sp:p35649] [db:swissprot] |
| 2425691 0_c2_75 | 917 | 3520 | 237 | 78 | 71 | 0.017 | [ln:spnana] [ac:x72967] [or:streptococcus pneumoniae] [db:genpept-bct] [de:s,pneumoniae nana gene.] [nt:orf2] [le:193] [re:495] [di:direct] |
| 2425733 7_f1_3 | 918 | 3521 | 1056 | 351 | 1329 | 8.60E-136 | [ac:q02138] [gn:ilv c] [or:lactococcus lactis] [sr:subsplactis:streptococcus lactis] [ec:1.1.1.86] [de:isomeroreductase) (alpha-keto-beta-hydroxylacil reductoisomerase)] [sp:q02138] [db:swissprot] |

TABLE 2-continued

| Orf | NT Seq ID | AA Seq ID | NT Orf Length | AA Orf Length | Score | Probability | Description |
|---|---|---|---|---|---|---|---|
| 24257752_c3_63 | 919 | 3522 | 231 | 76 | 64 | 0.092 | [ln:sccox6urf] [ac:x14452] [gn:cox6] [or:saccharomyces cerevisiae] [sr:baker's yeast] [db:genpept-pln] [de:s.cerevisiae cox6/urf-u intergenic region.] [nt:urf(aa 1-56)] [le:360] [re:530] [di:direct] |
| 24257763_c3_115 | 920 | 3523 | 234 | 77 | 104 | 5.60E-06 | [ln:af034574] [ac:af034574] [pn:putative cruciform dna binding protein] [gn:gv1] [or:glomus versiforme] [db:genpept-pln] [de:glomus versiforme putative cruciform dna binding protein (gv1) mrna, complete cds.] [nt:similar to ustilago maydis hmp1, encoded by |
| 24257813_c2_60 | 921 | 3524 | 774 | 257 | 1166 | 1.60E-118 | [ac:p52281] [gn:glpf] [or:streptococcus pneumoniae] [de:glycerol uptake facilitator protein] [sp:p52281] [db:swissprot] |
| 24257883_f3_39 | 922 | 3525 | 342 | 113 | 188 | 1.10E-13 | [ac:p32399] [gn:yhge] [or:bacillus subtilis] [de:hypothetical 84.1 kd protein in hemy-gltt intergenic region (orfb)] [sp:p32399] [db:swissprot] |
| 24257962_c2_39 | 923 | 3526 | 702 | 233 | 822 | 4.60E-82 | [ln:spspsa47] [ac:aj002055] [pn:spsa protein] [fn:iga binding protein] [or:streptococcus pneumoniae] [db:genpept-bct] [de:streptococcus pneumoniae siga binding.] [le:1] [re:1746] [di:direct] |
| 24258380_c3_40 | 924 | 3527 | 477 | 158 | 307 | 1.70E-27 | [ln:llabikorf] [ac:y11901] [pn:dutpase] [or:lactococcus lactis] [db:genpept-bct] [de:l.lactis abik gene, gene encoding dutpase and 8 orfs.] [nt:orf3] [le:1518] [re:1937] [di:direct] |
| 24259626_c1_33 | 925 | 3528 | 1344 | 447 | 340 | 5.40E-31 | [ac:q47745] [gn:vansb] [or:enterococcus faecalis] [sr:streptococcus faecalis] [ec:2.7.3.—] [de:protein vansb] (vancomycin histidine protein kinase) [sp:q47745] [db:swissprot] |
| 24267202_c1_80 | 926 | 3529 | 672 | 223 | 480 | 8.00E-46 | [ac:e69876] [pn:conserved hypothetical protein ylme] [gn:ylme] [or:bacillus subtilis] [db:pir] |
| 24267287_c2_201 | 927 | 3530 | 741 | 246 | 74 | 0.036 | [ln:af022236] [ac:af022236] [gn:escs] [or:escherichia coli] [db:genpept-bct] [de:escherichia coli strain e2348/69 pathogenicity island, rorf1 (rorf1), rorf2 (rorf2), escr (escr), escs (escs), esct (esct), escu (escu), cesd (cesd), escc (escc), escj (e |
| 24269061_f1_4 | 928 | 3531 | 420 | 139 | 204 | 1.40E-16 | [ln:sgu81957] [ac:u81957] [pn:comyd] [gn:comyd] [or:streptococcus gordonii] [db:genpept-bct] [de:streptococcus gordonii rna polymerase beta' subunit (rpoc),putative dna binding protein, putative abc transporter subunit,comya (comya), putative abc transport |
| 24273292_f1_1 | 929 | 3532 | 525 | 174 | 705 | 1.10E-69 | [ln:af000954] [ac:af000954] [or:streptococcus mutans] [db:genpept-bct] [de:streptococcus mutans diacylglycerol kinase (dgk) gene, complete cds,and g-protein (sgp) gene, partial cds.] [nt:orf3] [le:205] [re:699] [di:direct] |
| 24297630_f2_20 | 930 | 3533 | 771 | 256 | 148 | 7.70E-14 | [ac:s56619:b65255] [pn:gpmb protein:hypothetical protein o215b] [gn:gpmb] [or:escherichia coli] [db:pir] |
| 24297678_c1_64 | 931 | 3534 | 2571 | 856 | 1507 | 1.20E-154 | [ac:a69979] [pn:conjugation transfer protein homolog yrrc] [gn:yrrc] [or:bacillus subtilis] [db:pir] |
| 24300028_c3_108 | 932 | 3535 | 750 | 249 | 961 | 8.50E-97 | [ac:q07211] [gn:serk] [or:streptococcus mutans] [ec:2.7.1.4] [de:fructokinase.] [sp:q07211] [db:swissprot] |
| 24303452_f2_8 | 933 | 3536 | 201 | 66 | 48 | 0.6 | [ac:37697] [gn:ccpax] [or:acetobacter xylinum] [sr:acetobacter pasteurianus] [de:cellulose complementing protein] [sp:p37697] [db:swissprot] |
| 24303927_f2_19 | 934 | 3537 | 654 | 217 | 376 | 8.30E-35 | [ln:af015310] [ac:af015310] [pn:bth1] [or:brassica napus] [sr:rape] [db:genpept-pln] [de:brassica napus bth1 mrna, complete cds.] [le:20] [re:1591] [di:direct] |
| 24303928_c1_45 | 935 | 3538 | 423 | 140 | 76 | 0.68 | [ac:i47040] [pn:acyl-coa cholesterol acyltransferase, liver (clone 14b)] [or:oryctolagus cuniculus] [sr:, domestic rabbit] [db:pir] |
| 24303962_c1_42 | 936 | 3539 | 699 | 232 | 181 | 9.70E-13 | [ln:u93872] [ac:u93872] [or:kaposi's sarcoma-associated herpesvirus] [sr:kaposi's sarcoma-associated herpesvirus - human herpesvirus 8] [db:genpept-vrl] [de:kaposi's sarcoma-associated herpesvirus glycoprotein m, dnareplication protein, glycoprotein, dna |
| 24304587_f1_1 | 937 | 3540 | 786 | 261 | 374 | 1.40E-34 | [ac:p31728] [gn:hlp:ahi0620] [or:haemophilus influenzae] [de:28 kd outer membrane protein precursor] [sp:p31728] [db:swissprot] |

TABLE 2-continued

| Orf | NT Seq ID | AA Seq ID | NT Orf Length | AA Orf Length | Score | Probability | Description |
|---|---|---|---|---|---|---|---|
| 24306282_c3_18 | 938 | 3541 | 639 | 212 | 440 | 1.40E-41 | [ac:g69815] [pn:abc transporter (atp-binding protein) homolog ygad] [gn:ygad] [or:bacillus subtilis] [db:pir] |
| 24306927_f1_8 | 939 | 3542 | 720 | 239 | 993 | 3.50E-100 | [ac:p29727] [gn:guaa] [or:bacillus subtilis] [ec:6.3.5.2] [de:amidotransferase] (gmp synthetase) [sp:p29727] [db:swissprot] |
| 2430726_c1_34 | 940 | 3543 | 267 | 88 | 137 | 1.80E-09 | [ln:spz82001] [ac:z82001] [pn:unknown] [or:streptococcus pneumoniae] [db:genpept-bct] [de:s.pneumoniae pcpa gene and open reading frames.] [le:<1] [re:174] [di:direct] |
| 2431276_f1_2 | 941 | 3544 | 306 | 101 | 206 | 4.10E-16 | [ac:p42086] [gn:pbux] [or:bacillus subtilis] [de:xanthine permease] [sp:p42086] [db:swissprot] |
| 2431340_f2_2 | 942 | 3545 | 270 | 89 | 63 | 0.65 | [ac:q57944] [gn:mj0524] [or:methanococcus jannaschii] [de:hypothetical protein mj0524] [sp:q57944] [db:swissprot] |
| 2431381_c1_44 | 943 | 3546 | 393 | 130 | 142 | 1.10E-09 | [ac:d64822] [pn:hypothetical protein b0844] [or:escherichia coli] [db:pir] |
| 2431956_c1_30 | 944 | 3547 | 291 | 96 | 73 | 0.2 | [ln:ceb0393] [ac:z37983] [pn:b0393.4] [or:caenorhabditis elegans] [db:genpept-inv] [de:caenorhabditis elegans cosmid b0393, complete sequence.] [nt:amino terminus of this predicted protein is proline] [le:8213:8460:9087] [re:8410:8596:9336] [di:complement |
| 2432816_f3_30 | 945 | 3548 | 468 | 155 | 614 | 5.00E-60 | [ac:o06445] [gn:rplo] [or:staphylococcus aureus] [de:50s ribosomal protein 115] [sp:o06445] [db:swissprot] |
| 2433286_c3_10 | 946 | 3549 | 873 | 290 | 411 | 1.60E-38 | [ac:p45873] [gn:ywke] [or:bacillus subtilis] [de:hemk protein homolog] [sp:p45873] [db:swissprot] |
| 2433465_f1_4 | 947 | 3550 | 276 | 91 | 69 | 0.48 | [ln:celb0507] [ac:u64833] [gn:b0507.6] [or:caenorhabditis elegans] [sr:caenorhabditis elegans strain=bristol n2] [db:genpept-inv] [de:caenorhabditis elegans cosmid b0507.] [re:580:691:830:1889:2298] [re:642:774:991:2008:2404] [di:directjoin] |
| 2433476_c2_104 | 948 | 3551 | 1245 | 414 | 188 | 2.40E-12 | [ln:pseorf1] [ac:d84146] [pn:reductase] [gn:paha] [or:pseudomonas aeruginosa] [sr:pseudomonas aeruginosa (strain:pak1) dna] [db:genpept-bct] [de:pseudomonas aeruginosa pah genes for 12 orfs (components of naphthalene dioxygenase, dehydrogenase, hydratase-a |
| 2433756_f2_7 | 949 | 3552 | 1467 | 488 | 706 | 9.00E-70 | [ac:q11046] [gn:mtcy50.09] [or:mycobacterium tuberculosis] [de:hypothetical abc transporter atp-binding protein cy50.09] [sp:q11046] [db:swissprot] |
| 2433776_c2_43 | 950 | 3553 | 954 | 317 | 1604 | 6.20E-165 | [ln:soorfs] [ac:z79691] [pn:yorfd] [gn:yorfd] [or:streptococcus pneumoniae] [db:genpept-bct] [de:s.pneumoniae yorf[a,b,c,d,e], ftsl, pbpx and regr genes.] [le:2748] [re:3698] [di:direct] |
| 2433790_c2_37 | 951 | 3554 | 570 | 189 | 302 | 5.80E-27 | [ac:q10612] [gn:mtcy373.03] [or:mycobacterium tuberculosis] [de:hypothetical 18.2 kd protein cy373.03] [sp:q10612] [db:swissprot] |
| 2433856_c2_12 | 952 | 3555 | 552 | 183 | 885 | 9.60E-89 | [ln:strcomaa] [ac:m36180:115190] [pn:transposase] [or:streptococcus pneumoniae] [sr:streptococcus pneumoniae (strain rx1) dna] [db:genpept-bct] [de:streptococcus pneumoniae transposase, (coma and comb) and saicarsynthetase (purc) genes, complete cds.] [nt |
| 2433856_f1_3 | 953 | 3556 | 513 | 170 | 493 | 3.30E-47 | [ln:strcomaa] [ac:m36180:115190] [pn:transposase] [or:streptococcus pneumoniae] [sr:streptococcus pneumoniae (strain rx1) dna] [db:genpept-bct] [de:streptococcus pneumoniae transposase, (coma and comb) and saicarsynthetase (purc) genes, complete cds.] [nt |
| 2433856_f1_4 | 954 | 3557 | 1263 | 420 | 1924 | 7.60E-199 | [ln:af030361] [ac:af030361] [de:streptococcus pneumoniae strain sp-va92 glucose-1-phosphatethymidyl transferase (cps) gene, partial cds; anddtdp-4-keto-6-deoxyglucose-3,5-epimerase (cpsm).dt |
| 2433856_f1_5 | 955 | 3558 | 552 | 183 | 840 | 5.70E-84 | [ln:strcomaa] [ac:m36180:115190] [pn:transposase] [or:streptococcus pneumoniae] [sr:streptococcus pneumoniae (strain rx1) dna] [db:genpept-bct] [de:streptococcus pneumoniae transposase, (coma and comb) and saicarsynthetase (purc) genes, complete cds.] [nt |

TABLE 2-continued

| Orf | NT Seq ID | AA Seq ID | NT Orf Length | AA Orf Length | Score | Probability | Description |
|---|---|---|---|---|---|---|---|
| 24338562_f1_51 | 956 | 3559 | 186 | 61 | 85 | 0.00096 | [ln:strcomaa] [ac:m36180:115190] [pn:transposase] [or:streptococcus pneumoniae] [sr:streptococcus pneumoniae (strain rx1) dna] [db:genpept-bct] [de:streptococcus pneumoniae transposase, (coma and comb) and saicarsynthetase (purc) genes, complete cds.] [nt |
| 24338562_f3_16 | 957 | 3560 | 552 | 183 | 879 | 4.20E-88 | [ln:strcomaa] [ac:m36180:115190] [pn:transposase] [or:streptococcus pneumoniae] [sr:streptococcus pneumoniae (strain rx1) dna] [db:genpept-bct] [de:streptococcus pneumoniae transposase, (coma and comb) and saicarsynthetase (purc) genes, complete cds.] [nt |
| 24338562_f3_29 | 958 | 3561 | 552 | 183 | 858 | 7.00E-86 | [ln:strcomaa] [ac:m36180:115190] [pn:transposase] [or:streptococcus pneumoniae] [sr:streptococcus pneumoniae (strain rx1) dna] [db:genpept-bct] [de:streptococcus pneumoniae transposase, (coma and comb) and saicarsynthetase (purc) genes, complete cds.] [nt |
| 24338562_f3_59 | 959 | 3562 | 1290 | 429 | 2039 | 5.00E-211 | [ln:af030361] [ac:af030361] [de:streptococcus pneumoniae] [db:genpept-bct] [de:streptococcus pneumoniae strain sp-va92 glucose-1-phosphatethymidyl transferase (cps) gene, partial cds; anddtdp-4-keto-6-deoxyglucose-3,5-epimerase (cpsm),dt |
| 24345306_f1_2 | 960 | 3563 | 768 | 255 | 671 | 4.60E-66 | [ac:h69334] [pn:glutamine abc transporter, atp-binding protein (glnq) homolog] [or:archaeoglobus fulgidus] [db:pir] |
| 24353393_f3_24 | 961 | 3564 | 480 | 159 | 92 | 0.039 | [ac:b69825] [pn:cell wall-binding protein homolog yhdd] [gn:yhdd] [or:bacillus subtilis] [db:pir] |
| 24353427_c3_42 | 962 | 3565 | 486 | 161 | 274 | 5.40E-24 | [ac:p36922] [or:enterococcus faecalis] [sr:streptococcus faecalis] [de:ebsc protein] [sp:p36922] [db:swissprot] |
| 24353462_c1_12 | 963 | 3566 | 1419 | 472 | 2426 | 4.90E-252 | [ac:a28568:s12829] [pn:pneumolysin] [or:streptococcus pneumoniae] [db:pir] |
| 24357902_c1_45 | 964 | 3567 | 2076 | 691 | 69 | 0.16 | [acp12501] [gn:pol] [or:simian immunodeficiency virus] [sr:agm385 isolate:siv-agm] [ec:3.4.23.16;2.7.7.49;3.1.26.4] [de:transcriptase,; ribonuclease h.) (fragment)] [sp:p12501] [db:swissprot] |
| 24390756_f3_22 | 965 | 3568 | 1521 | 506 | 1312 | 5.40E-134 | [acp05653] [gn:gyra:nala:cafb] [or:bacillus subtilis] [ec:5.99.1.3] [de:dna gyrase subunit a.] [sp:p05653] [db:swissprot] |
| 24390812_f3_18 | 966 | 3569 | 219 | 72 | 53 | 0.43 | [ln:celk09e2] [accu23527] [gn:k09e2.1] [or:caenorhabditis elegans] [sr:caenorhabditis elegans strain=bristol n2] [db:genpept-inv] [de:caenorhabditis elegans cosmid k09e2.] [nt:weak similarity to collagen alpha] [le:24698:25089:25234:25455] [re:24876:25177 |
| 24390812_f3_8 | 967 | 3570 | 237 | 78 | 69 | 0.028 | [acs07013] [pn:hypothetical protein 95 (orit 5' region)] [or:escherichia coli] [db:pir] |
| 24391961_c3_58 | 968 | 3571 | 390 | 129 | 72 | 1 | [ac:a64706] [pn:lipase-like protein] [or:helicobacter pylori] [db:pir] |
| 24392753_c1_13 | 969 | 3572 | 189 | 62 | 48 | 0.17 | [ln:af005383] [ac:af005383] [pn:xylanase] [gn:xynd] [fn:xylosidase activity] [or:caldicellulosiruptor saccharolyticus] [db:genpept-bct] [de:caldicellulosiruptor saccharolyticus putative transport protein(xyng), putative transport protein (xynh), xylanase |
| 24394003_c2_6 | 970 | 3573 | 216 | 71 | 61 | 0.025 | [acp53230] [gn:ygr046w] [or:saccharomyces cerevisiae] [sr:baker's yeast] [de:hypothetical 44.2 kd protein in rmel-tfc4 intergenic region] [sp:p53230] [db:swissprot] |
| 24398425_f1_18 | 971 | 3574 | 1407 | 468 | 298 | 2.50E-24 | [acf69762] [pn:transporter homolog ycli] [gn:ycli] [or:bacillus subtilis] [db:pir] |
| 24398437_c3_82 | 972 | 3575 | 804 | 267 | 1016 | 1.30E-102 | [acp:49668] [gn:rpsb] [or:pediococcus acidilactici] [de:30s ribosomal protein s2] [sp:p49668] [db:swissprot] |
| 24399050_f2_34 | 973 | 3576 | 399 | 132 | 233 | 1.20E-19 | [acp54590] [gn:yhcf] [or:bacillus subtilis] [de:hypothetical transcriptional regulator in glpd-cspb intergenic region] [sp:p54590] [db:swissprot] |
| 24399062_c3_67 | 974 | 3577 | 630 | 209 | 96 | 0.018 | [ln:mtehgns7] [ac:z71699] [pn:nadh dehydrogenase subunit 4] [or:unidentified] [db:genpept-una] [de:e.herklotsi mitochondrion genes for trna-ser and nadh dehydrogenasessubunit 3.] [le:303] [re: |
| 24400301_f1_5 | 975 | 3578 | 657 | 218 | 242 | 1.30E-20 | [ac:q47086] [or:erwinia chrysanthemi] [de:iron(iii) chloride/dicitrate transport |

TABLE 2-continued

| Orf | NT Seq ID | AA Seq ID | NT Orf Length | AA Orf Length | Score | Probability | Description |
|---|---|---|---|---|---|---|---|
| 24400313_c1_25 | 976 | 3579 | 624 | 207 | 186 | 1.10E-14 | system permease protein cbrc [sp:q47086] [db:swissprot] |
| 24407503_c3_55 | 977 | 3580 | 267 | 88 | 67 | 0.12 | [ac:a57362] [pn:gyrb protein] [gn:gyrb] [or:streptococcus pneumoniae] [db:pir] [ln:cem79] [ac:z50806] [pn:m79.3] [or:caenorhabditis elegans] [db:genpept-inv] [de:caenorhabditis elegans cosmid m79, complete sequence.] [le:31773:32009:32175] [re:31956:32126:32281] [di:complement/join] |
| 24407515_f2_16 | 978 | 3581 | 699 | 232 | 577 | 4.20E-56 | [ac:p38493] [gn:cmk;jofc] [or:bacillus subtilis] [ec:2.7.4.14] [de:kinase] (cmp kinase)] [sp:p38493] [db:swissprot] |
| 24407762_f3_42 | 979 | 3582 | 234 | 77 | 65 | 0.00076 | [ln:spu09239] [ac:u09239] [gn:alia] [fn:oligopeptide transport] [or:streptococcus pneumoniae] [db:genpept-bct] [de:streptococcus pneumoniae type 19f capsular polysaccharidebiosynthesis operon, (cps19fabcdefghijklmno) genes, complete cds,and alia gene, par |
| 24407777_c3_17 | 980 | 3583 | 450 | 149 | 178 | 8.00E-14 | [ac:d69783] [pn:transcriptional regulator (marr family) homolog ydgj] [gn:ydgj] [or:bacillus subtilis] [db:pir] |
| 24408256_c1_19 | 981 | 3584 | 336 | 111 | 159 | 8.30E-12 | [ac:d70063] [pn:hypothetical protein ywna] [gn:ywna] [or:bacillus subtilis] [db:pir] |
| 24408567_f3_6 | 982 | 3585 | 573 | 190 | 447 | 2.50E-42 | [ac:p49778] [gn:efp] [or:bacillus subtilis] [de:elongation factor p (ef-p)] [sp:p49778] [db:swissprot] |
| 24409825_f3_19 | 983 | 3586 | 906 | 301 | 68 | 0.2 | [ac:jh0207] [pn:hypothetical 10.8k protein] [or:enterococcus faecalis] [db:pir] |
| 24410000_c2_75 | 984 | 3587 | 321 | 106 | 96 | 3.90E-05 | [ac:p37466] [gn:veg] [or:bacillus subtilis] [de:veg protein] [sp:p37466] [db:swissprot] |
| 24410932_f1_2 | 985 | 3588 | 327 | 108 | 206 | 8.60E-17 | [ac:s74709] [pn:hypothetical protein sll1188] [or:synechocystis sp.] [sr:pcc 6803, , pcc 6803] [sr:pcc 6803,] [db:pir] |
| 24412752_f3_48 | 986 | 3589 | 306 | 101 | 73 | 0.11 | [ac:p14847] [gn:ptx1:crp] [or:mus musculus] [sr:,mouse] [de:c-reactive protein precursor] [sp:p14847] [db:swissprot] |
| 24412762_f3_68 | 987 | 3590 | 1161 | 386 | 491 | 5.40E-47 | [ac:d69159] [or:methyl coenzyme m reductase system, component a2 homolog] [gn:mth454] [or:methanobacterium thermoautotrophicum] [db:pir] |
| 24413137_c3_153 | 988 | 3591 | 300 | 99 | 135 | 2.90E-09 | [ac:b30868] [pn:hypothetical protein 1 (insertion sequence is861)] [gn:is861-orf 1] [or:streptococcus agalactiae] [db:pir] |
| 24413187_f1_3 | 989 | 3592 | 681 | 226 | 681 | 4.00E-67 | [ac:c64666] [pn:glutamine abc transporter, atp-binding protein] [cl:inner membrane protein malk:malk protein homology] [or:helicobacter pylori] [db:pir] |
| 24413562_f3_5 | 990 | 3593 | 471 | 156 | 142 | 5.20E-10 | [ac:p54396] [gn:ypmb] [or:bacillus subtilis] [de:hypothetical 17.9 kd protein in ding-aspb intergenic region] [sp:p54396] [db:swissprot] |
| 24414682_f2_20 | 991 | 3594 | 210 | 69 | 64 | 0.092 | [ln:stu93029] [ac:u93029] [pn:amphipathic pore-forming peptide precursor] [gn:thma] [or:streptococcus thermophilus] [db:genpept-bct] [de:streptococcus thermophilus thermophilin 13 operon; amphipathicpore-forming peptide precursor (thma), enhancer peptide |
| 24414717_c2_33 | 992 | 3595 | 252 | 83 | 258 | 2.70E-22 | [ac:s66013:s11368] [pn:ribosomal protein s18:ribosomal protein bs21] [gn:rpsr] [cl:escherichia coli ribosomal protein s18] [or:bacillus subtilis] [db:pir] |
| 24414763_f2_4 | 993 | 3596 | 549 | 182 | 486 | 1.80E-46 | [ac:e69880] [pn:conserved hypothetical protein ylqe] [gn:ylqe] [or:bacillus subtilis] [db:pir] |
| 24415902_f3_12 | 994 | 3597 | 1038 | 345 | 208 | 4.90E-15 | [ac:p55530] [gn:y4kl] [or:rhizobium sp] [sr:ngr234,] [de:hypothetical 37.6 kd aaa-family atpase y4kl] [sp:p55530] [db:swissprot] |
| 24415937_f3_8 | 995 | 3598 | 1047 | 348 | 1044 | 1.40E-105 | [ac:o08326] [gn:glgc] [or:bacillus stearothermophilus] [ec:2.7.7.27] [de:synthase) (adp-glucose pyrophosphorylase)] [sp:o08326] [db:swissprot] |
| 24415942_c2_16 | 996 | 3599 | 720 | 239 | 92 | 0.04 | [ac:c69334] [pn:2-hydroxy-6-oxohepta-2,4-dienoate hydrolase (todf) homolog] [or:archaeoglobus fulgidus] [db:pir] |
| 24415967_f3_44 | 997 | 3600 | 999 | 332 | 503 | 2.90E-48 | [ln:llu81487] [ac:u81487] [pn:histidine kinase] [gn:llkind] [or:lactococcus lactis cremoris] [db:genpept-bct] [de:lactococcus lactis subsp. cremoris mg1363 histidine kinase (llkind)gene, complete cds,] [le:1] [re:999] [di:direct] |
| 24417062_f3_7 | 998 | 3601 | 210 | 69 | 122 | 6.90E-08 | [ln:spnana] [ac:x72967] [or:streptococcus pneumoniae] [db:genpept-bct] [de:s.pneumoniae nana gene,] [nt:orf2] [le:193] [re:495] [di:direct] |

TABLE 2-continued

| Orf | NT Seq ID | AA Seq ID | NT Orf Length | AA Orf Length | Score | Probability | Description |
|---|---|---|---|---|---|---|---|
| 24417267_c3_56 | 999 | 3602 | 3363 | 1120 | 469 | 3.00E-41 | [ac:i41291][pn:ecoa type i restriction-modification enzyme r subunit][or:escherichia coli][db:pir] |
| 24417318_c3_33 | 1000 | 3603 | 1173 | 390 | 373 | 1.70E-34 | [ac:p21175][gn:brac][or:pseudomonas aeruginosa][de:protein precursor (livat-bp)][sp:p21175][db:swissprot] |
| 24417338_f2_18 | 1001 | 3604 | 414 | 137 | 521 | 3.60E-50 | [ln:bacrplp][ac:147971][pn:ribosomal protein s8][gn:rpsh][or:bacillus subtilis][db:genpept-bct][de:bacillus subtilis ribosomal protein (rplpmxefroq, rpmcdj,rpsqnhemk) genes, integral membrane protein (secy) gene, adenylatekinase (adk) gene, methioni |
| 24417813_f3_37 | 1002 | 3605 | 894 | 297 | 895 | 8.40E-90 | [ac:c69638][pn:gmp synthetase guaa][gn:guaa][or:bacillus subtilis][db:pir] |
| 24421938_f3_8 | 1003 | 3606 | 513 | 170 | 96 | 0.0015 | [ac:b70064][pn:phosphinothricin acetyltransferase homolog ywnh][gn:ywnh][or:bacillus subtilis][db:pir] |
| 24422087_f2_23 | 1004 | 3607 | 2517 | 838 | 2067 | 5.40E-214 | [ac:p75793][gn:ybiw][or:escherichia coli][ec:2.3.1.54][de:yase 3)][sp:p75793][db:swissprot] |
| 24422625_c3_59 | 1005 | 3608 | 579 | 192 | 332 | 3.80E-30 | [acp54491][gn:ygn][or:bacillus subtilis][de:hypothetical 21.4 kd protein in soda-conga intergenic region][sp:p54491][db:swissprot] |
| 24423186_c2_8 | 1006 | 3609 | 306 | 101 | 196 | 4.40E-15 | [acp45246][gn:hi15545][or:haemophilus influenzae][de:hypothetical symporter hi1545][sp:p45246][db:swissprot] |
| 24423437_f2_5 | 1007 | 3610 | 2292 | 763 | 1401 | 2.00E-143 | [acp21458:p21459][gn:spoiie][or:bacillus subtilis][de:stage iii sporulation protein e][sp:p21458:p21459][db:swissprot] |
| 24424007_f2_6 | 1008 | 3611 | 606 | 201 | 216 | 7.50E-18 | [ac:c69895][pn:conserved hypothetical protein yoaa][gn:yoaa][or:bacillus subtilis][db:pir] |
| 24426577_c1_69 | 1009 | 3612 | 354 | 117 | 267 | 3.00E-23 | [acp54457][gn:yqel][or:bacillus subtilis][de:hypothetical 13.3 kd protein in arod-comer intergenic region][sp:p54457][db:swissprot] |
| 24426702_f1_44 | 1010 | 3613 | 792 | 263 | 182 | 6.30E-18 | [ln:bk5tattp][ac:144593][pn:repressor protein][or:lactococcus lactis phage bk5-t][sr:bacteriophage bk5-t dna][db:genpept-phg][de:bacteriophage bk5-t orf410, 3' end pf cds, 20 orfs, repressorprotein, and cro repressor protein genes, complete cds, or |
| 24428137_c1_75 | 1011 | 3614 | 339 | 112 | 106 | 3.40E-06 | [ac:c69878][pn:hypothetical protein yloh][gn:yloh][or:bacillus subtilis][db:pir] |
| 24428167_f2_12 | 1012 | 3615 | 249 | 82 | 371 | 2.80E-34 | [ac:s26297][pn:hypothetical protein 76][or:streptococcus pneumoniae][db:pir] |
| 24429812_f3_30 | 1013 | 3616 | 1413 | 470 | 1607 | 3.00E-165 | [ln:llu78036][ac:u78036][pn:dipeptidase][or:lactococcus lactis][db:genpept-bct][de:lactococcus lactis dipeptidase gene, complete cds.][le:79][re:1497][di:direct] |
| 24429838_f2_4 | 1014 | 3617 | 408 | 135 | 282 | 7.60E-25 | [ac:c67490][pn:single-stranded dna-binding protein][cl:single-stranded dna-binding protein homology][or:eubacterium sp.][db:pir] |
| 24430251_c2_15 | 1015 | 3618 | 339 | 112 | 71 | 0.22 | [ac:c65019][pn:hypothetical protein b2445][or:escherichia coli][db:pir] |
| 24430312_f3_30 | 1016 | 3619 | 1257 | 418 | 1077 | 4.30E-109 | [ac:p39762][gn:amps][or:bacillus subtilis][ec:3.4.11.—][de:aminopeptidase amps,][sp:p39762][db:swissprot] |
| 24430388_f3_5 | 1017 | 3620 | 687 | 228 | 426 | 8.80E-40 | [acp75831][gn:ybjz][or:escherichia coli][de:intergenic region][sp:p75831][db:swissprot] |
| 24430436_f1_5 | 1018 | 3621 | 1839 | 612 | 3008 | 0 | [ln:spu72720][ac:u72720][pn:heat shock protein 70][gn:dnak][or:streptococcus pneumoniae][db:genpept-bct][de:streptococcus pneumoniae heat shock protein 70 (dnak) gene,complete cds and dnaj (dnaj) gene, partial cds.][nt:hsp70; partial peptide sequen |
| 24430437_f3_15 | 1019 | 3622 | 588 | 195 | 56 | 0.91 | [ln:hsu80779][ac:u80779][pn:t cell receptor beta chain][or:homo sapiens][sr:human][db:genpept-pri2][de:human t cell receptor beta chain mrna, partial cds.][le:<1][re: |
| 24431292_c3_210 | 1020 | 3623 | 264 | 87 | 91 | 0.00017 | [acp18017][or:clostridium perfringens][de:hypothetical 19.7 kd protein (orf6)][sp:p18017][db:swissprot] |
| 24431563_f2_17 | 1021 | 3624 | 306 | 101 | 68 | 0.3 | [ac:q00516][gn:xcpv:pddc][or:pseudomonas aeruginosa][de:pddc][sp:q00516][db:swissprot] |
| 24432827_f2_7 | 1022 | 3625 | 357 | 118 | 274 | 5.40E-24 | [acp19083][gn:glnr][or:bacillus cereus][de:regulatory protein glnr][sp:p19083][db:swissprot] |

TABLE 2-continued

| Orf | NT Seq ID | AA Seq ID | NT Orf Length | AA Orf Length | Score | Probability | Description |
|---|---|---|---|---|---|---|---|
| 24432962_c3_59 | 1023 | 3626 | 2229 | 742 | 302 | 4.50E-31 | [ln:cef40f9] [ac:z70753] [pn:f40f9.6] [or:caenorhabditis elegans] [db:genpept-inv] [de:caenorhabditis elegans cosmid f40f9, complete sequence.] [nt:similar to glycosyl hydrolase; cdna est yk10h3.5] [le:23461:23645:24111] [re:23586:24046:25315] [di:complem |
| 24433126_f2_20 | 1024 | 3627 | 285 | 94 | 144 | 9.90E-10 | [ac:q57368] [gn:hi0301] [or:haemophilus influenzae] [de:hypothetical protein hi0301] [sp:q57368] [db:swissprot] |
| 24445237_c3_33 | 1025 | 3628 | 249 | 83 | 67 | 0.031 | [ln:ab000094] [ac:ab000094] [pn:inorganic phosphate transporter] [gn:pht2] [or:arabidopsis thaliana] [sr:arabidopsis thaliana (strain:columbia) dna] [db:genpept-pln] [de:arabidopsis thaliana gene for inorganic phosphate transporter,protein |
| 24475452_c1_149 | 1026 | 3629 | 231 | 76 | 69 | 0.23 | [ac:q01969] [gn:omp-alpha] [or:thermotoga maritima] [de:outer membrane protein alpha precursor] [sp:q01969] [db:swissprot] |
| 24484627_f1_10 | 1027 | 3630 | 1443 | 480 | 1721 | 2.50E-177 | [ac:d70019] [pn:conserved hypothetical protein yuru] [gn:yuru] [or:bacillus subtilis] [db:pir] |
| 24484675_c2_52 | 1028 | 3631 | 948 | 315 | 762 | 1.00E-75 | [acp54548] [gn:yqik] [or:bacillus subtilis] [de:hypothetical 34.0 kd protein in glnq-ansr intergenic region] [sp:p54548] [db:swissprot] |
| 24485306_c2_19 | 1029 | 3632 | 789 | 262 | 549 | 3.90E-53 | [ac:f69844] [pn:conserved hypothetical protein yjbn] [gn:yjbn] [or:bacillus subtilis] [db:pir] |
| 24485625_f2_3 | 1030 | 3633 | 591 | 196 | 258 | 2.70E-22 | [acp50726] [gn:ypaa] [or:bacillus subtilis] [de:hypothetical 20.5 kd protein in sera-fer intergenic region] [sp:p50726] [db:swissprot] |
| 24485692_c2_36 | 1031 | 3634 | 1383 | 460 | 1495 | 2.20E-153 | [acp37572] [gn:radasms] [or:bacillus subtilis] [de:dna repair protein rada homolog (dna repair protein sms homolog)] [sp:p37572] [db:swissprot] |
| 24485885_c3_24 | 1032 | 3635 | 2331 | 776 | 1965 | 6.80E-219 | [ac:e69794] [pn:atp-dependent dna helicase homolog yerf] [gn:yerf] [or:bacillus subtilis] [db:pir] |
| 24485885_f1_1 | 1033 | 3636 | 1356 | 451 | 380 | 3.10E-35 | [acs76138] [pn:hypothetical protein] [or:synechocystis sp.] [sr:pcc 6803, , pcc 6803] [sr:pcc 6803,] [db:pir] |
| 24486262_f2_10 | 1034 | 3637 | 702 | 233 | 621 | 9.10E-61 | [acp39121] [gn:dra] [or:bacillus subtilis] [ec:4.1.2.4] [de:(deoxyriboaldolase)] [sp:p39121] [db:swissprot] |
| 24486503_f1_11 | 1035 | 3638 | 1029 | 342 | 475 | 2.70E-45 | [ac:q02115] [gn:lytr] [or:bacillus subtilis] [de:membrane-bound protein lytr] [sp:q02115] [db:swissprot] |
| 24487502_c1_18 | 1036 | 3639 | 738 | 245 | 474 | 3.40E-45 | [ac:e69814] [pn:conserved hypothetical protein yfnb] [gn:yfnb] [or:bacillus subtilis] [db:pir] |
| 24487930_c3_40 | 1037 | 3640 | 660 | 219 | 458 | 1.70E-43 | [ac:d70039] [pn:two-component response regulator [yvft] homolog yvfu] [gn:yvfu] [or:bacillus subtilis] [db:pir] |
| 24488193_f2_8 | 1038 | 3641 | 1296 | 431 | 1300 | 1.00E-132 | [acp22326] [gn:tyrs] [or:bacillus subtilis] [ec:6.1.1.1] [de:(tyrrs)] [sp:p22326] [db:swissprot] |
| 24488756_f3_16 | 1039 | 3642 | 264 | 87 | 65 | 0.36 | [acp45433] [or:oncorhynchus mykiss] [sr:,rainbow trout:salmo gairdneri] [de:(signal sequence receptor alpha subunit) (ssr-alpha)] [sp:p45433] [db:swissprot] |
| 24490632_f1_4<br>24490750_c2_6 | 1040<br>1041 | 3643<br>3644 | 408<br>912 | 135<br>304 | 326<br>342 | 1.70E-29<br>3.30E-31 | [acs52544] [pn:is12 protein] [or:lactobacillus helveticus] [db:pir]<br>[ln:d89150] [ac:d89150] [or:schizosaccharomyces pombe] [sr:schizosaccharomyces pombe (strain:pr745) cdna to mrna] [db:genpept-pln] [de:fission yeast mrna, partial cds.] [nt:similar to saccharomyces serevisiae hypothetical] [le:<1] [re:1121] [di:direct] |
| 24492137_f2_24 | 1042 | 3645 | 447 | 148 | 368 | 5.90E-34 | [ln:xlnm23] [ac:x97899] [pn:nm23/nucleoside diphosphate kinase] [or:xenopus laevis] [sr:african clawed frog] [db:genpept-vrt] [de:x.laevis mrna for nm23/nucleoside diphosphate kinase.] [le:34] [re:498] [di:direct] |
| 24492186_f3_15 | 1043 | 3646 | 546 | 182 | 113 | 2.90E-05 | [ac:c69796] [pn:conserved hypothetical protein yes] [gn:yes] [or:bacillus subtilis] [db:pir] |
| 24492187_f3_19 | 1044 | 3647 | 456 | 151 | 212 | 7.20E-17 | [acp25744] [gn:ycee] [or:escherichia coli] [de:hypothetical 43.9 kd protein in msyb-httb intergenic region (orf1)] [sp:p25744] [db:swissprot] |
| 24492635_c2_11 | 1045 | 3648 | 585 | 194 | 545 | 1.00E-52 | [ac:g69626] [pn:ribosome recycling factor frr] [gn:frr] [or:bacillus subtilis] [db:pir] |

TABLE 2-continued

| Orf | NT Seq ID | AA Seq ID | NT Orf Length | AA Orf Length | Score | Probability | Description |
|---|---|---|---|---|---|---|---|
| 2449293_c3_35 | 1046 | 3649 | 357 | 118 | 299 | 1.20E−26 | [ln:clact] [ac:c80834] [pn:lacf] [gn:lacf] [fn:eiia lactose pts] [or:lactobacillus casei] [db:genpept-bct] [de:l.casei lact gene.] [le:<4723] [re:5065] [di:direct] |
| 2449262_f2_22 | 1047 | 3650 | 849 | 282 | 777 | 2.70E−77 | [ac:p46919] [gn:gpsa:glyc] [or:bacillus subtilis] [ec:1.1.1.94] [de:dependent dihydroxyacetone-phosphate reductase)] [sp:p46919] [db:swissprot] |
| 2449313_c2_48 | 1048 | 3651 | 273 | 91 | 195 | 1.30E−15 | [ac:p21335] [gn:yaaj] [or:bacillus subtilis] [de:hypothetical 17.8 kd protein in sers-dnah intergenic region] [sp:p21335] [db:swissprot] |
| 2449437_c1_44 | 1049 | 3652 | 267 | 88 | 79 | 0.022 | [ac:b69200] [pn:hypothetical protein mth749] [gn:mth749] [or:methanobacterium thermoautotrophicum] [db:pir] |
| 2449933_f2_29 | 1050 | 3653 | 606 | 201 | 92 | 0.075 | [ln:ae000789] [ac:ae000789] [pn:b. burgdorferi predicted coding region bbi16] [gn:bbi16] [or:borrelia burgdorferi] [sr:lyme disease spirochete] [db:genpept-bct] [de:borrelia burgdorferi plasmid lp28-4, complete plasmid sequence,] [nt:hypothetical protein; |
| 2449937_f1_12 | 1051 | 3654 | 297 | 98 | 195 | 1.30E−15 | [ac:p39302] [gn:sgab] [or:escherichia coli] [ec:2.7.1.69] [de:(ec 2.7.1.69] [sp:p39302] [db:swissprot] |
| 2449949_c1_8 | 1052 | 3655 | 682 | 227 | 412 | 1.30E−38 | [ac:s74902] [pn:water channel protein:protein slr2057:protein slr2057] [gn:apqz] [or:synechocystis sp.] [sr:pcc 6803, , pcc 6803] [sr:pcc 6803,] [db:pir] |
| 2450135_f3_8 | 1053 | 3656 | 1260 | 419 | 1469 | 1.30E−150 | [ac:p42020] [gn:pepl] [or:lactococcus lactis] [sr:subspcremoris:streptococcus cremoris] [ec:3.4.11.—] [de:peptidase t, (aminotripeptidase) (tripeptidase)] [sp:p42020] [db:swissprot] |
| 2450713_f3_21 | 1054 | 3657 | 792 | 263 | 184 | 1.80E−12 | [ac:a69745] [pn:hypothetical protein ybbr] [gn:ybbr] [or:bacillus subtilis] [db:pir] |
| 2450762_c2_74 | 1055 | 3658 | 477 | 158 | 361 | 3.20E−33 | [ac:p37437] [gn:rpli] [or:bacillus subtilis] [de:50s ribosomal protein 19 (b117) [sp:p37437] [db:swissprot] |
| 2450782_f2_31 | 1056 | 3659 | 1566 | 521 | 512 | 3.20E−49 | [ac:c64739:s45224] [pn:hypothetical protein (heml-pfs intergenic region)] [gn:yadq] [or:escherichia coli] [db:pir] |
| 2450855_f1_12 | 1057 | 3660 | 1269 | 422 | 2052 | 2.10E−212 | [ac:p54184] [gn:cina] [or:streptococcus pneumoniae] [de:putative competence-damage protein] [sp:p54184] [db:swissprot] |
| 2450971_f1_10 | 1058 | 3661 | 204 | 67 | 69 | 0.13 | [ln:cloermq] [ac:122689] [pn:23s rrna methlyase] [gn:ermq] [fn:erythromycin resistance determinant] [or:clostridium perfringens] [sr:clostridium perfringens (strain jir100) dna] [db:genpept-bct] [de:clostridium perfringens macrolide-lincosamide-streptogra 3'region] [sp:p54721] [db:swissprot] |
| 2451162_c3_11 | 1059 | 3662 | 246 | 81 | 142 | 1.40E−09 | [ac:p54721] [gn:yfie] [or:bacillus subtilis] [de:hypothetical 31.5 kd protein in glvbc 3'region] [sp:p54721] [db:swissprot] |
| 245187_f3_23 | 1060 | 3663 | 270 | 89 | 100 | 1.50E−05 | [ln:spz82001] [ac:z82001] [pn:unknown] [or:streptococcus pneumoniae] [db:genpept-bct] [de:s.pneumoniae pcpa gene and open reading frames.] [le:<1] [re:174] [di:direct] |
| 245443_f2_8 | 1061 | 3664 | 660 | 219 | 413 | 2.50E−41 | [ln:rsu53327] [ac:u53327] [pn:nodj] [gn:nodj] [or:rhizobium sp.] [db:genpept-bct] [de:rhizobium sp. orfz, noda, nodf, node, nodg, nodb, nodc, nodi, nodj, nodn, nodp, and nodq genes, complete cds.] [le:9536] [re:10450] [di:direct] |
| 2461017_c2_58 | 1062 | 3665 | 393 | 130 | 89 | 0.00045 | [ln:ehy14328] [ac:y14328] [pn:3e1 protein] [or:entamoeba histolytica] [db:genpept-inv] [de:entamoeba histolytica mrna for 3e1 protein.] [le:32] [re:418] [di:direct] |
| 2461032_f1_3 | 1063 | 3666 | 537 | 178 | 601 | 1.20E−58 | [ac:b69587] [pn:adenine phosphoribosyltransferase apt] [gn:apt] [or:bacillus subtilis] [db:pir] |
| 2461566_f1_2 | 1064 | 3667 | 192 | 63 | 48 | 0.29 | [ln:atu97224] [ac:u97224] [pn:disease resistance protein homolog] [gn:pnd14] [or:arabidopsis thaliana] [sr:thale cress] [db:genpept-pln] [de:arabidopsis thaliana disease resistance protein homolog (pnd14)gene, partial cds.] [le:<1] [re:spoiiiaa intergenic region] [sp:p54510] [db:swissprot] |
| 2461641_f2_23 | 1065 | 3668 | 195 | 64 | 90 | 0.00017 | [ac:p54510] [gn:yqhl] [or:bacillus subtilis] [de:hypothetical 14.6 kd protein in gvet-spoiiiaa intergenic region] [sp:p54510] [db:swissprot] |
| 2461641_f3_28 | 1066 | 3669 | 528 | 175 | 231 | 1.90E−19 | [ln:strhexb] [ac:m29686] [pn:unknown protein] [or:streptococcus pneumoniae] [de:s.pneumoniae mismatch repair (hexb) gene, complete cds.] [db:genpept-bct] [sr:streptococcus pneumoniae (clone: psp(8,41).) dna] [nt:orf; putative] [le:<1] [re:144] [di:complem |

TABLE 2-continued

| Orf | NT Seq ID | AA Seq ID | NT Orf Length | AA Orf Length | Score | Probability | Description |
|---|---|---|---|---|---|---|---|
| 24611666_f2_7 | 1067 | 3670 | 420 | 139 | 112 | 7.90E-07 | [acs:31840] [pn:probable transposase] [or:bacillus stearothermophilus] [db:pir] |
| 24611666_f1_52 | 1068 | 3671 | 687 | 228 | 368 | 5.90E-34 | [acp:54501] [gn:yygex] [or:bacillus subtilis] [de:hypothetical 23.2 kd protein in soda-comga intergenic region] [sp:p54501] [db:swissprot] |
| 24612628_c1_17 | 1069 | 3672 | 237 | 78 | 129 | 1.20E-08 | [n:smu75483] [acu75483] [pn:sakacin a production response regulator] [gn:sapr] [or:streptococcus mutans] [db:genpept-bct] [de:streptococcus mutans putative sakacin a production responseregulator (sapr) gene, partial cds.] [le:1] [re:] |
| 24612700_f1_14 | 1070 | 3673 | 192 | 63 | 65 | 0.11 | [acp:49108] [gn:psbr] [or:brassica campestris] [sr:field mustard] [de:photosystem ii 10 kd polypeptide precursor] [sp:p49108] [db:swissprot] |
| 24616250_c3_45 | 1071 | 3674 | 192 | 63 | 147 | 2.30E-09 | [acq:28279] [gn:cng1:cncg] [or:canis familiaris] [sr:,dog] [de:1) cng-1) (cng1) [sp:q28279] [db:swissprot] |
| 24635412_f3_29 | 1072 | 3675 | 252 | 83 | 185 | 1.40E-14 | [n:sau96620] [acu96620] [pn:ribosomal protein 130] [gn:130] [or:staphylococcus aureus] [db:genpept-bct] [de:staphylococcus aureus nctc 8325 ribosomal protein 130 (130),ribosomal protein 115 (115) and secy (secy) genes, complete cds.] [le:65] [re:244]d |
| 24640712_c2_31 | 1073 | 3676 | 5310 | 1769 | 1762 | 1.10E-181 | [n:spdexcap] [acc:z47210] [gn:orf] [or:streptococcus pneumoniae] [db:genpept-bct] [de:s,pneumoniae dexb, cap3a, cap3b and cap3c genes and orfs.] [le:12671] [re:13792] [di:direct] |
| 24641252_c1_15 | 1074 | 3677 | 1857 | 618 | 1240 | 2.30E-126 | [acp:39853] [gn:capd] [or:staphylococcus aureus] [de:capd protein] [sp:p39853] [db:swissprot] |
| 24641385_f2_6 | 1075 | 3678 | 1314 | 437 | 2176 | 1.50E-225 | [acq04698] [gn:malc] [or:streptococcus pneumoniae] [de:maltodextrin transport system permease protein malc] [sp:q04698] [db:swissprot] |
| 24641537_f3_5 | 1076 | 3679 | 657 | 218 | 235 | 7.30E-20 | [n:llu81489] [acu81489] [pn:histidine kinase] [gn:llkineorf2] [or:lactococcus lactis cremoris] [db:genpept-bct] [de:lactococcus lactis subsp cremoris mg1363 histidine kinase(llkineorf2) gene, complete cds.] [le:1] [re:657] [di:direct] |
| 24642012_c2_23 | 1077 | 3680 | 363 | 120 | 72 | 0.56 | [n:ae000788] [ac:ae000788] [pn:outer membrane protein] [gn:bbk53] [or:borrelia burgdorferi] [sr:lyme disease spirochete] [db:genpept-bct] [de:borrelia burgdorferi plasmid lp36, complete plasmid sequence.] [nt:similar to gb:131615 gb:131418 pid:520783] [] |
| 24642157_f1_1 | 1078 | 3681 | 246 | 81 | 208 | 9.20E-17 | [acq07636] [gn:pfka:pfk] [or:lactococcus lactis] [sr:,subsplactis:streptococcus lactis] [de:(phosphohexokinase)] [sp:q07636] [db:swissprot] |
| 24642163_c1_23 | 1079 | 3682 | 468 | 155 | 164 | 2.40E-12 | [ec:2.7.1.11] [acp:20298] [or:pyrococcus woesei] [de:hypothetical protein in gapdh 3'region (orf x) (fragment)] [sp:p20298] [db:swissprot] |
| 24642802_f2_12 | 1080 | 3683 | 492 | 163 | 275 | 4.20E-24 | [acs:74334] [pn:biotin carboxyl carrier protein:hypothetical protein slr0435:hypothetical protein slr0435] [gn:accb] [or:synechocystis sp.] [sr:pcc 6803, , pcc 6803, pcc 6803] [sr:pcc 6803,] [db:pir] |
| 24642817_c3_84 | 1081 | 3684 | 1305 | 434 | 688 | 7.20E-68 | [acp:39145] [gn:comfa:comfl] [or:bacillus subtilis] [de:comf operon protein 1] [sp:p39145] [db:swissprot] |
| 24642817_f1_5 | 1082 | 3685 | 942 | 313 | 130 | 3.70E-15 | [acc:65017] [pn:hypothetical protein b2430] [or:escherichia coli] [db:pir] |
| 24643951_f3_15 | 1083 | 3686 | 483 | 160 | 81 | 0.0023 | [acs:26352] [pn:hypothetical protein] [or:staphylococcus aureus] [db:pir] |
| 24646880_c3_74 | 1084 | 3687 | 1965 | 654 | 1985 | 2.60E-205 | [acq46469] [gn:ftsh:tma] [or:lactococcus lactis] [sr:,subsplactis:streptococcus lactis] [ec:3.4.24.—] [de:cell division protein ftsh homolog.] [sp:p46469] [db:swissprot] |
| 24647061_f2_9 | 1085 | 3688 | 645 | 214 | 742 | 1.40E-73 | [acq45486] [gn:yzdd] [or:bacillus subtilis] [de:pet112-like protein] [sp:q45486] [db:swissprot] |
| 24647131_c2_77 | 1086 | 3689 | 1299 | 432 | 2159 | 9.60E-224 | [n:af030361] [acaf030361] [pn:transposase] [or:streptococcus pneumoniae] [db:genpept-bct] [de:streptococcus pneumoniae strain sp-va92 glucose-1-phosphatethymidyl transferase (cps) gene, partial cds; anddtdp-4-keto-6-deoxyglucose-3,5-epimerase (cpsm).dt |
| 24647187_c2_109 | 1087 | 3690 | 1281 | 426 | 825 | 2.20E-82 | [acg69466] [pn:3-hydroxy-3-methylglutaryl-coenzyme a reductase (mvaa) homolog] [or:archaeoglobus fulgidus] [db:pir] |

TABLE 2-continued

| Orf | NT Seq ID | AA Seq ID | NT Orf Length | AA Orf Length | Score | Probability | Description |
|---|---|---|---|---|---|---|---|
| 24647187_f3_16 | 1088 | 3691 | 840 | 279 | 1375 | 1.10E-140 | [ln:spu43526] [ac:u43526] [or:streptococcus pneumoniae] [db:genpept-bct] [de:streptococcus pneumoniae neuraminidase b (nanb) gene, complete cds,and neuraminidase (nana) gene, partial cds.] [nt:orf-4] [le:4251] [re:5084] [di:direct] |
| 24647188_c2_81 | 1089 | 3692 | 249 | 82 | 203 | 1.80E-16 | [ac:s76591] [pn:hypothetical protein] [or:synechocystis sp.] [sr:pcc 6803, , pcc 6803] [sr:pcc 6803,] [db:pir] |
| 24647535_c1_28 | 1090 | 3693 | 264 | 87 | 75 | 0.0066 | [ln:spnana] [ac:x72967] [or:streptococcus pneumoniae] [db:genpept-bct] [de:s.pneumoniae nana gene.] [nt:orf2] [le:193] [re:495] [di:direct] |
| 24647535_f1_1 | 1091 | 3694 | 246 | 81 | 62 | 0.15 | [ln:spnana] [ac:x72967] [or:streptococcus pneumoniae] [db:genpept-bct] [de:s.pneumoniae nana gene.] [nt:orf2] [le:193] [re:495] [di:direct] |
| 24647535_f1_7 | 1092 | 3695 | 183 | 60 | 67 | 0.067 | [ln:hpu31786] [ac:u31786] [pn:transforming protein e6] [gn:e6] [or:human papillomavirus type 37] [db:genpept-vrl] [de:human papillomavirus type 37, complete genome.] [nt:putative] [le:200] [re:625] [di:direct] |
| 24647535_f2_23 | 1093 | 3696 | 339 | 112 | 89 | 0.0011 | [ac:g02026] [pn:mdm2-a] [gn:mdm2] [or:homo sapiens] [sr:, man] [db:pir] |
| 24647535_f2_4 | 1094 | 3697 | 369 | 122 | 60 | 0.27 | [ac:p80349] [or:rattus norvegicus] [sr:,rat] [de:fuctinin 3 (fucosyltransferase inhibitor 3) (fragment)] [sp:p80349] [db:swissprot] |
| 24647535_f3_47 | 1095 | 3698 | 213 | 70 | 64 | 0.092 | [ln:spnana] [ac:x72967] [or:streptococcus pneumoniae] [db:genpept-bct] [de:s.pneumoniae nana gene.] [nt:orf2] [le:193] [re:495] [di:direct] |
| 24648276_f3_5 | 1096 | 3699 | 456 | 151 | 310 | 8.20E-28 | [ac:h69773] [pn:conserved hypothetical protein ydck] [gn:ydck] [or:bacillus subtilis] [db:pir] |
| 24649213_c1_45 | 1097 | 3700 | 1986 | 661 | 542 | 2.10E-52 | [ac:f69848] [pn:transcriptional antiterminator (bglg famil) homolog yjdc] [gn:yjdc] [or:bacillus subtilis] [db:pir] |
| 24650217_f2_14 | 1098 | 3701 | 708 | 235 | 667 | 1.20E-65 | [ac:d69858] [pn:abc transporter (atp-binding protein) homolog ykny] [gn:ykny] [or:bacillus subtilis] [db:pir] |
| 24650828_c3_61 | 1099 | 3702 | 1113 | 370 | 120 | 0.00076 | [ac:p32653] [gn:mrp] [or:streptococcus suis] [de:muramidase-released protein precursor (136 kd surface protein)] [sp:p32653] [db:swissprot] |
| 24651436_f3_9 | 1100 | 3703 | 1149 | 382 | 332 | 1.40E-46 | [ac:o08327] [gn:glgd] [or:bacillus stearothermophilus] [de:glycogen biosynthesis protein glgd] [sp:o08327] [db:swissprot] |
| 24651515_f1_14 | 1101 | 3704 | 711 | 236 | 698 | 6.30E-69 | [ac:p44989] [gn:sgbe:hi1025] [or:haemophilus influenzae] [ec:5.1.—.—] [de:probable sugar isomerase sgbe,] [sp:p44989] [db:swissprot] |
| 24651537_f2_7 | 1102 | 3705 | 2166 | 721 | 3725 | 0 | [ac:q04707] [gn:pona:exp2] [or:streptococcus pneumoniae] [de:penicillin-binding protein 1a (pbp-1a)] [sp:q04707] [db:swissprot] |
| 24651587_c1_26 | 1103 | 3706 | 948 | 315 | 565 | 7.80E-55 | [ln:lsexogc] [ac:x98238] [or:lactobacillus sake] [db:genpept-bct] [de:l.sake gene cluster.] [nt:orf2] [le:4484] [re:5335] [di:direct] |
| 24663437_f3_14 | 1104 | 3707 | 933 | 310 | 366 | 9.60E-34 | [ac:q01625] [gn:spoiij] [or:bacillus subtilis] [de:stage iii sporulation protein j precursor] [sp:q01625] [db:swissprot] |
| 24665927_f2_31 | 1105 | 3708 | 921 | 306 | 546 | 8.10E-53 | [ac:g69989] [pn:abc transporter (permease) homolog ytcp] [gn:ytcp] [or:bacillus subtilis] [db:pir] |
| 24666026_f3_5 | 1106 | 3709 | 639 | 212 | 127 | 5.70E-06 | [ac:p44747] [gn:tyrp-b:hi0528] [or:haemophilus influenzae] [de:tyrosine-specific transport protein 2 (tyrosine permease 2)] [sp:p44747] [db:swissprot] |
| 24688160_c1_37 | 1107 | 3710 | 246 | 81 | 269 | 1.80E-23 | [ln:spnana] [ac:x72967] [or:streptococcus pneumoniae] [db:genpept-bct] [de:s.pneumoniae nana gene.] [nt:orf2] [le:193] [re:495] [di:direct] |
| 24688160_f2_5 | 1108 | 3711 | 201 | 66 | 138 | 1.40E-09 | [ln:spnana] [ac:x72967] [or:streptococcus pneumoniae] [db:genpept-bct] [de:s.pneumoniae nana gene.] [nt:orf2] [le:193] [re:495] [di:direct] |
| 24693751_f1_7 | 1109 | 3712 | 1461 | 486 | 2363 | 2.30E-245 | [ln:spu43526] [ac:u43526] [pn:neuraminidase b] [gn:nanb] [or:streptococcus pneumoniae] [db:genpept-bct] [de:streptococcus pneumoniae neuraminidase b (nanb) gene, complete cds,and neuraminidase (nana) gene, partial cds.] [nt:nanb] [le:5102] [re:7195] [di:d |
| 24695252_c3_52 | 1110 | 3713 | 1071 | 356 | 952 | 7.70E-96 | [ln:sasoda] [ac:y12224] [pn:hypothetical protein] [or:streptococcus agalactiae] [db:genpept-bct] [de:s.agalactiae soda gene.] [nt:hologous to yqen protein of b.subtilis] |

TABLE 2-continued

| Orf | NT Seq ID | AA Seq ID | NT Orf Length | AA Orf Length | Score | Probability | Description |
|---|---|---|---|---|---|---|---|
| 24703186_f3_9 | 1111 | 3714 | 354 | 117 | 101 | 2.60E-06 | [le:743] [re:1780] [di:direct] [ac:p55643] [gn:y4rj] [or:rhizobium sp] [sr:ngr234,] [de:putative transposase y4rj] [sp:p55643] [db:swissprot] |
| 24720077_c1_48 | 1112 | 3715 | 456 | 151 | 74 | 0.73 | [ln:cer05d7] [ac:z81105] [pn:r05d7.1] [or:caenorhabditis elegans] [db:genpept-inv] [de:caenorhabditis elegans cosmid r05d7, complete sequence.] |
| 24722175_f1_4 | 1113 | 3716 | 570 | 189 | 706 | 9.00E-70 | [le:33022:33231:33575:34088] [re:33156:33296:33818:34188] [di:directjoin] [ac:p08895] [gn:rple] [or:bacillus stearothermophilus] [de:50s ribosomal protein 15] [sp:p08895] [db:swissprot] |
| 24727213_c3_21 | 1114 | 3717 | 609 | 202 | 373 | 1.70E-34 | [ac:e69702] [pn:holliday junction dna helicase ruva] [gn:ruva] [or:bacillus subtilis] [db:pir] |
| 24728465_f2_16 | 1115 | 3718 | 1005 | 334 | 218 | 1.20E-16 | [ln:hau70664] [ac:u70664] [pn:2-keto-3-deoxygluconate kinase] [or:haloferax alicantei] [db:genpept-bct] [de:haloferax alicantei 2-dehydro-3-deoxyphosphogluconate aldolase,2-keto-3-deoxygluconate kinase, beta-d-galactosidase (bgab) genes,complete cds, and |
| 24734401_f1_3 | 1116 | 3719 | 975 | 324 | 1246 | 5.40E-127 | [ln:sgu81957] [ac:u81957] [pn:putative abc transporter subunit comya] [gn:comya] [or:streptococcus gordonii] [db:genpept-bct] [de:streptococcus gordonii ma polymerase beta ' subunit (rpoc),putative dna binding protein, putative abc transporter subunitcomy |
| 24742877_f2_40 | 1117 | 3720 | 1341 | 446 | 385 | 9.30E-36 | [ac:q47745] [gn:vansb] [or:enterococcus faecalis] [sr:streptococcus faecalis] [sp:q47745] [de:protein vansb] (vancomycin histidine protein kinase)] [sp:q47745] [dbswissprot] |
| 24744442_c2_13 | 1118 | 3721 | 1560 | 520 | 269 | 3.70E-20 | [ln:celzk84] [ac:u23181] [gn:zk84.1] [or:caenorhabditis elegans] [db:genpept-inv] [de:caenorhabditis elegans strain=bristol n2] [db:genpept-inv] [gn:yoji] [or:bacillus subtilis] [nt:final exon in repeat region; similar to long tandem] [le:24170:24288:24411:24654] |
| 24782802_c2_28 | 1119 | 3722 | 1386 | 461 | 890 | 2.80E-89 | [ac:f69906] [pn:conserved hypothetical protein yoji] [gn:yoji] [or:bacillus subtilis] [db:pir] |
| 24785712_f3_14 | 1120 | 3723 | 1029 | 342 | 1105 | 4.70E-112 | [ac:p54322] [gn:pyrdb] [or:lactococcus lactis] [sr:subspcremoris:streptococcus cremoris] [ec:1.3.3.1] [de:(dhodehase b) (dhodb)] [sp:p54322] [db:swissprot] |
| 24787375_c2_10 | 1121 | 3724 | 219 | 72 | 102 | 9.00E-06 | [ac:p55614] [gn:y4pe,y4sa] [or:rhizobium sp] [sr:ngr234,] [de:hypothetical 15.5 kd protein y4pc/y4sa] [sp:p55614] [db:swissprot] |
| 24787590_f1_4 | 1122 | 3725 | 1305 | 434 | 262 | 1.20E-20 | [ac:p47394] [gn:mg148] [or:mycoplasma genitalium] [de:hypothetical protein mg148] [sp:p47394] [db:swissprot] |
| 24798437_c2_68 | 1123 | 3726 | 660 | 219 | 244 | 1.40E-20 | [ac:f64500] [pn:lps biosynthesis related rfbu-protein homolog] [or:methanococcus jannaschii] [db:pir] [mp:for1581714–1582886] |
| 24799452_c3_6 | 1124 | 3727 | 309 | 102 | 400 | 5.40E-37 | [ac:a41971:a60282:a33134] [pn:surface protein pspa precursor:pneumococcal surface protein a] [gn:pspa] [cl:cpl repeat homology] [or:streptococcus pneumoniae] [db:pir] |
| 24799192_c2_198 | 1125 | 3728 | 6372 | 2123 | 285 | 1.10E-19 | [ln:u88974] [ac:u88974] [pn:orf45] [or:streptococcus thermophilus] [db:genpept-bct] [de:streptococcus thermophilus bacteriophage 01205 dna sequence.] [le:33448] [re:35979] [di:direct] |
| 24802312_c1_49 | 1126 | 3729 | 981 | 326 | 816 | 2.00E-81 | [ac:i40790] [pn:ttpp-dependent acetoin dehydrogenase alpha chain] [or:clostridium magnum] [db:pir] |
| 24802327_c1_9 | 1127 | 3730 | 951 | 316 | 233 | 3.00E-19 | [ac:q58902] [gn:mj1507] [or:methanococcus jannaschii] [de:hypothetical protein mj1507] [sp:q58902] [db:swissprot] |
| 24803256_f2_4 | 1128 | 3731 | 387 | 128 | 410 | 2.10E-38 | [ln:llu74322] [ac:u74322] [pn:6-phosphogluconate dehydrogenase] [or:lactococcus lactis] [db:genpept-bct] [ec:1.1.1.44] [de:lactococcus lactis 6-phosphogluconate dehydrogenase gene, completecds, and potassium transporter homolog gene, partial cds.] [le:898 |
| 24803312_c1_33 | 1129 | 3732 | 1515 | 504 | 479 | 1.00E-45 | [ac:i41293] [pn:ecoe type i restriction modification enzyme m subunit] [or:escherichia coli] [db:pir] |
| 24803325_c3_31 | 1130 | 3733 | 2145 | 714 | 119 | 1.60E-05 | [ac:p15293] [gn:prt] [or:lactococcus lactis] [sr:subsplactis:streptococcus lactis] [ec:3.4.21.—] [de:proteinase] (lp151] [sp:p15293] [db:swissprot] |
| 24803767_c2_101 | 1131 | 3734 | 393 | 130 | 87 | 0.071 | [ac:p40534] [gn:yil037c] [or:saccharomyces cerevisiae] [sr:baker's yeast] |

TABLE 2-continued

| Orf | NT Seq ID | AA Seq ID | NT Orf Length | AA Orf Length | Score | Probability | Description |
|---|---|---|---|---|---|---|---|
| 24804557_f2_29 | 1132 | 3735 | 477 | 158 | 338 | 8.90E-31 | [de:hypothetical 75.0 kd protein in not3-cka1 intergenic region] [sp:p40534] [db:swissprot] |
| 24804637_f2_25 | 1133 | 3736 | 1722 | 573 | 322 | 4.70E-26 | [ac:c69786] [pn:conserved hypothetical protein ydib] [gn:ydib] [or:bacillus subtilis] [db:pir] [ln:bsu18943] [ac:u18943;x99465] [gn:mtlr] [or:bacillus stearothermophilus] [db:genpept-bct] [de:bacillus stearothermophilus mannitol transport protein (mtla),putative transcriptional regulator (mtlr), mannitol enzyme iia(mtlf) and mannitol-1-phosphate de |
| 24804642_c2_191 | 1134 | 3737 | 282 | 93 | 73 | 0.017 | [ln:spu28142] [ac:u28142] [pn:emm12(a207)] [gn:emm12(a207)] [or:streptococcus pyogenes] [db:genpept-bct] [de:streptococcus pyogenes igg3-binding protein (emm12(a207)) gene,partial cds.] [nt:igg3-binding protein] [le:1] [re: |
| 24805175_f2_8 | 1135 | 3738 | 912 | 303 | 842 | 3.50E-84 | [ac:p46340] [gn:yqgi] [or:bacillus subtilis] [de:region (orf73)] [sp:p46340] [db:swissprot] |
| 24806253_f1_8 | 1136 | 3739 | 375 | 124 | 268 | 2.30E-23 | [ac:i40436;s24669;jq1214;s18072] [pn:ribonuclease p, protein component homolog:rnpa homolog] [gn:rnpa] [or:bacillus subtilis] [ec:3.1.26.5] [db:pir] |
| 24806326_f3_18 | 1137 | 3740 | 750 | 249 | 560 | 2.70E-54 | [ac:p32719] [gn:yjcul] [or:escherichia coli] [de:hypothetical 26.1 kd protein in fdhf-phnp intergenic region (f231)] [sp:p32719] [db:swissprot] |
| 24806532_f1_1 | 1138 | 3741 | 465 | 154 | 80 | 0.19 | [ln:ae000791] [ac:ae000791] [pn:conserved hypothetical protein] [gn:bbc03] [or:borrelia burgdorferi] [sr:lyme disease spirochete] [db:genpept-bct] [de:borrelia burgdorferi plasmid cp9, complete plasmid sequence.] [nt:similar to gbu03641 |
| 24806588_f3_13 | 1139 | 3742 | 297 | 98 | 75 | 0.041 | [ac:b69588] [pn:l-arabinose transport (integral membrane protein) arap] [gn:arap] [or:bacillus subtilis] [db:pir] |
| 24806592_c2_190 | 1140 | 3743 | 1407 | 468 | 179 | 2.30E-11 | [ln:u88974] [ac:u88974] [pn:orf28] [or:streptococcus thermophilus] [db:genpept-bct] [de:streptococcus thermophilus bacteriophage 01205 dna sequence,] [le:17062] [re:17955] [di:direct] |
| 24807637_c1_9 | 1141 | 3744 | 231 | 76 | 58 | 0.34 | [ln:eseraici] [ac:x66836] [pn:phosphoglycerate dehydrogenase] [gn:sera] [or:escherichia coli] [db:genpept-bct] [ec:1.1.1.95] [de:e.coli sera, icia, sbm genes and two open reading frames.] [nt:partial of sera orf] [sp:p08328] [le:<1] [re:298] |
| 24807967_c1_48 | 1142 | 3745 | 894 | 297 | 408 | 1.20E-37 | [ac:h69828] [pn:abc transporter (atp-binding protein) homolog yheh] [gn:yheh] [or:bacillus subtilis] [db:pir] |
| 24812552_c3_15 | 1143 | 3746 | 249 | 82 | 71 | 0.07 | [ac:pc2022] [pn:mucin like protein muc2 precursor:apoprotein] [gn:muc2] [or:rattus norvegicus] [sr:norway rat] [db:pir] [mp:1] |
| 24821000_c3_44 | 1144 | 3747 | 1215 | 404 | 113 | 0.0023 | [ln:bcy11138] [ac:y11138] [gn:orf1] [or:bacillus cereus] [db:genpept-bct] [de:b.cereus dna for orf1, orf2 and orf3 (2402 bp).] [nt:shows weak homology to c. elegans cosmid c33a12 orf] [le:156] [re:1373] [di:direct] |
| 24821887_c3_39 | 1145 | 3748 | 696 | 231 | 457 | 2.20E-43 | [ac:c69780] [pn:hypothetical protein ydff] [gn:ydff] [or:bacillus subtilis] [db:pir] |
| 24823385_f2_3 | 1146 | 3749 | 861 | 286 | 401 | 1.90E-37 | [ac:e70006] [pn:bacitracin resistance protein (undecapreno) homolog yubb] [gn:yubb] [or:bacillus subtilis] [db:pir] |
| 24823385_f3_18 | 1147 | 3750 | 906 | 301 | 809 | 1.10E-80 | [ac:o06973] [gn:yyvcj] [or:bacillus subtilis] [de:hypothetical 33.9 kd protein in crh-trxb intergenic region] [sp:o06973] [db:swissprot] |
| 24823412_f3_52 | 1148 | 3751 | 711 | 236 | 574 | 8.70E-56 | [ac:p40586] [gn:yir042c] [or:saccharomyces cerevisiae] [sr:baker's yeast] [de:hypothetical 27.4 kd protein in hyr1 3'region] [sp:p40586] [dbsswissprot] |
| 24823432_f1_12 | 1149 | 3752 | 1053 | 350 | 86 | 0.034 | [ac:b90383;b92077;a93813;a00171] [pn:cytochrome b5] [cl:cytochrome b5:cytochrome b5 core homology] [or:sus scrofa domestica] [sr:. domestic pig] [db:pir] |
| 24823437_f2_17 | 1150 | 3753 | 546 | 181 | 93 | 0.038 | [ac:c64674] [pn:conserved hypothetical integral membrane protein hp1235] [or:helicobacter pylori] [db:pir] |
| 24823437_f3_34 | 1151 | 3754 | 651 | 216 | 128 | 1.10E-06 | [ln:af016048] [ac:af016048] [pn:platelet-activating factor acetylhydrolase alpha] [gn:paf-ah alpha 2] [or:rattus norvegicus] [sr:norway rat] [db:genpept-rod] [de:rattus norvegicus platelet-activating factor acetylhydrolase alpha2 subunit (paf-ah alpha 2) |

TABLE 2-continued

| Orf | NT Seq ID | AA Seq ID | NT Orf Length | AA Orf Length | Score | Probability | Description |
|---|---|---|---|---|---|---|---|
| 24823438_f2_37 | 1152 | 3755 | 633 | 210 | 486 | 1.80E-46 | [ac:e53402] [pn:serine o-acetyltransferase,] [cl:galactoside acetyltransferase] [or:bacillus stearothermophilus] [ec:2.3.1.30] [db:pir] |
| 24845177_f2_30 | 1153 | 3756 | 798 | 265 | 624 | 4.40E-61 | [ac:c69693] [pn:ribonuclease h rnh] [gn:rnh] [or:bacillus subtilis] [db:pir] |
| 24846126_f1_2 | 1154 | 3757 | 391 | 131 | 123 | 1.00E-06 | [ln:mtv041] [ac:al021958] [pn:pgrs-family protein] [gn:mtv041.20] [or:mycobacterium tuberculosis] [db:genpept] [de:mycobacterium tuberculosis sequence v041.] [nt:mtv041.20, len:783, member of pgrs family of] [le:15587] [re:17938] [di:direct] |
| 24852193_c2_39 | 1155 | 3758 | 360 | 119 | 290 | 1.10E-25 | [ln:spac29b12] [ac:z99164] [pn:hypothetical protein] [gn:spac29b12.12] [or:schizosaccharomyces pombe] [sr:fission yeast] [db:genpept-pln] [de:s.pombe chromosome i cosmid c29b12.] [nt:spac29b12.12, unknown, len:113aa, similar eg. to] [le:31870] [re:32211] |
| 24853530_f1_2 | 1156 | 3759 | 189 | 62 | 54 | 0.67 | [ac:p20318] [gn:4.5] [or:bacteriophage t3] [de:gene 4.5 protein] [sp:p20318] [db:swissprot] |
| 24867750_c2_18 | 1157 | 3760 | 747 | 248 | 556 | 7.00E-54 | [ac:h70023] [pn:n-acetyl-glucosamine catabolism homolog yutf] [gn:yutf] [or:bacillus subtilis] [db:pir] |
| 24875936_f1_6 | 1158 | 3761 | 216 | 71 | 66 | 0.12 | [ac:46447.s53827] [pn:ymf48 protein] [or:mitochondrion acanthamoeba castellanii] [db:pir] |
| 24877193_c2_41 | 1159 | 3762 | 975 | 324 | 1132 | 6.50E-115 | [ac:d70008] [pn:nicotinate phosphoribosyltransferase homolog yuek] [gn:yuek] [or:bacillus subtilis] [db:pir] |
| 24877262_c2_108 | 1160 | 3763 | 2250 | 749 | 3049 | 0 | [ac:q54089] [gn:rela:rel] [or:streptococcus equisimilis] [ec:2.7.6.5] [de:protein] [sp:q54089] [db:swissprot] |
| 24879377_c1_11 | 1161 | 3764 | 564 | 188 | 809 | 1.10E-80 | [ac:q03158] [gn:enda] [or:streptococcus pneumoniae] [ec:3.1.30.—] [de:dna-entry nuclease (competence-specific nuclease).] [sp:q03158] [db:swissprot] |
| 24880000_f2_4 | 1162 | 3765 | 513 | 170 | 527 | 8.30E-51 | [ac:p23496] [gn:lacx] [or:lactococcus lactis] [sr:subsplactis:streptococcus lactis] [de:lacx protein, plasmid] [sp:p23496] [db:swissprot] |
| 24880258_c3_54 | 1163 | 3766 | 1410 | 469 | 520 | 4.60E-50 | [ac:b69271] [pn:hypothetical protein af0170] [or:archaeoglobus fulgidus] [db:pir] |
| 24882217_f2_13 | 1164 | 3767 | 495 | 164 | 254 | 7.10E-22 | [ln:sesirr] [ac:x99128] [pn:putative iron dependant repressor] [gn:sirr] [or:staphylococcus epidermidis] [db:genpept-bct] [de:s.epidermidis sirr gene.] [le:14] [re:658] [di:direct] |
| 24882888_f2_4 | 1165 | 3768 | 324 | 107 | 190 | 4.30E-15 | [ac:p24281] [gn:yaak] [or:bacillus subtilis] [de:hypothetical 11.8 kd protein in dnaz-recr intergenic region] [sp:p24281] [db:swissprot] |
| 24882927_f3_41 | 1166 | 3769 | 249 | 82 | 111 | 1.00E-06 | [ac:d69871] [pn:hypothetical protein ykzg] [gn:ykzg] [or:bacillus subtilis] [db:pir] |
| 24883437_f3_12 | 1167 | 3770 | 1158 | 385 | 866 | 9.90E-87 | [ln:ae001165] [ac:ae000783] [pn:spermidine/putrescine abc transporter,] [gn:bb0642] [or:borrelia burgdorferi] [sr:lyme disease spirochete] [db:genpept-bct] [de:borrelia burgdorferi (section 51 of 70) of the complete genome.] [nt:similar to gb:m64 |
| 24884842_c3_52 | 1168 | 3771 | 996 | 332 | 457 | 2.20E-43 | [ln:lacals] [ac:116975] [or:lactococcus lactis] [sr:lactococcus lactis (strain dsm 20384, sub_species lactis) dna] [db:genpept-bct] [de:lactococcus lactis alpha-acetolactate synthase (als) gene, completecds.] [nt:orf1] [le:28] [re:1077] [di:direct] |
| 24885937_f1_3 | 1169 | 3772 | 1182 | 393 | 743 | 1.10E-73 | [ln:af026542] [gn:agas] [or:escherichia coli] [de:agas protein] [sp:p42907] [db:swissprot] |
| 24886250_c3_35 | 1170 | 3773 | 186 | 61 | 51 | 0.048 | [ac:af026542] [ac:af026542:111653] [pn:scne] [gn:scne] [or:streptococcus pyogenes] [db:genpept-bct] [de:streptococcus pyogenes ff22 lantibiotic (scn) gene cluster regioncontaining:scnk, scnr, streptococcin a-ff22 precursor (scna),scna1, scnm, scnt, scnf, |
| 24886552_f2_21 | 1171 | 3774 | 1005 | 334 | 178 | 2.20E-13 | [ln:mtv028] [ac:al021426] [pn:hypothetical protein mtv028.11c] [gn:mtv028.11c] [or:mycobacterium tuberculosis] [db:genpept-bct] [de:mycobacterium tuberculosis sequence v028.] [nt:mtv028.11c, unknown, len:187; similar to jag_bacsu] [le:9544] [re:10107] [d |
| 24886557_f2_27 | 1172 | 3775 | 870 | 289 | 144 | 9.90E-08 | [ac:c69465] [pn:dinitrogenase reductase activating glycohydrolase (drag) homolog] [or:archaeoglobus fulgidus] [db:pir] |

TABLE 2-continued

| Orf | NT Seq ID | AA Seq ID | NT Orf Length | AA Orf Length | Score | Probability | Description |
|---|---|---|---|---|---|---|---|
| 24886563_f3_24 | 1173 | 3776 | 1278 | 425 | 536 | 9.30E-52 | [ln:bs43kbdna] [ac:aj223978] [pn:yvrn protein] [gn:yvrn] [or:bacillus subtilis] [db:genpept-bct] [de:bacillus subtilis 42.7kb dna fragment from yvsa to yvqa.] [le:14847] [re:16097] [di:direct] |
| 24890775_f1_4 | 1174 | 3777 | 363 | 120 | 524 | 1.70E-50 | [ln:sppbp2bh] [ac:z21808] [pn:internal region of the penicillin-binding] [db:genpept-bct] [de:s.pneumoniae of pbp 2b gene internal region of thepenicillin-binding protein 2b gene.] [nt:sequence i resistantance] [or:streptococcus pneumoniae] |
| 24897550_c2_18 | 1175 | 3778 | 516 | 171 | 70 | 0.05 | [ln:scu10280] [ac:u10280] [pn:mkk2p] [gn:mkk2] [fn:protein kinase] [or:saccharomyces cerevisiae] [sr:baker's yeast] [db:genpept-pln] [de:saccharomyces cerevisiae ume1p (ume1) and mkk2p (mkk2) genes,complete cds.] [le:2804] [re: |
| 24901567_f3_22 | 1176 | 3779 | 645 | 214 | 683 | 2.50E-67 | [ac:p28601] [gn:rpld] [or:bacillus stearothermophilus] [de:50s ribosomal protein 14] [sp:p28601] [db:swissprot] |
| 24901577_c2_5 | 1177 | 3780 | 195 | 64 | 94 | 0.00024 | [ac:o05732] [gn:hp0888] [or:helicobacter pylori] [sr:,campylobacter pylori] [de:probable iron chelatin transport atp-binding protein hp0888] [sp:o05732] |
| 2535252_f1_11 | 1178 | 3781 | 249 | 82 | 74 | 0.15 | [ac:g64502] [pn:hypothetical protein mj1626] [or:methanococcus jannaschii] [db:pir] [mp:rev1602382-1600085] |
| 2538338_f3_35 | 1179 | 3782 | 288 | 95 | 294 | 4.10E-26 | [ln:spnana] [acx72967] [or:streptococcus pneumoniae] [db:genpept-bct] [de:s.pneumoniae nana gene.] [nt:orf2] [le:193] [re:495] [di:direct] |
| 2538901_f3_29 | 1180 | 3783 | 321 | 106 | 153 | 1.10E-09 | [ac:jq04 06] [pn:hypothetical protein 1246 (uvra region)] [or:micrococcus luteus;micrococcus lysodeikticus] [db:pir] |
| 25391025_c3_41 | 1181 | 3784 | 192 | 63 | 47 | 0.81 | [ln:d89252] [ac:d89252] [or:schizosaccharomyces pombe] [sr:schizosaccharomyces pombe (strain:pr745) cdna to mma] [db:genpept-pln] [de:fission yeast mrna, partial cds.] [nt:similar to saccharomyces cerevisiae myo-inositol] [le:<1] [re:1131] [di:direct] |
| 25392877_c2_15 | 1182 | 3785 | 666 | 221 | 797 | 2.00E-79 | [ac:q01328] [gn:pcp] [or:streptococcus pyogenes] [de:peptidase] (pyroglutamyl-peptidase i)] [sp:q01328] [db:swissprot] |
| 25397512_f3_55 | 1183 | 3786 | 411 | 136 | 170 | 1.60E-12 | [ac:p36944;p96734] [gn:rbsr] [or:bacillus subtilis] [de:ribose operon repressor] [sp:p36944;p96734] |
| 25398427_f2_6 | 1184 | 3787 | 303 | 100 | 210 | 3.30E-17 | [ac:e69894] [pn:hypothetical protein ynzc] [gn:ynzc] [or:bacillus subtilis] [db:pir] |
| 25398442_f1_3 | 1185 | 3788 | 1536 | 511 | 2221 | 2.60E-230 | [ln:ab009314] [ac:ab009314] [pn:proton-translocating atpase, alpha subunit] [gn:atpa] [or:streptococcus bovis] [sr:streptococcus bovis (strain:jb-1) dna] [db:genpept-bct] [de:streptococcus bovis gene for proton-translocating atpase subunits,complete cds.] |
| 25399053_c3_98 | 1186 | 3789 | 237 | 78 | 70 | 0.26 | [ln:gacadsynh] [ac:x96429] [pn:(+)-delta-cadinene synthase] [gn:cad1-a] [or:gossypium arboreum] [db:genpept-pln] [de:garboreum mrna for cadinene synthase.] [le:97] [re:1764] [di:direct] |
| 25402202_c1_16 | 1187 | 3790 | 897 | 298 | 581 | 1.60E-56 | [ac:g69844] [pn:conserved hypothetical protein yjbo] [gn:yjbo] [or:bacillus subtilis] [db:pir] |
| 25406251_c1_57 | 1188 | 3791 | 321 | 106 | 80 | 0.0019 | [ac:p16517] [gn:16.7] [or:bacteriophage phi-29] [de:early protein gp16.7] [sp:p16517] [db:swissprot] |
| 25414692_c1_32 | 1189 | 3792 | 774 | 257 | 400 | 2.40E-37 | [ac:o69995] [pn:anion transport abc transporter (atp-bindi) homolog ytlc] [gn:ytlc] [or:bacillus subtilis] [db:pir] |
| 25415917_c1_24 | 1190 | 3793 | 978 | 325 | 407 | 4.30E-38 | [ac:p42422] [gn:yxdk:b65e] [or:bacillus subtilis] [de:(ec 2.7.3.—] [de:(ec 2.7.3.—)] [sp:p42422] [dbswissprot] |
| 25428328_f3_30 | 1191 | 3794 | 1068 | 355 | 1074 | 9.00E-109 | [ac:o06940] [gn:hrca] [or:streptococcus mutans] [de:heat-inducible transcription repressor hrca] [sp:o06940] [db:swissprot] |
| 25428775_f2_14 | 1192 | 3795 | 801 | 266 | 588 | 2.90E-57 | [ac:p39345] [gn:yjgu] [or:escherichia coli] [ec:1.—.—.—] [de:(ec 1.—.—.—)] [sp:p39345] [db:swissprot] |
| 25429814_c2_11 | 1193 | 3796 | 608 | 202 | 716 | 7.80E-71 | [ln:af030361] [ac:af030361] [pn:transposase] [or:streptococcus pneumoniae] [db:genpept-bct] [de:streptococcus pneumoniae strain sp-va92 glucose-1-phosphatethymidyl transferase (cpsi) gene, partial cds; anddtdp-4-keto-6-deoxyglucose-3,5-epimerase (cpsm),dt |

TABLE 2-continued

| Orf | NT Seq ID | AA Seq ID | NT Orf Length | AA Orf Length | Score | Probability | Description |
|---|---|---|---|---|---|---|---|
| 25433462_c1_163 | 1194 | 3797 | 324 | 107 | 82 | 0.0012 | [ln:u88974] [ac:u88974] [pn:orf33] [or:streptococcus thermophilus] [de:streptococcus thermophilus bacteriophage 01205 dna sequence.] [le:20355] [re:20693] [di:direct] |
| 2547807_c3_9 | 1195 | 3798 | 327 | 108 | 363 | 2.00E-33 | [ac:p20277] [gn:rplq] [or:bacillus subtilis] [de:50s ribosomal protein l17 (b115) (b121)] [sp:p20277] [db:swissprot] |
| 25478578_c3_37 | 1196 | 3799 | 228 | 75 | 192 | 2.60E-15 | [ln:spz82001] [ac:z82001] [pn:unknown] [or:streptococcus pneumoniae] [db:genpept-bct] [de:s.pneumoniae pcpa gene and open reading frames.] [le:<1] [re:174] [di:direct] |
| 25487551_c1_16 | 1197 | 3800 | 903 | 300 | 279 | 1.60E-24 | [ac:g64143] [pn:hypothetical protein hi0143] [or:haemophilus influenzae] [db:pir] |
| 2550217_f3_52 | 1198 | 3801 | 342 | 113 | 85 | 0.0081 | [ln:celt09d3] [ac:u64835] [gn:t09d3.3] [or:caenorhabditis elegans] [sr:caenorhabditis elegans strain=bristol n2] [db:genpept-inv] [de:caenorhabditis elegans cosmid t09d3.] [le:12376.12981:13120] [re:12935:13074:13173] [di:complementjoin] |
| 25511563_f1_1 | 1199 | 3802 | 930 | 309 | 662 | 4.60E-78 | [ac:p08188] [gn:manz:ptsm:gptb] [or:escherichia coli] [de:(ei:-m-man)] [sp:p08188] [db:swissprot] |
| 25511590_f2_23 | 1200 | 3803 | 696 | 231 | 212 | 2.40E-17 | [ln:strmalr] [ac:l21856] [pn:repressor protein] [gn:malr] [fn:maltose operon transcriptional repressor] [or:streptococcus pneumoniae] [db:genpept-bct] [de:streptococcus pneumoniae mala protein and repressor protein (malr)genes, complete cds.] [nt:putative |
| 25523507_f3_7 | 1201 | 3804 | 1311 | 436 | 1702 | 2.60E-175 | [ac:q59931] [gn:gapn] [or:streptococcus mutans] [de:dehydrogenase] [sp:q59931] [db:swissprot] |
| 25526383_c1_10 | 1202 | 3805 | 621 | 206 | 965 | 3.20E-97 | [ln:strcomaa] [ac:m36180:115190] [pn:transposase] [or:streptococcus pneumoniae] [sr:streptococcus pneumoniae (strain rx1) dna] [db:genpept-bct] [de:streptococcus pneumoniae transposase, (coma and comb) and saicarsynthetase (purc) genes, complete cds.] [nt |
| 25526383_c3_15 | 1203 | 3806 | 621 | 206 | 961 | 8.50E-97 | [ln:strcomaa] [ac:m36180:115190] [pn:transposase] [or:streptococcus pneumoniae] [sr:streptococcus pneumoniae (strain rx1) dna] [db:genpept-bct] [de:streptococcus pneumoniae transposase, (coma and comb) and saicarsynthetase (purc) genes, complete cds.] [nt |
| 25526383_f1_1 | 1204 | 3807 | 597 | 198 | 893 | 1.40E-89 | [ln:af030361] [ac:af030361] [pn:transposase] [or:streptococcus pneumoniae] [db:genpept-bct] [de:streptococcus pneumoniae strain sp-va92 glucose-1-phosphatethymidyl transferase (cps) gene, partial cds; anddtdp-4-keto-6-deoxyglucose-3,5-epimerase (cpsm).dt |
| 25526383_f1_2 | 1205 | 3808 | 255 | 84 | 356 | 1.10E-32 | [ln:af030361] [ac:af030361] [pn:transposase] [or:streptococcus pneumoniae] [db:genpept-bct] [de:streptococcus pneumoniae strain sp-va92 glucose-1-phosphatethymidyl transferase (cps) gene, partial cds; anddtdp-4-keto-6-deoxyglucose-3,5-epimerase (cpsm).dt |
| 25526383_f2_16 | 1206 | 3809 | 621 | 206 | 949 | 1.60E-95 | [ln:strcomaa] [ac:m36180:115190] [pn:transposase] [or:streptococcus pneumoniae] [sr:streptococcus pneumoniae (strain rx1) dna] [db:genpept-bct] [de:streptococcus pneumoniae transposase, (coma and comb) and saicarsynthetase (purc) genes, complete cds.] [nt |
| 25527253_f3_4 | 1207 | 3810 | 1230 | 409 | 1000 | 6.30E-101 | [ac:p50840] [gn:ypsc] [or:bacillus subtilis] [de:hypothetical 43.5 kd protein in cotd-kdud intergenic region precursor] [sp:p50840] [db:swissprot] |
| 25547942_c3_89 | 1208 | 3811 | 900 | 299 | 733 | 1.20E-72 | [ac:q04873] [gn:udg] [or:salmonella typhimurium] [ec:1.1.1.22] [de:udp-glucose 6-dehydrogenase, (udp-glc dehydrogenase)] [sp:q04873] [db:swissprot] |
| 25554061_f1_1 | 1209 | 3812 | 627 | 208 | 617 | 2.40E-60 | [ln:af009622] [ac:af009622] [pn:thioredoxin reductase] [gn:trxb] [or:listeria monocytogenes] [db:genpept-bct] [ec:1.6.4.5] [de:listeria monocytogenes thioredoxin reductase (trxb) gene, completecds, and udp-galactose-4-epimerase (gale) gene, partial cds.] |
| 2555437_f1_9 | 1210 | 3813 | 657 | 218 | 79 | 0.24 | [ln:celc33g8] [ac:u53154] [gn:c33g8.3] [or:caenorhabditis elegans] [sr:caenorhabditis elegans strain=bristol n2] [db:genpept-inv] [de:caenorhabditis elegans cosmid c33g8.] |

TABLE 2-continued

| Orf | NT Seq ID | AA Seq ID | NT Orf Length | AA Orf Length | Score | Probability | Description |
|---|---|---|---|---|---|---|---|
| 25563925_f2_11 | 1211 | 3814 | 1377 | 458 | 577 | 4.20E-56 | [ie:27678:27899:28087] [re:27848:27952:28290] [di:directjoin] [ac:f69354] [pn:trk potassium uptake system protein (trka-2) homolog] [or:archaeoglobus fulgidus] [db:pir] |
| 25556462_c3_44 | 1212 | 3815 | 1290 | 429 | 444 | 5.20E-42 | [ac:g64435] [pn:cobalt transport atp-binding protein o homolog] [cl:unassigned atp-binding cassette proteins;malk protein homology] [or:methanococcus jannaschii] [db:pir] [mp:rev1027976-1027137] |
| 25569193_f1_1 | 1213 | 3816 | 789 | 262 | 358 | 6.70E-33 | [ac:p42095] [gn:yqxn;yqfi] [or:bacillus subtilis] [de:(orf3)] [sp:p42095] [dbs:swissprot] |
| 25578250_c1_21 | 1214 | 3817 | 294 | 97 | 74 | 0.07 | [ac:d69689] [pn:response regulator aspartate phosphatase rapi] [gn:rapi] [or:bacillus subtilis] [db:pir] |
| 25579442_c1_9 | 1215 | 3818 | 294 | 97 | 135 | 2.90E-09 | [ac:g70041] [pn:conserved hypothetical protein yygz] [gn:yygz] [or:bacillus subtilis] [db:pir] |
| 25586001_f3_14 | 1216 | 3819 | 1311 | 436 | 327 | 1.30E-29 | [ac:q44406] [gn:xylr] [or:anaerocellum thermophilum] [de:xylose repressor] [sp:q44406] [db:swissprot] |
| 25586562_f1_15 | 1217 | 3820 | 657 | 218 | 528 | 6.50E-51 | [ac:p37537] [gn:tmk] [or:bacillus subtilis] [ec:2.7.4.9] [de:thymidylate kinase, (dtmp kinase)] [sp:p37537] [dbs:swissprot] |
| 25586693_c1_47 | 1218 | 3821 | 519 | 172 | 85 | 0.3 | [ac:g70008] [pn:nadh dehydrogenase (ubiquinone) homolog yufd] [gn:yufd] [or:bacillus subtilis] [db:pir] |
| 25588563_c3_43 | 1219 | 3822 | 405 | 134 | 189 | 5.50E-15 | [ac:e69751] [pn:abc transporter (atp-binding protein) homolog ybxa] [gn:ybxa] [or:bacillus subtilis] [db:pir] |
| 25593755_c3_119 | 1220 | 3823 | 1131 | 376 | 241 | 8.10E-18 | [ac:h69878] [pn:protein kinase homolog ylop] [gn:ylop] [or:bacillus subtilis] [db:pir] |
| 25596062_f3_40 | 1221 | 3824 | 228 | 75 | 65 | 0.16 | [ac:p25146] [gn:inla] [or:listeria monocytogenes] [de:internalin a] [sp:p25146] [db:swissprot] |
| 25597250_f3_26 | 1222 | 3825 | 189 | 62 | 56 | 0.57 | [in:celb0336] [ac:u32305] [gn:b0336.8] [or:caenorhabditis elegans] [sr:caenorhabditis elegans strain=bristol n2] [db:genpept-inv] [de:caenorhabditis elegans cosmid b0336.] [ie:10526:10663:10807] [re:10609:10755:10986] [di:complementjoin] |
| 25601577_c1_141 | 1223 | 3826 | 1059 | 352 | 61 | 0.073 | [ac:c22845] [pn:nadh dehydrogenase (ubiquinone) chain 4] [cl:nadh dehydrogenase (ubiquinone) chain 4] [or:mitochondrion trypanosoma brucei] [ec:1.6.5.3] [db:pir] |
| 25602312_f3_14 | 1224 | 3827 | 798 | 265 | 320 | 7.20E-29 | [ac:s74821] [pn:hypothetical protein slr1742] [or:synechocystis sp.] [srpcc 6803, , pcc 6803] [src:pcc 6803,] [db:pir] |
| 25626562_f3_17 | 1225 | 3828 | 402 | 133 | 392 | 1.70E-36 | [in:llu92974] [ac:u92974;m90760;m90761] [gn:aldr] [or:lactococcus lactis] [db:genpept-bct] [de:lactococcus lactis unknown gene, partial cds, and hisc (hisc),unknown, hisg (hisg), unknown, hisb (hisb), unknown, hish (hish),hisa (hisa), hisf (hisf |
| 25627312_f1_1 | 1226 | 3829 | 657 | 218 | 528 | 6.50E-51 | [ac:a69787] [pn:hypothetical protein ydih] [gn:ydih] [or:bacillus subtilis] [db:pir] |
| 25630038_f1_1 | 1227 | 3830 | 216 | 71 | 56 | 0.74 | [in:arexoygen] [ac:x95394] [pn:unknown] [gn:orf1] [or:agrobacterium radiobacter] [db:genpept-bct] [de:a.radiobacter exoy, alda, oata genes and orf1.] [ie:3516] [re:3947] [di:direct] |
| 25633390_c2_68 | 1228 | 3831 | 528 | 175 | 123 | 7.30E-08 | [ac:q01467] [gn:mred;rodb] [or:bacillus subtilis] [de:rod shape-determining protein mred] [sp:q01467] [dbs:swissprot] |
| 25634427_f1_5 | 1229 | 3832 | 2562 | 853 | 4098 | 0 | [in:sparcetp] [ac:z67739] [pn:dna topoisomerase iv] [gn:parc] [or:streptococcus pneumoniae] [db:genpept-bct] [de:s.pneumoniae parc, parc and transposase genes and unknown orf.] [nt:parc subunit] [ie:3618] [re:6089] [di:direct] |
| 25641593_c2_18 | 1230 | 3833 | 600 | 199 | 397 | 5.00E-37 | [ac:p39796] [gn:trer] [or:bacillus subtilis] [de:trehalose operon transcriptional repressor] [sp:p39796] [dbs:swissprot] |
| 25650267_c1_34 | 1231 | 3834 | 729 | 242 | 525 | 1.40E-50 | [ac:h69979] [pn:proteinase homolog yrro] [gn:yrro] [or:bacillus subtilis] [db:pir] |
| 25650312_c3_38 | 1232 | 3835 | 198 | 65 | 68 | 0.31 | [in:ecu28375] [ac:u28375] [or:escherichia coli] [db:genpept-bct] [de:escherichia coli k-12 genome; approximately 64 to 65 minutes.] [nt:orf_o439] [ie:35581] [re:36900] [di:direct] |
| 25664057_f2_8 | 1233 | 3836 | 381 | 126 | 438 | 2.20E-41 | [in:spadca] [ac:z71552] [pn:abc protein] [gn:adcc] [or:streptococcus pneumoniae] |

TABLE 2-continued

| Orf | NT Seq ID | AA Seq ID | NT Orf Length | AA Orf Length | Score | Probability | Description |
|---|---|---|---|---|---|---|---|
| 25664061_f2_78 | 1234 | 3837 | 1149 | 382 | 290 | 2.60E-47 | [db:genpept-bct] [de:streptococcus pneumoniae adccba operon.] [le:20] [re:721] [di:direct] |
| 25667760_f2_26 | 1235 | 3838 | 774 | 257 | 75 | 0.99 | [ln:u93688] [ac:u93688] [pn:integrase] [gn:int] [or:staphylococcus aureus] [db:genpept-bct] [de:staphylococcus aureus toxic shock syndrome toxin-1 (tst),enterotoxin (ent), and integrase (int) genes, complete cds.] [nt:similar to staphylococcal phage integ |
| 25672763_f3_5 | 1236 | 3839 | 744 | 247 | 89 | 1.30E-06 | [ln:ae000789] [ac:ae000789] [pn:pfs protein (pfs)] [gn:bbi06] [or:borrelia burgdorferi] [sr:lyme disease spirochete] [db:genpept-bct] [de:borrelia burgdorferi plasmid lp28-4, complete plasmid sequence.] [nt:similar to gb:d26562 sp:p24247 gb:m83735 pid:473 |
| 25679643_c1_35 | 1237 | 3840 | 375 | 124 | 61 | 0.22 | [ln:lmiap12061] [ac:x85856] [pn:invasive associated protein] [gn:iap] [or:listeria monocytogenes] [db:genpept-bct] [de:l.monocytogenes type 1 partial iap gene (strain 12067).] [nt:invades nonprofessional phagocytic cells] [le:<1] [re: |
| 25683537_f3_36 | 1238 | 3841 | 453 | 150 | 64 | 0.17 | [ac:g69441] [pn:glutaredoxin (grx-1) homolog] [or:archaeoglobus fulgidus] [db:pir] |
| 2578200_f3_4 | 1239 | 3842 | 1857 | 618 | 144 | 3.00E-08 | [ln:mmu47023] [ac:u47023] [pn:unknown] [or:methanococcus maripaludis] [db:genpept-bct] [de:methanococcus maripaludis plasmid purb500, complete genome.] [nt:orf-13] [le:5239] [re:5490] [di:direct] |
| 25820307_c1_13 | 1240 | 3843 | 213 | 71 | 153 | 3.60E-11 | [ac:h64496] [pn:hypothetical protein mj1577] [or:methanococcus jannaschii] [db:pir] [mp:for1552198-1553994] |
| 25831355_c1_3 | 1241 | 3844 | 474 | 158 | 657 | 1.40E-64 | [ac:q00990] [gn:rplm] [or:staphylococcus carnosus] [de:50s ribosomal protein l13] [sp:q00990] [dbswissprot] |
| 25832561_c1_42 | 1242 | 3845 | 300 | 99 | 173 | 2.70E-13 | [ac:p28691] [gn:hflb:ftsh:mrsc] [or:escherichia coli] [ec:3.4.24.—] [de:cell division protein ftsh.] [sp:p28691] [dbswissprot] |
| 2584687_c3_41 | 1243 | 3846 | 432 | 143 | 342 | 3.30E-31 | [ac:p39703] [gn:yal004w] [or:saccharomyces cerevisiae] [sr:baker's yeast] [de:hypothetical 23.8 kd protein in ssa1-cfb1 intergenic region] [sp:p39703] [dbswissprot] |
| 25906253_c3_2 | 1244 | 3847 | 402 | 134 | 104 | 2.10E-05 | [ln:padldh] [ac:x70925] [gn:y210] [or:pediococcus acidilactici] [db:genpept-bct] [de:p.acidilactici gene for d-lactate dehydrogenase.] [le:<1] [re:637] [di:direct] |
| 25908563_f2_12 | 1245 | 3848 | 1137 | 378 | 944 | 5.40E-95 | [ln:rnu63111] [ac:u63111] [pn:dentin phosphoprotein precursor] [or:rattus norvegicus] [sr:norway rat] [db:genpept-rod] [de:rattus norvegicus dentin phosphoprotein precursor mrna, complete cds.] [le:43] [re:846] [di:direct] |
| 25938462_c1_22 | 1246 | 3849 | 1953 | 650 | 1621 | 9.80E-167 | [ln:af012876] [ac:af012876] [pn:homocysteine synthase] [or:schizosaccharomyces pombe] [sr:fission yeast] [db:genpept-pln] [ec:4.2.99.10] [de:schizosaccharomyces pombe homocysteine synthase mrna, complete cds.] [le:105] [re:1394] [di:direct] |
| 25973430_c1_49 | 1247 | 3850 | 360 | 119 | 71 | 0.96 | [ac:o05519] [gn:ydif] [or:bacillus subtilis] [de:hypothetical abc transporter atp-binding protein ydif] [sp:o05519] [dbswissprot] |
| 25973808_c2_4 | 1248 | 3851 | 666 | 221 | 498 | 9.80E-48 | [ac:a55839] [pn:transcription factor inhibitor i-kappa-b-beta] [cl:unassigned ankyrin repeat proteins:ankyrin repeat homology] [or:mus musculus] [sr: house mouse] [db:pir] |
| 25976525_f2_14 | 1249 | 3852 | 1392 | 463 | 1428 | 2.80E-146 | [ac:e69785] [pn:transcriptional regulator (gntr family) homolog ydhq] [gn:ydhq] [or:bacillus subtilis] [db:pir] |
| 25992269_c2_14 | 1250 | 3853 | 1008 | 335 | 434 | 6.00E-41 | [ac:b69745] [pn:phosphoglucomutase (glycolysis) homolog ybbl] [gn:ybbl] [or:bacillus subtilis] [db:pir] |
| 25995133_f2_3 | 1251 | 3854 | 198 | 65 | 56 | 0.088 | [ln:sput09352] [ac:u09352] [or:streptococcus pyogenes] [db:genpept-bct] [de:streptococcus pyogenes 42 kd protein (orf1) gene and 67 kdmyosin-crossreactive streptococcal antigen gene, complete cds.] [nt:orf1, putative 42 kda protein] [le:237] [re:1418] [di: |
| 26015942_c3_73 | 1252 | 3855 | 219 | 72 | 210 | 3.30E-17 | [ac:s41022] [pn:hypothetical protein t07c4.9] [cl:annexin repeat homology] [or:caenorhabditis elegans] [db:pir] |
| 26018757_f2_31 | 1253 | 3856 | 231 | 76 | 184 | 1.90E-14 | [ac:q02522] [gn:hpt] [or:lactococcus lactis] [sr:,subsplactis:streptococcus lactis] [ec:2.4.2.8] [de:(hgprtase)] [sp:q02522] [dbswissprot] [ac:s52544] [pn:is12 protein] [or:lactobacillus helveticus] [db:pir] |

TABLE 2-continued

| Orf | NT Seq ID | AA Seq ID | NT Orf Length | AA Orf Length | Score | Probability | Description |
|---|---|---|---|---|---|---|---|
| 26037642_f1_1 | 1254 | 3857 | 939 | 312 | 655 | 2.30E-64 | [ac:e69879] [pn:conserved hypothetical protein ylov] [gn:ylov] [or:bacillus subtilis] [db:pir] |
| 26054818_c2_5 | 1255 | 3858 | 1653 | 550 | 2265 | 5.60E-235 | [ac:a41971:a60282:a33134] [pn:surface protein pspa precursor:pneumococcal surface protein a] [gn:pspa] [cl:cpl repeat homology] [or:streptococcus pneumoniae] [db:pir] |
| 26055442_c2_96 | 1256 | 3859 | 1389 | 462 | 1191 | 3.60E-121 | [n:ehy13922:y15222] [gn:ftsa] [or:enterococcus hirae] [db:genpept-bct] [de:enterococcus hirae mraz, pbp3s, mray, murd, mug, ftsz and ftsagenes, mraw, yllc and ftsz partial genes,] [e:8960] [re:10288] [di:direct] |
| 26069215_c3_82 | 1257 | 3860 | 213 | 70 | 119 | 8.40E-07 | [n:spcpsl4e] [ac:x85787] [gn:tasa] [or:streptococcus pneumoniae] [db:genpept-bct] [de:s.pneumoniae cps14 locus,] [e:12856] [re:13935] [di:direct] |
| 26072000_f2_8 | 1258 | 3861 | 222 | 73 | 248 | 5.00E-20 | [ac:a69584] [pn:alanyl-tma synthetase alas] [gn:alas] [or:bacillus subtilis] [db:pir] |
| 26145067_c3_42 | 1259 | 3862 | 267 | 88 | 219 | 3.60E-18 | [n:sgu57759] [ac:u57759] [pn:intrageneric coaggregation-relevant adhesin] [or:streptococcus gordonii] [db:genpept-bct] [de:streptococcus gordonii intragenic coaggregation-relevant adhesingene, complete cds,] [e:277] [re:1212] [di:direct] |
| 26172500_f3_6 | 1260 | 3863 | 522 | 173 | 453 | 5.80E-43 | [ac:a69637] [pn:transcription elongation factor grea] [gn:grea] [or:bacillus subtilis] [db:pir] |
| 26181517_c1_24 | 1261 | 3864 | 516 | 171 | 102 | 0.0049 | [n:celf42g9] [ac:u00051] [gn:f42g9.5] [or:caenorhabditis elegans] [sr:caenorhabditis elegans strain=bristol n2] [db:genpept-inv] [de:caenorhabditis elegans cosmid f42g9.] [nt:similar to betaine-aldehyde dehydrogenase] [l:e:18579:18760:18886] [re:18709:188 |
| 26181562_c2_62 | 1262 | 3865 | 423 | 140 | 415 | 6.10E-39 | [ac:02522] [gn:hpt] [or:lactococcus lactis] [sr:subsplactis:streptococcus lactis] [ec:2.4.2.8] [de:(hgptase)] [sp:q02522] [db:swissprot] |
| 26189812_c3_38 | 1263 | 3866 | 864 | 287 | 1480 | 8.60E-152 | [n:af030362] [ac:af030362] [de:streptococcus pneumoniae strain sp-ga71 glucose-1-phosphatethymidyl transferase (cps) gene, partial cds; anddtp-4-keto-6-deoxyglucose-phosphatethymidyl transferase (cps) gene, partial cds, anddtp-4-keto-6-deoxyglucose-1-phosphatethymidyl transferase (cps) gene, partial cds; [pn:rhamnose synthase] [gn:cpso] [or:streptococcus pneumoniae] [db:genpept-bct] |
| 26197087_c1_33 | 1264 | 3867 | 315 | 104 | 227 | 5.10E-19 | [ac:p32728] [gn:ylxr] [or:bacillus subtilis] [de:hypothetical 10.4 kd protein in nusa-infb intergenic region (orf3)] [sp:p32728] [db:swissprot] |
| 26198262_f1_5 | 1265 | 3868 | 492 | 163 | 175 | 2.90E-13 | [ac:p49330] [gn:rgg] [or:streptococcus gordonii challis] [de:rgg protein] [sp:p49330] [db:swissprot] |
| 26198441_f2_11 | 1266 | 3869 | 1092 | 363 | 872 | 2.30E-87 | [ac:s77464] [pn:hypothetical protein] [or:synechocystis sp.] [sr:pcc 6803,, pcc 6803] [sr:pcc 6803,] [db:pir] |
| 26199213_f3_62 | 1267 | 3870 | 255 | 84 | 61 | 0.24 | [n:celk10c2] [acu39852] [gn:k10c2.6] [or:caenorhabditis elegans] [sr:caenorhabditis elegans strain=bristol n2] [db:genpept-inv] [de:caenorhabditis elegans cosmid k10c2.] [l:e:<32854:32898:33228] [re:32855:33169:33274] [di:direct join] |
| 26203201_f1_1 | 1268 | 3871 | 855 | 284 | 1009 | 7.00E-102 | [ac:q00752] [gn:msmk] [or:streptococcus mutans] [de:multiple sugar-binding transport atp-binding protein msmk] [sp:q00752] [db:swissprot] |
| 26203781_f1_8 | 1269 | 3872 | 921 | 306 | 1318 | 1.30E-134 | [ac:q54713] [gn:hasc] [or:streptococcus pyogenes] [ec:2.7.7.9] [de:uridylyltransferase) (uridine diphosphoglucose pyrophosphorylase)] [sp:q54713] [db:swissprot] |
| 26211517_f3_31 | 1270 | 3873 | 714 | 237 | 508 | 8.60E-49 | [ac:p10089] [gn:hlyb] [or:escherichia coli] [de:hemolysin secretion atp-binding protein, chromosomal] [sp:p10089] [db:swissprot] |
| 26226050_c1_55 | 1271 | 3874 | 318 | 105 | 126 | 2.60E-08 | [ac:b30868] [pn:hypothetical protein 1 (insertion sequence is861)] [gn:is861-orf 1] [or:streptococcus agalactiae] [db:pir] |
| 26227302_f1_3 | 1272 | 3875 | 1080 | 359 | 1806 | 2.40E-186 | [ac:p18765] [gn:amie] [or:streptococcus pneumoniae] [de:oligopeptide transport atp-binding protein amie] [sp:p18765] [db:swissprot] |
| 26227307_c1_13 | 1273 | 3876 | 780 | 259 | 671 | 4.60E-66 | [ac:p42976] [gn:dapb] [or:bacillus subtilis] [ec:1.3.1.26] [de:dihydrodipicolinate reductase,] [sp:p42976] [db:swissprot] |
| 26230400_f1_1 | 1274 | 3877 | 1725 | 574 | 264 | 2.60E-24 | [ac:e69975] [pn:acyltransferase homolog yrhl] [gn:yrhl] [or:bacillus subtilis] [db:pir] |
| 26254681_c2_111 | 1275 | 3878 | 507 | 168 | 345 | 1.60E-31 | [n:shu75349] [acu75349] [pn:periplasmic-iron-binding protein shib] [or:serpulina hyodysenteriae] [db:genpept-bct] [de:serpulina hyodysenteriae shi operon, periplasmic-iron-bindingproteins shia and shib, putative abc transporter shic, and putativepermeas |
| 26257843_f3_14 | 1276 | 3879 | 1203 | 400 | 485 | 2.30E-46 | [ac:g69849] [pn:endo-1,4-beta-xylanase homolog yjea] [gn:yjea] [or:bacillus subtilis] |

TABLE 2-continued

| Orf | NT Seq ID | AA Seq ID | NT Orf Length | AA Orf Length | Score | Probability | Description |
|---|---|---|---|---|---|---|---|
| 26259687_c2_16 | 1277 | 3880 | 1047 | 349 | 1372 | 2.40E-140 | [ac:b69722] [pn:trna-guanine transglycosylase tgt] [gn:tgt] [or:bacillus subtilis] [db:pir] |
| 2626l317_f1_1 | 1278 | 3881 | 447 | 148 | 316 | 1.90E-28 | [ac:p39157] [gn:ywlg:ipc-33d] [or:bacillus subtilis] [de:hypothetical 19.4 kd protein in spoiii-glyc intergenic region] [sp:p39157] [db:swissprot] |
| 26288288_f1_10 | 1279 | 3882 | 645 | 214 | 91 | 0.21 | [ac:p26685] [or:african swine fever virus] [sr:isolate malawi lil 20/1:asfv] [ec:1.17.4.1] [de:(ribonucleotide reductase)] [sp:p26685] [db:swissprot] |
| 26282942_f3_28 | 1280 | 3883 | 267 | 88 | 87 | 0.015 | [ln:ab002371] [ac:ab002371] [gn:kiaa0373] [or:homo sapiens] [sr:homo sapiens male brain cdna to mrna, clone_lib:pbluescriptii s] [db:genpept-pri2] [de:human mrna for kiaa0373 gene, complete cds.] [le:1181] [re:5800] [di:direct] |
| 26284688_f3_29 | 1281 | 3884 | 462 | 153 | 368 | 5.90E-34 | [ac:q02141] [gn:leua] [or:lactococcus lactis] [sr:subsplactis:streptococcus lactis] [ec:4.1.3.12] [de:synthase) (alpha-ipm synthetase)] [sp:q02141] [db:swissprot] |
| 26291630_c2_19 | 1282 | 3885 | 294 | 97 | 101 | 0.00021 | [ln:nfu43192] [ac:u43192] [pn:myosin ii heavy chain] [or:naegleria fowleri] [db:genpept-inv] [de:naegleria fowleri myosin ii heavy chain mrna, partial cds.] [le:<1] [re:2243] [di:direct] |
| 26296926_c2_110 | 1283 | 3886 | 249 | 82 | 128 | 5.00E-08 | [ac:q00753] [gn:msmr] [or:streptococcus mutans] [de:msm operon regulatory protein] [sp:q00753] [db:swissprot] |
| 26297201_c3_26 | 1284 | 3887 | 1362 | 453 | 1766 | 4.20E-182 | [ac:q99040] [gn:dexb] [or:streptococcus mutans] [ec:3.2.1.70] [de:(exo-1,6-alpha-glucosidase) (glucodextranase)] [sp:q99040] [db:swissprot] |
| 26345063_f3_3 | 1285 | 3888 | 2328 | 775 | 1146 | 4.60E-137 | [ac:d69617] [pn:dna polymerase iii (alpha subunit) dnae] [gn:dnae] [or:bacillus subtilis] [db:pir] |
| 26346006_c3_15 | 1286 | 3889 | 225 | 74 | 248 | 3.10E-21 | [ac:p26908] [gn:rplu] [or:bacillus subtilis] [de:50s ribosomal protein 121 (b120)] [sp:p26908] [db:swissprot] |
| 26350137_f2_6 | 1287 | 3890 | 267 | 88 | 64 | 0.029 | [ln:celc33f10] [ac:u49830] [gn:c33f10.4] [or:caenorhabditis elegans] [sr:caenorhabditis elegans strain=bristol n2] [db:genpept-inv] [de:caenorhabditis elegans cosmid c33f10.] [le:621:1086:1560] [re:770:1514:1955] [di:direct|join] |
| 26352312_f3_30 | 1288 | 3891 | 876 | 291 | 665 | 2.00E-65 | [ac:b69098] [pn:phosphate transporter permease pstc] [gn:mth1729] [or:methanobacterium thermoautotrophicum] [db:pir] |
| 26359757_f1_1 | 1289 | 3892 | 1185 | 394 | 1176 | 1.40E-119 | [ln:ldgappgk] [ac:aj000339] [pn:phosphoglycerate kinase] [gn:pgk] [or:lactobacillus delbrueckii] [db:genpept-bct] [ec:2.7.2.3] [de:lactobacillus delbrueckii ygap, gap, pgk, tpi, and ycse genes.] [le:2369] [re:3580] [di:direct] |
| 26362557_f2_8 | 1290 | 3893 | 2361 | 786 | 1478 | 1.40E-151 | [ac:d69985] [pn:dna mismatch repair protein homolog yshd] [gn:yshd] [or:bacillus subtilis] [db:pir] |
| 26362780_f3_1 | 1291 | 3894 | 186 | 62 | 95 | 5.00E-05 | [ac:b70057] [pn:transcriptional regulator (marr family) homolog ywha] [gn:ywha] [or:bacillus subtilis] [db:pir] |
| 26362817_c3_30 | 1292 | 3895 | 1566 | 521 | 1270 | 1.50E-129 | [ac:p73473] [gn:prfcslr1228] [or:synechocystis sp] [srpcc 6803,] [de:peptide chain release factor 3 (rf-3)] [sp:p73473] [db:swissprot] |
| 26363175_f2_5 | 1293 | 3896 | 744 | 247 | 523 | 2.20E-50 | [ac:a64666] [pn:glutamine abc transporter, permease protein] [or:helicobacter pylori] [db:pir] |
| 26365912_c1_39 | 1294 | 3897 | 231 | 76 | 75 | 0.0014 | [ac:p15552] [or:strongylocentrotus purpuratus] [sr:purple sea urchin] [ec:1.6.5.3] [de:nadh-ubiquinone oxidoreductase chain 5,] [sp:p15552] [db:swissprot] |
| 26366327_c1_50 | 1295 | 3898 | 1200 | 399 | 315 | 2.40E-28 | [ln:efu94707] [ac:u94707] [pn:cell division protein] [gn:div1b] [or:enterococcus faecalis] [db:genpept-bct] [de:enterococcus faecalis strain a24836 cell wall/cell division genecluster, yllb, yllc, ylld, pbpc, mray, murd, murg, div1b, ftsa andftsz genes, c |
| 26366626_c3_41 | 1296 | 3899 | 609 | 202 | 696 | 1.00E-68 | [ac:p04447] [gn:rpla] [or:bacillus stearothermophilus] [de:50s ribosomal protein 11] [sp:p04447] [db:swissprot] |
| 26367303_c1_43 | 1297 | 3900 | 873 | 290 | 445 | 4.10E-42 | [ac:h69708] [pn:dna processing smf protein homolog smf] [gn:smf] [or:bacillus subtilis] [db:pir] |
| 26367312_c1_39 | 1298 | 3901 | 627 | 208 | 902 | 1.50E-90 | [ln:sasoda] [ac:y12224] [pn:manganese-dependent superoxide dismutase] [gn:soda] [or:streptococcus agalactiae] [db:genpept-bct] [de:s.agalactiae soda gene.] [le:1860] |

TABLE 2-continued

| Orf | NT Seq ID | AA Seq ID | NT Orf Length | AA Orf Length | Score | Probability | Description |
|---|---|---|---|---|---|---|---|
| | | | | | | | [re:2468] [di:direct] |
| 26367762_f2_5 | 1299 | 3902 | 909 | 302 | 764 | 6.40E−76 | [ln:cau76387] [ac:u76387] [pn:prpp synthetase] [gn:prs] [or:*corynebacterium ammoniagenes*] [db:genpept-bct] [ec:2.7.6.1] [de:*corynebacterium ammoniagenes* n-acetyl glucoseamine 1-phosphateuridyltransferase (glmu) gene, partial cds, and prpp-synthetase(prs) |
| 26367812_c2_35 | 1300 | 3903 | 1029 | 342 | 212 | 8.60E−16 | [ac:p44658] [gn:hi0357] [or:*haemophilus influenzae*] [de:putative thiamine biosynthesis protein hi0357] [sp:p44658] [db:swissprot] |
| 26369000_f3_4 | 1301 | 3904 | 1179 | 392 | 81 | 0.027 | [ac:f69769] [pn:conserved hypothetical protein ydao] [gn:ydao] [or:*bacillus subtilis*] [db:pir] |
| 26369052_c2_41 | 1302 | 3905 | 1905 | 634 | 1094 | 6.90E−111 | [ln:soorfs] [ac:z79691] [pn:orfa] [gn:yorfa] [or:*streptococcus pneumoniae*] [db:genpept-bct] [de:*s.pneumoniae* yorf[a,b,c,d,e], ftsl, pbpx and regr genes.] [le:<1] [re:624] [di:direct] |
| 26369077_c1_33 | 1303 | 3906 | 2181 | 726 | 636 | 1.10E−97 | [ac:s46952:s63605] [pn:phosphotransferase system enzyme ii,, glucose-specific, factor iia:glucose permease:phosphoenolpyruvate:glucose phosphotransferase system enzyme ii, glucose-specific:phosphotransferase system enzyme ii, glucose-specific, factor 1:pr |
| 26369187_c1_19 | 1304 | 3907 | 201 | 66 | 70 | 0.055 | [ac:s46426] [pn:probable botulinum neurotoxin regulator protein 22] [or:*clostridium botulinum* phage 1c] [sr:strain c 468, , strain c 468] [sr:strain c 468,] [db:pir] |
| 26370757_c3_56 | 1305 | 3908 | 750 | 249 | 102 | 0.003 | [ln:sbglurich] [ac:x95984] [pn:glutamic acid-rich protein] [or:*solanum berthaultii*] [db:genpept-pln] [de:*s.berthaultii* mrna for glutamic acid-rich protein.] [le:162] [re:884] [di:direct] |
| 26370881_f3_9 | 1306 | 3909 | 528 | 175 | 441 | 1.10E−41 | [ac:p96050] [gn:fold] [or:*streptococcus thermophilus*] [ec:1.5.1.5:3.5.4.9] [de:methenyltetrahydrofolate cyclohydrolase,] [sp:p96050] [db:swissprot] |
| 26375465_c1_20 | 1307 | 3910 | 258 | 85 | 149 | 4.50E−10 | [ln:spcps14e] [ac:x85787] [gn:tasa] [or:*streptococcus pneumoniae*] [db:genpept-bct] [de:*s.pneumoniae* cps14 locus.] [le:12856] [re:13935] [di:direct] |
| 26377258_f2_3 | 1308 | 3911 | 567 | 188 | 182 | 3.00E−14 | [ln:mtcy22d7] [ac:z83866] [pn:unknown] [gn:mtcy22d7.28] [or:*mycobacterium tuberculosis*] [db:genpept-bct] [de:*mycobacterium tuberculosis* cosmid scy22d7.] [nt:mtcy22d7.28. len:184. function:unknown but shows] [le:28139] [re:28693] [di:direct] |
| 26381567_f1_2 | 1309 | 3912 | 222 | 73 | 56 | 0.86 | [ac:p08447] [gn:atpf] [or:synechococcus sp] [sr:pcc 6301,] [ec:3.6.1.34] [de:atp synthase b chain, (subunit i)] [sp:p08447] [db:swissprot] |
| 26382061_c3_118 | 1310 | 3913 | 297 | 98 | 200 | 3.70E−16 | [ac:g69878] [pn:conserved hypothetical protein yloo] [gn:yloo] [or:*bacillus subtilis*] [db:pir] |
| 26383563_c3_116 | 1311 | 3914 | 948 | 315 | 787 | 2.30E−78 | [ac:a69626] [pn:methionyl-trna formyltransferase fmt] [gn:fmt] [or:*bacillus subtilis*] [db:pir] |
| 26384637_c2_97 | 1312 | 3915 | 1245 | 414 | 206 | 3.50E−16 | [ln:rmexpgns] [ac:z79692] [pn:orf25] [or:*sinorhizobium meliloti*] [db:genpept-bct] [de:*r.meliloti* exp gene cluster.] [le:30279] [re:31097] [di:complement] |
| 26384687_c1_38 | 1313 | 3916 | 627 | 208 | 243 | 6.00E−24 | [ln:af015453] [ac:af015453] [pn:unknown] [or:*lactobacillus rhamnosus*] [db:genpept-bct] [de:*lactobacillus rhamnosus* 6-phospho-beta-glucosidase homolog gene,partial cds; gntr transcriptional regulator homolog and surfacelocated protein genes, complete cds.] |
| 26385967_c2_68 | 1314 | 3917 | 1716 | 571 | 1039 | 4.60E−105 | [ac:i40794] [pn:dihydrolipoamide dehydrogenase,] [or:*clostridium magnum*] [ec:1.8.1.4] [db:pir] |
| 26423750_f2_4 | 1315 | 3918 | 717 | 238 | 102 | 0.0084 | [ln:stpykforf] [ac:x99945] [pn:amino acid permease yeef like protein] [gn:orf48] [or:*salmonella typhimurium*] [db:genpept-bct] [de:*s.typhimurium* orfs 32 & 48 & gene pykf.] [le:1171] [re:2517] [di:direct] |
| 26438452_f3_38 | 1316 | 3919 | 1263 | 420 | 891 | 2.20E−89 | [ac:g70019] [pn:conserved hypothetical protein yurx] [gn:yurx] [or:*bacillus subtilis*] [db:pir] |
| 26439010_f1_2 | 1317 | 3920 | 708 | 235 | 535 | 1.20E−51 | [ac:f69879] [pn:phosphoglycerate dehydrogenase homolog ylow] [gn:ylow] [or:*bacillus subtilis*] [db:pir] |
| 26439463_f3_30 | 1318 | 3921 | 1017 | 338 | 646 | 2.00E−63 | [ac:p42062] [gn:appb] [or:*bacillus subtilis*] [de:oligopeptide transport permease protein |

TABLE 2-continued

| Orf | NT Seq ID | AA Seq ID | NT Orf Length | AA Orf Length | Score | Probability | Description |
|---|---|---|---|---|---|---|---|
| 26445282_f2_22 | 1319 | 3922 | 990 | 329 | 261 | 1.30E-22 | appb] [sp:p42062] [db:swissprot] [ac:i40867] [pn:hypothetical protein 2] [or:clostridium perfringens] [db:pir] |
| 26445443_c1_50 | 1320 | 3923 | 1008 | 335 | 886 | 7.50E-89 | [ac:i40791] [pn:tpp-dependent acetoin dehydrogenase beta chain] [or:clostridium magnum] [db:pir] |
| 26446062_c1_19 | 1321 | 3924 | 2043 | 680 | 227 | 6.10E-18 | [ac:p46321] [gn:celr] [or:bacillus subtilis] [de:putative cel operon regulator] [sp:p46321] [db:swissprot] |
| 26449187_c2_37 | 1322 | 3925 | 666 | 221 | 334 | 2.40E-30 | [ac:q47744] [gn:vanb] [or:enterococcus faecalis] [sr:,streptococcus faecalis] [de:regulatory protein vanrb] [sp:q47744] [db:swissprot] |
| 26454762_f1_1 | 1323 | 3926 | 675 | 224 | 577 | 4.20E-56 | [ac:c70040] [pn:plant-metabolite dehydrogenase homolog yvgn] [gn:yvgn] [or:bacillus subtilis] [db:pir] |
| 26460882_c1_26 | 1324 | 3927 | 213 | 70 | 77 | 0.0071 | [pn:pmdoroft5l] [ac:z49712] [gn:orf] [or:pseudotsuga menziesii] [sr:douglas fir] [db:genpept-pln] [de:p.menziesii mrna (open reading frame) (df77a).] [le:79] [re:573] [di:direct] |
| 26460926_c1_74 | 1325 | 3928 | 642 | 213 | 614 | 5.00E-60 | [ac:b69878] [pn:guanylate kinase homolog ylod] [gn:ylod] [or:bacillus subtilis] [db:pir] |
| 26460942_c2_182 | 1326 | 3929 | 210 | 69 | 61 | 0.27 | [1n:bus89796] [acus89796] [pn:chitinase] [gn:chi] [or:bacillus thuringiensis] [db:genpept-bct] [de:bacillus thuringiensis chitinase (chi) gene, complete cds.] [le:255] [re:2162] [di:direct] |
| 26460962_c1_160 | 1327 | 3930 | 252 | 83 | 74 | 0.13 | [1n:celc3065] [ac:u23450] [gn:c3065.6] [or:caenorhabditis elegans] [sr:caenorhabditis elegans strain=bristol n2] [db:genpept-inv] [de:caenorhabditis elegans cosmid c30b5.] [le:27490:27675:27835] [re:27593:27782:27927] [di:complementjoin] |
| 26461062_c2_21 | 1328 | 3931 | 573 | 191 | 219 | 3.60E-18 | [1n:gapfa] [ac:y08498] [pn:aggregation promoting protein] [gn:apfa] [or:lactobacillus gasseri] [db:genpept-bct] [de:l.gasseri apfa gene.] [le:125] [re:1018] [di:direct] |
| 26462827_c1_34 | 1329 | 3932 | 267 | 88 | 95 | 0.00036 | [ac:p32653] [gn:mrp] [or:streptococcus suis] [de:muramidase-released protein precursor (136 kd surface protein)] [sp:p32653] [db:swissprot] |
| 26464067_f1_5 | 1330 | 3933 | 1086 | 361 | 662 | 4.10E-65 | [ac:s75507] [pn:3-dehydroquinate synthase;protein slr2130:protein slr2130] [gn:arob] [cl:3-dehydroquinate synthase:3-dehydroquinate synthase homology] [or:synechocystis sp.] [sr:pcc 6803, , pcc 6803] [db:pir] |
| 26464192_f1_8 | 1331 | 3934 | 276 | 91 | 77 | 0.0071 | [ac:q58062] [gn:mj0646] [or:methanococcus jannaschii] [de:hypothetical protein mj0646] [sp:q58062] [db:swissprot] |
| 26566902_f3_16 | 1332 | 3935 | 201 | 66 | 68 | 0.33 | [ac:p50770] [gn:e2] [or:human papillomavirus type 24] [de:regulatory protein e2] [sp:p50770] [db:swissprot] |
| 26580452_f2_15 | 1333 | 3936 | 1386 | 461 | 567 | 4.80E-55 | [1n:lhpepign] [ac:z56283] [gn:orfl] [or:lactobacillus helveticus] [db:genpept-bct] [de:l.helveticus pepi gene.] [le:184] [re:1518] [di:direct] |
| 26587580_c1_25 | 1334 | 3937 | 213 | 70 | 134 | 2.50E-08 | [1n:llu80410] [ac:u80410] [pn:phosphopentomutase] [gn:deob] [or:lactococcus lactis cremoris] [db:genpept-bct] [de:lactococcus lactis cremoris phosphopentomutase (deob) and purinenucleoside phosphorylase (deod) genes, complete cds.] [nt:deob; deob mutant i |
| 26594032_f1_2 | 1335 | 3938 | 201 | 66 | 100 | 1.50E-05 | [ac:c69931] [pn:transcriptional regulator homolog yozg] [gn:yozg] [or:bacillus subtilis] [db:pir] |
| 26594063_c2_48 | 1336 | 3939 | 972 | 323 | 271 | 1.10E-23 | [ac:p39776] [gn:codv] [or:bacillus subtilis] [de:probable integrase/recombinase codv] [sp:p39776] [db:swissprot] |
| 26594586_f2_12 | 1337 | 3940 | 402 | 133 | 518 | 7.50E-50 | [ac:a36933] [pn:diacylglycerol kinase homolog] [or:streptococcus mutans] [db:pir] |
| 26597253_c1_14 | 1338 | 3941 | 999 | 333 | 453 | 1.90E-59 | [1n:celc34g6] [ac:u97407] [gn:c34g6.4] [or:caenorhabditis elegans] [sr:caenorhabditis elegans strain=bristol n2] [db:genpept-inv] [de:caenorhabditis elegans cosmid c34g6.] [nt:strong similarity to the atp-binding transport] [1e:18845:19018:20025:20344] [r |
| 26603188_c1_26 | 1339 | 3942 | 3732 | 1243 | 509 | 1.60E-54 | [ac:c69492] [pn:phosphoribosylformylglycinamidine synthase ii (purl) homolog] [or:archaeoglobus fulgidus] [db:pir] |
| 26603463_c1_54 | 1340 | 3943 | 1248 | 415 | 948 | 2.00E-95 | [ac:p35855] [gn:dltb] [or:lactobacillus casei] [de:dltb protein (basic membrane protein) (bmp)] [sp:p35855] [db:swissprot] |

TABLE 2-continued

| Orf | NT Seq ID | AA Seq ID | NT Orf Length | AA Orf Length | Score | Probability | Description |
|---|---|---|---|---|---|---|---|
| 26604575_c1_28 | 1341 | 3944 | 579 | 192 | 99 | 0.0022 | [ac:p52086] [gn:phpb] [or:escherichia coli] [de:phpb protein] [sp:p52086] |
| 26604828_f1_7 | 1342 | 3945 | 1347 | 448 | 882 | 2.00E-88 | [ac:p54521] [gn:yqib] [or:bacillus subtilis] [ec:3.1.11.6] [de:vii large subunit] [sp:p54521] [db:swissprot] |
| 26618965_f3_29 | 1343 | 3946 | 1092 | 363 | 737 | 4.60E-73 | [ac:e70009] [pn:conserved hypothetical protein yufp] [gn:yufp] [or:bacillus subtilis] [db:pir] |
| 26620327_f1_1 | 1344 | 3947 | 390 | 129 | 80 | 0.46 | [in:mmrhammr] [ac:x64550:s41029] [pn:ha receptor for hyaluronic acid] [gn:rhamm1] [fn:involved in cell motility] [or:mus musculus] [sr:house mouse] [db:genpept-rod] [de:m.musculus mrna rhamm.] [nt:70-kd protein, exon 4 alternatively spliced] [sp:Q00547] |
| 266251_f1_1 | 1345 | 3948 | 249 | 82 | 59 | 0.84 | [ac:p20246] [or:torpedo marmorata] [sr:marbled electric ray] [de:hemoglobin beta-1 chain] [sp:p20246] [db:swissprot] |
| 266263_c2_108 | 1346 | 3949 | 324 | 107 | 68 | 0.49 | [in:af029944] [ac:af029944] [pn:igm heavy chain vdj region] [or:oryctolagus cuniculus] [db:genpept-mam] [de:oryctolagus cuniculus clone 2516 igm heavy chain vdj region mrna,partial cds.] [le:<1] [re: |
| 26678808_f3_29 | 1347 | 3950 | 519 | 172 | 84 | 0.064 | [ac:p25958] [gn:comgf:comg6] [or:bacillus subtilis] [de:comg operon protein 6] [sp:p25958] [db:swissprot] |
| 26681687_f2_27 | 1348 | 3951 | 744 | 247 | 67 | 0.66 | [in:vcrvc] [ac:x64097] [or:vibrio cholerae] [de:v.cholerae dna for rvc repeated sequence.] [nt:orf(11 kda)] [le:1628] [re:1918] [di:complement] |
| 26736642_c3_18 | 1349 | 3952 | 186 | 61 | 54 | 0.19 | [ac:s76247] [pn:hypothetical protein] [or:synechocystis sp.] [sr:pcc 6803, , pcc 6803] [sr:pcc 6803,] [db:pir] |
| 26738757_c1_12 | 1350 | 3953 | 879 | 292 | 381 | 2.50E-35 | [ac:p32436] [gn:degv] [or:bacillus subtilis] [de:degv protein] [sp:p32436] [db:swissprot] |
| 26740926_f1_1 | 1351 | 3954 | 498 | 165 | 387 | 5.70E-36 | [in:stacadres] [ac:110009] [gn:ds rf] [or:staphylococcus aureus] [sr:staphylococcus aureus (strain r35) dna] [db:genpept-bct] [de:staphylococcus aureus tnpa gene, tnpb gene, tnpc gene, ds rf gene,complete cds's; cadmium resistance (cada) gene, complete cds.] |
| 26745292_f3_10 | 1352 | 3955 | 327 | 108 | 334 | 2.40E-30 | [in:spu11799] [ac:u11799] [or:streptococcus pyogenes] [db:genpept-bct] [de:streptococcus pyogenes insertion sequence is 1239 putativetransposase gene, complete cds.] [nt:putative transposase] [le:379] [re:1359] [di:direct] |
| 26751250_f1_12 | 1353 | 3956 | 252 | 83 | 228 | 4.00E-19 | [ac:d69999] [pn:conserved hypothetical protein ytqa] [gn:ytqa] [or:bacillus subtilis] [db:pir] |
| 26751563_c3_63 | 1354 | 3957 | 204 | 67 | 115 | 3.80E-07 | [in:bmgluckin] [ac:aj000005] [gn:orf1] [fn:homologous to yqgq from bacillus subtilis] [or:bacillus megaterium] [db:genpept-bct] [de:bacillus megaterium glk gene,] [le:67] [re:273] [di:direct] |
| 26756312_f2_7 | 1355 | 3958 | 534 | 177 | 324 | 2.70E-29 | [ac:a64922] [pn:hypothetical protein b1647] [or:escherichia coli] [db:pir] |
| 26756567_c2_49 | 1356 | 3959 | 708 | 235 | 428 | 2.60E-40 | [ac:d64128] [pn:lic-1 protein c] [gn:licc] [or:haemophilus influenzae] [db:pir] |
| 26756640_f2_18 | 1357 | 3960 | 1056 | 351 | 1152 | 4.90E-117 | [ac:q02143] [or:lactococcus lactis] [sr:.subsplactis:streptococcus lactis] [ec:1.1.1.85] [de:(imdh) (3-ipm-dh)] [sp:q02143] [db:swissprot] |
| 26756677_c2_58 | 1358 | 3961 | 1383 | 460 | 2287 | 2.60E-237 | [in:spdnaarg] [ac:af000658] [pn:initiator protein] [gn:spdnaa] [or:streptococcus pneumoniae] [db:genpept-bct] [de:streptococcus pneumoniae r801 trna-arg gene, partial sequence, andputative serine protease (sphtra), spspoj (spspoj), initiatorprotein (spdna |
| 26756703_c3_13 | 1359 | 3962 | 756 | 251 | 237 | 1.10E-35 | [ac:e69796] [pn:two-component response regulator [yesn] homolog yesn] [gn:yesn] [or:bacillus subtilis] [db:pir] |
| 26757838_f1_2 | 1360 | 3963 | 642 | 213 | 385 | 9.30E-36 | [ac:a69999] [pn:phenylalanyl-trna synthetase (beta subunit) homolog ytpr] [gn:ytpr] [or:bacillus subtilis] [db:pir] |
| 26758426_f3_14 | 1361 | 3964 | 486 | 161 | 575 | 6.80E-56 | [ac:p43659] [gn:smpb] [or:enterococcus faecalis] [sr:streptococcus faecalis] [de:small protein b homolog] [sp:p43659] [db:swissprot] |
| 26758437_c3_86 | 1362 | 3965 | 2034 | 677 | 3357 | 0 | [ac:s71016] [pn:helicase recg homolog] [or:streptococcus pneumoniae] [db:pir] |
| 26759700_c1_37 | 1363 | 3966 | 681 | 226 | 291 | 2.90E-25 | [ac:p54493] [gn:yqgp] [or:bacillus subtilis] [de:hypothetical 56.4 kd protein in soda-comga intergenic region] [sp:p54493] [db:swissprot] |

TABLE 2-continued

| Orf | NT Seq ID | AA Seq ID | NT Orf Length | AA Orf Length | Score | Probability | Description |
|---|---|---|---|---|---|---|---|
| 26759707_c3_35 | 1364 | 3967 | 960 | 319 | 268 | 2.20E-46 | [ac:p21628] [gn:brae] [or:pseudomonas aeruginosa] [de:high-affinity branched-chain amino acid transport protein brae] [sp:p21628] [db:swissprot] |
| 26761012_c3_48 | 1365 | 3968 | 1335 | 444 | 1106 | 3.70E-112 | [ac:h69979] [pn:proteinase homolog yrro] [gn:yrro] [or:bacillus subtilis] [db:pir] |
| 26767888_f1_11 | 1366 | 3969 | 462 | 153 | 93 | 0.0022 | [ac:g64636] [pn:hypothetical protein hp0935] [or:helicobacter pylori] [db:pir] |
| 26768762_f3_10 | 1367 | 3970 | 1305 | 434 | 1425 | 5.80E-146 | [ac:p52985] [gn:hom] [or:lactococcus lactis] [sr:,subsplactis.streptococcus lactis] [ec:1.1.1.3] [de:homoserine dehydrogenase, (hdh)] [sp:p52985] [db:swissprot] |
| 26772338_c2_16 | 1368 | 3971 | 621 | 206 | 84 | 0.55 | [tn:ae001149] [ac:ae001149:ae000783] [pn:aspartyl-trna synthetase (asps)] [gn:bb0446] [or:borrelia burgdorferi] [sr:lyme disease spirochete] [db:genpept-bct] [de:borrelia burgdorferi (section 35 of 70) of the complete genome.] [nt:similar to sp:p21889 gb: |
| 26773430_f2_27 | 1369 | 3972 | 477 | 158 | 283 | 6.00E-25 | [m:lu63724] [ac:u63724] [pn:signal peptidase type ii] [gn:lspl] [or:lactococcus lactis] [db:genpept-bct] [de:lactococcus lactis signal peptidase type ii (lspl) gene, completecds.] [nt:lspl] [le:430] [re:861] [di:direct] |
| 26773437_c1_19 | 1370 | 3973 | 2343 | 780 | 3671 | 0 | [ac:q59934] [gnpfl] [or:streptococcus mutans] [ec:2.3.1.54] [de:formate acetyltransferase, (pyruvate formate-lyase)] [sp:q59934] [db:swissprot] |
| 26774212_f1_5 | 1371 | 3974 | 717 | 238 | 172 | 3.60E-13 | [ac:g70045] [pn:hypothetical protein yvqf] [gn:yvqf] [or:bacillus subtilis] [db:pir] |
| 26776050_f2_19 | 1372 | 3975 | 375 | 124 | 210 | 3.30E-17 | [ac:jc1151] [pn:hypothetical 20.3k protein (insertion sequence is 1131) or:agrobacterium tumefaciens] [db:pir] |
| 26776535_c3_120 | 1373 | 3976 | 219 | 72 | 62 | 0.18 | [ac:p52488] [gn:uba2:ua11:pip2;ydr390c:d9509.10] [or:saccharomyces cerevisiae] [sr:,baker's yeast] [de:2] [sp:p52488] [dbswissprot] |
| 26776563_f2_25 | 1374 | 3977 | 1788 | 595 | 1435 | 5.00E-147 | [ac:p50852] [gn:mtla] [or:bacillus stearothermophilus] [ec:2.7.1.69] [de:(ec 2.7.1.69) (eii-mtl)] [sp:p50852] [dbswissprot] |
| 26776637_f1_3 | 1375 | 3978 | 336 | 111 | 186 | 1.10E-14 | [ac:p46319] [gn:celc] [or:bacillus subtilis] [ec:2.7.1.69] [de:(ec 2.7.1.69) (eiii-cel)] [sp:p46319] [dbswissprot] |
| 26777330_f2_16 | 1376 | 3979 | 1110 | 369 | 1036 | 9.60E-105 | [tn:sgu81957] [ac:u81957] [pn:putative abc transporter subunit comyb] [gn:comyb] [or:streptococcus gordonii] [db:genpept-bct] [de:streptococcus gordonii ma polymerase beta' subunit (rpoc),putative dna binding protein, putative abc transporter subunitcomy |
| 26796899_c1_11 | 1377 | 3980 | 820 | 273 | 315 | 1.10E-27 | [ac:q11046] [gn:mtcy50.09] [or:mycobacterium tuberculosis] [de:hypothetical abc transporter atp-binding protein cy50.09] [sp:q11046] [dbswissprot] |
| 26802200_f1_3 | 1378 | 3981 | 882 | 293 | 532 | 2.50E-51 | [ac:p54460] [gn:yyqet] [or:bacillus subtilis] [ec:2.1.1.—] [de:probable methyltransferase,] [sp:p54460] [dbswissprot] |
| 26829637_f3_11 | 1379 | 3982 | 261 | 86 | 124 | 4.20E-08 | [ac:a70028] [pn:hypothetical protein yval] [gn:yval] [or:bacillus subtilis] [db:pir] |
| 26834657_c1_67 | 1380 | 3983 | 318 | 105 | 85 | 0.00057 | [n:d78257] [ac:d78257] [pn:bacb] [gn:bacb] [or:enterococcus faecalis] [sr:enterococcus faecalis plasmid pyi17 dna] [db:genpept-bct] [de:enterococcus faecalis plasmid pyi17 genes for baca, bacb, orf3, orf4, orf5, orf6, orf7, orf8, orf9, orf10, orf11, partia |
| 26836053_f2_3 | 1381 | 3984 | 1302 | 433 | 240 | 3.10E-29 | [ac:e69796] [pn:two-component response regulator [yesm] homolog yesn] [gn:yesn] [or:bacillus subtilis] [db:pir] |
| 26839687_f3_16 | 1382 | 3985 | 969 | 322 | 687 | 9.20E-68 | [tn:lllvsfpep] [ac:x99710] [pn:transcription factor] [or:lactococcus lactis] [db:genpept-bct] [de:l.lactis orf, genes homologous to vsf-1 and pepf2 and gene encodingprotein homologous to methyltransferase.] [nt:weak homology with vsf-1 gene (x73635)] [le: |
| 26839762_c1_23 | 1383 | 3986 | 1719 | 572 | 1548 | 5.30E-159 | [ac:s76895] [pn:hypothetical protein] [or:synechocystis sp.] [sr:pcc 6803 , pcc 6803] [sr:pcc 6803,] [db:pir] |
| 26852051_f1_7 | 1384 | 3987 | 258 | 85 | 139 | 1.10E-09 | [tn:spnana] [ac:x72967] [or:streptococcus pneumoniae] [nt:orf2] [le:193] [re:495] [di:direct] |
| 26854676_c3_76 | 1385 | 3988 | 729 | 242 | 217 | 2.00E-17 | [ac:h69812] [pn:conserved hypothetical protein yfmi] [gn:yfmi] [or:bacillus subtilis] [db:pir] |
| 273451_c1_69 | 1386 | 3989 | 630 | 209 | 358 | 6.70E-33 | [ac:e69670] [pn:glycine betaine/carnitine/choline abc transporter (osmoprotec) opucc] [gn:opucc] [or:bacillus subtilis] [db:pir] |
| 2735037_c2_70 | 1387 | 3990 | 705 | 234 | 92 | 0.2 | [tn:ae001120] [ac:ae001120:ae000783] [pn:b. burgdorferi predicted coding region bb0072] [gn:bb0072] [or:borrelia burgdorferi] [sr:lyme disease spirochete] [db:genpept- |

TABLE 2-continued

| Orf | NT Seq ID | AA Seq ID | NT Orf Length | AA Orf Length | Score | Probability | Description |
|---|---|---|---|---|---|---|---|
| 2735687_f1_6 | 1388 | 3991 | 345 | 114 | 65 | 0.073 | bct] [de:borrelia burgdorferi (section 6 of 70) of the complete genome.] [nt:hypothetica [ln:spz82001] [ac:z82001] [pn:unknown] [or:streptococcus pneumoniae] [db:genpept-bct] [de:s.pneumoniae pcpa gene and open reading frames.] [le:<1] [re:174] [di:direct] |
| 2739768_f3_16 | 1389 | 3992 | 564 | 187 | 612 | 8.20E-60 | [ac:a33595:a30868] [pn:probable transposase (insertion sequence is861)] [gn:is861-orf 2] [or:streptococcus agalactiae] [db:pir] |
| 274017_c2_39 | 1390 | 3993 | 666 | 221 | 955 | 3.70E-96 | [ln:sgu57759] [ac:u57759] [pn:intrageneric coaggregation-relevant adhesin] [or:streptococcus gordonii] [db:genpept-bct] [de:streptococcus gordonii intrageneric coaggregation-relevant adhesingene, complete cds.] [le:277] [re:1212] [di:direct] |
| 2740801_f2_81 | 1391 | 3994 | 189 | 62 | 58 | 0.34 | [ac:g69750] [pn:hypothetical protein ybgb] [gn:ybgb] [or:bacillus subtilis] [db:pir] |
| 2740883_c2_31 | 1392 | 3995 | 228 | 75 | 73 | 0.14 | [ac:p10269] [gn:env] [or:baboon endogenous virus] [sr:m7.] [de:protein gp70 and transmembrane protein p20e] [sp:p10269] [db:swissprot] |
| 2745678_c2_74 | 1393 | 3996 | 198 | 65 | 267 | 3.00E-23 | [ln:spnana] [ac:x72967] [or:streptococcus pneumoniae] [db:genpept-bct] [de:s.pneumoniae nana gene.] [nt:orf2] [le:193] [re:495] [di:direct] |
| 2745678_f1_2 | 1394 | 3997 | 189 | 62 | 200 | 3.70E-16 | [ln:spnana] [ac:x72967] [or:streptococcus pneumoniae] [db:genpept-bct] [de:s.pneumoniae nana gene.] [nt:orf2] [le:193] [re:495] [di:direct] |
| 2745678_f1_3 | 1395 | 3998 | 225 | 74 | 203 | 1.80E-16 | [ln:spnana] [ac:x72967] [or:streptococcus pneumoniae] [db:genpept-bct] [de:s.pneumoniae nana gene.] [nt:orf2] [le:193] [re:495] [di:direct] |
| 2750278_c2_90 | 1396 | 3999 | 1308 | 435 | 1252 | 1.20E-127 | [ac:d69981] [pn:conserved hypothetical protein yrvn] [gn:yrvn] [or:bacillus subtilis] [db:pir] |
| 2750292_f2_19 | 1397 | 4000 | 285 | 94 | 70 | 0.17 | [ac:a60236] [pn:f protein] [or:mus musculus] [sr:, house mouse] [db:pir] |
| 276388_c3_71 | 1398 | 4001 | 1356 | 451 | 1087 | 3.80E-110 | [ac:f69825] [pn:sodium-dependent transporter homolog yhdh] [gn:yhdh] [or:bacillus subtilis] [db:pir] |
| 276707_f2_19 | 1399 | 4002 | 381 | 126 | 64 | 0.11 | [ln:scdnafabd] [ac:x86475] [pn:acyl carrier protein] [gn:acp] [or:streptomyces coelicolor] [db:genpept-bct] [de:s.coelicolor fabd, fabh, and acpp genes.] [le:2215] [re:2463] [di:direct] |
| 277162_f2_21 | 1400 | 4003 | 573 | 190 | 351 | 3.70E-32 | [ac:e69999] [pn:hypothetical protein ytqb] [gn:ytqb] [or:bacillus subtilis] [db:pir] |
| 2771953_f2_11 | 1401 | 4004 | 618 | 205 | 355 | 1.40E-32 | [ln:spnana] [ac:x72967] [or:streptococcus pneumoniae] [db:genpept-bct] [de:s.pneumoniae nana gene.] [nt:orf2] [le:193] [re:495] [di:direct] |
| 2777312_f3_5 | 1402 | 4005 | 1407 | 468 | 116 | 7.00E-08 | [ln:hsu77718] [ac:u77718] [pn:pinin] [or:homo sapiens] [sr:human] [db:genpept-pri2] [de:human desmosome associated protein pinin mrna, complete cds.] [nt:desmosome associated protein; phosphoprotein] [le:31] [re:2262] [di:direct] |
| 2782063_f2_4 | 1403 | 4006 | 768 | 255 | 417 | 3.80E-39 | [ac:e69979] [pn:folate metabolism homolog yrrl] [gn:yrrl] [or:bacillus subtilis] [db:pir] |
| 2812586_f3_27 | 1404 | 4007 | 669 | 222 | 223 | 1.40E-18 | [ac:p37507] [gn:yyaq] [or:bacillus subtilis] [de:hypothetical 13.9 kd protein in cotf-tetb intergenic region] [sp:p37507] [db:swissprot] |
| 2812882_c1_13 | 1405 | 4008 | 597 | 198 | 936 | 3.80E-94 | [ln:strcoomaa] [ac:m36180:115190] [pn:transposase] [or:streptococcus pneumoniae] [sr:streptococcus pneumoniae (strain rx1) dna] [db:genpept-bct] [de:streptococcus pneumoniae transposase, (coma and comb) and saicarsynthetase (purc) genes, complete cds.] [nt |
| 281638_c2_30 | 1406 | 4009 | 585 | 194 | 125 | 6.10E-06 | [ac:p49263] [gn:pxn1] [or:xenopus laevis] [sr:,african clawed frog] [de:pentraxin fusion protein precursor] [sp:p49263] [db:swissprot] |
| 2823775_c3_66 | 1407 | 4010 | 543 | 180 | 168 | 9.60E-13 | [ln:lrcnbgene] [ac:x99716] [pn:collagen binding protein] [gn:cnb] [or:lactobacillus reuteri] [db:genpept-bct] [de:l.reuteri cnb gene.] [nt:potential part of an abc transporter system] [le:181] [re:972] [di:direct] |
| 2834655_f3_40 | 1408 | 4011 | 222 | 73 | 58 | 0.19 | [ac:p34137] [gn:ptpaptpl] [or:dictyostelium discoideum] [sr:,slime mold] [ec:3.1.3.48] [de:phosphate phosphohydrolase 1)] [sp:p34137] [db:swissprot] |
| 2862706_c1_37 | 1409 | 4012 | 378 | 125 | 497 | 1.30E-47 | [ln:soorfs] [ac:z79691] [gn:ftsl] [pn:ftsl] [fn:cell division protein] [or:streptococcus pneumoniae] [db:genpept-bct] [de:s.pneumoniae yorf[a,b,c,d,e], ftsl, pbpx and regr genes.] [le:3710] [re:4027] [di:direct] |
| 2869528_f1_1 | 1410 | 4013 | 249 | 82 | 158 | 5.90E-11 | [ln:ldgappgk] [ac:aj000339] [pn:phosphoglycerate kinase] [gn:pgk] [or:lactobacillus |

TABLE 2-continued

| Orf | NT Seq ID | AA Seq ID | NT Orf Length | AA Orf Length | Score | Probability | Description |
|---|---|---|---|---|---|---|---|
| 287688_f1_1 | 1411 | 4014 | 585 | 194 | 83 | 0.45 | delbrueckii] [db:genpept-bct] [de:lactobacillus delbrueckii ygap, gap, pgk, tpi, and ycse genes.] [ec:2369] [re:3580] [di:direct] [ac:p06224] [gn:siga:rpod] [or:bacillus subtilis] [de:rna polymerase sigma factor rpod (sigma-a) (sigma-43)] [sp:p06224] [dbs:swissprot] |
| 2914687_f3_14 | 1412 | 4015 | 1524 | 507 | 1412 | 1.40E-144 | [ac:b69795] [pn:amidase homolog yerm] [gn:yerm] [or:bacillus subtilis] [db:pir] |
| 2921888_f1_15 | 1413 | 4016 | 795 | 264 | 164 | 3.00E-10 | [ac:c26304] [pn:ribose transport protein rbsc] [gn:rbsc] [or:escherichia coli] [db:pir] [mp:84] |
| 2924076_f1_5 | 1414 | 4017 | 1221 | 406 | 185 | 1.40E-11 | [in:pbu42580] [ac:u42580:u17055:u32570] [or:paramecium bursaria chlorella virus 1] [db:genpept-vr1] [de:paramecium bursaria chlorella virus 1, complete genome.] [nt:similar to phage t5 helicase, corresponds to] [ie:77899] [re:79278] |
| 2926702_c2_29 | 1415 | 4018 | 918 | 305 | 1249 | 2.60E-127 | [ac:p35592] [gn:expl:plpa] [or:streptococcus pneumoniae] [de:exported protein 1 (fragment)] [sp:p35592] [dbs:swissprot] |
| 2929618_f2_6 | 1416 | 4019 | 900 | 299 | 387 | 5.70E-36 | [ac:p54604] [gn:yhct] [or:bacillus subtilis] [de:hypothetical 33.7 kd protein in cspb-glpp intergenic region] [sp:p54604] [dbs:swissprot] |
| 29297281_c2_20 | 1417 | 4020 | 681 | 226 | 961 | 8.50E-97 | [ac:p36399] [gn:upp] [or:streptococcus salivarius] [ec:2.4.2.9] [de:pyrophosphorylase) (uptase)] [sp:p36399] [dbs:swissprot] |
| 2930160_f1_4 | 1418 | 4021 | 345 | 114 | 189 | 5.50E-15 | [ac:p44068] [gn:hi0882] [or:haemophilus influenzae] [de:hypothetical protein hi0882] [sp:p44068] [dbs:swissprot] |
| 2930,1927_c1_32 | 1419 | 4022 | 288 | 95 | 144 | 3.20E-10 | [ac:p08876] [gn:ykxh] [or:bacillus subtilis] [de:hypothetical 7.4 kd protein in ptsx operon (protein k)] [sp:p08876] [dbs:swissprot] |
| 2930,2162_f2_29 | 1420 | 4023 | 315 | 104 | 204 | 1.40E-16 | [ac:jc1151] [pn:hypothetical 20.3k protein (insertion sequence is 1131) or:agrobacterium tumefaciens] [db:pir] |
| 2930342_c2_21 | 1421 | 4024 | 987 | 328 | 969 | 1.20E-97 | [ac:p39646] [gn:pta:ipa-88d] [or:bacillus subtilis] [ec:2.3.1.8] [de:(phosphotransacetylase)] [sp:p39646] [dbs:swissprot] |
| 2930462_f3_24 | 1422 | 4025 | 489 | 162 | 108 | 3.00E-06 | [ac:p37187:p76413] [gn:gata] [or:escherichia coli] [ec:2.7.1.69] [de:(ec 2.7.1.69)] [sp:p37187:p76413] [dbs:swissprot] |
| 2931568_f3_13 | 1423 | 4026 | 906 | 301 | 866 | 9.90E-87 | [ac:p12039] [gn:purd] [or:bacillus subtilis] [ec:6.3.4.13] [de:ribonucleotide synthetase) (phosphoribosylglycinamide synthetase)] [sp:p12039] [dbs:swissprot] |
| 2931582_c2_71 | 1424 | 4027 | 636 | 211 | 322 | 4.40E-29 | [ac:p37494] [gn:yyb] [or:bacillus subtilis] [de:intergenic region] [sp:p37494] [dbs:swissprot] |
| 29320836_c2_45 | 1425 | 4028 | 1386 | 461 | 2269 | 2.10E-235 | [ac:p14677] [gn:pbpx] [or:streptococcus pneumoniae] [de:penicillin-binding protein 2x (pbp-2x) (pbp2x)] [sp:p14677] [dbs:swissprot] |
| 29320886_c2_11 | 1426 | 4029 | 1602 | 533 | 421 | 2.90E-39 | [ac:p44808] [gn:hi0658] [or:haemophilus influenzae] [de:hypothetical abc transporter atp-binding protein hi0658] [sp:p44808] [dbs:swissprot] |
| 2932962_c3_69 | 1427 | 4030 | 645 | 215 | 719 | 3.80E-71 | [ac:p50924] [gn:pyrf] [or:lactococcus lactis] [sr:,subspcremoris:streptococcus cremoris] [ec:4.1.1.23] [de:decarboxylase)] [sp:p50924] [dbs:swissprot] |
| 29332967_c2_66 | 1428 | 4031 | 750 | 249 | 637 | 1.80E-62 | [ac:e69751] [pn:abc transporter (atp-binding protein) homolog ybxa] [gn:ybxa] [or:bacillus subtilis] [db:pir] |
| 29335436_f2_27 | 1429 | 4032 | 186 | 61 | 60 | 0.23 | [in:mgu02157] [ac:u02157] [pn:mgpa] [fn:adhesin] [or:mycoplasma genitalium] [db:genpept-bct] [de:mycoplasma genitalium adhesin mgpa gene, partial cds.] [nt:homology to m31431] [le:1] [re:218] [di:direct] |
| 29347090_c2_188 | 1430 | 4033 | 468 | 155 | 115 | 3.80E-07 | [in:lbphigle] [ac:x98106] [gn:rorf115] [or:bacteriophage phig1e] [db:genpept-phg] [de:lactobacillus bacteriophage phig1e complete genomic dna.] [ie:33364] [re:33711] [di:complement] |
| 29351077_f1_1 | 1431 | 4034 | 1107 | 368 | 850 | 4.90E-85 | [ac:h69980] [pn:single-strand dna-specific exonuclease homolog yrve] [gn:yrve] [or:bacillus subtilis] [db:pir] |
| 29352152_c1_21 | 1432 | 4035 | 657 | 218 | 85 | 0.0018 | [in:smorfa] [ac:m27108] [or:streptomyces lividans] [sr:streptomyces lividans dna] [db:genpept-bct] [de:streptomyces lividans orfa gene, 3' end.] [nt:orfa] [ie:<1] [re:304] [di:direct] |

TABLE 2-continued

| Orf | NT Seq ID | AA Seq ID | NT Orf Length | AA Orf Length | Score | Probability | Description |
|---|---|---|---|---|---|---|---|
| 29382303_f3_8 | 1433 | 4036 | 621 | 206 | 96 | 0.083 | [ac:s59310] [pn:probable membrane protein ymr317w:hypothetical protein ym9924.09] [or:saccharomyces cerevisiae] [db:pir] [mp:13r] |
| 29384375_f2_8 | 1434 | 4037 | 222 | 73 | 61 | 0.25 | [ac:ab001684] [ac:ab001684] [gn:trnI] [or:chloroplast chlorella vulgaris] [sr:chlorella vulgaris chloroplast dna] [db:genpept-pln] [de:chlorella vulgaris c-27 chloroplast dna, complete sequence,] [nt:orf131] [re:46755] [re:47150] [di:complement] |
| 29386552_f3_10 | 1435 | 4038 | 420 | 139 | 366 | 9.60E-34 | [ac:q59812] [gn:glnA] [or:staphylococcus aureus] [ec:6.3.1.2] [de:glutamine synthetase, (glutamate--ammonia ligase) (gs)] [sp:q59812] [db:swissprot] |
| 29386553_c2_13 | 1436 | 4039 | 501 | 166 | 743 | 1.10E-73 | [ac:p10564] [gn:hexA] [or:streptococcus pneumoniae] [de:dna mismatch repair protein hexa] [sp:p10564] [db:swissprot] |
| 29398503_c3_16 | 1437 | 4040 | 1368 | 455 | 1405 | 7.60E-144 | [ac:p25811] [gn:thdF] [or:bacillus subtilis] [de:possible thiophene and furan oxidation protein thdf] [sp:p25811] [db:swissprot] |
| 29398534_c2_49 | 1438 | 4041 | 1106 | 368 | 1195 | 1.40E-121 | [ac:s32227] [pn:glutamate dehydrogenase (nadp+),] [cl:glutamate dehydrogenase (nad(p)+)] [or:corynebacterium glutamicum] [sr:ssp. melassecola atcc 17965, , ssp. melassecola atcc 17965] [ec:1.4.1.4] [db:pir] |
| 29401543_c3_11 | 1439 | 4042 | 225 | 74 | 154 | 1.70E-10 | [ac:p42602] [gn:ygjU] [or:escherichia coli] [de:hypothetical 43.5 kd protein in ebgc-uxaa intergenic region (o414)] [sp:p42602] [db:swissprot] |
| 29406325_f3_51 | 1440 | 4043 | 273 | 90 | 58 | 0.34 | [ac:b31946] [pn:hypothetical protein (xdh 5' region)] [gn:dpse/ry] [or:drosophila pseudoobscura] [db:pir] |
| 29407000_c3_57 | 1441 | 4044 | 195 | 64 | 53 | 0.12 | [ln:sau73374] [ac:u73374] [pn:cap8I] [gn:cap8I] [or:staphylococcus aureus] [dbgenpept-bct] [de:staphylococcus aureus type 8 capsule genes, cap8a, cap8b, cap8c, cap8d, cap8e, cap8f, cap8g, cap8h, cap8i, cap8j, cap8k, cap8l, cap8m, cap8n, cap8o, cap8p, compl |
| 29407812_c1_18 | 1442 | 4045 | 924 | 307 | 327 | 1.30E-29 | [ac:p16148] [gn:pplz12] [or:lupinus polyphyllus] [sr:,large-leaved lupine] [de:pplz12 protein] [sp:p16148] [db:swissprot] |
| 29414702_c1_37 | 1443 | 4046 | 243 | 80 | 90 | 0.00025 | [ac:c69875] [pn:hypothetical protein ylbn] [gn:ylbn] [or:bacillus subtilis] [db:pir] |
| 29417086_f2_2 | 1444 | 4047 | 318 | 106 | 287 | 2.20E-24 | [ac:q03727] [gn:coma] [or:streptococcus pneumoniae] [de:transport atp-binding protein coma] [sp:q03727] [db:swissprot] |
| 29417086_f2_5 | 1445 | 4048 | 213 | 70 | 60 | 0.31 | [ac:p40082] [gn:yer135c] [or:saccharomyces cerevisiae] [sr:,baker's yeast] [de:hypothetical 15.4 kd protein in glc7-gdi1 intergenic region] [sp:p40082] [db:swissprot] |
| 29454443_c3_214 | 1446 | 4049 | 852 | 283 | 76 | 0.027 | [ac:p40274] [or:trypanosoma cruzi] [de:histone h1.m6.2] [sp:p40274] [db:swissprot] |
| 29459376_c1_18 | 1447 | 4050 | 192 | 63 | 65 | 0.26 | [ln:celt01c4] [ac:u70858] [gn:t01c4.4] [or:caenorhabditis elegans] [sr:caenorhabditis elegans strain=bristol n2] [db:genpept-inv] [de:caenorhabditis elegans cosmid t01c4.] [nt:weak similarity to family 1 of g-protein coupled] [le:6968:7334:7438] [re:7195: |
| 29459688_c1_53 | 1448 | 4051 | 267 | 88 | 72 | 0.17 | [ac:s17112] [pn:interferon alpha/beta receptor] [or:homo sapiens] [sr:, man] [db:pir] |
| 2946067_f3_11 | 1449 | 4052 | 384 | 127 | 214 | 1.90E-17 | [ac:b69517] [pn:phosphoserine phosphatase (serB) homolog] [or:archaeoglobus fulgidus] |
| 29479587_c2_105 | 1450 | 4053 | 243 | 80 | 70 | 0.13 | [ac:p33251] [gn:atpB] [or:mycoplasma gallisepticum] [ec:3.6.1.34] [de:atp synthase a chain, (protein 6)] [sp:p33251] [db:swissprot] |
| 29492192_f2_14 | 1451 | 4054 | 2235 | 744 | 1565 | 8.40E-161 | [ln:temela] [ac:y08557] [pn:melibiase] [gn:mela] [fn:melibiose+h(2)o=galactose+glucose] [or:thermoanaerobacter ethanolicus] [db:genpept] [ec:3.2.1.22] [de:t.ethanolicus mela and laca genes.] [nt:alpha-galactosidase] [le:<1] [re:1882] [di:direct] |
| 29492756_f2_5 | 1452 | 4055 | 210 | 69 | 89 | 0.0055 | [ln:celk09h11] [ac:u97002] [gn:k09h11.1] [or:caenorhabditis elegans] [sr:caenorhabditis elegans strain=bristol n2] [db:genpept-inv] [de:caenorhabditis elegans cosmid k09h11.] [nt:similar to acyl-coa dehydrogenases and epoxide |
| 29495462_f3_26 | 1453 | 4056 | 405 | 134 | 319 | 9.20E-29 | [ac:p19079] [gn:cdd] [or:bacillus subtilis] [ec:3.5.4.5] [de:cytidine deaminase, (cytidine aminohydrolase) (cda)] [sp:p19079] [db:swissprot] |
| 29532961_f3_30 | 1454 | 4057 | 735 | 244 | 721 | 2.30E-71 | [ac:f70009] [pn:conserved hypothetical protein yufq] [gn:yufq] [or:bacillus subtilis] [db:pir] |

TABLE 2-continued

| Orf | NT Seq ID | AA Seq ID | NT Orf Length | AA Orf Length | Score | Probability | Description |
|---|---|---|---|---|---|---|---|
| 29547806_f1_1 | 1455 | 4058 | 2640 | 879 | 2845 | 1.90E−296 | [ac:q24803;q27649] [gn:adh2] [or:entamoeba histolytica] [ec:1.1.1.1:1.2.1.10] [de:dehydrogenase, (acdh)] [sp:q24803;q27649] [db:swissprot] |
| 29586586_f2_10 | 1456 | 4059 | 834 | 277 | 322 | 4.40E−29 | [ac:p54535] [gn:yqix] [or:bacillus subtilis] [de:intergenic region precursor] [sp:p54535] [db:swissprot] |
| 29687515_c1_10 | 1457 | 4060 | 249 | 82 | 95 | 0.0001 | [ac:s51908] [pn:cryptogene protein g1(nd9)] [or:leishmania tarentolae] [sr:strain lem125, , strain lem125] [sr:strain lem125,] [db:pir] |
| 29703951_f3_24 | 1458 | 4061 | 201 | 66 | 55 | 0.58 | [ln:cec07e3] [ac:z49908] [pn:c07e3.7] [or:caenorhabditis elegans] [db:genpept-inv] [de:caenorhabditis elegans cosmid c07e3, complete sequence.] [nt:similar to homeobox protein] [le:25003] [re:25239] [di:complement] |
| 29710294_c2_75 | 1459 | 4062 | 671 | 223 | 1150 | 8.00E−117 | [ln:af019904] [ac:af019904] [pn:choline binding protein a] [gn:cbpa] [or:streptococcus pneumoniae] [db:genpept-bct] [de:streptococcus pneumoniae choline binding protein a (cbpa) gene,partial cds.] [nt:cbpa] [le:<1] [re:1992] [di:direct] |
| 29800937_c1_32 | 1460 | 4063 | 687 | 228 | 545 | 1.00E−52 | [ln:sapbp4gen] [ac:x91786] [pn:atp-binding cassette transporter a] [gn:abca] [or:staphylococcus aureus] [db:genpept-bct] [de:s.aureus abca, pbp4, and tagd genes.] [le:311] [re:2038] [di:complement] |
| 29871000_c2_26 | 1461 | 4064 | 231 | 76 | 70 | 0.048 | [ac:p25566] [gn:yc133c] [or:saccharomyces cerevisiae] [sr:baker's yeast] [de:hypothetical 19.3 kd protein in ste50 5'region] [sp:p25566] [db:swissprot] |
| 29871000_c3_35 | 1462 | 4065 | 231 | 76 | 70 | 0.048 | [ac:p25566] [gn:yc133c] [or:saccharomyces cerevisiae] [sr:baker's yeast] [de:hypothetical 19.3 kd protein in ste50 5'region] [sp:p25566] [db:swissprot] |
| 29871000_c3_52 | 1463 | 4066 | 231 | 76 | 70 | 0.048 | [ac:p25566] [gn:yc133c] [or:saccharomyces cerevisiae] [sr:baker's yeast] [de:hypothetical 19.3 kd protein in ste50 5'region] [sp:p25566] [db:swissprot] |
| 29878587_c2_55 | 1464 | 4067 | 318 | 105 | 100 | 0.00037 | [ac:p41508] [or:mycoplasma hyorhinis] [de:p115 protein] [sp:p41508] [db:swissprot] |
| 29884392_f1_6 | 1465 | 4068 | 597 | 198 | 551 | 2.40E−53 | [ac:b30868] [pn:hypothetical protein 1 (insertion sequence is861)] [gn:is861-orf 1] [or:streptococcus agalactiae] [db:pir] |
| 29898562_c1_59 | 1466 | 4069 | 678 | 225 | 617 | 2.40E−60 | [ln:bcbctlglr1] [ac:y10927] [pn:glutamate racemase] [gn:bcglr] [or:bacillus cereus] [db:genpept-bct] [de:b.cereus bct1 and bcglr genes.] [le:1826] [re:] |
| 29899150_c1_59 | 1467 | 4070 | 279 | 92 | 312 | 5.10E−28 | [ac:l69866] [pn:tetrahydrodipicolinate succinylase homolog ykuq] [gn:ykuq] [or:bacillus subtilis] [db:pir] |
| 29930312_f3_13 | 1468 | 4071 | 414 | 137 | 122 | 2.90E−07 | [ac:p46339] [gn:yqgh] [or:bacillus subtilis] [de:region (orf72)] [sp:p46339] [db:swissprot] |
| 29938791_f1_9 | 1469 | 4072 | 1287 | 428 | 1760 | 1.80E−181 | [ac:p30299] [gn:ptsi] [or:streptococcus salivarius] [ec:2.7.3.9] [de:(phosphotransferase system, enzyme i)] [sp:p30299] [db:swissprot] |
| 29964201_f1_7 | 1470 | 4073 | 240 | 79 | 146 | 8.70E−10 | [ac:p46919] [gn:gpsa:glyc] [or:bacillus subtilis] [ec:1.1.1.94] [de:dependent dihydroxyacetone-phosphate reductase)] [sp:p46919] [db:swissprot] |
| 29971068_c1_34 | 1471 | 4074 | 1134 | 377 | 225 | 1.00E−17 | [ac:q58615] [gn:mj1218] [or:methanococcus jannaschii] [de:hypothetical protein mj1218] [sp:q58615] [db:swissprot] |
| 29976636_c1_56 | 1472 | 4075 | 498 | 165 | 308 | 1.30E−27 | [ac:a33595:a30868] [pn:probable transposase (insertion sequence is861)] [gn:is861-orf 2] [or:streptococcus agalactiae] [db:pir] |
| 29976636_c3_154 | 1473 | 4076 | 498 | 165 | 315 | 2.40E−28 | [ac:a33595:a30868] [pn:probable transposase (insertion sequence is861)] [gn:is861-orf 2] [or:streptococcus agalactiae] [db:pir] |
| 29976636_c3_41 | 1474 | 4077 | 498 | 165 | 288 | 1.80E−25 | [ac:a33595:a30868] [pn:probable transposase (insertion sequence is861)] [gn:is861-orf 2] [or:streptococcus agalactiae] [db:pir] |
| 29976636_f3_21 | 1475 | 4078 | 303 | 100 | 289 | 1.40E−25 | [ac:b30868] [pn:hypothetical protein 1 (insertion sequence is861)] [gn:is861-orf 1] [or:streptococcus agalactiae] [db:pir] |
| 29976636_f3_32 | 1476 | 4079 | 303 | 100 | 280 | 1.20E−24 | [ac:b30868] [pn:hypothetical protein 1 (insertion sequence is861)] [gn:is861-orf 1] [or:streptococcus agalactiae] [db:pir] |
| 30078375_c3_68 | 1477 | 4080 | 2379 | 792 | 1586 | 2.40E−203 | [ac:i41291] [pn:ecoa type i restriction-modification enzyme r subunit] [or:escherichia coli] [db:pir] |
| 30079587_f3_6 | 1478 | 4081 | 387 | 128 | 77 | 0.065 | [ac:p54557] [gn:yqit] [or:bacillus subtilis] [de:hypothetical 15.2 kd protein in glnq-ansr |

TABLE 2-continued

| Orf | NT Seq ID | AA Seq ID | NT Orf Length | AA Orf Length | Score | Probability | Description |
|---|---|---|---|---|---|---|---|
| 30079702_c2_95 | 1479 | 4082 | 591 | 196 | 92 | 0.025 | intergenic region] [sp:p54557] [db:swissprot] [ac:p25149] [gn:ywafipa-11d] [or:bacillus subtilis] [de:hypothetical 27.3 kd protein in tyrz-sacy intergenic region (orf1)] [sp:p25149] [db:swissprot] |
| 30079827_f1_5 | 1480 | 4083 | 861 | 286 | 595 | 5.20E-58 | [ac:g70057] [pn:hypermidine synthase homolog ywhf] [gn:ywhf] [or:bacillus subtilis] [db:pir] |
| 30080000_c1_43 | 1481 | 4084 | 258 | 85 | 124 | 1.10E-07 | [ac:p07655] [gn:pstb/phot] [or:escherichia coli] [de:phosphate transport atp-binding protein pstb] [sp:p07655] [db:swissprot] |
| 30081393_c3_52 | 1482 | 4085 | 2826 | 941 | 2319 | 1.10E-240 | [ac:p18311] [gn:infb] [or:enterococcus faecium] [sr.,streptococcus faecium] [de:translation initiation factor if-2] [sp:p18311] [db:swissprot] |
| 30088962_c1_21 | 1483 | 4086 | 273 | 90 | 66 | 0.057 | [ln:spnana] [ac:x72967] [or:streptococcus pneumoniae] [db:genpept-bct] [de:s.,pneumoniae nana gene,] [nt:orf2] [le:193] [re:495] [di:direct] |
| 30094211_f1_2 | 1484 | 4087 | 234 | 77 | 131 | 7.60E-09 | [ac:c69844] [pn:hypothetical protein yjbk] [gn:yjbk] [or:bacillus subtilis] [db:pir] |
| 30095633_c3_16 | 1485 | 4088 | 1227 | 408 | 719 | 3.80E-71 | [ac:p42977] [gn:paps] [or:bacillus subtilis] [ec:2.7.7.19] [de:poly(a)polymerase, (pap)] [sp:p42977] [db:swissprot] |
| 30095887_f3_28 | 1486 | 4089 | 291 | 96 | 89 | 0.00022 | [ac:q47150] [gn:dinj] [or:escherichia coli] [de:dna-damage-inducible protein j] [sp:q47150] [db:swissprot] |
| 30098775_c3_40 | 1487 | 4090 | 309 | 102 | 105 | 5.30E-05 | [ac:p50360] [gn:y4hp] [or:rhizobium sp] [sr:ng234,] [de:hypothetical 61.7 kd protein y4hp] [sp:p50360] [db:swissprot] |
| 30173292_c2_15 | 1488 | 4091 | 1902 | 633 | 1310 | 8.90E-134 | [ac:69814] [pn:abc transporter (atp-binding protein) homolog yfmr] [gn:yfmr] [or:bacillus subtilis] [db:pir] |
| 30173812_c1_38 | 1489 | 4092 | 819 | 272 | 517 | 9.50E-50 | [ac:p54554] [gn:yqiq] [or:bacillus subtilis] [ec:1.—.—.—] [de:(ec 1.—.—.—)] [sp:p54554] [db:swissprot] |
| 30267942_f3_54 | 1490 | 4093 | 1392 | 463 | 1514 | 2.10E-155 | [ac:069785] [pn:beta-glucosidase homolog ydhp] [gn:ydhp] [or:bacillus subtilis] [db:pir] |
| 30272700_f1_16 | 1491 | 4094 | 243 | 80 | 69 | 0.34 | [ln:cec08b6] [ac:z72502] [or:caenorhabditis elegans] [db:genpept-inv] [de:caenorhabditis elegans cosmid c08b6, complete sequence,] [nt:similar to udp-glucuronosyl transferase; cdna est] [le:1305:1776:21711] [re:1724:1861:2692] [di:complementjo |
| 30273588_c1_37 | 1492 | 4095 | 861 | 286 | 325 | 2.10E-29 | [ac:p54535] [gn:yqix] [or:bacillus subtilis] [de:intergenic region precursor] [sp:p54535] [db:swissprot] |
| 30274015_f1_3 | 1493 | 4096 | 591 | 196 | 64 | 0.27 | [ac:p24019] [gn:taga] [or:vibrio cholerae] [ec:3.2.2.20] [de:(3-methyladenine-dna glycosylase) (fragment)] [sp:p24019] [db:swissprot] |
| 30289812_c1_24 | 1494 | 4097 | 1005 | 334 | 259 | 9.10E-25 | [ac:s35295:s28578] [pn:rfbb protein] [gn:rfbb] [or:yersinia enterocolitica] [db:pir] |
| 30292137_c1_56 | 1495 | 4098 | 2031 | 676 | 74 | 0.46 | [ac:p46116] [gn:aara] [or:providencia stuartii] [de:aara protein] [sp:p46116] [db:swissprot] |
| 30343755_c3_34 | 1496 | 4099 | 219 | 72 | 129 | 1.20E-08 | [ac:d70063] [pn:hypothetical protein ywna] [gn:ywna] [or:bacillus subtilis] [db:pir] |
| 30344688_c2_33 | 1497 | 4100 | 885 | 295 | 196 | 9.90E-16 | [ac:f69742] [pn:hypothetical protein ybaf] [gn:ybaf] [or:bacillus subtilis] [db:pir] |
| 30361632_c2_63 | 1498 | 4101 | 549 | 182 | 213 | 1.60E-17 | [ac:f69972] [pn:conserved hypothetical protein yrbg] [gn:yrbg] [or:bacillus subtilis] [db:pir] |
| 30367325_f3_51 | 1499 | 4102 | 267 | 88 | 245 | 6.40E-21 | [ac:p44030] [gn:hi0659] [or:haemophilus influenzae] [de:hypothetical protein hi0659] [sp:p44030] [db:swissprot] |
| 30368813_f3_4 | 1500 | 4103 | 1731 | 576 | 307 | 1.30E-24 | [ac:d69796] [pn:two-component sensor histidine kinase [yes homolog yesm] [gn:yesm] [or:bacillus subtilis] [db:pir] |
| 30468826_c2_59 | 1501 | 4104 | 489 | 162 | 99 | 1.90E-05 | [ac:g64935] [pn:hypothetical protein b1759] [or:escherichia coli] [db:pir] |
| 30475451_c3_79 | 1502 | 4105 | 1257 | 419 | 432 | 9.70E-41 | [ac:p39578] [gn:dltd:ipa-2r] [or:bacillus subtilis] [de:protein dltd precursor] [sp:p39578] [db:swissprot] |
| 30484537_c3_28 | 1503 | 4106 | 1200 | 399 | 730 | 2.60E-72 | [ac:a69802] [pn:a/g-specific adenine glycosylase homolog yfhq] [gn:yfhq] [or:bacillus subtilis] [db:pir] |
| 30503427_f3_52 | 1504 | 4107 | 1104 | 367 | 1220 | 3.10E-124 | [ac:p49999] [gn:recf] [or:streptococcus pyogenes] [de:recf protein] [sp:p49999] |

TABLE 2-continued

| Orf | NT Seq ID | AA Seq ID | NT Orf Length | AA Orf Length | Score | Probability | Description |
|---|---|---|---|---|---|---|---|
| 30507160_c1_66 | 1505 | 4108 | 354 | 117 | 206 | 8.60E-17 | [db:swissprot] [ac:s74925] [pn:transposase:protein sll0650:protein sll0650] [or:synechocystis sp.] [sr:pcc 6803, , pcc 6803] [sr:pcc 6803,] [db:pir] |
| 30507160_c3_11 | 1506 | 4109 | 354 | 117 | 206 | 8.60E-17 | [ac:s74925] [pn:transposase:protein sll0650:protein sll0650] [or:synechocystis sp.] [sr:pcc 6803, , pcc 6803] [sr:pcc 6803,] [db:pir] |
| 30507160_c3_84 | 1507 | 4110 | 354 | 117 | 204 | 1.40E-16 | [ln:ssu38915] [pn:putative transposase] [or:synechocystis pcc6803] [db:genpept-bct] [de:synechocystis sp. insertion sequences is5sb, is4sa and mariner-likeinsertion sequence istcsa, lytb gene, complete cds, and putativetransposase genes, parti |
| 30511462_c3_42 | 1508 | 4111 | 897 | 298 | 1193 | 2.20E-121 | [ac:q00750] [gn:msmf] [or:streptococcus mutans] [de:multiple sugar-binding transport system permease protein msmf] [sp:q00750] [db:swissprot] |
| 30650200_f2_19 | 1509 | 4112 | 330 | 109 | 346 | 1.30E-31 | [ac:g64507] [pn:hypothetical protein mj1665] [or:methanococcus jannaschii] [db:pir] [mp:rev1648556–1647180] |
| 30656713_f3_44 | 1510 | 4113 | 678 | 225 | 350 | 4.70E-32 | [ac:p37078] [gn:sorc] [or:klebsiella pneumoniae] [de:sorbitol (sor) operon regulator] [sp:p37078] [db:swissprot] |
| 30661263_f2_15 | 1511 | 4114 | 816 | 271 | 1250 | 2.00E-127 | [ln:spu43526] [ac:u43526] [pn:neuraminidase b] [gn:nanb] [or:streptococcus pneumoniae] [db:genpept-bct] [de:streptococcus pneumoniae neuraminidase b (nanb) gene, complete cds,and neuraminidase (nana) gene, partial cds.] [nt:nanb] [le:5102] [re:7195] [di:d |
| 30665888_c1_38 | 1512 | 4115 | 936 | 311 | 1542 | 2.30E-158 | [ac:p14677] [gn:pbpx] [or:streptococcus pneumoniae] [de:penicillin-binding protein 2x (pbp-2x) (pbp2x)] [sp:p14677] [db:swissprot] |
| 30682762_f3_33 | 1513 | 4116 | 1038 | 345 | 1302 | 6.20E-133 | [ac:p54689] [gn:ilve:hi1193] [or:haemophilus influenzae] [ec:2.6.1.42] [de:b] (bcat)] [sp:p54689] [db:swissprot] |
| 30705313_c1_150 | 1514 | 4117 | 501 | 166 | 78 | 0.73 | [ln:mtcy277] [ac:z79701] [pn:unknown] [gn:mtcy277.18] [or:mycobacterium tuberculosis] [db:genpept-bct] [de:mycobacterium tuberculosis cosmid y277. nt:mtcy277.18, unknown, len:334, similarity to] [le:15782] [re:16786] [di:direct] |
| 30724218_c1_126 | 1515 | 4118 | 363 | 120 | 154 | 3.60E-10 | [ac:p03211] [gn:bkrf1] [or:epstein-barr virus] [sr:b95-8,human herpesvirus 4] [de:ebna-1 nuclear protein] [sp:p03211] [dbswissprot] |
| 30735087_f1_6 | 1516 | 4119 | 330 | 109 | 87 | 0.0047 | [ac:p09122] [gn:dnax:dnah] [or:bacillus subtilis] [sp:p09122] [de:dna polymerase iii subunits gamma and tau,] [sp:p09122] [db:swissprot] |
| 30745313_f3_9 | 1517 | 4120 | 864 | 287 | 531 | 3.10E-51 | [ac:p42978] [gn:ypjc:ojc] [or:bacillus subtilis] [de:hypothetical 23.6 kd protein in qcrc-dapb intergenic region] [sp:p42978] [db:swissprot] |
| 30745881_c1_7 | 1518 | 4121 | 1128 | 375 | 1116 | 3.20E-113 | [ac:p45213] [gn:hi1455] [or:haemophilus influenzae] [de:hypothetical protein hi1455] [sp:p45213] [db:swissprot] |
| 30750637_f2_21 | 1519 | 4122 | 747 | 248 | 121 | 2.20E-07 | [ac:s57618:a47097:s26479] [pn:pbp5-control factor pst] [gn:psr] [or:enterococcus hirae] [db:pir] |
| 31261593_f3_5 | 1520 | 4123 | 804 | 267 | 801 | 7.70E-80 | [ac:q46845] [gn:yghu] [or:escherichia coli] [de:hypothetical 34.2 kd protein in gsp-hybg intergenic region] [sp:q46845] [db:swissprot] |
| 31263_f2_28 | 1521 | 4124 | 1338 | 445 | 81 | 0.77 | [ln:hsu40347] [ac:u40347] [pn:serotonin n-acetyltransferase] [or:homo sapiens] [sr:human] [db:genpept-pri2] [ec:2.3.1.87] [de:human serotonin n-acetyltransferase mrna, complete cds.] [nt:arylalkylamine n-acetyltransferase] [le:235] [re:858] [di:direct] |
| 31276015_c3_4 | 1522 | 4125 | 888 | 295 | 58 | 0.93 | [ln:hiu04997] [ac:u04997] [pn:uvra] [gn:uvra] [fn:dna excision repair] [or:haemophilus influenzae] [db:genpept-bct] [de:haemophilus influenzae tn106 dna excision repair protein (uvra)gene, partial cds, and single-stranded dna binding protein (ssb)gene, co |
| 3129693_f2_13 | 1523 | 4126 | 321 | 106 | 80 | 0.035 | [ln:adu92286] [ac:u92286] [pn:pyrroline-5-carboxylate synthetase] [or:actinidia deliciosa] [db:genpept-pln] [de:actinidia deliciosa pyrroline-5-carboxylate synthetase mrna,complete cds.] [le:9] [re:2162] [di:direct] |
| 31297086_f2_9 | 1524 | 4127 | 888 | 295 | 354 | 1.80E-32 | [ac:q02473] [gn:prtm] [or:lactobacillus paracasei] [de:protease maturation protein precursor] [sp:q02473] [db:swissprot] |

TABLE 2-continued

| Orf | NT Seq ID | AA Seq ID | NT Orf Length | AA Orf Length | Score | Probability | Description |
|---|---|---|---|---|---|---|---|
| 31339590_f1_8 | 1525 | 4128 | 273 | 90 | 66 | 0.057 | [ac:d49786] [pn:bacteriocin precursor a1] [or:*lactococcus lactis* subsp. *cremoris*] |
| 31366317_c1_35 | 1526 | 4129 | 255 | 84 | 89 | 0.00022 | [ac:e64801] [pn:hypothetical protein b0663] [or:*escherichia coli*] [db:pir] |
| 31385814_c2_10 | 1527 | 4130 | 518 | 172 | 771 | 1.20E−76 | [ac:p45293] [gn:hi1647] [or:*haemophilus influenzae*] [de:hypothetical protein hi1647] [sp:p45293] [db:swissprot] |
| 31412930_f2_5 | 1528 | 4131 | 567 | 188 | 416 | 4.80E−39 | [ac:s49402:s38204] [pn:atx protein] [gn:atpx] [or:*streptococcus pneumoniae*] [db:pir] |
| 31429530_c3_40 | 1529 | 4132 | 1350 | 449 | 1183 | 2.50E−120 | [ac:a69763] [pn:homoserine dehydrogenase homolog yclm] [gn:yclm] [or:*bacillus subtilis*] [db:pir] |
| 31448505_f1_8 | 1530 | 4133 | 1041 | 346 | 1167 | 1.30E−118 | [ac:p55180] [gn:gale] [or:*bacillus subtilis*] [ec:5.1.3.2] [de:galactose 4-epimerase] [sp:p55180] [db:swissprot] |
| 31448577_c1_171 | 1531 | 4134 | 213 | 70 | 70 | 0.022 | [ac:p54323] [gn:sdh4:sdhd] [or:*chondrus crispus*] [sr:,carragheen] [de:dehydrogenase, subunit iv] [sp:p54323] [db:swissprot] |
| 31484567_c3_53 | 1532 | 4135 | 219 | 72 | 68 | 0.0099 | [ln:atceld] [ac:z777855] [pn:sugar-binding transport protein] [or:*anaerocellum thermophilum*] [db:genpept-bct] [de:*a.thermophilum* celd gene.] [nt:putative] [le:3925] [re:4836] [di:direct] |
| 31509756_f2_5 | 1533 | 4136 | 1107 | 368 | 537 | 7.30E−52 | [ac:p46348] [gn:yeab] [or:*bacillus subtilis*] [de:hypothetical 31.8 kd protein in gabp-guaa intergenic region (orfx)] [sp:p46348] [db:swissprot] |
| 31451432_c1_83 | 1534 | 4137 | 282 | 93 | 192 | 3.80E−14 | [ac:a56034] [pn:insulin activator factor] [or:*homo sapiens*] [sr:, man] [db:pir] |
| 31456533_f1_1 | 1535 | 4138 | 192 | 63 | 47 | 0.44 | [ln:s80082] [ac:s80082] [pn:gag] [gn:gag] [or:*mus musculus*] [sr:house mouse mrv evi-2 murine aids virus-related provirus] [db:genpept-rod] [de:gag...env {provirus}] [*mus musculus*, mrv, evi-2, murine aidsvirus-related provirus, genomic mutant, 3 genes, 4765 |
| 31462813_c1_24 | 1536 | 4139 | 1356 | 451 | 962 | 6.70E−97 | [ln:llu81486] [ac:u81486] [pn:histidine kinase] [gn:llkinc] [or:*lactococcus lactis cremoris*] [db:genpept-bct] [de:*lactococcus lactis* subsp. *cremoris* mg1363 histidine kinase (llkinc)gene, complete cds.] [le:1] [re:1428] [di:direct] |
| 31647556_f1_1 | 1537 | 4140 | 297 | 98 | 453 | 5.80E−43 | [ln:stus88973] [ac:u88973] [pn:ribosomal protein 119] [or:*streptococcus thermophilus*] [db:genpept-bct] [de:*streptococcus thermophilus* ribosomal protein 119 gene, completecds; and trna-arg gene, complete sequence.] [le:152] [re:499] [di:direct] |
| 31657075_f1_1 | 1538 | 4141 | 729 | 242 | 319 | 9.20E−29 | [ac:p54505] [gn:yqhb] [or:*bacillus subtilis*] [de:hypothetical 50.0 kd protein in soda-comga intergenic region] [sp:p54505] [db:swissprot] |
| 31686_f1_1 | 1539 | 4142 | 1734 | 577 | 1962 | 7.20E−203 | [ac:q02137] [gn:ilvb] [or:*lactococcus lactis*] [sr:,subsplactis.*streptococcus lactis*] [ec:4.1.3.18] [de:(acetohydroxy-acid synthase large subunit) (als)] [sp:q02137] [db:swissprot] |
| 31722843_f1_1 | 1540 | 4143 | 975 | 324 | 201 | 1.60E−13 | [ac:p03211] [gn:bkrf1] [or:epstein-barr virus] [sr:b95-8,human herpesvirus 4] [de:ebna-1 nuclear protein] [sp:p03211] [db:swissprot] |
| 31737665_f1_1 | 1541 | 4144 | 291 | 96 | 246 | 5.00E−21 | [ln:lmu66186] [ac:u66186] [pn:lema] [gn:lema] [or:*listeria monocytogenes*] [db:genpept-bct] [de:*listeria monocytogenes* lema (lema) gene, complete cds, and lemb(emb) gene, partial cds.] [nt:putative cytoplasmic membrane protein with nout- |
| 31739683_c1_11 | 1542 | 4145 | 252 | 83 | 92 | 0.0001 | [ac:s01844] [pn:fibroin] [cl:silk fibroin] [or:*bombyx mori*] [sr:, silkworm] [db:pir] |
| 31741450_f1_1 | 1543 | 4146 | 183 | 60 | 60 | 0.25 | [ac:s54462] [gn:yqev] [or:*bacillus subtilis*] [de:hypothetical 51.7 kd protein in dnaj-rpsu intergenic region] [sp:p54462] [db:swissprot] |
| 31801707_f2_34 | 1544 | 4147 | 660 | 219 | 1235 | 7.90E−126 | [ac:p06653] [gn:lyta] [or:*streptococcus pneumoniae*] [ec:3.5.1.28] [de:hydrolase] (mucopeptide aminohydrolase) (cell wall hydrolase] [sp:p06653] [db:swissprot] |
| 31806275_f3_19 | 1545 | 4148 | 561 | 186 | 857 | 8.90E−86 | [ac:p29850] [gn:malx] [or:*streptococcus pneumoniae*] [de:maltose/maltodextrin-binding protein precursor] [sp:p29850] [db:swissprot] |
| 31806563_f1_3 | 1546 | 4149 | 1224 | 407 | 294 | 2.00E−25 | [ac:jc5326] [pn:methicillin resistance factor femb] [gn:femb] [or:*staphylococcus epidermidis*] [db:pir] |
| 31836643_f2_4 | 1547 | 4150 | 864 | 287 | 80 | 0.98 | [ac:p47491:q49487] [gn:rpod:siga:mg249] [or:*mycoplasma genitalium*] [de:rna polymerase sigma factor rpod (sigma-a)] [sp:p47491:q49487] [db:swissprot] |
| 31836687_f3_15 | 1548 | 4151 | 771 | 256 | 756 | 4.50E−75 | [ac:q58418] [gn:pstb:mj1012] [or:*methanococcus jannaschii*] [de:probable phosphate transport atp-binding protein pstb] [sp:q58418] [db:swissprot] |

TABLE 2-continued

| Orf | NT Seq ID | AA Seq ID | NT Orf Length | AA Orf Length | Score | Probability | Description |
|---|---|---|---|---|---|---|---|
| 31900_f1_1 | 1549 | 4152 | 498 | 165 | 187 | 8.90E-15 | [ac:a69795] [pn:conserved hypothetical protein yerl] [gn:yerl] [or:bacillus subtilis] [db:pir] |
| 31906688_f1_3 | 1550 | 4153 | 195 | 64 | 48 | 0.074 | [ac:p29704] [gn:erg9,yhr190w] [or:saccharomyces cerevisiae] [sr:baker's yeast] [ec:2.5.1.21] [de:synthetase] (sqs) (ss) (fpp:fpp farnesyltransferase) [sp:p29704] [db:swissprot] |
| 31908561_c1_42 | 1551 | 4154 | 198 | 65 | 65 | 0.3 | [ac:e64627] [pn:hypothetical protein hp0861] [or:helicobacter pylori] [db:pir] |
| 32034837_f1_1 | 1552 | 4155 | 4962 | 1653 | 133 | 2.80E-12 | [ac:p49610] [gn:strh] [or:streptococcus pneumoniae] [ec:3.2.1.52] [de:beta-n-acetylhexosaminidase precursor,] [sp:p49610] [db:swissprot] |
| 32039212_f3_27 | 1553 | 4156 | 678 | 225 | 630 | 1.00E-61 | [ac:h69334] [pn:glutamine abc transporter, atp-binding protein (glnq) homolog] [or:archaeoglobus fulgidus] [db:pir] |
| 32040962_f2_9 | 1554 | 4157 | 657 | 218 | 321 | 5.60E-29 | [ac:s68596:s65576] [pn:negative regulator phou] [gn:phou] [or:pseudomonas aeruginosa] [db:pir] |
| 32062587_c1_16 | 1555 | 4158 | 213 | 10 | 65 | 0.49 | [ln:cezk8961] [ac:z82288] [pn:zk896.9] [or:caenorhabditis elegans] [db:genpept-inv] [de:caenorhabditis elegans cosmid zk896, complete sequence.] [nt:similarity to mouse cmp-sialic acid transporter] [le:3686:3862:4541:5970] [re:3808:4805:6138] [di:dire |
| 32087777_f3_34 | 1556 | 4159 | 867 | 288 | 793 | 5.40E-79 | [ac:p44990] [gn:sgbu:hi1026] [or:haemophilus influenzae] [ec:5.—.—.—] [de:putative hexulose-6-phosphate isomerase, (humpi)] [sp:p44990] [db:swissprot] |
| 3209776_c3_23 | 1557 | 4160 | 471 | 156 | 100 | 0.00032 | [ln:ehu67063] [acu67063] [pn:serine rich protein] [gn:srehp] [or:entamoeba histolytica] [db:genpept-inv] [de:entamoeba histolytica serine rich protein (srehp) mrna, partialcds.] [nt:k2 transcript; new isoform] [le:<1] [re:515] [di:direct] |
| 3210840_f2_20 | 1558 | 4161 | 783 | 260 | 513 | 2.50E-49 | [ac:p17894:p19671] [gn:recn] [or:bacillus subtilis] [sp:p17894:p19671] [db:swissprot] (recombination protein n)] |
| 32156430_c3_35 | 1559 | 4162 | 189 | 62 | 54 | 0.67 | [ln:af035166] [ac:af035166] [pn:nadh dehydrogenase subunit 41] [gn:nd41] [or:mitochondrion branchiostoma floridae] [sr:florida lancelet] [db:genpept-inv] [de:branchiostoma floridae nadh dehydrogenase subunit 41 (nd41) gene,mitochondrial gene encoding mito |
| 32204067_f2_9 | 1560 | 4163 | 483 | 160 | 270 | 1.40E-23 | [ln:spanana] [ac:x72967] [or:streptococcus pneumoniae] [db:genpept-bct] [de:s.pneumoniae nana gene.] [nt:orf2] [le:193] [re:495] [di:direct] |
| 3220626_c3_55 | 1561 | 4164 | 3210 | 1069 | 4162 | 0 | [ln:llaj109] [ac:aj000109] [pn:carbamoylphosphate synthetase] [gn:carb] [or:lactococcus lactis] [db:genpept-bct] [de:lactococcus lactis carb and gpo genes.] [le:986] [re:4180] [di:direct] |
| 32210827_c1_62 | 1562 | 4165 | 1158 | 385 | 1132 | 6.50E-115 | [ac:p37469] [gn:dnac] [or:bacillus subtilis] [ec:3.6.1.—] [de:replicative dna helicase,] [sp:p37469] [db:swissprot] |
| 32222752_f1_7 | 1563 | 4166 | 858 | 285 | 182 | 3.50E-14 | [ac:q58322] [gn:mj0912] [or:methanococcus jannaschii] [de:hypothetical protein mj0912] [sp:q58322] [db:swissprot] |
| 3225325_c3_44 | 1564 | 4167 | 291 | 96 | 100 | 1.50E-05 | [ln:lsplcprf] [ac:x97014] [pn:ribose-phosphate pyrophosphokinase] [gn:prs] [or:listeria seeligeri] [db:genpept-bct] [ec:2.7.6.1] [de:l.seeligeri dna for plca/prfa operon.] [le:<1] [re:262] [di:direct] |
| 32287816_c2_47 | 1565 | 4168 | 450 | 149 | 47 | 0.046 | [ln:flanald] [ac:k01018] [or:influenza a virus] [sr:influenza a/duck/alberta/60/76, cdna to viral rna, grown i] [db:genpept-vrl] [de:influenza a/duck/alberta/60/76 (h12n5), neuraminidase (seg 6), 5'end.] [nt:neuraminidase] [le:21] [re: |
| 3242200_f1_7 | 1566 | 4169 | 1221 | 406 | 1115 | 4.10E-113 | [ac:p37877] [gn:acka] [or:bacillus subtilis] [ec:2.7.2.1] [de:acetate kinase, (acetokinase)] [sp:p37877] [db:swissprot] |
| 32429693_c3_112 | 1567 | 4170 | 564 | 187 | 328 | 1.00E-29 | [ac:p54452] [gn:yqeg] [or:bacillus subtilis] [de:hypothetical 20.1 kd protein in nucb-arod intergenic region] [sp:p54452] [db:swissprot] |
| 32456966_c1_11 | 1568 | 4171 | 294 | 97 | 53 | 1 | [ac:p41806] [gn:vma21:ygr105w] [or:saccharomyces cerevisiae] [sr:baker's yeast] [de:vacuolar atpase assembly integral membrane protein vma21] [sp:p41806] [db:swissprot] |

TABLE 2-continued

| Orf | NT Seq ID | AA Seq ID | NT Orf Length | AA Orf Length | Score | Probability | Description |
|---|---|---|---|---|---|---|---|
| 32462550_c2_36 | 1569 | 4172 | 549 | 182 | 379 | 4.00E-35 | [ac:s52544] [pn:is12 protein] [or:lactobacillus helveticus] [db:pir] |
| 32507342_f2_11 | 1570 | 4173 | 1023 | 340 | 646 | 2.00E-63 | [ac:a70032] [pn:conserved hypothetical protein yvck] [gn:yvck] [or:bacillus subtilis] [db:pir] |
| 32611510_f1_9 | 1571 | 4174 | 276 | 91 | 65 | 0.25 | [ac:p12974] [gn:mcrd] [or:methanothermus fervidus] [de:methyl-coenzyme m reductase operon protein d] [sp:p12974] [db:swissprot] |
| 32614786_c3_16 | 1572 | 4175 | 429 | 142 | 105 | 1.40E-06 | [ln:cru73817] [ac:cu73817] [gn:lrg5] [or:chlamydomonas reinhardtii] [de:chlamydomonas reinhardtii lrg5 mrna, complete cds.] [le:112] [re:2034] [di:direct] |
| 32660750_c1_8 | 1573 | 4176 | 648 | 215 | 1012 | 3.40E-102 | [ln:af010151] [ac:af010151] [pn:pscn] [gn:pscn] [or:pseudomonas aeruginosa] [db:genpept-bct] [de:pseudomonas aeruginosa pscn (pscn) gene, complete cds, and psco(psco) gene, partial cds.] [le:94] [re:1416] [di:direct] |
| 32661051_f1_5 | 1574 | 4177 | 363 | 120 | 581 | 1.60E-56 | [ac:q54513] [or:streptococcus pneumoniae] [de:transposase for insertion sequence is1202] [sp:q54513] [db:swissprot] |
| 32678307_c2_192 | 1575 | 4178 | 252 | 83 | 67 | 0.045 | [ln:yscen4] [ac:m13000] [pn:unknown protein] [or:saccharomyces cerevisiae] [sr:saccharomyces cerevisiae (strain s288c) (clone:lambda-53-sc4130)] [db:genpept-pln] [de:yeast (s.cerevisiae) chromosome 4 centromere (cen4) dna.] [nt:orf4; putative] [le:<1] [r |
| 32708275_f1_1 | 1576 | 4179 | 192 | 63 | 287 | 2.30E-25 | [ac:p27078] [gn:int] [or:bacteriophage 434] [de:integrase] [sp:p27078] [db:swissprot] |
| 32710883_c1_21 | 1577 | 4180 | 234 | 77 | 160 | 6.50E-12 | [ac:h70010] [pn:polyribonucleotide nucleotidyltransferase homolog yugi] [gn:yugi] [or:bacillus subtilis] [db:pir] |
| 32785_f1_48 | 1578 | 4181 | 924 | 307 | 105 | 2.20E-05 | [ac:c48653] [pn:hypothetical protein 3 (pip 3' region)] [or:lactococcus lactis subsp. lactis] [db:pir] |
| 3303827_f1_1 | 1579 | 4182 | 402 | 133 | 68 | 0.044 | [ac:a61355] [pn:hypothetical protein] [or:chloroplast euglena gracilis] [db:pir] |
| 3314062_c3_77 | 1580 | 4183 | 198 | 65 | 155 | 2.20E-11 | [ac:p78492] [gn:orf1 5' of glgb homolog] [or:streptococcus mutans] [sr:streptococcus mutans sms202] [db:genpept-bct] [de:glg operon:glgb homolog {promoter} streptococcus mutans, sms202,genomic mutant, 2400 nt]. [le:907] [re:1063] [di:direct] |
| 3316067_c3_76 | 1581 | 4184 | 1518 | 505 | 2283 | 6.90E-237 | [ac:p50099] [gn:guab] [or:streptococcus pyogenes] [ec:1.1.1.205] [de:dehydrogenase] (impdh) (impd)] [sp:p50099] [db:swissprot] |
| 33203130_f1_4 | 1582 | 4185 | 228 | 75 | 63 | 0.16 | [ln:ictighvm] [ac:m58673] [pn:immunoglobulin heavy chain v-region] [or:ictalurus punctatus] [sr:i.punctatus, cdna to mrna] [db:genpept-vrt] [de:i.punctatus ig heavy chain mrna v-region, clone ng64.] [le:56] [re: |
| 33204442_c1_9 | 1583 | 4186 | 486 | 161 | 81 | 0.0024 | [ln:ab001684] [ac:ab001684] [gn:trng] [or:chlorella vulgaris] [sr:chlorella vulgaris chloroplast dna] [db:genpept-pln] [de:chlorella vulgaris c-27 chloroplast dna, complete sequence.] [nt:orf42c] [le:92172] [re:92300] [di:complement] |
| 33204568_f3_39 | 1584 | 4187 | 1290 | 429 | 1014 | 3.30E-132 | [ac:s74347] [pn:hypothetical protein slr0049] [or:synechocystis sp.] [sr:pcc 6803, , pcc 6803] [db:pir] |
| 33204787_f3_34 | 1585 | 4188 | 297 | 98 | 72 | 0.1 | [ac:q57864] [gn:mj0421] [or:methanococcus jannaschii] [de:hypothetical protein mj0421] [sp:q57864] [db:swissprot] |
| 33223768_c1_34 | 1586 | 4189 | 858 | 285 | 101 | 5.20E-05 | [ln:xlu74761] [ac:u74761] [pn:nocturnin] [or:xenopus laevis] [sr:african clawed frog] [db:genpept-vrt] [de:xenopus laevis nocturnin mrna, complete cds.] [le:36] [re:1202] [di:direct] |
| 33224086_f3_11 | 1587 | 4190 | 252 | 83 | 88 | 6.90E-05 | [ln:ab000222] [ac:ab000222] [gn:epr] [fn:glycylglycine endopeptidase resistance] [or:staphylococcus capitis] [sr:staphylococcus capitis dna] [db:genpept-bct] [de:staphylococcus capitis epr gene, complete cds.] [le:426] [re:1667] [di:direct] |
| 33245887_f1_3 | 1588 | 4191 | 744 | 247 | 437 | 2.90E-41 | [ac:p44202] [gn:hi1454] [or:haemophilus influenzae] [de:hypothetical cytochrome c-type biogenesis protein hi1454] [sp:p44202] [db:swissprot] |
| 33258442_c1_22 | 1589 | 4192 | 1230 | 409 | 743 | 1.10E-73 | [ac:p31851] [gn:taba] [or:pseudomonas syringae] [sr:.pvtabaci] [de:taba protein] [sp:p31851] [db:swissprot] |
| 33258577_c1_33 | 1590 | 4193 | 2163 | 720 | 2528 | 7.60E-263 | [ac:p27756] [gn:aga] [or:streptococcus mutans] [ec:3.2.1.22] [de:alpha-galactosidase, (melibiase)] [sp:p27756] [db:swissprot] |

TABLE 2-continued

| Orf | NT Seq ID | AA Seq ID | NT Orf Length | AA Orf Length | Score | Probability | Description |
|---|---|---|---|---|---|---|---|
| 33283133_c1_22 | 1591 | 4194 | 255 | 84 | 153 | 3.60E-11 | [ln:spnana] [ac:x72967] [or:streptococcus pneumoniae] [db:genpept-bct] [de:s.pneumoniae nana gene.] [nt:orf2] [le:193] [re:495] [di:direct] |
| 33287882_c1_53 | 1592 | 4195 | 504 | 167 | 125 | 3.30E-08 | [ln:l16srna] [ac:x65713] [or:lactococcus lactis] [db:genpept-bct] [de:l.lactis promoter region of 16s rrna gene (5'end).] [nt:orf] [le:<1] [re:468] [di:direct] |
| 33297162_f2_38 | 1593 | 4196 | 639 | 212 | 87 | 0.52 | [ac:s33442] [pn:ef protein] [or:streptococcus suis] [db:pir] |
| 33298532_f2_10 | 1594 | 4197 | 618 | 205 | 694 | 1.70E-68 | [ac:p38424] [gn:yssxc] [or:bacillus subtilis] [de:(orfx)] [sp:p38424] [db:swissprot] |
| 33300307_f3_21 | 1595 | 4198 | 222 | 73 | 66 | 0.088 | [ac:q80920] [pn:e6] [or:human papillomavirus type 48] [de:e6 protein] [sp:q80920] [db:swissprot] |
| 33306281_c2_75 | 1596 | 4199 | 474 | 157 | 253 | 9.00E-22 | [ac:h69772] [pn:holo-acyl-carrier protein synthase homolog ydcb] [gn:ydcb] [or:bacillus subtilis] [db:pir] |
| 33307752_f2_3 | 1597 | 4200 | 660 | 219 | 499 | 7.70E-48 | [ac:s52544] [pn:is12 protein] [or:lactobacillus helveticus] [db:pir] |
| 33307906_c2_65 | 1598 | 4201 | 294 | 97 | 71 | 0.017 | [ac:d69905] [pn:hypothetical protein yoed] [gn:yoed] [or:bacillus subtilis] [db:pir] |
| 33328557_f1_5 | 1599 | 4202 | 812 | 271 | 59 | 0.84 | [ln:ricmtnad] [ac:d32052] [pn:orf72] [or:mitochondrion oryza sativa] [db:genpept-pln] [de:mitochondrion oryza sativa (organelle mitochondrion oryza sativa),ribosomal proteins and trna-fm oryza sativa genes for nadh dehydrogenase subunits,ribosomal proteins and trna-fm |
| 33329692_f2_25 | 1600 | 4203 | 210 | 69 | 63 | 0.29 | [ln:spbc19g7] [ac:a1021839] [pn:hypothetical protein] [gn:spbc19g7.17] [or:schizosaccharomyces pombe] [sr:fission yeast] [db:genpept] [de:s.pombe chromosome ii cosmid c19g7.] [nt:spbc19g7.17, (partial) protein transport protein,] [le:36807:36868:37005:371 |
| 33339200_f2_7 | 1601 | 4204 | 756 | 251 | 485 | 2.30E-46 | [ac:p54461] [gn:yqeu] [or:bacillus subtilis] [de:hypothetical 28.8 kd protein in dnaj-rpsu intergenic region] [sp:p54461] [db:swissprot] |
| 33335802_c1_8 | 1602 | 4205 | 231 | 76 | 65 | 0.073 | [ln:ysctgysup] [ac:m87272] [or:saccharomyces cerevisiae] [sr:saccharomyces cerevisiae dna] [db:genpept-pln] [de:yeast ochre suppressor transfer rna-tyr (tma-tyr) gene, andpartial orf.] [nt:orf; no protein homologies to this open reading] [le:<1] [re:335] |
| 33359377_c2_31 | 1603 | 4206 | 1701 | 566 | 1225 | 9.00E-125 | [ac:p50976] [gn:lace] [or:streptococcus mutans] [de:(ec:2.7.1.69) (eii-lac)] [sp:p50976] [db:swissprot] |
| 33365650_f2_14 | 1604 | 4207 | 849 | 282 | 127 | 4.80E-06 | [ac:e69787] [pn:hypothetical protein ydil] [gn:ydil] [or:bacillus subtilis] [db:pir] |
| 33366557_c2_26 | 1605 | 4208 | 246 | 81 | 59 | 0.86 | [ac:p33618] [gn:csnk] [or:oryctolagus cuniculus] [sr:,rabbit] [de:kappa casein precursor] [sp:p33618] [db:swissprot] |
| 33366687_c2_25 | 1606 | 4209 | 204 | 67 | 56 | 0.49 | [ln:vibvci284] [ac:d11122] [pn:incomplete protein of the rfbt gene product] [gn:rfbt2] [or:vibrio cholerae] [sr:vibrio cholerae (strain 47-4041-1, biotype classical, serotyp] [db:genpept-bct] [de:v. cholerae rfbt2 gene for ogawa specific antigen in the ca |
| 33367087_f3_12 | 1607 | 4210 | 684 | 227 | 830 | 6.50E-83 | [ln:ctsialida] [ac:y08695] [pn:putative acylneuraminate lyase] [or:clostridium tertium] [db:genpept-bct] [ec:4.1.3.3] [de:clostridium tertium nanh gene,] [nt:monomer] [re:2481] [re: |
| 33384643_f1_3 | 1608 | 4211 | 1725 | 574 | 755 | 5.70E-75 | [ac:e64556] [pn:para-aminobenzoate synthetase] [or:helicobacter pylori] [db:pir] |
| 33388_c3_22 | 1609 | 4212 | 225 | 74 | 76 | 0.0051 | [ln:spnana] [ac:x72967] [or:streptococcus pneumoniae] [db:genpept-bct] [de:s.pneumoniae nana gene.] [nt:orf2] [le:193] [re:495] [di:direct] |
| 33395338_c2_39 | 1610 | 4213 | 1191 | 396 | 793 | 5.40E-79 | [ac:d70006] [pn:conserved hypothetical protein yuba] [gn:yuba] [or:bacillus subtilis] [db:pir] |
| 33397577_f1_4 | 1611 | 4214 | 4392 | 1463 | 3591 | 0 | [ac:p13267] [gn:polc:dnae:dnaf:muti] [or:bacillus subtilis] [ec:2.7.7.7] [de:dna polymerase iii, alpha chain,] [sp:p13267] [db:swissprot] |
| 33398587_c2_54 | 1612 | 4215 | 654 | 217 | 338 | 8.90E-31 | [ac:d69433] [pn:abc transporter, atp-binding protein homolog] [or:archaeoglobus fulgidus] [db:pir] |
| 33401902_c3_42 | 1613 | 4216 | 546 | 181 | 159 | 8.30E-12 | [ln:spz82001] [ac:z82001] [pn:unknown] [or:streptococcus pneumoniae] [db:genpept-bct] [de:s.pneumoniae pcpa gene and open reading frames.] [le:<1] [re:174] [di:direct] |
| 33402203_c1_82 | 1614 | 4217 | 663 | 220 | 300 | 9.40E-27 | [ac:b69616] [pn:cell-division initiation protein (septum placement) diviva] [gn:diviva] [or:bacillus subtilis] [db:pir] |
| 33406437_f2_4 | 1615 | 4218 | 186 | 61 | 110 | 1.30E-06 | [ln:spnana] [ac:x72967] [or:streptococcus pneumoniae] [db:genpept-bct] |

TABLE 2-continued

| Orf | NT Seq ID | AA Seq ID | NT Orf Length | AA Orf Length | Score | Probability | Description |
|---|---|---|---|---|---|---|---|
| 33406562_f2_14 | 1616 | 4219 | 321 | 106 | 114 | 1.80E-06 | [de:s.pneumoniae nana gene.] [nt:orf2] [le:193] [re:495] [di:direct] |
| 33414067_c2_61 | 1617 | 4220 | 726 | 241 | 390 | 2.70E-36 | [nt:ssu38915] [acu38915] [pn:putative transposase] [or:synechocystis pcc6803] [db:genpept-bct] [de:synechocystis sp. insertion sequences is5sb, is46a and mariner-likeinsertion sequence istcsa, lytb gene, complete cds, and putativetransposase genes, part] |
| 33417202_c3_81 | 1618 | 4221 | 1011 | 336 | 991 | 5.60E-100 | [ac:d70044] [pn:transcriptional regulator (gntr family) homolog yvoa] [or:bacillus subtilis] [db:pir] |
| 33454390_f3_21 | 1619 | 4222 | 873 | 290 | 1356 | 1.20E-138 | [ac:f69786] [pn:glycoprotein endopeptidase homolog ydie] [gn:ydie] [or:bacillus subtilis] [db:pir] |
| 33470275_f2_37 | 1620 | 4223 | 858 | 285 | 1357 | 9.30E-139 | [ac:ab007465] [ac:ab007465] [pn:dna gyrase subunit a] [gn:gyra coding region encoding for dna gyrase subunit] [or:streptococcus thermophilus] [sr:streptococcus thermophilus (strain:m-192) dna] [db:genpept-bct] [de:streptococcus thermophilus gene for dna g [ns:pdnagcpo] [ac:y11463] [gn:cpoa] [or:streptococcus pneumoniae] [db:genpept-bct] [de:streptococcus pneumoniae dnag, rpod, cpoa genes and orf3 and orf5.] [le:2160] [re:3176] [di:direct] |
| 33470888_c3_52 | 1621 | 4224 | 789 | 262 | 611 | 1.00E-59 | [nt:laclacr] [ac:m53575] [or:lactococcus lactis] [sr:l.lactis (strain mg1820) dna] [db:genpept-bct] [de:l.lactis lactose phosphotransferase system repressor (lacr) gene,complete cds.] [nt:lactose repressor (lacr; alt.)] [le:370] [re:1155] [di:direct] |
| 33475007_f3_11 | 1622 | 4225 | 753 | 250 | 1112 | 8.50E-113 | [nt:sau61271] [ac:u61271] [pn:glutamine synthetase type 1] [gn:glna] [or:streptococcus agalactiae] [db:genpept-bct] [de:streptococcus agalactiae glutamine synthetase type 1 (glna) gene,complete cds.] [le:40] [re:1389] [di:direct] |
| 33492135_c3_79 | 1623 | 4226 | 834 | 277 | 278 | 2.00E-24 | [ac:q01466] [gn:mrec] [or:bacillus subtilis] [de:rod shape-determining protein mrec] [sp:q01466] [db:swissprot] |
| 33603462_c2_63 | 1624 | 4227 | 1338 | 445 | 2202 | 2.70E-228 | [ac:s49545] [pn:histidine kinase] [cl:sensor histidine kinase homology] [or:streptococcus pneumoniae] [db:pir] |
| 33617880_f3_19 | 1625 | 4228 | 342 | 113 | 542 | 2.10E-52 | [ns:spadca] [ac:z71552] [pn:abc protein] [gn:adce] [or:streptococcus pneumoniae] [db:genpept-bct] [de:streptococcus pneumoniae adccba operon.] [le:20] [re:721] [di:direct] |
| 33620256_f1_12 | 1626 | 4229 | 234 | 77 | 69 | 0.028 | [ac:s43483] [pn:hypothetical protein] [or:escherichia coli] [db:pir] |
| 33620712_c2_106 | 1627 | 4230 | 690 | 229 | 157 | 4.40E-10 | [ac:p39402] [gn:yijp] [or:escherichia coli] [de:hypothetical 30.5 kd protein in dnat-bglj intergenic region (f277)] [sp:p39402] [db:swissprot] |
| 33625828_c1_12 | 1628 | 4231 | 2127 | 708 | 125 | 0.00044 | [ac:p45386] [gn:iga] [or:haemophilus influenzae] [ec:3.4.21.72] [de:immunoglobulin a1 protease precursor, (iga1 protease)] [sp:p45386] [db:swissprot] |
| 33625925_f2_7 | 1629 | 4232 | 480 | 159 | 167 | 1.20E-12 | [ac:p39335] [gn:yjgk] [or:escherichia coli] [de:hypothetical 17.3 kd protein in pyrI-argi intergenic region (o153b)] [sp:p39335] [dbsswissprot] |
| 33632902_f3_30 | 1630 | 4233 | 759 | 252 | 391 | 2.10E-36 | [ac:p39593] [gn:thim:thik:ipa-25d] [or:bacillus subtilis] [ec:2.7.1.50] [de:hydroxyethylthiazole kinase] (thz kinase) (th kinase)] [sp:p39593] [dbsswissprot] |
| 33633382_c3_76 | 1631 | 4234 | 1221 | 406 | 376 | 8.30E-35 | [nt:lslasampt] [ac:z54312] [pn:unknown] [gn:orf414] [or:lactobacillus sake] [db:genpept-bct] [de:l.sake las[a,m,p,t] genes.] [le:7331] [re:8575] [di:direct] |
| 33673576_c2_7 | 1632 | 4235 | 258 | 85 | 62 | 0.15 | [nt:vv18r] [ac:x76267] [or:variola virus] [db:genpept-vrl] [de:variola virus (garcia-1966) 18r,i1,i3r,i2i,i4i,i5r,i5.5r,i6r,i7l,i8r,i9r,n1r,n2r,n3l,n4r and n5r genes.] [nt:orf16r] [le:12684] [re: |
| 33669903_f1_8 | 1633 | 4236 | 189 | 62 | 61 | 0.68 | [nt:atpc115] [ac:z11507] [pn:plastid ribosomal protein c115] [or:arabidopsis thaliana] [sr:thale cress] [db:genpept-pln] [de:a.thaliana mrna for plastid ribosomal protein c115.] [nt:the gene encoding plastid ribosomal protein c115 is] [sp:p258 |
| 3369438_f2_15 | 1634 | 4237 | 1152 | 383 | 307 | 1.60E-38 | [ac:h69980] [pn:single-strand dna-specific exonuclease homolog yrve] [gn:yrve] [or:bacillus subtilis] [db:pir] |
| 3370312_f1_7 | 1635 | 4238 | 729 | 242 | 409 | 8.10E-38 | [ns:poppdaca] [acx89237] [pn:oligopeptidepermease] [gn:oppa] [or:streptococcus pyogenes] [db:genpept-bct] [de:s.pyogenes dna for oppa, oppb, oppc, oppd, oppf, and |

TABLE 2-continued

| Orf | NT Seq ID | AA Seq ID | NT Orf Length | AA Orf Length | Score | Probability | Description |
|---|---|---|---|---|---|---|---|
| 33703791_f3_34 | 1636 | 4239 | 780 | 259 | 860 | 4.30E-86 | daca genes.] [le:1382] [re:3352] [di:direct] [ac:q01328] [gn:pcp] [or:streptococcus pyogenes] [ec:3.4.19.3] [de:peptidase] (pyroglutamyl-peptidase i)] [sp:q01328] [db:swissprot] |
| 33708501_c3_13 | 1637 | 4240 | 243 | 80 | 68 | 0.11 | [in:pop22nin] [ac:x78401] [pn:ning protein] [or:bacteriophage p22] [db:genpept-phg] [de:bacteriophage p22 right operon, orf48, replication genes 18 and12, nin region genes, ning phosphatase, late control gene 23, orf60, complete cds, late control region, copr] [sp:p24716] |
| 33710337_c2_181 | 1638 | 4241 | 273 | 90 | 66 | 0.057 | [ac:p24716] [gn:copr] [or:streptococcus agalactiae] [de:plasmid copy control protein copr] [sp:p24716] [db:swissprot] |
| 33720713_c1_92 | 1639 | 4242 | 516 | 171 | 585 | 5.90E-57 | [ac:s39974] [pn:hypothetical protein] [or:streptococcus equisimilis] [db:pir] |
| 33751675_f1_1 | 1640 | 4243 | 546 | 181 | 810 | 8.50E-81 | [ac:p23495] [gn:lacb] [or:lactococcus lactis] [sr:subsplactis:streptococcus lactis] [ec:5.—— —] [de:galactose-6-phosphate isomerase lacb subunit,] [sp:p23495] [db:swissprot] |
| 33750306_f3_11 | 1641 | 4244 | 276 | 91 | 145 | 6.20E-10 | [in:cju93169] [ac:u93169] [pn:outer membrane protein] [gn:omph1] [or:campylobacter jejuni] [db:genpept-bct] [de:campylobacter jejuni outer membrane protein (omph1) gene, complete cds.] [ac:u93169] [re:1003] [di:direct] |
| 33756278_f1_10 | 1642 | 4245 | 309 | 102 | 73 | 0.38 | [ln:mmu96724] [ac:u96724] [pn:putative phosphoinositide 5-phosphatase type ii] [or:mus musculus] [sr:house mouse] [db:genpept-rod] [de:mus musculus putative phosphoinositide 5-phosphatase type ii mrna,complete cds.] [le:112] [re:1518] [di:direct] |
| 33777138_f1_5 | 1643 | 4246 | 738 | 245 | 362 | 2.50E-33 | [ac:p33918] [gn:yejd] [or:escherichia coli] [de:hypothetical 25.9 kd protein in ber-rply intergenic region] [sp:p33918] [db:swissprot] |
| 33782675_f3_2 | 1644 | 4247 | 231 | 76 | 262 | 9.00E-22 | [ac:p22976] [gn:recp] [or:streptococcus pneumoniae] [ec:2.2.1.1] [de:probable transketolase, (tk)] [sp:p22976] [db:swissprot] |
| 33788562_f1_12 | 1645 | 4248 | 312 | 103 | 134 | 3.00E-08 | [in:af015453] [ac:af015453] [pn:unknown] [or:lactobacillus rhamnosus] [db:genpept-bct] [de:lactobacillus rhamnosus 6-phospho-beta-glucosidase homolog gene,partial cds; gntr transcriptional regulator homolog and surfacelocated protein genes, complete cds.] |
| 33789067_f1_2 | 1646 | 4249 | 780 | 259 | 711 | 2.60E-70 | [ac:q57060:o05007] [gn:hi0095] [or:haemophilus influenzae] [de:hypothetical protein hi0095] [sp:q57060:o05007] [db:swissprot] |
| 33790942_f3_12 | 1647 | 4250 | 459 | 152 | 181 | 3.80E-14 | [ac:q70031] [pn:mutator mutt protein homolog yvci] [gn:yvci] [or:bacillus subtilis] [db:pir] |
| 33797040_f2_5 | 1648 | 4251 | 462 | 153 | 72 | 0.023 | [ac:d69273] [pn:conserved hypothetical protein af01188] [or:archaeoglobus fulgidus] [db:pir] |
| 33807808_f1_1 | 1649 | 4252 | 1101 | 366 | 61 | 0.11 | [ln:sss297384] [ac:z97384] [gn:sla-3] [or:sus scrofa] [srpig] [db:genpept-mam] [de:sus scrofa sla-3 gene, exon 2 (partial).] [nt:mhc class i gene] [le:<1] [re: |
| 33828181_f3_42 | 1650 | 4253 | 210 | 69 | 66 | 0.065 | [ln:ehy14328] [ac:y14328] [pn:3e1 protein] [or:entamoeba histolytica] [db:genpept-inv] [de:entamoeba histolytica mrna for 3e1 protein.] [le:32] [re:418] [di:direct] |
| 33860150_f3_15 | 1651 | 4254 | 1035 | 344 | 911 | 1.70E-91 | [ac:h69679] [pn:involved in fatty acid/phospholipid synthesis plsx] [gn:plsx] [or:bacillus subtilis] [db:pir] |
| 33397825_f1_3 | 1652 | 4255 | 3651 | 1216 | 4244 | 0 | [ac:p37870] [gn:rpob:rfm:crse] [or:bacillus subtilis] [ec:2.7.7.6] [de:beta chain) (rna polymerase beta subunit)] [sp:p37870] [db:swissprot] |
| 33984687_f2_27 | 1653 | 4256 | 1308 | 435 | 1036 | 9.60E-105 | [ac:f69723] [pn:trigger factor (prolyl isomerase) tig] [gn:tig] [or:bacillus subtilis] [db:pir] |
| 33985687_f2_12 | 1654 | 4257 | 1107 | 368 | 582 | 1.20E-56 | [ac:p20966] [gn:frua:ptsf] [or:escherichia coli] [ec:2.7.1.69] [de:(ec 2.7.1.69) (eii-fru)] [sp:p20966] [db:swissprot] |
| 33986075_c1_44 | 1655 | 4258 | 342 | 113 | 126 | 2.60E-08 | [ac:q45399] [gn:cela] [or:bacillus stearothermophilus] [ec:2.7.1.69] [de:(ec 2.7.1.69)] [sp:q45399] [db:swissprot] |
| 33991517_f2_16 | 1656 | 4259 | 561 | 186 | 586 | 4.70E-57 | [ac:p42369] [gn:grpe] [or:lactococcus lactis] [sr:subsplactis:streptococcus lactis] [de:grpe protein] [sp:p42369] [db:swissprot] |
| 33992812_f2_22 | 1657 | 4260 | 2076 | 691 | 706 | 9.00E-70 | [ac:e70040] [pn:conserved hypothetical protein yvgp] [gn:yvgp] [or:bacillus subtilis] [db:pir] |

TABLE 2-continued

| Orf | NT Seq ID | AA Seq ID | NT Orf Length | AA Orf Length | Score | Probability | Description |
|---|---|---|---|---|---|---|---|
| 33994042_f2_27 | 1658 | 4261 | 618 | 206 | 549 | 3.90E-53 | [ac:p39300] [gn:yjfr] [or:escherichia coli] [de:hypothetical 40.3 kd protein in aidb-rpsf intergenic region (f356)] [sp:p39300] [db:swissprot] |
| 34001338_c1_35 | 1659 | 4262 | 873 | 290 | 1174 | 2.30E-119 | [ac:q00751] [gn:msmg] [or:streptococcus mutans] [de:multiple sugar-binding transport system permease protein msmg] [sp:q00751] [db:swissprot] |
| 34008443_c2_33 | 1660 | 4263 | 384 | 127 | 145 | 2.50E-10 | [ac:s52344] [pn:hypothetical protein] [or:lactococcus lactis] [db:pir] |
| 34002187_c2_68 | 1661 | 4264 | 366 | 121 | 85 | 0.015 | [ac:q91085] [or:meleagris gallopavo] [sr:common turkey] [de:(fragment)] [sp:q91085] [db:swissprot] |
| 34023382_f2_10 | 1662 | 4265 | 765 | 254 | 585 | 5.90E-57 | [ac:p28643] [gn:clkr27] [or:cuphea lanceolata] [ec:1.1.1.100] [de:(3-ketoacyl-acyl carrier protein reductase)] [sp:p28643] [db:swissprot] |
| 34023441_f1_2 | 1663 | 4266 | 711 | 236 | 356 | 1.10E-32 | [ac:c69859] [pn:two-component response regulator [ykoh] homolog ykog] [gn:ykog] [or:bacillus subtilis] [db:pir] |
| 34024057_f3_38 | 1664 | 4267 | 3720 | 1239 | 4515 | 0 | [in:sprpnocgen] [ac:x96385] [or:streptococcus pyogenes] [db:genpept-bct] [ec:2.7.7.6] [de:s.pyogenes rpoc gene.] [nt:b subunit] [le:<1] [re: |
| 34037778_c2_77 | 1665 | 4268 | 261 | 86 | 62 | 0.11 | [in:pepallex2] [ac:x16772] [or:petroselinum crispum] [sr:parsley] [db:genpept-pln] [de:p.crispum pal-1 gene for phenylalanine ammonia-lyase exon 2.] [nt:phenylalanine ammonia-lyase (aa 137 – 716) (1 is) [sp:p24481] [le:<1] [re:1744] [di:direct] |
| 34037778_c3_30 | 1666 | 4269 | 252 | 83 | 71 | 0.36 | [in:cec29e6] [ac:z72504] [pn:cec29e6.4] [or:caenorhabditis elegans] [db:genpept-inv] [de:caenorhabditis elegans cosmid c29e6, complete sequence.] [le:15816:15929:16114:16409] [re:15878:16066:16346:16497] [di:directjoin] |
| 34039692_f3_35 | 1667 | 4270 | 915 | 304 | 509 | 6.70E-49 | [ac:p31437] [gn:yicj] [or:escherichia coli] [de:hypothetical 33.1 kd protein in selc-nlpa intergenic region] [sp:p31437] [db:swissprot] |
| 34042340_f1_2 | 1668 | 4271 | 519 | 172 | 87 | 0.035 | [ac:p13857] [gn:riml] [or:escherichia coli] [ec:2.3.1.—] [de:enzyme for n-terminal of ribosomal protein 17/112)] [sp:p13857] [db:swissprot] |
| 34064062_f2_2 | 1669 | 4272 | 462 | 154 | 452 | 7.40E-43 | [ac:q54433] [gn:dfp] [or:streptococcus mutans] [de:dna/pantothenate metabolism flavoprotein homolog (fragment)] [sp:q54433] [db:swissprot] |
| 34064417_f3_2 | 1670 | 4273 | 582 | 193 | 337 | 1.10E-30 | [ac:g69762] [pn:two-component response regulator [yclk] homolog yclj] [gn:yclj] [or:bacillus subtilis] [db:pir] |
| 34066031_f2_7 | 1671 | 4274 | 552 | 183 | 328 | 1.00E-29 | [ac:p31135] [gn:poth] [or:escherichia coli] [de:putrescine transport system permease protein poth] [sp:p31135] [db:swissprot] |
| 34069382_f3_12 | 1672 | 4275 | 285 | 94 | 123 | 9.80E-08 | [ac:p21458:p21459] [gn:spoiiie] [or:bacillus subtilis] [de:stage iii sporulation protein e] [sp:p21458:p21459] [db:swissprot] |
| 34070307_f1_3 | 1673 | 4276 | 510 | 169 | 164 | 2.40E-12 | [in:ab010789] [ac:ab010789] [or:lactococcus lactis] [sr:lactococcus lactis (sub_species:lactis, strain:01–7) dna] [db:genpept-bct] [de:lactococcus lactis gene for gad c, glutamate decarboxylase, partialand complete cds.] [nt:unnamed protein product] [le:2 |
| 34070313_f2_15 | 1674 | 4277 | 327 | 108 | 358 | 6.70E-33 | [ac:p04455] [gn:rplx] [or:bacillus stearothermophilus] [de:50s ribosomal protein 124] [sp:p04455] [db:swissprot] |
| 3407841_f3_49 | 1675 | 4278 | 909 | 302 | 363 | 9.40E-38 | [ac:p37540] [gn:yaas] [or:bacillus subtilis] [de:hypothetical 37.6 kd protein in xpac-abrb intergenic region] [sp:p37540] [db:swissprot] |
| 34078952_c1_25 | 1676 | 4279 | 186 | 61 | 64 | 0.44 | [in:af013249] [ac:af013249] [pn:leukocyte-associated ig-like receptor-1] [gn:lair-1] [or:homo sapiens] [sr:human] [db:genpept-pri2] [de:homo sapiens leukocyte-associated ig-like receptor-1 (lair-1) mrna,complete cds.] [nt:membrane glycoprotein] [le:69] [r |
| 34089062_c1_157 | 1677 | 4280 | 477 | 158 | 84 | 0.025 | [ac:q03182] [gn:rina] [or:bacteriophage phi-11] [de:transcriptional activator rina] [sp:q03182] [db:swissprot] |
| 34100717_f1_7 | 1678 | 4281 | 1179 | 392 | 835 | 1.90E-83 | [ac:f69806] [pn:rrna methyltransferase homolog yfjo] [gn:yfjo] [or:bacillus subtilis] [db:pir] |
| 34104550_f2_8 | 1679 | 4282 | 966 | 321 | 1232 | 1.60E-125 | [in:spgroelgn] [ac:x89236] [pn:heat shock protein] [gn:groel] [or:streptococcus pyogenes] [db:genpept-bct] [de:s.pyogenes dna for groel gene.] [le:<1] [re:1446] [db:pir] |

TABLE 2-continued

| Orf | NT Seq ID | AA Seq ID | NT Orf Length | AA Orf Length | Score | Probability | Description |
|---|---|---|---|---|---|---|---|
| 34109437_f3_13 | 1680 | 4283 | 414 | 137 | 626 | 2.70E-61 | [di:direct] [ac:s49401:s49406:s38203:s38208] [pn:h+-transporting atp synthase, chain b] [gn:atpb] [or:streptococcus pneumoniae] [db:pir] |
| 34112751_f1_1 | 1681 | 4284 | 1401 | 822 | 273 | 2.00E-143 | [ac:p21998] [gn:exoa] [or:streptococcus pneumoniae] [de:exodeoxyribonuclease,] [sp:p21998] [db:swissprot] |
| 34113433_f2_8 | 1682 | 4285 | 398 | 294 | 97 | 3.90E-37 | [ln:sau61271] [acu61271] [pn:glutamine synthetase type 1] [gn:glna] [or:streptococcus agalactiae] [db:genpept-bct] [de:streptococcus agalactiae glutamine synthetase type 1 (glna) gene, complete cds.] [le:40] [re:1389] [di:direct] |
| 34117012_c2_12 | 1683 | 4286 | 129 | 83 | 249 | 1.20E-08 | [ac:a69931] [pn:hypothetical protein yoze] [gn:yoze] [or:bacillus subtilis] [db:pir] |
| 34157512_f2_20 | 1684 | 4287 | 413 | 285 | 858 | 1.00E-38 | [ac:g69712] [pn:essential for sigma-g activity at stage iii spoiiij] [gn:spoiiij] [or:bacillus subtilis] [db:pir] |
| 34158132_c2_34 | 1685 | 4288 | 77 | 85 | 258 | 0.076 | [ac:p41909] [gn:pxa1,pat2:pal1,ssh2:ypl147w:lp1lw:p2607] [or:saccharomyces cerevisiae] [sr:,baker's yeast] [de:transporter 1] [sp:p41909] [db:swissprot] |
| 34161715_c2_76 | 1686 | 4289 | 65 | 68 | 207 | 0.073 | [ln:af031958] [ac:af031958] [pn:gen5 homolog] [gn:gen5] [or:arabidopsis thaliana] [sr:thale cress] [db:genpept-pln] [de:arabidopsis thaliana gen5 homolog (gen5) mrna, partial cds.] [nt:similar to yeast gen5] [le:<1] [re: |
| 34175068_c1_32 | 1687 | 4290 | 886 | 385 | 1158 | 7.50E-89 | [ac:b69668] [pn:transcription termination nusa] [gn:nusa] [or:bacillus subtilis] [db:pir] |
| 34179066_c3_15 | 1688 | 4291 | 71 | 71 | 216 | 0.017 | [ln:miatgenb] [ac:y08502] [gn:trna-ser] [or:mitochondrion arabidopsis thaliana] [sr:thale cress] [db:genpept-pln] [de:a.thaliana mitochondrial genome, part b] [nt:orf117] [le:58045] [re:58398] [di:complement] |
| 34179066_f1_3 | 1689 | 4292 | 60 | 96 | 291 | 0.23 | [ac:a45099] [pn:calcium channel alpha 1 subunit] [or:mus musculus] [sr:, house mouse] [db:pir] |
| 34179590_c1_22 | 1690 | 4293 | 157 | 192 | 579 | 6.40E-14 | [ln:af004325] [ac:af004325] [pn:unknown] [gn:cps19g] [or:streptococcus pneumoniae] [db:genpept-bct] [de:streptococcus pneumoniae capsular serotype 19b capsule biosynthesislocus, cps19bf gene, partial cds, cps19bg, cps19bh, cps19bi, cps19bq, cps19 |
| 34179700_f2_12 | 1691 | 4294 | 280 | 316 | 951 | 1.20E-24 | [ac:s77536] [pn:hypothetical protein] [or:synechocystis sp.] [sr:pcc 6803, , pcc 6803] [sr:pcc 6803, ] [db:pir] |
| 34179838_f2_6 | 1692 | 4295 | 731 | 276 | 828 | 2.00E-72 | [ac:p96051] [or:streptococcus thermophilus] [de:(orf1091)] [sp:p96051] [db:swissprot] |
| 34180262_f2_23 | 1693 | 4296 | 64 | 85 | 258 | 0.26 | [ln:bbu42599] [ac:u42599] [or:borrelia burgdorferi] [sr:lyme disease spirochete] [db:genpept-bct] [de:borrelia burgdorferi plasmid cp18, ospe (ospe) gene, partial cds.] [nt:orfe] [le:1395] [re:1967] [di:direct] |
| 34182762_f3_30 | 1694 | 4297 | 1457 | 459 | 1380 | 2.30E-149 | [ac:p43905] [gn:aroa] [or:lactococcus lactis] [sr:, subsplactis:f001b]streptococcus lactis] [ec:2.5.1.19] [de:enolpyruvylshikimate-3-phosphate synthase) (epsp synthase)] [sp:p43905] [db:swissprot] |
| 34189093_f2_11 | 1695 | 4298 | 124 | 116 | 351 | 1.60E-07 | [ac:q49330] [gn:rgg] [or:streptococcus gordonii challis] [de:rgg protein] [sp:p49330] [db:swissprot] |
| 34189383_f2_21 | 1696 | 4299 | 301 | 91 | 276 | 7.40E-27 | [ac:s52544] [pn:is12 protein] [or:lactobacillus helveticus] [db:pir] |
| 34189462_f3_25 | 1697 | 4300 | 1096 | 429 | 1290 | 4.20E-111 | [ac:p77836] [gn:pyn] [or:bacillus stearothermophilus] [ec:2.4.2.2] [de:pyrimidine-nucleoside phosphorylase] [sp:p77836] [db:swissprot] |
| 34191588_c1_16 | 1698 | 4301 | 209 | 418 | 1257 | 1.70E-16 | [ac:p31465] [gn:yief] [or:escherichia coli] [de:hypothetical 20.4 kd protein in tnab-bglb intergenic region] [sp:p31465] [db:swissprot] |
| 34193787_f3_22 | 1699 | 4302 | 1229 | 350 | 1053 | 3.40E-125 | [ac:a69688] [pn:s-adenosylmethionine trna ribosyltransferase quea] [gn:quea] [or:bacillus subtilis] [db:pir] |
| 34193880_f3_7 | 1700 | 4303 | 191 | 136 | 411 | 3.40E-15 | [ac:p54519] [gn:yqhy] [or:bacillus subtilis] [de:hypothetical 14.7 kd protein in accc-fold intergenic region] [sp:p54519] [db:swissprot] |
| 34193955_c2_8 | 1701 | 4304 | 184 | 136 | 411 | 1.90E-14 | [ac:q48709] [gn:nrdi] [or:lactococcus lactis] [sr:, subspcremoris:streptococcus cremoris] [de:nrdi protein] [sp:q48709] [db:swissprot] |
| 34194062_f1_2 | 1702 | 4305 | 1368 | 346 | 1041 | 6.30E-140 | [ln:lsaj1330] [ac:aj001330] [pn:ornithine transcarbamoylase] [gn:arcb] [or:lactobacillus |

TABLE 2-continued

| Orf | NT Seq ID | AA Seq ID | NT Orf Length | AA Orf Length | Score | Probability | Description |
|---|---|---|---|---|---|---|---|
| 34194127_c1_16 | 1703 | 555 | 184 | 294 | 4.10E-26 | | sake [db:genpept-bct] [ec:2.1.3.3] [de:lactobacillus sake dna encoding the arginine-deiminase pathwaygenes.] [le:1503] [re:2516] [di:direct] |
| 34195452_f1_1 | 1704 | 717 | 238 | 1205 | 1.20E-122 | | [ac:f69815] [pn:hypothetical protein ygac] [gn:ygac] [or:bacillus subtilis] [db:pir] [ac:s49405:s38207] [pn:h+-transporting atp synthase, chain a] [gn:atpa] [or:streptococcus pneumoniae] [ec:3.6.1.34] [db:pir] |
| 34195936_c1_10 | 1705 | 672 | 223 | 152 | 1.70E-09 | | [ln:bsy09476] [ac:y09476] [pn:yitl] [or:bacillus subtilis] [db:genpept-bct] [de:b.subtilis 54kb genomic dna fragment.] [nt:putative] [le:38747] [re:39595] [di:direct] |
| 34198517_c1_17 | 1706 | 2493 | 830 | 162 | 5.80E-10 | | [ln:u93872] [ac:u93872] [or:kaposi's sarcoma-associated herpesvirus] [sr:kaposi's sarcoma-associated herpesvirus - human herpesvirus 8] [db:genpept-vrl] [de:kaposi's sarcoma-associated herpesvirus glycoprotein m, dnareplication protein, glycoprotein, dna |
| 34250137_f3_10 | 1707 | 744 | 247 | 208 | 3.60E-16 | | [ac:q10449] [gn:spac12b10.16c] [or:schizosaccharomyces pombe] [sr:, fission yeast] [de:hypothetical 57.2 kd protein c12b10.16c in chromosome i] [sp:q10449] [db:swissprot] |
| 34253377_f3_5 | 1708 | 855 | 284 | 518 | 7.50E-50 | | [ln:af019986] [ac:af019986] [pn:pksb] [gn:pksb] [or:dictyostelium discoideum] [db:genpept-inv] [de:dictyostelium discoideum pksb (pksb) mrna, complete cds.] [nt:similar to e. coli 3-oxoacyl-[acyl-carrier protein]] [le:1] [re:783] [di:direct] |
| 34254635_c1_13 | 1709 | 1230 | 409 | 894 | 1.10E-89 | | [ac:b69640] [pn:coproporphyrinogen iii oxidase hemn] [gn:hemn] [or:bacillus subtilis] [db:pir] |
| 34255432_c3_35 | 1710 | 507 | 168 | 309 | 1.10E-27 | | [ac:g69180] [pn:ribose 5-phosphate isomerase] [gn:mth608] [or:methanobacterium thermoautotrophicum] [db:pir] |
| 34257693_c2_53 | 1711 | 645 | 214 | 147 | 9.50E-09 | | [ac:i38170] [pn:gene hr44 protein] [gn:hr44] [or:homo sapiens] [sr:, man] [db:pir] |
| 34257778_c1_10 | 1712 | 204 | 67 | 49 | 0.25 | | [ac:p29348] [gn:gnat3;gnat-3] [or:rattus norvegicus] [sr:,rat] [de:alpha-3 chain] [sp:p29348] [db:swissprot] |
| 34258262_f2_7 | 1713 | 318 | 105 | 259 | 2.10E-22 | | [ac:p04454] [gn:rplw] [or:bacillus stearothermophilus] [de:50s ribosomal protein 123] [sp:p04454] [db:swissprot] |
| 34258467_c2_42 | 1714 | 837 | 278 | 923 | 9.10E-93 | | [ac:p18843:p78235] [gn:nade:efg:nrt] [or:escherichia coli] [ec:6.3.5.1] [de:protein] [sp:p18843:p78235] [db:swissprot] |
| 34261562_c2_30 | 1715 | 672 | 223 | 194 | 1.60E-15 | | [ac:p39066] [gn:acub] [or:bacillus subtilis] [de:acetoin utilization acub protein] [sp:p39066] [db:swissprot] |
| 34266287_c2_11 | 1716 | 573 | 190 | 144 | 4.50E-09 | | [ac:p39214] [gn:mcpa] [or:bacillus subtilis] [de:methyl-accepting chemotaxis protein mcpa (h1)] [sp:p39214] [db:swissprot] |
| 34266287_c2_11 | 1717 | 1134 | 377 | 371 | 6.30E-34 | | [ac:d69796] [pn:two-component sensor histidine kinase [yes homolog yesm] [gn:yesm] [or:bacillus subtilis] [db:pir] |
| 34266336_f2_6 | 1718 | 2253 | 750 | 405 | 4.90E-35 | | [ln:af019904] [ac:af019904] [pn:choline binding protein a] [gn:cbpa] [or:streptococcus pneumoniae] [db:genpept-bct] [de:streptococcus pneumoniae choline binding protein a (cbpa) gene, partial cds.] [nt:cbpa] [le:<1] [re:1992] [di:direct] |
| 34272266_c1_29 | 1719 | 648 | 215 | 167 | 1.20E-12 | | [ln:d78257] [ac:d78257] [pn:orf8] [gn:orf8] [or:enterococcus faecalis] [sr:enterococcus faecalis plasmid:pyi17 dna] [db:genpept-bct] [de:enterococcus faecalis plasmid pyi17 genes for baca, bacb, orf3, orf4, orf5, orf6, orf7, orf8, orf9, orf10, orf11, partia |
| 34274090_c3_15 | 1720 | 573 | 190 | 938 | 2.30E-94 | | [ac:p51595] [gn:sulc] [or:streptococcus pneumoniae] [ec:3.5.4.16] [de:gtp cyclohydrolase i, (gtp-ch-i)] [sp:p51595] [db:swissprot] |
| 34274138_f1_4 | 1721 | 888 | 295 | 804 | 3.70E-80 | | [ac:c69795] [pn:pet112-like protein homolog yern] [gn:yern] [or:bacillus subtilis] [db:pir] |
| 34274177_f3_12 | 1722 | 885 | 294 | 896 | 6.60E-90 | | [ac:g69879] [pn:1-serine dehydratase homolog y1pa] [gn:y1pa] [or:bacillus subtilis] [db:pir] |
| 34375681_f1_8 | 1723 | 308 | 103 | 170 | 1.20E-12 | | [ln:fibril] [ac:af007112] [pn:fibrillarin] [gn:fib] [or:plasmodium falciparum] [sr:malaria parasite] [db:genpept-inv] [de:plasmodium falciparum fibrillarin (fib) gene, partial cds.] [nt:nucleolar protein] [le:<1] [re:906] [di:direct] |

TABLE 2-continued

| Orf | NT Seq ID | AA Seq ID | NT Orf Length | AA Orf Length | Score | Probability | Description |
|---|---|---|---|---|---|---|---|
| 34376661_f3_12 | 1724 | 1785 | 594 | 1214 | 1.30E-123 | | [ac:jc5618] [pn:beta-galactosidase,;lactase] [gn:bgac] [or:bacillus circulans] [ec:3.2.1.23] [db:pir] |
| 34378317_f1_13 | 1725 | 384 | 127 | 82 | | 0.067 | [ac:s25535] [pn:mry15 protein] [or:streptococcus pyogenes] [db:pir] |
| 34381875_f1_7 | 1726 | 279 | 92 | 74 | | 0.069 | [ac:p14247] [gn:rpoa2] [or:methanococcus vannielii] [ec:2.7.7.6] [de:dna-directed ma polymerase subunit a",] [sp:p14247] [db:swissprot] |
| 34381875_f3_17 | 1727 | 2187 | 728 | 3571 | 0 | | [ac:q03727] [gn:coma] [or:streptococcus pneumoniae] [de:transport atp-binding protein coma] [sp:q03727] [db:swissprot] |
| 34407327_f3_12 | 1728 | 876 | 291 | 196 | 4.30E-13 | | [ac:jc4176] [pn:pyruvate, water dikinase,:phosphoenolpyruvate synthetase] [gn:ppsa] [or:pyrococcus furiosus] [ec:2.7.9.2] [db:pir] |
| 34413410_f1_2 | 1729 | 354 | 117 | 204 | 1.40E-16 | | [ac:s74925] [pn:transposase:protein s110650:protein s110650] [or:synechocystis sp.] [sr:pcc 6803, , pcc 6803] [sr:pcc 6803, ] [db:pir] |
| 34415678_c1_31 | 1730 | 765 | 254 | 422 | 1.10E-39 | | [ac:f64149] [pn:hypothetical protein hi0355] [cl:hypothetical protein b0934] [or:haemophilus influenzae] [db:pir] |
| 34415937_c2_41 | 1731 | 2880 | 959 | 1217 | 9.20E-126 | | [ln:bcex98455] [ac:x98455] [gn:snf] [or:bacillus cereus] [db:genpept-bct] [de:b. cereus orf1 and snf2 gene.] [le:1471] [re:4665] [di:direct] |
| 34416500_f1_3 | 1732 | 774 | 257 | 1238 | 3.80E-126 | | [ac:p35593] [gn:msra:exp3] [or:streptococcus pneumoniae] [de:(exported protein 3)] [sp:p35593] [db:swissprot] |
| 34417087_c3_12 | 1733 | 225 | 74 | 54 | | 0.31 | [ln:celf26g5] [ac:af022974] [gn:f26g5.9] [or:caenorhabditis elegans] [sr:caenorhabditis elegans strain=bristol n2] [db:genpept-inv] [de:caenorhabditis elegans cosmid f26g5.] [nt:contains similarity to c3hc4-type zinc fingers;] [le:13407:13548:14519] [re:1] |
| 34417187_c3_32 | 1734 | 924 | 307 | 679 | 6.50E-67 | | [ac:g69818] [pn:cmp-binding factor homolog yham] [gn:yham] [or:bacillus subtilis] [db:pir] |
| 34417212_c3_93 | 1735 | 729 | 242 | 660 | 6.70E-65 | | [ac:p35159] [gn:ypul] [or:bacillus subtilis] [de:hypothetical 26.0 kd protein in spmb-aroc intergenic region (orfx13)] [sp:p35159] [db:swissprot] |
| 34431507_f1_13 | 1736 | 1266 | 421 | 980 | 8.30E-99 | | [ln:stproba] [ac:x92418] [pn:gamma-glutamyl phosphate reductase] [gn:proa] [or:streptococcus thermophilus] [db:genpept-bct] [de:s.thermophilus prob and proa genes.] [le:946] [re:2196] [di:direct] |
| 34453175_f1_3 | 1737 | 900 | 299 | 634 | 3.80E-62 | | [ac:p46338] [gn:yjggl] [or:bacillus subtilis] [de:region precursor (orf108)] [sp:p46338] [db:swissprot] |
| 34453403_c3_28 | 1738 | 1413 | 470 | 753 | 9.40E-75 | | [ac:b70007] [pn:na+-transporting atp synthase homolog yubg] [gn:yubg] [or:bacillus subtilis] [db:pir] |
| 34468793_c1_11 | 1739 | 201 | 66 | 94 | 6.40E-05 | | [ln:spz82001] [ac:z82001] [pn:unknown] [or:streptococcus pneumoniae] [db:genpept-bct] [de:s.pneumoniae pcpa gene and open reading frames.] [le:<1] [re:174] [di:direct] |
| 34468927_f1_4 | 1740 | 288 | 95 | 68 | | 0.73 | [ac:jc1440] [pn:hypothetical 55k protein] [or:aedes aegypti] [sr:, yellow fever mosquito] [db:pir] |
| 34547066_c1_34 | 1741 | 669 | 222 | 888 | 4.60E-89 | | [ln:af019904] [ac:af019904] [pn:choline binding protein a] [gn:cbpa] [or:streptococcus pneumoniae] [db:genpept-bct] [de:streptococcus pneumoniae choline binding protein a (cbpa) gene, partial cds.] [nt:cbpa] [le:<1] [re:1992] [di:direct] |
| 34553342_f3_12 | 1742 | 207 | 68 | 61 | | 0.18 | [ln:mu58160] [ac:u58160] [gn:mhc class i] [or:lepidodactylus moestus] [db:genpept-vrt] [de:lepidodactylus moestus mhc class i mnna, peptide binding regionalpha-2 domain, partial cds.] [nt:encodes peptide binding region alpha-2 domain] [le:<1] [re:] [di:direct] |
| 34555451_f3_16 | 1743 | 789 | 262 | 379 | 4.00E-35 | | [ac:p06755] [gn:nodj] [or:rhizobium leguminosarum] [sr:,biovar viciae] [de:nodulation protein j] [sp:p06755] [db:swissprot] |
| 34564062_f3_37 | 1744 | 3675 | 1224 | 1783 | 2.00E-232 | | [ln:llu76424] [ac:u76424] [pn:exonuclease rexa] [gn:rexa] [or:lactococcus lactis] [db:genpept] [de:lactococcus lactis dnaa (dnaa) gene, partial cds; polymerase iii subunit dnan (dnan), exonuclease rexb (rexb), and exonuclease rexa(rexa) genes, complete cds [db:pir] |
| 34564067_f3_15 | 1745 | 1815 | 604 | 617 | 2.40E-60 | | [ac:g69843] [pn:oligoendopeptidase homolog yjbg] [gn:yjbg] [or:bacillus subtilis] [db:pir] |
| 34564187_c2_194 | 1746 | 390 | 129 | 82 | | 0.24 | [ln:htcalnex] [ac:z35108] [pn:calnexin] [fn:er-bound chaperone] [or:helianthus |

TABLE 2-continued

| Orf | NT Seq ID | AA Seq ID | NT Orf Length | AA Orf Length | Score | Probability | Description |
|---|---|---|---|---|---|---|---|
| 34569186_f1_2 | 1747 | 4350 | 693 | 230 | 188 | 7.00E-15 | *tuberosus*] [db:genpept-pln] [de:*h.tuberosus* mrna for calnexin.] [le:69] [re:1691] [ac:p25362] [gn:pet18hti2ycr20c] [or:*saccharomyces cerevisiae*] [sr:baker's yeast] [de:pet18 protein] [sp:p25362] [db:swissprot] |
| 34569193_c1_8 | 1748 | 4351 | 1320 | 439 | 617 | 2.40E-60 | [ac:c697851] [pn:cellobiose phosphotransferase system enzym homolog ydho] [gn:ydho] [or:*bacillus subtilis*] [db:pir] |
| 34570890_f1_4 | 1749 | 4352 | 1356 | 451 | 2307 | 2.00E-239 | [ln:spu43526] [accu43526] [or:*streptococcus pneumoniae*] [db:genpept-bct] [de:*streptococcus pneumoniae* neuraminidase b (nanb) gene, complete cds, and neuraminidase (nana) gene, partial cds.] [nt:orf-2] [le:1951] [re:3288] [di:direct] |
| 34571056_f3_23 | 1750 | 4353 | 810 | 269 | 713 | 1.60E-70 | [ac:g69728] [pn:uridine kinase udk] [gn:udk] [or:*bacillus subtilis*] [db:pir] |
| 34571877_c2_43 | 1751 | 4354 | 240 | 79 | 233 | 1.20E-19 | [ac:q48708] [gn:mdh] [or:*lactococcus lactis*] [sr:subspcremoris:*streptococcus cremoris*] [de:glutaredoxin-like protein mrdh] [sp:q48708] [db:swissprot] |
| 34572192_c3_38 | 1752 | 4355 | 198 | 65 | 67 | 0.045 | [ac:g69771] [pn:hypothetical protein ydbl] [gn:ydbl] [or:*bacillus subtilis*] [db:pir] |
| 34572207_c3_19 | 1753 | 4356 | 201 | 66 | 58 | 0.34 | [ln:sc354chiv] [ac:x959661] [gn:orfpza105] [or:*saccharomyces cerevisiae*] [sr:baker's yeast] [db:genpept-pln] [de:*s.cerevisiae* 35.4kb dna region on left arm of chromosome iv.] [le:33874] [di:direct] |
| 34574063_c3_56 | 1754 | 4357 | 1730 | 439 | 1320 | 2.80E-178 | [ac:s65968:a42280] [pn:adenylosuccinate synthase; imp-aspartate ligase] [gn:pura] [cl:adenylosuccinate synthase] [or:*bacillus subtilis*] [ec:6.3.4.4] [db:pir] |
| 34578928_f3_13 | 1755 | 4358 | 933 | 310 | 1056 | 7.30E-107 | [ac:a33595:a30868] [pn:probable transposase (insertion sequence is861)] [gn:is861-orf 2] [or:*streptococcus agalactiae*] [db:pir] |
| 34578928_f2_13 | 1756 | 4359 | 933 | 310 | 1055 | 9.30E-107 | [ac:a33595:a30868] [pn:probable transposase (insertion sequence is861)] [gn:is861-orf 2] [or:*streptococcus agalactiae*] [db:pir] |
| 34578928_f2_14 | 1757 | 4360 | 933 | 310 | 1037 | 7.50E-105 | [ac:a33595:a30868] [pn:probable transposase (insertion sequence is861)] [gn:is861-orf 2] [or:*streptococcus agalactiae*] [db:pir] |
| 34579635_f3_14 | 1758 | 4361 | 516 | 171 | 294 | 4.10E-26 | [ac:a64533] [pn:conserved hypothetical protein hp01105] [or:*helicobacter pylori*] [db:pir] |
| 34582167_c1_12 | 1759 | 4362 | 324 | 107 | 71 | 0.7 | [ac:p50237] [gn:st1c1] [or:*rattus norvegicus*] [sr:,rat] [ec:2.8.2.—] [de:n-hydroxyarylamine sulfotransferase, (hast-i)] [sp:p50237] [db:swissprot] |
| 34585312_f3_38 | 1760 | 4363 | 225 | 74 | 75 | 0.086 | [ac:z27564] [pn:polysaccharide translocation-related protein] [or:*escherichia coli*] [db:pir] |
| 34586062_c2_47 | 1761 | 4364 | 318 | 105 | 259 | 2.10E-22 | [ac:p55768] [or:*enterococcus faecium*] [sr:*streptococcus faecium*] [de:probable ribosomal protein in infb 5′region] [sp:p55768] [db:swissprot] |
| 34589068_f1_2 | 1762 | 4365 | 789 | 262 | 496 | 1.60E-47 | [ln:ae001165] [ac:ae001165:ac000783] [pn:spermidine/putrescine abc transporter, permease] [gn:bb0640] [or:*borrelia burgdorferi*] [sr:lyme disease spirochete] [db:genpept-bct] [de:*borrelia burgdorferi* (section 51 of 70) of the complete genome.] |
| 34589187_f3_18 | 1763 | 4366 | 1362 | 453 | 2172 | 4.00E-225 | [ac:p36498] [gn:comb] [or:*streptococcus pneumoniae*] [de:transport protein comb] [sp:p36498] [db:swissprot] |
| 34611037_f1_43 | 1764 | 4367 | 708 | 235 | 63 | 0.42 | [ln:pfagbp] [ac:m15212] [or:*plasmodium falciparum*] [sr:*p.falciparum* (fc27) schizont, cdna to mrna, clone ag 78] [db:genpept-inv] [de:*p.falciparum* glycophorin-binding protein mrna, partial.] [nt:glycophorin binding protein] [le:<1] [re: |
| 34617811_f1_3 | 1765 | 4368 | 864 | 287 | 231 | 1.90E-19 | [ac:d69841] [pn:hypothetical protein yits] [gn:yits] [or:*bacillus subtilis*] [db:pir] |
| 34617937_f3_17 | 1766 | 4369 | 1821 | 606 | 2159 | 9.60E-224 | [ln:sau49821] [accu49821] [pn:group b oligopeptidase pepb] [gn:pepb] [or:*streptococcus agalactiae*] [db:genpept-bct] [de:*streptococcus agalactiae* group b oligopeptidase pepb (pepb) gene, complete cds.] [le:205] [re:2010] [di:direct] |
| 34626902_f3_44 | 1767 | 4370 | 1761 | 586 | 880 | 3.30E-88 | [ac:p55452] [gn:y4fn] [or:*rhizobium sp*] [sr:ngr234,] [de:probable abc transporter permease protein y4fn] [sp:p55452] [db:swissprot] |
| 34632825_c2_51 | 1768 | 4371 | 1236 | 411 | 799 | 1.30E-79 | [ac:b69888] [pn:gtp-binding protein proteinase modulator homolog ynba] [gn:ynba] [or:*bacillus subtilis*] [db:pir] |
| 34640667_f3_23 | 1769 | 4372 | 1347 | 448 | 257 | 3.50E-31 | [ac:a33427:a00901:a61016:i54348:i37394:i84457] [pn:alpha-1-fucosidase, 1 precursor, tissue:alpha-1-fucoside fucohydrolase i:alpha-1-fucose fucohydrolase] [cl:alpha-1-fucosidase] [or:*homo sapiens*] [sr:, man] [gn:fuca1] [ec:3.2.1.51] [db:pir] [mp:lp35-lp34] |

TABLE 2-continued

| Orf | NT Seq ID | AA Seq ID | NT Orf Length | AA Orf Length | Score Probability | Description |
|---|---|---|---|---|---|---|
| 34642135_c3_73 | 1770 | 4373 | 654 | 217 | 1073 | 1.20E-108 | [ln:spparcetp] [ac:z67739] [gn:orf2] [or:streptococcus pneumoniae] [db:genpept-bct] [de:s.pneumoniae parc, pare and transposase genes and unknown orf.] [nt:unidentified] [e:478] [re:1119] [di:complement] |
| 34642207_f2_18 | 1771 | 4374 | 1962 | 653 | 3299 | 0 | [ln:spparcetp] [ac:z67739] [pn:dna topoisomerase iv] [gn:parc] [or:streptococcus pneumoniae] [db:genpept-bct] [de:s.pneumoniae parc, pare and transposase genes and unknown orf.] [nt:pare subunit] [e:1255] [re:3198] [di:direct] |
| 34642556_f1_17 | 1772 | 4375 | 990 | 329 | 1452 | 7.90E-149 | [ln:spdnagpol] [ac:y11463] [gn:rpod] [or:streptococcus pneumoniae] [db:genpept-bct] [de:streptococcus pneumoniae dnag, rpod, cpoa genes and orf3 and orf5.] [le:566] [re:1675] [di:direct] |
| 34642762_c3_67 | 1773 | 4376 | 1383 | 460 | 1378 | 5.50E-141 | [ln:efu94707] [ac:u94707] [pn:d-glutamic acid adding enzyme] [gn:murd] [or:enterococcus faecalis] [db:genpept-bct] [de:enterococcus faecalis strain a24836 cell wall/cell division genecluster, yllb, ylld, ylld, pbpc, mray, murd, mug, div1b, ftsa and ftsa g |
| 34643752_f2_10 | 1774 | 4377 | 255 | 84 | 157 | 1.30E-11 | [ac:p51280] [gn:acpp] [or:porphyra purpurea] [de:acyl carrier protein] [sp:p51280] [db:swissprot] |
| 34647127_f2_6 | 1775 | 4378 | 864 | 287 | 1275 | 4.50E-130 | [ac:p33170] [gn:tuf] [or:streptococcus oralis] [de:elongation factor tu (ef-tu)] [sp:p33170] [db:swissprot] |
| 34648442_c1_17 | 1776 | 4379 | 486 | 161 | 386 | 7.30E-36 | [ac:p32393] [gn:comeb:come2] [or:bacillus subtilis] [de:come operon protein 2] [sp:p32393] [db:swissprot] |
| 34652142_f3_11 | 1777 | 4380 | 495 | 164 | 98 | 9.20E-05 | [ac:a694404] [pn:mutator protein mutt (mutt) homolog] [or:archaeoglobus fulgidus] [db:pir] |
| 34662525_c2_11 | 1778 | 4381 | 183 | 60 | 58 | 0.34 | [ac:p54027] [gn:m[0249] [or:methanococcus jannaschii] [de:50s ribosomal protein 144e] [sp:p54027] [db:swissprot] |
| 34663438_f3_29 | 1779 | 4382 | 543 | 180 | 156 | 1.70E-11 | [ln:u97022] [ac:u97022] [or:fervidobacterium islandicum] [db:genpept-bct] [de:fervidobacterium islandicum dna topoisomerase i (topa) gene, complete cds.] [nt:orf; similar to serine/threonine protein] [e:3164] [re:3814] [di:direct] |
| 34667942_f3_46 | 1780 | 4383 | 444 | 147 | 60 | 0.4 | [ln:asporfgen] [ac:x95645] [pn:molybdo-pterin binding protein] [gn:mop] [or:anabaena sp.] [sr:anabaena sp] [db:genpept-bct] [de:anabaena sp. mop gene and 5 orfs.] [le:252] [re:461] [di:complement] |
| 35515957_f1_3 | 1781 | 4384 | 471 | 156 | 522 | 2.80E-50 | [ac:p96050] [gn:fold] [or:streptococcus thermophilus] [ec:1.5.1.5;3.5.4.9] [de:methenyltetrahydrofolate cyclohydrolase,] [sp:p96050] [db:swissprot] |
| 35157188_c2_77 | 1782 | 4385 | 546 | 181 | 238 | 3.50E-20 | [ac:p94559] [gn:ysnb] [or:bacillus subtilis] [de:hypothetical 19.2 kd protein in rph-ilvb intergenic region] [sp:p94559] [db:swissprot] |
| 35158580_f3_31 | 1783 | 4386 | 903 | 300 | 745 | 6.60E-74 | [ac:p43909] [or:lactococcus lactis] [sr:,subsplactis:streptococcus lactis] [ec:4.2.1.51] [de:prephenate dehydratase, (pdt)] [sp:p43909] [db:swissprot] |
| 35162937_f2_27 | 1784 | 4387 | 756 | 251 | 73 | 0.98 | [ln:bmfib5e] [ac:x03973:m24222] [pn:fibroin] [or:bombyx mandarina] [db:genpept-inv] [de:bombyx mandarina fibroin gene 5'-end region (exons 1 and 2 partial).] [le:952.1963] [re:993: |
| 35164067_c1_23 | 1785 | 4388 | 192 | 63 | 67 | 0.045 | [ac:p19281] [or:thermoproteus tenax virus 1] [sr:kra1,ttv1] [de:hypothetical 8.9 kd protein] [sp:p19281] [dbswissprot] |
| 35172212_c3_9 | 1786 | 4389 | 192 | 63 | 99 | 1.90E-05 | [ln:cet0488] [ac:z66565] [pn:t04f8.8] [or:caenorhabditis elegans] [db:genpept-inv] [de:caenorhabditis elegans cosmid t04f8, complete sequence.] [nt:cdna est yk121f1.5 comes from this gene] [le:34969] [re:35259] [di:direct] |
| 35175337_f1_6 | 1787 | 4390 | 192 | 63 | 91 | 0.00013 | [ln:cet0488] [ac:z66565] [pn:t04f8.8] [or:caenorhabditis elegans] [db:genpept-inv] [de:caenorhabditis elegans cosmid t04f8, complete sequence.] [nt:cdna est yk121f1.5 comes from this gene] [le:34969] [re:35259] [di:direct] |
| 35176568_f2_28 | 1788 | 4391 | 1914 | 637 | 542 | 2.10E-52 | [ln:spz82001] [ac:z82001] [pn:pepa] [gn:pepa] [or:streptococcus pneumoniae] [db:genpept-bct] [de:s.pneumoniae pepa gene and open reading frames.] [nt:the n-terminal domain of pepa is similar to] [le:2064] [re:4190] [di:direct] |

TABLE 2-continued

| Orf | NT Seq ID | AA Seq ID | NT Orf Length | AA Orf Length | Score | Probability | Description |
|---|---|---|---|---|---|---|---|
| 35197136_c1_43 | 1789 | 243 | 80 | 142 | 5.20E-10 | [ac:q57574] [gn:mj0110] [or:methanococcus jannaschii] [de:hypothetical protein mj0110] [sp:q57574] [db:swissprot] |
| 35205050_c2_3 | 1790 | 243 | 80 | 70 | 0.022 | [ac:p43608] [gn:yfr035c] [or:saccharomyces cerevisiae] [sr:baker's yeast] [de:hypothetical 12.5 kd protein in pho4-cdc26 intergenic region] [sp:p43608] [db:swissprot] |
| 35207937_c1_39 | 1791 | 711 | 236 | 538 | 5.70E-52 | [ac:b69693] [pn:ribonuclease iii rncs] [gn:rncs] [or:bacillus subtilis] [db:pir] |
| 35212588_f1_1 | 1792 | 1107 | 368 | 84 | 0.22 | [ac:s63658] [pn:nadh dehydrogenase (ubiquinone), chain 2] [or:mitochondrion allomyces macrogynus] [ec:1.6.5.3] [db:pir] |
| 35212876_f3_53 | 1793 | 699 | 232 | 98 | 0.019 | [ln:af001780] [ac:af001780] [pn:nifs] [gn:nifs] [fn:nitrogen fixation] [or:cyanothece pcc 8801] [db:genpept-bct] [de:cyanothece pcc 8801 nitrogenase (nifb), fdxn (fdxn), nifs (nifs) and nifu (nifu) genes, complete cds, and nifh (nifh) gene, partial cds.] [] |
| 35234636_f3_17 | 1794 | 480 | 159 | 163 | 3.10E-12 | [ac:g70079] [pn:hypothetical protein yxji] [gn:yxji] [or:bacillus subtilis] [db:pir] |
| 35235787_f3_27 | 1795 | 537 | 178 | 589 | 2.20E-57 | [ac:p44779] [gn:fuci:hi0614] [or:haemophilus influenzae] [ec:5.3.1.—] [de:1-fucose isomerase,] [sp:p44779] [db:swissprot] |
| 35241383_f3_7 | 1796 | 3873 | 1290 | 6561 | 0 | [ac:q49610] [gn:strh] [or:streptococcus pneumoniae] [ec:3.2.1.52] [de:beta-n-acetylhexosaminidase precursor,] [sp:p49610] [db:swissprot] |
| 35245288_f1_10 | 1797 | 357 | 118 | 136 | 2.30E-09 | [ac:g69983] [pn:hypothetical protein ysda] [gn:ysda] [or:bacillus subtilis] [db:pir] |
| 35292813_c3_62 | 1798 | 2226 | 741 | 1302 | 2.80E-135 | [ac:g69708] [pn:chromosome segregation smc protein homolg smc] [gn:smc] [or:bacillus subtilis] [db:pir] |
| 35332075_f1_4 | 1799 | 237 | 78 | 98 | 0.00037 | [ac:p23920] [gn:mets] [or:bacillus stearothermophilus] [ec:6.1.1.10] [de:(metrs)] [sp:p23920] [db:swissprot] |
| 35338911_c1_30 | 1800 | 216 | 71 | 52 | 0.099 | [ac:p09004] [or:zea mays] [sr:,maize] [de:mitochondrial 24 kd protein (orf25)] [sp:p09004] [db:swissprot] |
| 35343827_f1_10 | 1801 | 1152 | 383 | 179 | 8.80E-15 | [ln:mtv018] [ac:a1021899] [pn:putative regulator] [gn:mtv018.04] [or:mycobacterium tuberculosis] [db:genpept] [de:mycobacterium tuberculosis sequence v018.] nt:mtv018.04, len:346. unknown but shows similarity] [le:2429] [re:3469] [di:direct] |
| 35344525_f3_6 | 1802 | 318 | 105 | 154 | 2.80E-11 | [ac:o69868] [pn:conserved hypothetical protein ykvj] [gn:ykvj] [or:bacillus subtilis] [db:pir] |
| 35351687_c2_23 | 1803 | 402 | 134 | 90 | 0.0063 | [ac:e69896] [pn:hypothetical protein yoak] [gn:yoak] [or:bacillus subtilis] [db:pir] |
| 35353567_f2_23 | 1804 | 984 | 327 | 112 | 0.0035 | [ac:a64465] [pn:hypothetical protein mj1322] [or:methanococcus jannaschii] [db:pir] [mp:rev12733394-1270377] |
| 35355433_f3_15 | 1805 | 519 | 172 | 397 | 5.00E-37 | [ac:p54556] [gn:yqjs] [or:bacillus subtilis] [de:hypothetical 33.6 kd protein in glnq-ansr intergenic region] [sp:p54556] [db:swissprot] |
| 35361455_f2_3 | 1806 | 756 | 251 | 454 | 4.50E-43 | [ac:p08186] [gn:manx:ptsl:gptb] [or:escherichia coli] [ec:2.7.1.69] [de:(ec 2.7.1.69) (eiii-man)] [sp:p08186] [db:swissprot] |
| 35367205_c3_106 | 1807 | 207 | 68 | 59 | 0.28 | [ln:abgltba] [ac:x71632] [pn:glutamate synthase (nadph)] [gn:gltb] [or:azospirillum brasilense] [db:genpept-bct] [ec:1.4.1.13] [de:a.brasilense gene for glutamate synthase.] [le:<1] [re: |
| 35367205_f1_2 | 1808 | 207 | 68 | 59 | 0.28 | [ln:abgltba] [ac:x71632] [pn:glutamate synthase (nadph)] [gn:gltb] [or:azospirillum brasilense] [db:genpept-bct] [ec:1.4.1.13] [de:a.brasilense gene for glutamate synthase.] [le:<1] [re: |
| 35392217_f1_5 | 1809 | 294 | 97 | 68 | 0.036 | [ac:p17286] [gn:vpu] [or:chimpanzee immunodeficiency virus (siv)] [sr:,siv:cpz:civ] [de:vpu protein (u orf protein)] [sp:p17286] [db:swissprot] |
| 35397592_c2_14 | 1810 | 330 | 109 | 328 | 1.00E-29 | [ac:d69785] [pn:beta-glucosidase homolog ydhp] [gn:ydhp] [or:bacillus subtilis] [db:pir] |
| 35407033_c3_82 | 1811 | 297 | 98 | 73 | 0.027 | [ac:p33054] [gn:rpo22:j4r:14r] [or:variola virus] [ec:2.7.7.6] [de:dna-directed rna polymerase 22 kd polypeptide,] [sp:p33054] [db:swissprot] |
| 35422967_c1_70 | 1812 | 783 | 260 | 486 | 1.80E-46 | [ac:p54458] [gn:yqem] [or:bacillus subtilis] [de:hypothetical 28.3 kd protein in arod-comer intergenic region] [sp:p54458] [db:swissprot] |

TABLE 2-continued

| Orf | NT Seq ID | AA Seq ID | NT Orf Length | AA Orf Length | Score | Probability | Description |
|---|---|---|---|---|---|---|---|
| 35429683_f1_9 | 1813 | 345 | 114 | 332 | 3.80E-30 | | [ac:p55339] [gn:ecsa:prst] [or:bacillus subtilis] [de:abc-type transporter atp-binding protein ecsa] [sp:p55339] [db:swissprot] |
| 35444503_f3_3 | 1814 | 489 | 162 | 181 | 1.20E-13 | | [ac:a69875] [pn:hypothetical protein ylbl] [gn:ylbl] [or:bacillus subtilis] [db:pir] |
| 35580393_f2_8 | 1815 | 300 | 99 | 111 | 4.40E-06 | | [n:nempl] [ac:x03345] [or:escherichia coli] [db:genpept-bct] [de:e. coli npl gene for n-acetylneuraminate lyase subunit (ec4.1.3.3)] [nt:n-acetylneuraminate lyase (ec 4.1.3.3) (aa 1–297)] [sp:p06995] [le:93] [re:986] di:direct] |
| 35585952_c3_13 | 1816 | 582 | 193 | 720 | 2.90E-71 | | [ac:p45294] [gn:hi1648] [or:haemophilus influenzae] [de:hypothetical protein hi1648] [sp:p45294] [db:swissprot] |
| 35600818_c3_64 | 1817 | 855 | 284 | 462 | 6.40E-44 | | [ac:p09997:p76737] [gn:yida] [or:escherichia coli] [de:hypothetical 29.7 kd protein in ibpa-gyrb intergenic region] [sp:p09997:p76737] [db:swissprot] |
| 35703750_c2_64 | 1818 | 186 | 61 | 63 | 0.12 | | [ac:f69858] [pn:hypothetical protein ykoa] [gn:ykoa] [or:bacillus subtilis] [db:pir] |
| 35710942_c2_27 | 1819 | 390 | 130 | 149 | 2.70E-10 | | [ac:p49330] [gn:rgg] [or:streptococcus gordonii challis] [de:hypothetical protein] [sp:p49330] [db:swissprot] |
| 35742318_f2_4 | 1820 | 936 | 311 | 728 | 4.20E-72 | | [ac:a69677] [pn:fructose 1-phosphate kinase frub] [gn:frub] [or:bacillus subtilis] |
| 35742875_c3_43 | 1821 | 831 | 276 | 147 | 2.20E-08 | | [ac:s75891] [pn:hypothetical protein] [or:synechocystis sp.] [sr:pcc 6803, , pcc 6803] [sr:pcc 6803,] [db:pir] |
| 35751527_c2_97 | 1822 | 615 | 204 | 60 | 0.61 | | [ln:ccu12924] [ac:u12924] [pn:nadh dehydrogenase subunit 5] [gn:nd5] [or:mitochondrion ceratitis capitata] [sr:mediterranean fruit fly] [db:genpept-inv] [de:ceratitis capitata mitochondrion nadh dehydrogenase subunit 5(nd5) and nadh dehydrogenase subunit |
| 35757805_f1_10 | 1823 | 1281 | 426 | 678 | 8.30E-67 | | [ac:p69881] [pn:conserved hypothetical protein yluc] [gn:yluc] [or:bacillus subtilis] [db:pir] |
| 35785630_f3_42 | 1824 | 333 | 110 | 267 | 3.00E-23 | | [ac:p49938] [gn:fhuc] [or:bacillus subtilis] [de:ferrichrome transport atp-binding protein fhuc] [sp:p49938] [db:swissprot] |
| 35792668_c2_110 | 1825 | 192 | 63 | 154 | 2.80E-11 | | [ln:celc34d4] [ac:u58755] [gn:c34d4.11] [or:caenorhabditis elegans] [sr:caenorhabditis elegans strain=bristol n2] [db:genpept-inv] [de:caenorhabditis elegans cosmid c34d4.] [e:13972:14090:14398] [re:14036:14143:14493] [di:complementjoin] |
| 35820437_c2_61 | 1826 | 216 | 71 | 69 | 0.19 | | [ln:ab006531] [ac:ab006531] [pn:nonstructural polyprotein] [or:plautia stali intestine virus] [sr:plautia stali intestine virus (specific_host:plautia stali) rna] [db:genpept-vrl] [de:plautia stali intestine virus rna for nonstructuralpolyprotein, capsid |
| 35833438_c3_7 | 1827 | 579 | 192 | 206 | 8.60E-17 | | [ac:p11288] [gn:yaaa] [or:escherichia coli] [de:hypothetical 29.6 kd protein in thrc-talb intergenic region] [sp:p11288] [db:swissprot] |
| 35833603_c1_89 | 1828 | 393 | 130 | 181 | 3.80E-14 | | [ac:s34666] [pn:glycine-rich protein] [cl:phaseolus glycine-rich protein 1.0] [or:nicotiana tabacum] [sr:, common tobacco] [db:pir] |
| 35937837_f3_54 | 1829 | 1221 | 406 | 332 | 5.50E-30 | | [ac:s39886] [pn:virr protein] [or:streptococcus pyogenes] [db:pir] |
| 35972157_f2_3 | 1830 | 645 | 214 | 381 | 2.50E-35 | | [ac:s77250] [pn:hypothetical protein] [or:synechocystis sp.] [sr:pcc 6803, , pcc 6803] [sr:pcc 6803,] [db:pir] |
| 35994090_f1_11 | 1831 | 363 | 120 | 373 | 1.70E-34 | | [ac:q02144] [gn:eud] [or:lactococcus lactis] [sr:,subsplactis:streptococcus lactis] [ec:4.2.1.33] [de:(isopropylmalate isomerase) (alpha-ipm isomerase)] [sp:q02144] [db:swissprot] |
| 36023300_f3_38 | 1832 | 423 | 140 | 174 | 3.40E-12 | | [ac:p32399] [gn:yhge] [or:bacillus subtilis] [de:hypothetical 84.1 kd protein in hemy-glit intergenic region (orfb)] [sp:p32399] [db:swissprot] |
| 36023437_f1_4 | 1833 | 876 | 291 | 428 | 2.60E-40 | | [ac:p28244:p77647] [gn:ydib] [or:escherichia coli] [de:hypothetical 31.2 kd protein in ipp-arod intergenic region] [sp:p28244:p77647] [db:swissprot] |
| 36023466_c1_147 | 1834 | 330 | 109 | 63 | 0.71 | | [ac:p52858] [gn:rpsn] [or:synechococcus sp] [sr:pcc 6301,] [de:30s ribosomal protein s14] [sp:p52858] [db:swissprot] |
| 36024178_f3_14 | 1835 | 849 | 283 | 735 | 7.60E-73 | | [ln:smu69164] [ac:u69164] [pn:d-alanine:d-alanine ligase] [or:streptococcus mitis] [db:genpept-bct] [de:streptococcus mitis nctc 12261 d-alanineel-alanine ligase gene,partial cds,] [le:<1] [re: |

TABLE 2-continued

| Orf | | NT Seq ID | AA Seq ID | NT Orf Length | AA Orf Length | Score Probability | Description |
|---|---|---|---|---|---|---|---|
| 36025417_c3_222 | 1836 | 4439 | 519 | 172 | 73 | 0.0055 | [ln:bhp9011] [ac:x84706] [gn:a1] [or:bacteriophage b1] [db:genpept-phg] [de:bacteriophage tp901-1 genomic region.] [le:2002] [re:2340] [di:direct] |
| 36042213_c3_12 | 1837 | 4440 | 651 | 216 | 687 | 9.20E-68 | [ac:p45246] [gn:hi1545] [or:haemophilus influenzae] [de:hypothetical symporter hi1545] [sp:p45246] [db:swissprot] |
| 36053457_f2_3 | 1838 | 4441 | 735 | 244 | 485 | 2.30E-46 | [ac:b69627] [pn:transcriptional repressor of the fructose operon frur] [gn:frur] [or:bacillus subtilis] [db:pir] |
| 36054687_f1_6 | 1839 | 4442 | 288 | 95 | 178 | 8.00E-14 | [ln:ssoorfs] [ac:z79691] [gn:yorfb] [or:streptococcus pneumoniae] [db:genpept-bct] [de:s.pneumoniae yorf[a,b,c,d,e], ftsI, pbpx and regr genes.] [le:1914] [re:2372] [di:complement] |
| 36063307_f1_4 | 1840 | 4443 | 213 | 70 | 66 | 0.22 | [ac:q04663] [gn:cpsc] [or:streptococcus agalactiae] [de:cpsc protein] [sp:q04663] [db:swissprot] |
| 36071931_f3_35 | 1841 | 4444 | 273 | 90 | 66 | 0.4 | [ac:p75585] [or:mycoplasma pneumoniae] [de:hypothetical protein mg147 homolog] [sp:p75585] [db:swissprot] |
| 36073775_f1_4 | 1842 | 4445 | 945 | 314 | 670 | 5.80E-66 | [ac:p25744] [gn:yeee] [or:escherichia coli] [de:hypothetical 43.9 kd protein in msyb-htrb intergenic region (orf1)] [sp:p25744] [db:swissprot] |
| 36073805_c1_63 | 1843 | 4446 | 282 | 93 | 72 | 0.13 | [ln:atap22] [ac:z99708] [pn:purple acid phosphatase] [or:arabidopsis thaliana] [sr:thale cress] [db:genpept-pln] [de:arabidopsis thaliana dna chromosome 4, essa i ap2 contig fragmentno. 2.] [nt:strong similarity to 1kbpa - purple acid] [le:193868:194196:1 |
| 36078593_f3_8 | 1844 | 4447 | 432 | 143 | 227 | 5.10E-19 | [ac:c70008] [pn:pyrazinamidase/nicotinamidase homolog yuej] [gn:yuej] [or:bacillus subtilis] [db:pir] |
| 36110881_f1_2 | 1845 | 4448 | 1026 | 341 | 1042 | 2.20E-105 | [ac:jc5310] [pn:galactose repressor] [gn:galr] [or:streptococcus mutans] [db:pir] |
| 36118812_c2_14 | 1846 | 4449 | 897 | 298 | 1492 | 4.60E-153 | [ac:p09357] [gn:dpnb] [or:streptococcus pneumoniae] [ec:3.1.21.4] [de:(r.dpnii)] [sp:p09357] [db:swissprot] |
| 36125437_c3_53 | 1847 | 4450 | 942 | 313 | 867 | 7.80E-87 | [ac:q60252] [gn:pyrb] [or:lactobacillus leichmanii] [ec:2.1.3.2] [de:transcarbamylase (atcase)] [sp:q60252] [db:swissprot] |
| 36125802_c1_16 | 1848 | 4451 | 240 | 67 | 204 | 2.20E-20 | [ln:llu89998] [ac:u89998] [pn:50s ribosomal protein subunit 132] [gn:rpmf] [or:lactococcus lactis cremoris] [db:genpept-bct] [de:lactococcus lactis cremoris 50s ribosomal protein subunit 132(rpmf), 50s ribosomal protein subunit 133 (rpmg),5-methyl-cytosin |
| 36126252_c2_39 | 1849 | 4452 | 1281 | 426 | 1361 | 3.50E-139 | [ac:q00749] [gn:msme] [or:streptococcus mutans] [de:multiple sugar-binding protein precursor] [sp:q00749] [db:swissprot] |
| 36126876_c2_35 | 1850 | 4453 | 666 | 221 | 194 | 1.60E-15 | [ac:s56619:b65255] [pn:gpmb protein:hypothetical protein o215b] [gn:gpmb] [or:escherichia coli] [db:pir] |
| 36128160_c3_55 | 1851 | 4454 | 258 | 85 | 64 | 0.015 | [ac:s75748] [pn:hypothetical protein] [or:synechocystis sp.] [sr:pcc 6803, , pcc 6803] [sr:pcc 6803, ] [db:pir] |
| 36132663_c1_11 | 1852 | 4455 | 747 | 248 | 911 | 1.70E-91 | [ac:q07637] [gn:pyk] [or:lactococcus lactis] [sr:,subsp.lactis:streptococcus lactis] [ec:2.7.1.40] [de:pyruvate kinase,] [sp:q07637] [db:swissprot] |
| 36133437_f3_7 | 1853 | 4456 | 1362 | 453 | 1314 | 3.30E-134 | [ac:p39772] [gn:asns] [or:bacillus subtilis] [ec:6.1.1.22] [de:(asnrs)] [sp:p39772] [db:swissprot] |
| 36135787_f1_39 | 1854 | 4457 | 261 | 86 | 67 | 0.44 | [ac:q59395] [gn:celv1] [or:erwinia carotovora] [ec:3.2.1.4] [de:(cellulase v1)] [sp:q59395] [db:swissprot] |
| 36135878_c2_43 | 1855 | 4458 | 357 | 118 | 67 | 0.045 | [ln:hrsdrbc] [ac:176975] [pn:major histocompatibility complex] [gn:drb] [fn:antigen binding domain] [or:equus caballus] [sr:domestic horse] [db:genpept-mam] [de:equus caballus mhc class ii dr-beta (drb) gene, exon 2, partialcds.] [nt:putative] [le:<1] [re |
| 36136062_c2_19 | 1856 | 4459 | 624 | 207 | 205 | 1.10E-16 | [ac:p31465] [gn:yief] [or:escherichia coli] [de:hypothetical 20.4 kd protein in tnab-bglb intergenic region] [sp:p31465] [db:swissprot] |
| 36140640_f2_26 | 1857 | 4460 | 471 | 156 | 429 | 2.00E-40 | [ac:p39300] [gn:yjfr] [or:escherichia coli] [de:hypothetical 40.3 kd protein in aidb-rpsf intergenic region (f356)] [sp:p39300] [db:swissprot] |
| 36147252_f2_6 | 1858 | 4461 | 327 | 108 | 73 | 0.38 | [ac:q59978] [gn:grpes110057] [or:synechocystis sp] [sr:pcc 6803,] [de:grpe protein] |

TABLE 2-continued

| Orf | NT Seq ID | AA Seq ID | NT Orf Length | AA Orf Length | Score | Probability | Description |
|---|---|---|---|---|---|---|---|
| 36147706_c1_41 | 1859 | 4462 | 516 | 171 | 85 | 0.042 | [sp:q59978] [db:swissprot] |
| 36148262_f2_6 | 1860 | 4463 | 486 | 161 | 382 | 1.90E-35 | [ac:q06242] [gn:vanz] [or:enterococcus faecium] [sr:streptococcus faecium] [de:vanz protein] [sp:q06242] [db:swissprot] |
| 36148462_c1_66 | 1861 | 4464 | 1083 | 360 | 1121 | 9.40E-114 | [ac:q10449] [gn:spac12b10.16c] [or:schizosaccharomyces pombe] [sr:.fission yeast] [de:hypothetical 57.2 kd protein c12b10.16c in chromosome i] [sp:q10449] [db:swissprot] |
| 36152132_f2_14 | 1862 | 4465 | 282 | 93 | 356 | 1.10E-32 | [ln:llpepa] [ac:x81089] [pn:glutamyl-aminopeptidase] [gn:pepa] [or:lactococcus lactis] [db:genpept-bct] [de:l.lactis pepa gene.] [le:643] [re:1710] [di:direct] |
| 36203262_f2_19 | 1863 | 4466 | 1356 | 451 | 114 | 0.00075 | [ac:q23828] [gn:rpsq] [or:bacillus stearothermophilus] [de:30s ribosomal protein s17] [sp:q23828] [db:swissprot] |
| 36204688_f3_13 | 1864 | 4467 | 378 | 125 | 227 | 5.10E-19 | [ln:sgu61158] [ac:u61158] [pn:gdmh] [gn:gdmh] [or:staphylococcus gallinarum] [db:genpept-bct] [de:staphylococcus gallinarum tue3928 gdmf (gdmf), putative membraneprotein (gdmh), abc transporter (gdma), and antibiotic galliderminprecursor (gdma) genes, com |
| 36207767_f2_6 | 1865 | 4468 | 1455 | 484 | 1167 | 1.30E-118 | [ln:ab000631] [ac:ab000631] [or:streptococcus mutans] [sr:streptococcus mutans dna] [db:genpept-bct] [de:streptococcus mutans dna for sigma 42 protein,ddtp-4-keto-1-rhamnose reductase, complete cds.] [nt:unnamed protein product] [le:1869] [re:2204] [di:di |
| 36209692_f1_8 | 1866 | 4469 | 1590 | 529 | 2230 | 2.90E-231 | [ac:p39125] [gn:glga] [or:bacillus subtilis] [ec:2.4.1.21] [de:synthase] [sp:p39125] [db:swissprot] |
| 36211002_c1_20 | 1867 | 4470 | 1419 | 472 | 348 | 7.40E-38 | [ac:q54431;p96469] [gn:ffh] [or:streptococcus mutans] [de:signal recognition particle protein (fifty-four homolog)] [sp:q54431;p96469] [db:swissprot] |
| 36214005_f3_9 | 1868 | 4471 | 669 | 222 | 376 | 8.30E-35 | [ln:spac57a10] [ac:z94864] [pn:unknown] [gn:spac57a10.03] [or:schizosaccharomyces pombe] [sr:fission yeast] [db:genpept-pln] [de:s.pombe chromosome i cosmid c57a10.] [nt:spac57a10.03, cyclophilin-related, len:156aa,] [le:5344:5414:5521:5779] [re:5373:5455 |
| 36218763_f2_16 | 1869 | 4472 | 1677 | 558 | 1074 | 9.00E-109 | [ac:p39694] [gn:comea;come1] [or:bacillus subtilis] [de:come operon protein 1] [sp:p39694] [db:swissprot] |
| 36219078_f1_4 | 1870 | 4473 | 195 | 64 | 75 | 0.03 | [ac:h69884] [pn:conserved hypothetical protein ymfa] [gn:ymfa] [or:bacillus subtilis] [db:pir] |
| 36222187_f3_34 | 1871 | 4474 | 318 | 105 | 69 | 0.69 | [ac:p35116] [gn:nocp] [or:agrobacterium tumefaciens] [de:nopaline permease atp-binding protein p] [sp:p35116] [db:swissprot] |
| 36223437_f2_11 | 1872 | 4475 | 1311 | 436 | 222 | 8.70E-16 | [ac:s00006] [pn:mad4 protein] [or:mus musculus] [sr:. house mouse] [db:pir] [ln:smalregl] [ac:y07706] [pn:putative maltose-binding protein] [gn:male] [or:streptomyces coelicolor] [db:genpept-bct] [de:s.coelicolor malr, male, malf and malg genes.] [le:1620] [re:2891] [di:direct] |
| 36225007_f3_7 | 1873 | 4476 | 597 | 198 | 549 | 3.90E-53 | [ac:p42085] [gn:xpt] [or:bacillus subtilis] [ec:2.4.2.—] [de:xanthine phosphoribosyltransferase,] [sp:p42085] [db:swissprot] |
| 36225317_c3_233 | 1874 | 4477 | 432 | 143 | 123 | 5.40E-08 | [ac:p111888] [gn:14] [or:bacteriophage phi-29] [de:lysis protein (late protein gp14)] [sp:p11188] [db:swissprot] |
| 36226555_c2_90 | 1875 | 4478 | 1500 | 499 | 1650 | 8.30E-170 | [ac:p96994] [gn:galt] [or:streptococcus mutans] [ec:2.7.7.10] [de:galactose-1-phosphate uridylyltransferase,] [sp:p96994] [db:swissprot] |
| 36226563_f3_29 | 1876 | 4479 | 717 | 238 | 505 | 1.80E-48 | [ln:ae001166] [ac:ae001166:ae000783] [pn:conserved hypothetical protein] [de:borrelia burgdorferi] [sr:lyme disease spirochete] [db:genpept-bct] |
| 36226563_f3_3 | 1877 | 4480 | 606 | 201 | 261 | 1.30E-22 | [ln:bb0644] [or:borrelia burgdorferi] (section 52 of 70) of the complete genome.] [nt:similar to [ac:p37494] [gn:yybj] [or:bacillus subtilis] [de:intergenic region] [sp:p37494] [db:swissprot] |
| 36226586_c3_209 | 1878 | 4481 | 234 | 77 | 101 | 1.20E-05 | [ac:a64334] [pn:hypothetical protein mj0272] [or:methanococcus jannaschii] [db:pir] [mp:for257413–257652] |

TABLE 2-continued

| Orf | NT Seq ID | AA Seq ID | NT Orf Length | AA Orf Length | Score | Probability | Description |
|---|---|---|---|---|---|---|---|
| 36226627_c2_187 | 1879 | 282 | 93 | 130 | 9.80E-09 | | [ln:u88974] [ac:u88974] [pn:orf21] [or:streptococcus thermophilus] [db:genpept-bct] [de:streptococcus thermophilus bacteriophage 01205 dna sequence.] [le:11376] [re:11681] [di:direct] |
| 36227067_c2_11 | 1880 | 639 | 212 | 260 | 1.60E-22 | | [ac:f69903] [pn:d-alanyl-d-alanine carboxypeptidase homolog yodj] [or:bacillus subtilis] [db:pir] |
| 36227311_c3_115 | 1881 | 2415 | 804 | 1835 | 2.10E-189 | | [ac:a69682] [pn:primosomal replication factor y pria] [gn:pria] [or:bacillus subtilis] [db:pir] |
| 36229628_c1_14 | 1882 | 201 | 66 | 61 | 0.0062 | | [ac:p53168] [gn:yg1061c] [or:saccharomyces cerevisiae] [sr:;baker's yeast] [de:hypothetical 27.5 kd protein in pyc1-ubc2 intergenic region] [sp:p53168] [db:swissprot] |
| 36345717_c3_17 | 1883 | 1176 | 391 | 1711 | 2.80E-176 | | [ac:q56115] [gn:pepc] [or:streptococcus thermophilus] [ec:3.4.22.—] [de:aminopeptidase c,] [sp:q56115] [db:swissprot] |
| 36345912_f2_18 | 1884 | 183 | 60 | 116 | 8.50E-07 | | [ln:strcomaa] [ac:m36180;115190] [pn:transposase] [or:streptococcus pneumoniae] [sr:streptococcus pneumoniae (strain rx1) dna] [db:genpept-bct] [de:streptococcus pneumoniae transposase, (coma and comb) and saicarsynthetase (purc) genes, complete cds.] [nt |
| 36347162_c3_27 | 1885 | 1740 | 579 | 2428 | 3.00E-252 | | [ac:q59925;q59926] [gn:fhs] [or:streptococcus mutans] [ec:6.3.4.3] [de:synthetase) (fhs) (fthfs)] [sp:q59925;q59926] [db:swissprot] |
| 36360910_c2_46 | 1886 | 366 | 121 | 79 | 0.029 | | [ac:p22053] [or:bovine coronavirus:bovine coronavirus] [sr:mebus:quebec,] [de:hypothetical protein iorf1] [sp:p22053] [db:swissprot] |
| 36361051_c3_238 | 1887 | 189 | 62 | 48 | 0.023 | | [ac:s53860] [pn:nadh dehydrogenase chain 3] [cl:nadh dehydrogenase (ubiquinone) chain 3] [or:mitochondrion acanthamoeba castellanii] [db:pir] |
| 36363317_c1_36 | 1888 | 330 | 109 | 282 | 7.60E-25 | | [ln:stu73111] [acu73111] [pn:glutamine transport atp-binding protein glnq] [or:salmonella typhimurium] [db:genpept-bct] [de:salmonella typhimurium pexb (pexb) gene, partial cds andhigh-affinity glutamine transport operon, high-affinity periplasmicglutami |
| 36367156_f1_1 | 1889 | 426 | 141 | 76 | 0.7 | | [ac:s58137;s24456] [pn:gene 7 protein] [or:phage spp1] [db:pir] |
| 36367260_c1_25 | 1890 | 213 | 70 | 64 | 0.08 | | [ln:af016485] [ac:af016485] [gn:cyda] [or:halobacterium sp. nrc-1] [db:genpept-bct] [de:halobacterium sp. nrc-1 plasmid pnrc100, complete plasmid sequence.] [nt:similar to e. coli cytochrome d oxidase subunit i] [le:42257] [re:43705] [di:direct] |
| 36386053_f3_18 | 1891 | 873 | 290 | 896 | 6.60E-90 | | [ac:p55045] [gn:mutm:fpg] [or:streptococcus mutans] [ec:3.2.2.23] [de:glycosylase)] [sp:p55045] [db:swissprot] |
| 36424037_c1_7 | 1892 | 327 | 108 | 289 | 1.40E-25 | | [ln:af030361] [ac:af030361] [pn:transposase] [or:streptococcus pneumoniae] [db:genpept-bct] [de:streptococcus pneumoniae (cps1) gene, partial cds; anddtdp-4-keto-6-deoxyglucose-3,5-epimerase (cpsm).dt |
| 36424037_c2_19 | 1893 | 327 | 108 | 275 | 4.20E-24 | | [ln:strcomaa] [ac:m36180;115190] [pn:transposase] [or:streptococcus pneumoniae] [sr:streptococcus pneumoniae (strain rx1) dna] [db:genpept-bct] [de:streptococcus pneumoniae transposase, (coma and comb) and saicarsynthetase (purc) genes, complete cds.] [nt |
| 36424037_f2_13 | 1894 | 327 | 108 | 296 | 2.50E-26 | | [ln:af030361] [ac:af030361] [pn:transposase] [or:streptococcus pneumoniae] [db:genpept-bct] [de:streptococcus pneumoniae strain sp-va92 glucose-1-phosphatethymidyl transferase (cps1) gene, partial cds; anddtdp-4-keto-6-deoxyglucose-3,5-epimerase (cpsm).dt |
| 36424037_f2_5 | 1895 | 327 | 108 | 288 | 1.80E-25 | | [ln:af030361] [ac:af030361] [pn:transposase] [or:streptococcus pneumoniae] [db:genpept-bct] [de:streptococcus pneumoniae strain sp-va92 glucose-1-phosphatethymidyl transferase (cps1) gene, partial cds; anddtdp-4-keto-6-deoxyglucose-3,5-epimerase (cpsm).dt |
| 36424037_f2_9 | 1896 | 801 | 266 | 1235 | 7.90E-126 | | [ln:strcomaa] [ac:m36180;115190] [pn:transposase] [or:streptococcus pneumoniae] |

TABLE 2-continued

| Orf | NT Seq ID | AA Seq ID | NT Orf Length | AA Orf Length | Score | Probability | Description |
|---|---|---|---|---|---|---|---|
| 36424037_f3_24 | 4500 | 327 | 108 | 280 | | 1.20E-24 | [sr:*streptococcus pneumoniae* (strain rx1) dna] [db:genpept-bct] [de:*streptococcus pneumoniae* transposase, (coma and comb) and saicarsynthetase (purc) genes, complete cds.] [nt |
| 36442338_c3_33 | 4501 | 246 | 81 | 66 | | 0.46 | [ln:strcomaa] [ac:m36180:115190] [pn:transposase] [or:*streptococcus pneumoniae* (strain rx1) dna] [db:genpept-bct] [de:*streptococcus pneumoniae* transposase, (coma and comb) and saicarsynthetase (purc) genes, complete cds.] [nt [ac:s75730:s50064] [pn:biof protein] [or:synechocystis sp.] [sr:pcc 6803, , pcc 6803] [sr:pcc 6803, ] [dbpir] |
| 36446008_f2_1 | 4502 | 207 | 68 | 42 | | 0.15 | [ac:a49591:s37435] [pn:spike protein] [gn:s] [cl:coronavirus e2 glycoprotein] [or:porcine epidemic diarrhea virus] [dbpir] |
| 36517300_c1_33 | 4503 | 2178 | 725 | 1841 | | 4.80E-190 | [ac:p50640] [gn:mde] [or:*mycobacterium tuberculosis*] [ec:1.17.4.1] [de:(ribonucleotide reductase) (r1 subunit) (fragment)] [sp:p50640] [dbsswissprot] |
| 36523552_c3_43 | 4504 | 2451 | 816 | 976 | | 1.00E-178 | [ac:p37571] [gn:mecb:clpc] [or:*bacillus subtilis*] [de:negative regulator of genetic competence mecb] [sp:p37571] [dbsswissprot] |
| 36537877_c2_70 | 4505 | 768 | 255 | 143 | | 6.10E-08 | [ln:aopcza361] [ac:a223998] [pn:pcza361.23] [or:*amycolatopsis orientalis*] [db:genpept] [de:*amycolatopsis orientalis* cosmid pcza361.] [le:7732] [re:8556] |
| 36542135_f3_27 | 4506 | 6717 | 2238 | 308 | | 1.80E-38 | [ln:temela] [ac:y08557] [pn:lactase] [gn:laca] [or:*thermoanaerobacter ethanolicus*] [db:genpept-bct] [ec:3.2.1.23] [de:*t.ethanolicus* mela and laca genes.] [nt:beta-galactosidase] [le:1061] [re:3292] [di:direct] |
| 36589844_c1_24 | 4507 | 1241 | 413 | 2042 | | 2.40E-211 | [ln:spaliag] [ac:z35135] [pn:alia] [gn:alia] [fn:oligopeptide-binding protein] [or:*streptococcus pneumoniae*] [db:genpept-bct] [de:*s.pneumoniae* alia gene for amia-like gene a.] [le:66] [re:2048] [di:direct] |
| 36594032_f1_1 | 4508 | 276 | 91 | 150 | | 7.40E-11 | [ac:p37283] [gn:groes] [or:*lactococcus lactis*] [sr:subsplactis:*streptococcus lactis* [de:10 kd chaperonin (protein cpn10) (protein groes)] [sp:p37283] [dbsswissprot] |
| 36595336_c2_42 | 4509 | 1353 | 450 | 1234 | | 1.00E-125 | [ac:c69662] [pn:udp-n-acetylmuramate-alanine ligase murc] [gn:murc] [or:*bacillus subtilis*] [dbpir] |
| 36598437_f3_31 | 4510 | 1140 | 379 | 209 | | 1.10E-27 | [ac:p20590] [gn:hinfim] [or:*haemophilus influenzae*] [ec:2.1.1.72] [de:methyltransferase hinfi) (m.hinfi)] [sp:p20590] [dbsswissprot] |
| 36600717_c3_31 | 4511 | 1056 | 351 | 478 | | 1.30E-45 | [ac:q58092] [gn:mj0679] [or:*methanococcus jannaschii*] [ec:2.2.1.1] [de:putative transketolase c-terminal section, (tk)] [sp:q58092] [dbsswissprot] |
| 36601588_c3_21 | 4512 | 432 | 143 | 62 | | 0.24 | [ac:p14159] [or:*ovis aries*] [sr:,sheep] [de:homeobox protein hox-8.1 (fragment)] [sp:p14159] [dbsswissprot] |
| 36602262_f1_7 | 4513 | 249 | 82 | 75 | | 0.14 | [ln:cef15a2] [ac:z70207] [pn:f15a2.6] [or:*caenorhabditis elegans*] [db:genpept-inv] [de:*caenorhabditis elegans* cosmid f15a2, complete sequence.] [nt:protein predicted using genefinder; similarity to] [le:19512:20228:21046] [re:19596:20393:21127] [di:comple |
| 36603513_f1_2 | 4514 | 1536 | 511 | 1267 | | 3.20E-129 | [ln:ae001166] [ac:ae001166:ae000783] [pn:pts system, glucose-specific iibc component] [gn:bb0645] [or:*borrelia burgdorferi*] [sr:lyme disease spirochete] [db:genpept-bct] [de:*borrelia burgdorferi* (section 52 of 70) of the complete genome.] |
| 39010_c3_52 | 4515 | 639 | 212 | 94 | | 0.0099 | [ac:e69743] [pn:hypothetical protein ybba] [gn:ybba] [or:*bacillus subtilis*] [dbpir] |
| 3906300_f2_5 | 4516 | 942 | 313 | 1187 | | 9.60E-121 | [ac:p54380] [gn:glyq] [or:*bacillus subtilis*] [ec:6.1.1.14] [de:alpha chain) (glyrs)] [sp:p54380] [dbsswissprot] |
| 39063_f1_2 | 4517 | 336 | 111 | 242 | | 1.20E-19 | [ln:ae001146] [ac:ae001146:ae000783] [pn:pts system, fructose-specific iiabc component] [gn:bb0408] [or:*borrelia burgdorferi*] [sr:lyme disease spirochete] [db:genpept-bct] [de:*borrelia burgdorferi* (section 32 of 70) of the complete genome.] [nt:similar to |
| 3906502_f3_21 | 4518 | 186 | 61 | 64 | | 0.11 | [ln:pcu53921] [ac:u53921] [pn:major surface glycoprotein] [gn:msg] [or:*pneumocystis carinii*] [db:genpept-pln] [de:*pneumocystis carinii* major surface glycoprotein (msg) |

TABLE 2-continued

| Orf | NT Seq ID | AA Seq ID | NT Orf Length | AA Orf Length | Score | Probability | Description |
|---|---|---|---|---|---|---|---|
| 3906693_f3_41 | 4519 | 888 | 594 | 295 | 6.60E-58 | | gene, partialcds.] [nt:gpa; expression site of msg; encodes leader] [re:<1940:2187] [re:fn:iron transport] [ac:u02617] [pn:dtxr/iron regulated lipoprotein precursor] [gn:irp1] [de:corynebacterium diphtheriae dtxr/iron-regulated lipoproteinprecursor (irp1) gene, [or:corynebacterium diphtheriae] [db:genpept-bct] |
| 3907012_c3_84 | 4520 | 267 | 143 | 88 | 1.90E-09 | | [ac:p00886] [gn:arog] [or:escherichia coli] [ec:4.1.2.15] [desynthetase) (3-deoxy-d-arabino-heptulosonate 7-phosphate synthase)] [sp:p00886] [db:swissprot] |
| 3907151_c1_18 | 4521 | 327 | 103 | 108 | 7.10E-06 | | [ac:s51910] [pn:cryptogene protein g4] [or:leishmania tarentolae] [sr:strain lem125, , strain lem125] [sr:strain lem125, ] [db:pir] |
| 3907717_c3_41 | 4522 | 336 | 143 | 111 | 4.10E-10 | | [ac:q46213] [or:clostridium perfringens] [de:hypothetical 10.7 kd protein in virr 5'region (orf2)] [sp:q46213] [db:swissprot] |
| 3907637_c2_49 | 4523 | 207 | 202 | 68 | 2.30E-16 | | [ln:spnana] [ac:x72967] [or:streptococcus pneumoniae] [db:genpept-bct] [de:s.pneumoniae nana gene,] [nt:orf2] [le:193] [re:495] [di:direct] |
| 3907837_c3_59 | 4524 | 633 | 101 | 210 | 0.0058 | | [ac:s75088] [pn:hypothetical protein sl110245] [or:synechocystis sp.] [sr:pcc 6803, , pcc 6803] [sr:pcc 6803, ] [db:pir] |
| 391087_c3_75 | 4525 | 255 | 75 | 84 | 0.015 | | [ln:mtu19362] [ac:u19362] [pn:unknown] [or:methanobacterium thermoautotrophicum] [db:genpept-bct] [de:methanobacterium thermoautotrophicum methylene-tetrahydromethanopterin dehydrogenase (mtd), imidazoleglycerol-phosphate dehydrogenase (hisb), and putative] |
| 3912943_c3_45 | 4526 | 555 | 316 | 184 | 1.90E-28 | | [ln:sadnas25] [ac:x87105] [gn:mdr] [fn:multidrug resistance] [or:staphylococcus aureus] [db:genpept-bct] [de:s.aureus mdr, pbp4 and taqd genes (pvi-25 isolate).] [le:316] [re:1287] [di:complement] |
| 3914687_f1_15 | 4527 | 1029 | 687 | 342 | 9.20E-68 | | [ac:a69653] [pn:transmembrane lipoprotein [plb] [gn:plb] [or:bacillus subtilis] [db:pir] |
| 3914812_f1_4 | 4528 | 318 | 117 | 105 | 3.40E-06 | | [ln:aopcza363] [aca:a223999] [pn:pcza363.2] [or:amycolatopsis orientalis] [db:genpept] [de:amycolatopsis orientalis cosmid pcza363.] [nt:similar to mdr/abc transporter] [le:1562] [re:3514] [di:direct] |
| 392042_c3_202 | 4529 | 315 | 72 | 104 | 0.47 | | [ac:a48572] [pn:rhopty protein homolog] [or:babesia ovis] [db:pir] |
| 3922090_f1_14 | 4530 | 546 | 171 | 181 | 4.40E-13 | | [ln:mgu02192] [ac:u02192] [or:mycoplasma genitalium] [db:genpept-bct] [de:mycoplasma genitalium random genomic clone sf2, partial cds.] [nt:homology to surface protein antigen d90354] [le:1] [re:355] [di:complement] |
| 3922188_c3_13 | 4531 | 963 | 435 | 320 | 4.70E-41 | | [ac:p54538] [gn:yqja] [or:bacillus subtilis] [de:hypothetical 37.1 kd protein in bmru-ansr intergenic region] [sp:p54538] [db:swissprot] |
| 3923192_f2_20 | 4532 | 954 | 1009 | 317 | 7.00E-102 | | [ac:p37887] [gn:cysk] [or:bacillus subtilis] [ec:4.2.99.8] [de:(o-acetylserine (thiol)-lyase) (csase)] [sp:p37887] [db:swissprot] |
| 392328_f2_3 | 4533 | 801 | 105 | 266 | 0.002 | | [ac:q49418] [gn:mg327] [or:mycoplasma genitalium] [ec:3.1.—.—] [deputative esterase/lipase 2.] [sp:q49418] [db:swissprot] |
| 3924137_c3_28 | 4534 | 1968 | 1752 | 655 | 1.30E-180 | | [ac:f69794] [pn:dna ligase homolog yerg] [gn:yerg] [or:bacillus subtilis] [db:pir] |
| 3925068_f3_57 | 4535 | 558 | 173 | 185 | 2.70E-13 | | [ac:b69985] [pn:hypothetical protein yshb] [gn:yshb] [or:bacillus subtilis] [db:pir] |
| 3931502_f1_9 | 4536 | 2406 | 1753 | 801 | 1.00E-180 | | [ac:a69676] [pn:phenylalanyl-trna synthetase (beta subunit) phet] [gn:phet] [or:bacillus subtilis] [db:pir] |
| 3932650_f1_2 | 4537 | 243 | 89 | 80 | 0.0018 | | [ac:g69295] [pn:oxalate/formate antiporter (oxlt-2) homolog] [or:archaeoglobus fulgidus] [db:pir] |
| 3932687_c2_67 | 4538 | 303 | 296 | 100 | 2.50E-26 | | [ac:s52544] [pn:is12 protein] [or:lactobacillus helveticus] [db:pir] |
| 3932963_c2_43 | 4539 | 783 | 270 | 260 | 1.40E-23 | | [ac:p26422] [gn:lacr] [or:streptococcus mutans] [de:lactose phosphotransferase system repressor] [sp:p26422] [db:swissprot] |
| 3937561_c1_19 | 4540 | 1965 | 111 | 654 | 0.024 | | [ac:p52438] [gn:u30] [or:herpes simplex virus] [sr:type 7/ji,hhv7] [de:capsid assembly protein u30] [sp:p52438] [db:swissprot] |
| 3937588_f2_11 | 4541 | 807 | 244 | 268 | 8.10E-21 | | [ac:p39608] [gn:ywcj:jpa-48rj] [or:bacillus subtilis] [de:hypothetical 28.4 kd protein in sact-sacp intergenic region] [sp:p39608] [db:swissprot] |
| 3937842_c1_10 | 4542 | 1320 | 1207 | 439 | 7.30E-123 | | [ac:a69662] [pn:udp-n-acetylglucosamine 1-carboxyvinyltransferase mura] [gn:mura] |

TABLE 2-continued

| Orf | NT Seq ID | AA Seq ID | NT Orf Length | AA Orf Length | Score | Probability | Description |
|---|---|---|---|---|---|---|---|
| 3937875_c2_100 | 4543 | 2820 | 939 | 2707 | 8.10E-282 | | [or:*bacillus subtilis*] [db:pir] [ac:h69643] [pn:isoleucyl-trna synthetase iles] [gn:iles] [or:*bacillus subtilis*] [db:pir] |
| 3939625_f1_11 | 4544 | 330 | 109 | 375 | 1.10E-34 | | [ln:ab011419] [ac:ab011419] [pn:phospho-beta-galactosidase ii] [gn:pbg2] [or:*lactobacillus gasseri*] [sr:*lactobacillus gasseri*] [de:*lactobacillus gasseri* (strain:jcm 1031, isolate:human intestine] [db:genpept] [de:*lactobacillus gasseri* gene for phospho-beta-galactosidase ii, complete |
| 3943803_f1_18 | 4545 | 297 | 98 | 67 | 0.045 | | [ln:mtbxdha] [ac:148243] [pn:dehydrogenase] [gn:xdha] [or:*methylobacterium extorquens*] [db:genpept-bct] [de:*methylobacterium extorquens* dehydrogenase (xdha) gene, partial cds.] [le:<1] [re: |
| 3944452_c1_12 | 4546 | 360 | 119 | 334 | 2.40E-30 | | [ac:q02009] [or:*lactococcus lactis*] [sr:*subsplactis:streptococcus lactis*] [pn:hypothetical 13.3 kd protein in trpe 5'region] [spq02009] [dbswissprot] |
| 3945165_f2_10 | 4547 | 804 | 267 | 158 | 1.90E-09 | | [ln:mtv012] [ac:a1021287] [pn:hypothetical protein mtv012.53c] [gn:mtv012.53c] [or:*mycobacterium tuberculosis*] [db:genpept-bct] [de:*mycobacterium tuberculosis* sequence v012.] [nt:mtv012.53c, len: 327. unknown, low similarity to] [le:54433] [re:55416] [di: |
| 3945180_c1_9 | 4548 | 816 | 271 | 1432 | 5.00E-163 | | [ac:p09358] [gn:dpna] [or:*streptococcus pneumoniae*] [ec:2.1.1.72] [de:methyltransferase dpnii 2) (m.dpnii 2)] [sp:p09358] [dbswissprot] |
| 3945256_c1_77 | 4549 | 636 | 211 | 81 | 0.93 | | [ln:ab007892] [ac:ab007892] [gn:kiaa0432] [or:*homo sapiens*] [sr:*homo sapiens* male brain cdna to mrna, clone_lib:pbluescriptii s] [db:genpept-pri2] [de:*homo sapiens* kiaa0432 mrna, complete cds.] [le:964] [re:2967] [di:direct] |
| 3945463_f3_17 | 4550 | 909 | 302 | 1465 | 3.30E-150 | | [ln:ab003804] [ac:ab003804] [pn:gtp-binding protein] [gn:sgg] [or:*streptococcus gordonii*] [sr:*streptococcus gordonii* (strain:challis) dna] [db:genpept-bct] [de:*streptococcus gordonii* gene for gtp-binding protein, complete cds.] [le:61] [re:960] [di:direct] |
| 3946967_f3_57 | 4551 | 1329 | 442 | 725 | 8.70E-72 | | [ac:p35636] [gn:inva] [or:*zymomonas mobilis*] [ec:3.2.1.26] [de:(invertase e1)] [sp:35636] [dbswissprot] |
| 3947177_f3_49 | 4552 | 513 | 170 | 335 | 1.80E-30 | | [ac:p46543] [or:*lactobacillus delbrueckii*] [sr:subsplactis] [de:hypothetical 19.8 kd protein in pepi 3'region] [sp:p46543] [dbswissprot] |
| 3947305_f3_45 | 4553 | 726 | 241 | 462 | 6.40E-44 | | [ac:d64672] [pn:abc transporter, atp-binding protein] [or:*helicobacter pylori*] [db:pir] |
| 3948438_c1_166 | 4554 | 243 | 80 | 74 | 0.012 | | [ln:hpv3] [ac:x74462] [pn:envelope protein] [gn:e6] [or:human papillomavirus type 3] [db:genpept-vrl] [de:human papillomavirus type 3 genomic dna.] [le:114] [re:560] [di:direct] |
| 3948537_c3_219 | 4555 | 627 | 208 | 118 | 0.0002 | | [ac:s22452.s22069] [pn:surface exclusion protein seal precursor] [gn:seal] [or:*enterococcus faecalis*] [db:pir] |
| 3948592_f2_23 | 4556 | 1098 | 365 | 753 | 9.40E-75 | | [ln:pbu42580] [accu42580:u17055:u32570] [gn:a638r] [or:*paramecium bursaria chlorella virus 1*] [db:genpept-vrl] [de:*paramecium bursaria chlorella* virus 1, complete genome.] [le:307857] [re:308939] [di:direct] |
| 395167_c2_42 | 4557 | 435 | 144 | 291 | 8.50E-26 | | [ln:ssoorfs] [ac:z79691] [pn:orfc] [gn:yorfc] [or:*streptococcus pneumoniae*] [db:genpept-bct] [de:*s.pneumoniae* yorf[a,b,c,d,e], ftsl, pbpx and regr genes.] [le:2427] [re:2618] [di:direct] |
| 3953213_c2_44 | 4558 | 426 | 141 | 91 | 0.016 | | [ln:mhaj1652] [ac:aj001652] [pn:vaa surface lipoprotein adhesin precursor] [gn:vaa] [or:*mycoplasma hominis*] [db:genpept-bct] [de:*mycoplasma hominis* vaa gene, category 3, strain 4195.] [le:64] [re:1125] [di:direct] |
| 3955063_c3_79 | 4559 | 693 | 230 | 377 | 6.50E-35 | | [ac:d69786] [pn:glycoprotein endopeptidase homolog ydic] [gn:ydic] [or:*lactobacillus subtilis*] [db:pir] |
| 3958330_c3_39 | 4560 | 1407 | 468 | 481 | 6.20E-46 | | [ln:lpplsabkr] [ac:y15127] [pn:histidine kinase] [gn:plsk] [or:*lactobacillus plantarum*] [db:genpept-bct] [de:*lactobacillus plantarum* plsa, plsb, plsk & plsr genes.] [nt:putative] [le:2564] [re:3844] [di:direct] |
| 3960325_f1_5 | 4561 | 513 | 170 | 548 | 5.00E-53 | | [ac:p96053] [gn:recr:recm] [or:*streptococcus thermophilus*] [de:recombination protein |

TABLE 2-continued

| Orf | NT Seq ID | AA Seq ID | NT Orf Length | AA Orf Length | Score Probability | Description |
|---|---|---|---|---|---|---|
| 3961507_f3_40 | 4562 | 339 112 | 198 | 6.10E-16 | | recr] [sp:p96053] [db:swissprot] |
| 3961592_f2_22 | 4563 | 1791 596 | 3033 | 0 | | [ln:spz82002] [acz82002] [pn:pcpc] [gn:pcpc] [fn:unknown] [or:streptococcus pneumoniae] [db:genpept-bct] [des:pneumoniae pcpb and pcpe genes.] [nt:pcpc contains a choline binding domain] [le:1401] [re:2285] [di:direct] |
| 3963452_c2_21 | 4564 | 510 169 | 152 | 4.60E-11 | | [ln:strspxb] [ac:139074] [pn:pyruvate oxidase] [gn:spxb] [or:streptococcus pneumoniae] [db:genpept-bct] [des:streptococcus pneumoniae pyruvate oxidase (spxb) gene, complete cds.] [nt:tpp binding consensus sequence (x5,gly,asp,gly,] [le:154] [re:1929] [di:di |
| 3964092_c3_50 | 4565 | 744 247 | 113 | 0.00012 | | [ac:b70006] [pn:hypothetical protein yuai] [gn:yuai] [or:bacillus subtilis] [db:pir] [ln:af007261] [ac:af007261] [pn:channel subunit of abc transporter for] [gn:yejv] [or:mitochondrion reclinomonas americana] [sr:reclinomonas americana] [db:genpept-inv] [de:reclinomonas americana mitochondrial dna, complete genome.] [le:46089] [re:46763] |
| 3964713_f2_7 | 4566 | 954 317 | 785 | 3.80E-78 | | [ac:d65208:a93686:a91798:s05690:a05053:jv0023] [pn:homoserine o-succinyltransferase; homoserine o-transsuccinylase] [gn:meta] [cl:homoserine succinyltransferase] [or:escherichia coli] [ec:2.3.1.46] [db:pir] [mp:91] |
| 3985832_f3_13 | 4567 | 981 326 | 1000 | 6.30E-101 | | [ln:efaj3331] [ac:aj223331] [pn:carbamate kinase] [gn:arcc] [fn:synthesis of atp from carbamylphosphate] [or:enterococcus faecium] [db:genpept] [ec:2.7.2.2] [de:enterococcus faecium arcc gene, complete cds.] [le:1] [re:933] [di:direct] |
| 3987540_c3_35 | 4568 | 216 71 | 83 | 0.0083 | | [ln:af007261] [ac:af007261] [pn:secy-type transporter protein] [gn:secy] [or:mitochondrion reclinomonas americana] [sr:reclinomonas americana] [db:genpept-inv] [de:reclinomonas americana mitochondrial dna, complete genome.] [le:28012] [re:29244] [di:direc |
| 3992000_f2_33 | 4569 | 225 74 | 200 | 6.00E-16 | | [ln:spu11799] [ac:u11799] [or:streptococcus pyogenes] [db:genpept-bct] [de:streptococcus pyogenes insertion sequence is1239 putativetransposase gene, complete cds.] [nt:putative transposase] [le:379] [re:1359] [di:direct] |
| 3994002_c2_32 | 4570 | 714 237 | 1042 | 2.20E-105 | | [ac:q56037] [gn:deod] [or:streptococcus thermophilus] [ec:2.4.2.1] [de:(pnp) (fragment)] [sp:q56037] [dbswissprot] |
| 3995675_c1_159 | 4571 | 1494 497 | 486 | 1.80E-46 | | [ln:u88974] [ac:u88974] [pn:orf27] [or:streptococcus thermophilus] [db:genpept-bct] [de:streptococcus thermophilus bacteriophage 01205 dna sequence.] [nt:putative portal protein] [le:15560] [re:17065] [di:direct] |
| 4000443_f1_7 | 4572 | 1113 370 | 1008 | 8.90E-102 | | [ac:p43901] [gn:tyra] [or:lactococcus lactis] [sr:subsplactis:streptococcus lactis] [ec:1.3.1.12] [de:prephenate dehydrogenase, (pdh)] [sp:p43901] [dbswissprot] |
| 4000461_f3_22 | 4573 | 612 204 | 193 | 2.10E-15 | | [ac:q69879] [pn:hypothetical protein ylos] [gn:ylos] [or:bacillus subtilis] [db:pir] |
| 4001312_c3_242 | 4574 | 288 95 | 66 | 0.5 | | [ac:t0902] [pn:chaperonin 60 beta] [gn:cpn60 beta] [cl:chaperonin groel] [or:triticum aestivum] [sr:. common wheat] [db:pir] |
| 400412_f3_17 | 4575 | 258 85 | 104 | 5.50E-05 | | [ac:p95789] [gn:atpd] [or:streptococcus mutans] [ec:3.6.1.34] [de:atp synthase beta chain,] [sp:p95789] [dbswissprot] |
| 4011002_c3_25 | 4576 | 192 63 | 123 | 5.40E-08 | | [ln:spz82001] [ac:z82001] [pn:unknown] [or:streptococcus pneumoniae] [db:genpept-bct] [de:s.pneumoniae pcpa gene and open reading frames.] [le:<1] [re:174] [di:direct] |
| 4016088_c3_126 | 4577 | 669 222 | 417 | 3.80E-39 | | [ac:f69633] [or:streptococcus gordonii] [db:genpept-bct] [de:s.gordonii partial aldb gene, csha gene & flpa gene.] [le:8248] [re:9900] [di:complement] |
| 4016911_f1_6 | 4578 | 186 61 | 100 | 1.50E-05 | | [ac:c64671] [pn:hypothetical protein hp1211] [or:helicobacter pylori] [db:pir] |
| 4017135_c3_42 | 4579 | 1692 563 | 2215 | 1.10E-229 | | [ln:sgcshag] [ac:x65164:s52427] [pn:fibronectin-binding protein-like protein a] [gn:flpa] [or:streptococcus gordonii] [db:genpept-bct] [de:s.gordonii partial aldb gene, csha gene & flpa gene.] [le:8248] [re:9900] [di:complement] |
| 4017592_c2_112 | 4580 | 450 149 | 271 | 1.10E-23 | | [ln:shu75349] [ac:u75349] [pn:periplasmic-iron-binding protein shia] [or:serpulina hyodysenteriae] [db:genpept-bct] [de:serpulina hyodysenteriae shi-operon, periplasmic-iron-bindingproteins shia and shib, putative abc transporter shic, and putativepermeas |

TABLE 2-continued

| Orf | NT Seq ID | AA Seq ID | NT Orf Length | AA Orf Length | Score | Probability | Description |
|---|---|---|---|---|---|---|---|
| 4017592_c2_47 | 1978 | 4581 | 240 | 79 | 131 | 7.60E-09 | [ln:apu96137] [ac:u96137] [or:anabaena pcc7120] [db:genpept-bct] [de:anabaena pcc7120 apceabc gene cluster, phycobilisome core-membranelinker protein (apce), allophycocyanin alpha subunit (apca),allophycocyanin beta subunit (apcb) and phycobilisome core 1 |
| 4017592_c2_54 | 1979 | 4582 | 183 | 60 | 94 | 0.00038 | [ln:s80872] [ac:s80872] [gn:orf1 3′ ofant1 5′insertion site] [or:aspergillus niger] [sr:aspergillus niger transposon ant1 chlorate-resistant mutant 46] [db:genpept-pln] [de:orf1 3′ of ant1 5′insertion site {niad insertion site}[aspergillus niger, chlor |
| 4019662_f2_19 | 1980 | 4583 | 246 | 81 | 273 | 6.90E-24 | [ln:strcomaa] [ac:m36180:115190] [pn:transposase] [or:streptococcus pneumoniae] [sr:streptococcus pneumoniae (strain rx1) dna] [db:genpept-bct] [de:streptococcus pneumoniae transposase, (coma and comb) and saicarsynthetase (purc) genes, complete cds.] [nt |
| 4023500_c3_146 | 1981 | 4584 | 297 | 98 | 53 | 0.58 | [ln:sneliptra] [ac:133791] [pn:lipid transfer protein] [or:senecio odorus] [sr:senecio odorus cdna to mrna] [db:genpept-pln] [de:senecio odorus lipid transfer protein mrna, 3′ end.] [le:<1] [re:272] [di:direct] |
| 4026703_f3_38 | 1982 | 4585 | 1644 | 547 | 1087 | 3.80E-110 | [ln:lmu15554] [ac:u15554] [pn:p-type adenosine triphosphatase] [gn:ctpa] [fn:involved in cation transport] [or:listeria monocytogenes] [db:genpept-bct] [de:listeria monocytogenes p-type adenosine triphosphatase (ctpa) gene,partial cds.] [nt:similar to ent |
| 4031693_c1_35 | 1983 | 4586 | 297 | 98 | 72 | 0.046 | [ac:h69402] [pn:hypothetical protein af1225] [or:archaeoglobus fulgidus] [db:pir] |
| 4032812_c2_67 | 1984 | 4587 | 709 | 194 | 585 | 4.30E-70 | [ln:spgyrbg] [ac:x83917] [gn:orflgyrb] [or:streptococcus pneumoniae] [db:genpept-bct] [de:s.pneumoniae orflgyrb and gyrb gene encoding dna gyrase b subunit.] [le:<1] [re:437] [di:direct] |
| 4032812_f3_43 | 1985 | 4588 | 1068 | 355 | 1147 | 1.70E-116 | [ac:q46127] [gn:trps:trsa] [or:clostridium longisporum] [ec:6.1.1.2] [de:(trps)] [sp:q46127] [db:swissprot] |
| 4033187_f1_4 | 1986 | 4589 | 441 | 146 | 60 | 0.39 | [ln:mmu91573] [ac:u91573] [pn:glucose-6-phosphatase] [gn:g6pase] [or:mus musculus sr:house mouse] [db:genpept-rod] [de:mus musculus glucose-6-phosphatase (g6pase) gene, exon 1 andpartial cds.] [re:834] [re: |
| 4035910_f1_21 | 1987 | 4590 | 492 | 163 | 654 | 2.90E-64 | [ac:p42920] [gn:rplc] [or:bacillus subtilis] [de:50s ribosomal protein 13 (b13)] [sp:p42920] [db:swissprot] |
| 40637_f1_11 | 1988 | 4591 | 186 | 61 | 112 | 7.90E-07 | [ln:spnana] [ac:x72967] [or:streptococcus pneumoniae] [db:genpept-bct] [de:s.pneumoniae nana gene.] [nt:orf2] [le:193] [re:495] [di:direct] |
| 4064062_f1_9 | 1989 | 4592 | 371 | 567 | 1704 | 5.50E-34 | [ac:p17867] [gn:cisa:spoivca] [or:bacillus subtilis] [de:putative dna recombinase] [sp:p17867] [db:swissprot] |
| 406681_f2_39 | 1990 | 4593 | 49 | 62 | 189 | 0.064 | [ln:ae001160] [ac:ae001160:ac000783] [pn:competence locus e, putative] [gn:bb0591] [or:borrelia burgdorferi] [sr:lyme disease spirochete] [db:genpept-bct] [de:borrelia burgdorferi (section 46 of 70) of the complete genome] [nt:similar to gb:115202 sp:p39 |
| 4067765_c1_34 | 1991 | 4594 | 324 | 151 | 456 | 2.70E-29 | [ac:o07513] [gn:hit] [or:bacillus subtilis] [de:hit protein] [sp:o07513] [db:swissprot] |
| 4070463_f3_19 | 1992 | 4595 | 2117 | 659 | 1980 | 2.70E-219 | [ac:p22976] [gn:recp] [or:streptococcus pneumoniae] [ec:2.2.1.1] [de:probable transketolase, (tk)] [sp:p22976] [db:swissprot] |
| 4078336_f2_1 | 1993 | 4596 | 2456 | 617 | 1854 | 3.20E-255 | [ac:p22976] [gn:recp] [or:streptococcus pneumoniae] [ec:2.2.1.1] [de:probable transketolase, (tk)] [sp:p22976] [db:swissprot] |
| 4078588_c1_46 | 1994 | 4597 | 236 | 107 | 324 | 5.70E-20 | [ac:p46319] [gn:celc] [or:bacillus subtilis] [ec:2.7.1.69] [de:(ec 2.7.1.69) (eiii-cel)] [sp:p46319] [db:swissprot] |
| 4080007_c2_68 | 1995 | 4598 | 33 | 112 | 339 | 0.91 | [ac:p48883] [gn:clpp] [or:hordeum vulgare] [sr:barley] [ec:3.4.21.92] [de:(fragment)] [sp:p48883] [db:swissprot] |
| 4080262_f3_15 | 1996 | 4599 | 1690 | 360 | 1083 | 4.80E-174 | [ac:q54513] [or:streptococcus pneumoniae] [de:transposase for insertion sequence is1202] [sp:q54513] [db:swissprot] |
| 4085900_c3_67 | 1997 | 4600 | 1963 | 400 | 1203 | 5.60E-203 | [ln:spdnaarg] [ac:af000658] [pn:putative serine protease] [gn:sphtra] [or:streptococcus pneumoniae] [db:genpept-bct] [de:streptococcus pneumoniae r801 trna-arg gene, partial |

TABLE 2-continued

| Orf | NT Seq ID | AA Seq ID | NT Orf Length | AA Orf Length | Score | Probability | Description |
|---|---|---|---|---|---|---|---|
| 40881_f2_10 | 1998 | 4601 | 933 | 310 | 1076 | 5.50E-109 | sequence, andputative serine protease (sphtra), spspoj (spspoj). initiatorprotein [ac:p23391] [gn:lacc] [or:lactococcus lactis] [sr,subsplactis:streptococcus lactis] [ec:2.7.1.—] [de:tagatose-6-phosphate kinase, (phosphotagatokinase)] [sp:p23391] [db:swissprot] |
| 4094713_c3_51 | 1999 | 4602 | 990 | 329 | 887 | 5.90E-89 | [ln:ehy13922] [ac:y13922;y15222] [gn:mray] [or:enterococcus hirae] [db:genpept-bct] [de:enterococcus hirae mrai, pbp3s, mray, murd, murg, ftsq and ftsagenes, mraw, yllc and ftsz partial genes.] [le:4104] [re:5069] [di:direct] |
| 4095317_c1_12 | 2000 | 4603 | 990 | 329 | 1485 | 2.50E-152 | [ac:p05382] [gn:sula] [or:streptococcus pneumoniae] [ec:2.5.1.15] [de:pyrophosphorylase] [sp:p05382] [db:swissprot] |
| 4095328_c1_20 | 2001 | 4604 | 2073 | 690 | 641 | 6.90E-63 | [ln:mtcy71] [ac:z92771] [pn:unknown] [gn:mtcy71.10] [or:mycobacterium tuberculosis] [de:mycobacterium tuberculosis cosmid y71.] |
| 4095337_c1_49 | 2002 | 4605 | 1068 | 355 | 425 | 5.40E-40 | nt:mtcy71.10, cation transport atpase, len: 718 aa,] [le:10205] [re:12361] [di:direct] [ln:ae001176] [ac:ae001176:ae000783] [pn:udp-n-acetylglucosamine-n-acetylmuramyl-] [gn:bb0767] [or:borrelia burgdorferi] [sr:lyme disease spirochete] [db:genpept-bct] [de:borrelia burgdorferi (section 62 of 70) of the complete genome.] [nt:similar to gb: |
| 4095443_f3_31 | 2003 | 4606 | 240 | 79 | 156 | 1.70E-11 | [ac:b69770] [pn:conserved hypothetical protein ydas] [gn:ydas] [or:bacillus subtilis] [db:pir] |
| 40968_c1_22 | 2004 | 4607 | 525 | 286 | 861 | 1.40E-50 | [ac:q58094] [gn:mj0681] [or:methanococcus jannaschii] [ec:2.2.1.1] [de:putative transketolase n-terminal section, (tk)] [sp:q58094] [db:swissprot] |
| 4100425_f1_1 | 2005 | 4608 | 150 | 86 | 261 | 7.40E-11 | [ac:c69701] [pn:ribosomal protein s20 (bs20) rpst] [gn:rpst] [or:bacillus subtilis] [db:pir] |
| 4100453_f1_10 | 2006 | 4609 | 54 | 0.57 | 1419 | 472 | [ln:hiv1u13498] [acu13498] [pn:envelope glycoprotein v1v2 region] [gn:env] [or:human immunodeficiency virus type 1] [db:genpept-vrl] [de:human immunodeficiency virus type 1, isolate 020 from brazil,envelope glycoprotein (env) gene, v1v2 region, partial c |
| 4101062_c3_115 | 2007 | 4610 | 82 | 0.022 | 240 | 79 | [ac:a56034] [pn:insulin activator factor] [or:homo sapiens] [sr:, man] [db:pir] |
| 4101592_c3_36 | 2008 | 4611 | 429 | 2.00E-40 | 585 | 194 | [ac:s52544] [pn:is12 protein] [or:lactobacillus helveticus] [db:pir] |
| 4101687_f2_7 | 2009 | 4612 | 1589 | 2.40E-163 | 2364 | 787 | [ac:g70027] [pn:conserved hypothetical protein yvaj] [gn:yvaj] [or:bacillus subtilis] [db:pir] |
| 4101693_c3_31 | 2010 | 4613 | 845 | 1.70E-84 | 474 | 157 | [ac:p41354] [gn:mutx] [or:streptococcus pneumoniae] [ec:3.6.1.—] [de:(8-oxo-dgtpase), (dgtp pyrophohydrolase)] [sp:p41354] [db:swissprot] |
| 4102318_f1_2 | 2011 | 4614 | 1144 | 3.50E-116 | 846 | 281 | [ac:p04257] [gn:rplb] [or:bacillus stearothermophilus] [de:50s ribosomal protein 12] [sp:p04257] [db:swissprot] |
| 4103127_c3_65 | 2012 | 4615 | 2409 | 3.10E-250 | 1866 | 621 | [ac:e69872] [pn:gtp-binding elongation factor homolog ylag] [gn:ylag] [or:bacillus subtilis] [db:pir] |
| 4103516_c1_73 | 2013 | 4616 | 286 | 2.90E-25 | 357 | 118 | [ac:b69970] [pn:transcriptional regulator (merr family) homolog yrab] [gn:yrab] [or:bacillus subtilis] [db:pir] |
| 4104693_c1_28 | 2014 | 4617 | 1853 | 2.60E-191 | 1059 | 352 | [ln:af030359] [ac:af030359] [pn:dtdp-glucose-4,6-dehydratase] [gn:cpsn] [or:streptococcus pneumoniae] [db:genpept-bct] [de:streptococcus pneumoniae strain nctc11906 glucose-1-phosphatethymidyl transferase (cpsl) gene, partial cds; anddtdp-4-keto-6-deoxygl |
| 4105263_f2_19 | 2015 | 4618 | 419 | 2.30E-39 | 963 | 320 | [ac:g70003] [pn:hypothetical protein yyxk] [gn:ytxk] [or:bacillus subtilis] [db:pir] |
| 4105330_f1_11 | 2016 | 4619 | 847 | 7.10E-156 | 1866 | 621 | [ac:g69682] [pn:prolyl-trna synthetase pros] [gn:pros] [or:bacillus subtilis] [db:pir] |
| 4109462_f1_3 | 2017 | 4620 | 738 | 3.60E-73 | 1185 | 394 | [ac:p39587] [gn:ywbdipa-19d] [or:bacillus subtilis] [de:hypothetical 44.4 kd protein in epr-galk intergenic region] [sp:p39587] [db:swissprot] |
| 4112557_f1_1 | 2018 | 4621 | 276 | 3.30E-24 | 828 | 275 | [ac:h64428] [pn:magnesium and cobalt transport protein homolog] [or:methanococcus jannaschii] [db:pir] [mp:for965089–966042] |
| 4117132_f2_18 | 2019 | 4622 | 157 | 1.30E-11 | 597 | 198 | [ac:b69524] [pn:rrna (adenine-n6)-methyltransferase homolog] [or:archaeoglobus fulgidus] [db:pir] |

TABLE 2-continued

| Orf | NT Seq ID | AA Seq ID | NT Orf Length | AA Orf Length | Score | Probability | Description |
|---|---|---|---|---|---|---|---|
| 4119012_c2_67 | 4623 | 243 | 80 | 209 | 4.20E-17 | | [ac:p39579] [gn:dltc:ipa-3r] [or:bacillus subtilis] [de:d-alanyl carrier protein (dcp)] [sp:p39579] [db:swissprot] |
| 4119052_c2_79 | 4624 | 732 | 243 | 402 | 1.50E-37 | | [ac:p35154] [gn:ypug] [or:bacillus subtilis] [de:hypothetical 29.6 kd protein in ribt-dacb intergenic region (orfx7)] [sp:p35154] [db:swissprot] |
| 4119062_c1_21 | 4625 | 948 | 315 | 246 | 5.00E-21 | | [ln:nmu65788] [acu65788] [pn:glycosyl transferase] [gn:lgtc] [or:neisseria meningitidis] [db:genpept-bct] [de:neisseria meningitidis strain 126e glycyl trna synthetase (glys)gene, partial cds, and lps biosynthetic gene locus, lgta/lgtb,lgtc, lgtd, and lg |
| 4146882_f1_13 | 4626 | 639 | 212 | 102 | 0.0022 | | [ac:c69816] [pn:hypothetical protein ygai] [gn:ygai] [or:bacillus subtilis] [db:pir] |
| 4146950_f3_56 | 4627 | 1713 | 570 | 240 | 2.80E-17 | | [ac:p37966] [gn:lpla] [or:bacillus subtilis] [de:lipoprotein lpla precursor] [sp:p37966] [db:swissprot] |
| 4149018_f3_33 | 4628 | 2268 | 755 | 1919 | 5.50E-206 | | [ac:a96601] [pn:atp-dependent clp proteinase-like protein clpe] [gn:clpe] [or:bacillus subtilis] [db:pir] |
| 4151511_c2_38 | 4629 | 585 | 194 | 331 | 4.90E-30 | | [ac:p43984] [gn:hi0318] [or:haemophilus influenzae] [de:hypothetical protein hi0318] [sp:p43984] [db:swissprot] |
| 4151693_f1_6 | 4630 | 1176 | 391 | 1090 | 1.80E-110 | | [ac:q59803] [gn:aroc] [or:staphylococcus aureus] [ec:4.6.1.4] [de:phospholyase] [sp:q59803] [db:swissprot] |
| 4152217_f2_11 | 4631 | 1476 | 491 | 350 | 4.20E-30 | | [ac:f69848] [pn:transcriptional antiterminator (bglg famil) homolog yjdc] [gn:yjdc] [or:bacillus subtilis] [db:pir] |
| 417068_f2_26 | 4632 | 654 | 217 | 444 | 5.20E-42 | | [ac:q02002] [gn:tpf] [or:lactococcus lactis] [sr:subsplactis:streptococcus lactis] [ec:5.3.1.24] [de:n-(5′-phosphoribosyl)anthranilate isomerase, (prai)] [sp:q02002] [db:swissprot] |
| 4173463_c1_27 | 4633 | 558 | 185 | 111 | 1.10E-06 | | [ac:p20298] [or:pyrococcus woesei] [de:hypothetical protein in gapdh 3′region (orf x) (fragment)] [sp:p20298] [db:swissprot] |
| 4173468_c1_15 | 4634 | 573 | 190 | 109 | 6.10E-05 | | [ac:h69908] [pn:phage-related protein homolog yokl] [gn:yokl] [or:bacillus subtilis] [db:pir] |
| 4173577_c2_67 | 4635 | 795 | 264 | 694 | 1.70E-68 | | [ac:f69742] [pn:hypothetical protein ybaf] [gn:ybaf] [or:bacillus subtilis] [db:pir] |
| 4176260_f3_47 | 4636 | 267 | 88 | 66 | 0.43 | | [ln:pbu42580] [acu42580:u17055:u32570] [gn:a2561] [or:paramecium bursaria chlorella virus 1] [db:genpept-vrl] [de:paramecium bursaria chlorella virus 1, complete genome.] [le:129625] [re:130860] [di:complement] |
| 4178570_f2_22 | 4637 | 396 | 131 | 205 | 1.70E-16 | | [ac:p23877:p77587] [gn:fepg] [or:escherichia coli] [de:ferric enterobactin transport protein fepg] [sp:p23877:p77587] [db:swissprot] |
| 4179663_f1_13 | 4638 | 189 | 62 | 69 | 0.34 | | [ln:ae001131] [ac:ae001131:ae000783] [pn:b. burgdorferi predicted coding region bb0208] [gn:bb0208] [or:borrelia burgdorferi] [sr:lyme disease spirochete] [db:genpept-bct] [de:borrelia burgdorferi (section 17 of 70) of the complete genome.] [nt:hypothetic |
| 4179702_f3_26 | 4639 | 1488 | 495 | 459 | 1.30E-43 | | [ln:naf004325] [ac:af004325] [pn:putative oligosaccharide repeat unit] [gn:cps19bj] [or:streptococcus pneumoniae] [db:genpept-bct] [de:streptococcus pneumoniae capsular serotype 19b capsule biosynthesislocus, cps 19bf gene, partial cds, cps19bg, cps19bh, cp |
| 4179837_c3_69 | 4640 | 1473 | 490 | 1246 | 5.40E-127 | | [ac:i41293] [pn:ecoe type i restriction modification enzyme m subunit] [or:escherichia coli] [db:pir] |
| 4179838_f2_16 | 4641 | 996 | 331 | 1126 | 2.80E-114 | | [ac:p44779] [gn:fuci:hi0614] [or:haemophilus influenzae] [ec:5.3.1.—] [de:1-fucose isomerase,] [sp:p44779] [db:swissprot] |
| 4180385_c2_102 | 4642 | 2421 | 806 | 78 | 0.064 | | [ln:hpu21867] [acu21867] [pn:11 protein] [or:human papillomavirus type 23] [db:genpept-vrl] [de:human papillomavirus type 23 11 protein gene, partial cds.] [le:<1] [re: |
| 4183578_c1_25 | 4643 | 1158 | 385 | 1581 | 1.70E-162 | | [ln:spu09239] [ac:u09239] [pn:possible polysaccharide transport protein] [gn:cps19fj] [or:streptococcus pneumoniae] [db:genpept-bct] [de:streptococcus pneumoniae type 19f capsular polysaccharidebiosynthesis operon, (cps19fabcdefghijklmno) genes complete |
| 4188762_c3_51 | 4644 | 984 | 327 | 1076 | 5.50E-109 | | [ac:q54321] [gn:pyrda] [or:lactococcus lactis] [sr:subspcremonis:streptococcus |

TABLE 2-continued

| Orf | NT Seq ID | AA Seq ID | NT Orf Length | AA Orf Length | Score | Probability | Description |
|---|---|---|---|---|---|---|---|
| 4191902_c2_14 | 2042 | 4645 | 264 | 87 | 428 | 2.00E-39 | cremoris] [ec:1.3.3.1] [de:(dlhodehase a) (dlhoda)] [sp:p54321] [db:swissprot] |
| 4194052_c2_107 | 2043 | 4646 | 240 | 79 | 131 | 7.60E-09 | [ac:p10564] [gn:hexa] [or:streptococcus pneumoniae] [de:dna mismatch repair protein hexa] [sp:p10564] [db:swissprot] |
| 4199013_f3_14 | 2044 | 4647 | 279 | 92 | 246 | 2.00E-20 | [ln:spz82001] [ac:z82001] [pn:unknown] [or:streptococcus pneumoniae] [db:genpept-bct] [de:s.pneumoniae pcpa gene and open reading frames.] [le:<1] [re:174] [di:direct] [ac:f69806] [pn:rna methyltransferase homolog yfjo] [gn:yf[o] [or:bacillus subtilis] [db:pir] |
| 422768_f3_28 | 2045 | 1884 | 627 | 1883 | 1.70E-194 | [ac:p14951] [gn:uvrc] [or:bacillus subtilis] [de:excinuclease abc subunit c] [sp:p14951] [db:swissprot] |
| 429526_c2_111 | 2046 | 4649 | 498 | 165 | 64 | 0.2 | [ac:p45649] [or:coxiella burnetii] [de:hypothetical 9.9 kd protein in rpa 3'region] [sp:p45649] [db:swissprot] |
| 429693_f2_24 | 2047 | 1368 | 455 | 947 | 2.60E-95 | [ac:b69618] [pn:dna polymerase iii (gamma and tau subunits) dnax] [gn:dnax] [or:bacillus subtilis] [db:pir] |
| 4297653_c1_11 | 2048 | 213 | 70 | 50 | 0.42 | [ln:af014479] [ac:af014479] [pn:ma5elp28] [gn:5el] [or:african swine fever virus] [db:genpept-vrl] [de:african swine fever virus ikb-like protein mal5elp28 (5el) gene, complete cds.] [nt:ikb-like protein; encodes four ankyrin motifs] [le:1] [re:720] [di:d |
| 4328392_f1_4 | 2049 | 348 | 115 | 194 | 1.60E-15 | [ac:a69785] [pn:cellobiose phosphotransferase system enzym homolog ydhm] [gn:ydhm] [or:bacillus subtilis] [db:pir] |
| 4328583_c2_24 | 2050 | 714 | 237 | 133 | 4.40E-07 | [ac:p50389] [gn:mtap] [or:sulfolobus solfataricus] [ec:2.4.2.28] [de:phosphorylase] [sp:p50389] [db:swissprot] |
| 4328963_f2_4 | 2051 | 555 | 184 | 423 | 8.70E-40 | [ac:p54570] [gn:ykg] [or:bacillus subtilis] [de:hypothetical 21.0 kd protein in glnq-ansr intergenic region] [sp:p54570] [db:swissprot] |
| 4329093_c3_31 | 2052 | 246 | 81 | 122 | 1.10E-07 | [ac:c64146] [pn:hypothetical protein hi0259] [or:haemophilus influenzae] [db:pir] |
| 4329842_c2_69 | 2053 | 999 | 332 | 821 | 5.80E-82 | [ac:g69830] [pn:lipoate-protein ligase homolog yhfi] [gn:yhfi] [or:bacillus subtilis] [db:pir] |
| 4331250_c1_13 | 2054 | 213 | 70 | 61 | 0.18 | [ac:s06427] [pn:phospholipid transfer protein homolog:amylase/proteinase inhibitor homolog.] [cl:phospholipid transfer protein] [or:oryza sativa] [sr:, rice] [db:pir] |
| 4331713_f1_1 | 2055 | 1047 | 348 | 1020 | 4.80E-103 | [ac:g64507] [pn:hypothetical protein mj1665] [or:methanococcus jannaschii] [db:pir] [mp:rev1648556-1647180] |
| 4332000_f3_15 | 2056 | 477 | 158 | 498 | 9.80E-48 | [ac:p12044] [gn:pure] [or:bacillus subtilis] [ec:4.1.1.21] [de:(ec 4.1.1.21) (air carboxylase) (airc)] [sp:p12044] [db:swissprot] |
| 4333393_c3_55 | 2057 | 561 | 186 | 194 | 1.60E-15 | [ac:p05332] [gn:p20] [or:bacillus licheniformis] [de:hypothetical p20 protein] [sp:p05332] [db:swissprot] |
| 4334453_c1_21 | 2058 | 1455 | 484 | 2231 | 2.20E-231 | [ln:af030373] [ac:af030373] [pn:putative regulatory protein] [gn:cpsa] [or:streptococcus pneumoniae] [db:genpept-bct] [de:streptococcus pneumoniae strain sp-264 alpha, 1-6-glucosidase(dexb) gene, partial cds; putative regulatory protein (cpsa) andcpsb (cp |
| 4336515_c3_68 | 2059 | 768 | 255 | 1225 | 9.00E-125 | [ln:spdnaarg] [ac:af000658] [pn:spspo] [gn:spspoj] [de:streptococcus pneumoniae r801 trna-arg gene, partial sequence, andputative serine protease (sphtra), spspoj (spspo), initiatorprotein (spd |
| 4336687_c3_16 | 2060 | 825 | 274 | 1389 | 3.80E-142 | [ln:spu16156] [ac:u16156:m17362:m58706] [fn: folate biosynthesis] [or:streptococcus pneumoniae] [db:genpept-bct] [de:streptococcus pneumoniae dihydropteroate synthase (sula),dihydrofolate synthetase (s |
| 4338380_f3_4 | 2061 | 216 | 71 | 132 | 6.00E-09 | [ln:cet04f8] [ac:z66565] [pn:t04f8.8] [or:caenorhabditis elegans] [db:genpept-inv] [de:caenorhabditis elegans cosmid t04f8, complete sequence.] [nt:cdna est yk121f1.5 comes from this gene] [le:34969] [re:35259] [di:direct] |
| 4339405_c2_25 | 2062 | 285 | 94 | 79 | 0.027 | [ac:p37349:p76013] [gn:ygce] [or:escherichia coli] [de:hypothetical 51.6 kd protein in trea-pth intergenic region] [sp:p37349:p76013] [db:swissprot] |

TABLE 2-continued

| Orf | NT Seq ID | AA Seq ID | NT Orf Length | AA Orf Length | Score | Probability | Description |
|---|---|---|---|---|---|---|---|
| 4339808_c3_34 | 2063 | 4666 | 1017 | 338 | 709 | 4.30E-70 | [ac:p46317] [gn:celb] [or:bacillus subtilis] [de:permease iic component) (phosphotransferase enzyme ii, c component)] [sp:p46317] [db:swissprot] |
| 4344637_f2_22 | 2064 | 4667 | 723 | 240 | 74 | 0.2 | [ac:q58589] [gn:mj1189] [or:methanococcus jannaschii] [de:hypothetical protein mj1189] [sp:q58589] [db:swissprot] |
| 4345887_f3_24 | 2065 | 4668 | 516 | 171 | 364 | 1.60E-33 | [ac:p37872] [gn:ybxb] [or:bacillus subtilis] [de:(orf23)] [sp:p37872] [db:swissprot] |
| 4350068_c3_36 | 2066 | 4669 | 1422 | 473 | 1221 | 2.40E-124 | [ac:p11175] [gn:lacg] [or:staphylococcus aureus] [ec:3.2.1.85] [de:galactohydrolase] (pgalase) (p-beta-gal) (pbg)] [sp:p11175] [db:swissprot] |
| 4351462_f2_3 | 2067 | 4670 | 192 | 63 | 65 | 0.15 | [ac:p31970] [gn:gltx] [or:synechococcus sp] [sr:pcc 7002,agmenellum quadruplicatum] [ec:6.1.1.17] [de:(glurs) (fragment)] [sp:p31970] [db:swissprot] |
| 4352137_f1_9 | 2068 | 4671 | 489 | 162 | 781 | 1.00E-77 | [ln:spdnaarg] [ac:af000658] [fn:unknown] [or:streptococcus pneumoniae] [db:genpept-bct] [de:streptococcus pneumoniae r801 trna-arg gene, partial sequence, anputative serine protease (sphtra), spspoj (spspoj), initiatorprotein (spdnaa) and beta subunit of |
| 4353212_f3_2 | 2069 | 4672 | 864 | 287 | 173 | 4.30E-13 | [ac:p08511] [gn:sh] [or:drosophila melanogaster] [sr:,fruit fly] [de:potassium channel protein, late population (shaker-beta)] [sp:p08511] [db:swissprot] |
| 4354840_f3_18 | 2070 | 4673 | 891 | 296 | 75 | 0.038 | [ac:s44477] [pn:nadh dehydrogenase (ubiquinone), chain 41] [gn:nd41] [cl:nadh dehydrogenase (ubiquinone) chain 41] [or:mitochondrion hansenula wingei] [ec:1.6.5.3] [db:pir] |
| 4355192_c2_8 | 2071 | 4674 | 438 | 145 | 287 | 2.30E-25 | [ac:p44202] [gn:hi1454] [or:haemophilus influenzae] [de:hypothetical cytochrome c-type biogenesis protein hi1454] [sp:p44202] [db:swissprot] |
| 4376643_f1_4 | 2072 | 4675 | 1341 | 446 | 416 | 7.70E-72 | [ac:s43914] [pn:hypothetical protein 1] [or:bacillus stearothermophilus] [db:pir] |
| 4380093_f1_8 | 2073 | 4676 | 216 | 71 | 64 | 0.092 | [ln:celc30e1] [ac:af026204] [gn:c30e1.1] [or:caenorhabditis elegans] [sr:caenorhabditis elegans strain=bristol n2] [db:genpept-inv] [de:caenorhabditis elegans cosmid c30e1.] [le:13826.14163] [re:13931.14314] [di:direct] |
| 4380093_f1_15 | 2074 | 4677 | 216 | 71 | 64 | 0.092 | [ln:celc30e1] [ac:af026204] [gn:c30e1.1] [or:caenorhabditis elegans] [sr:caenorhabditis elegans strain=bristol n2] [db:genpept-inv] [de:caenorhabditis elegans cosmid c30e1.] [le:13826.14163] [re:13931.14314] [di:direct] |
| 4391013_c2_43 | 2075 | 4678 | 360 | 120 | 81 | 0.019 | [ac:s75406] [pn:hypothetical protein c04040] [or:sulfolobus solfataricus] [db:pir] |
| 4392183_f2_25 | 2076 | 4679 | 351 | 116 | 74 | 0.1 | [ln:ehy14328] [ac:y14328] [pn:3e1 protein] [or:entamoeba histolytica] [db:genpept-inv] [de:entamoeba histolytica mrna for 3e1 protein,] [le:32] [re:418] [di:direct] |
| 4392338_c3_8 | 2077 | 4680 | 1500 | 499 | 1694 | 1.80E-174 | [ac:p37477] [gn:lyss] [or:bacillus subtilis] [ec:6.1.1.6] [de:lysyl-trna synthetase, (lysine-trna ligase) (lysrs)] [sp:p37477] [db:swissprot] |
| 4395178_c3_19 | 2078 | 4681 | 288 | 95 | 71 | 0.11 | [ac:p33502] [gn:nd1] [or:anopheles quadrimaculatus] [sr:,mosquito] [ec:1.6.5.3] [de:nadh-ubiquinone oxidoreductase chain 1,] [sp:p33502] [db:swissprot] |
| 4407838_f2_29 | 2079 | 4682 | 594 | 197 | 350 | 4.70E-32 | [ac:b44070.s27552] [gn:phosphotransferase system enzyme ii, asc] [or:escherichia coli] [ec:2.7.1.69] [db:pir] |
| 4413341_f1_3 | 2080 | 4683 | 225 | 74 | 113 | 1.70E-06 | [ac:p44068] [gn:hi0882] [or:haemophilus influenzae] [de:hypothetical protein hi0882] [sp:p44068] [db:swissprot] |
| 4414713_c1_81 | 2081 | 4684 | 549 | 182 | 154 | 2.80E-11 | [ac:f69876] [pn:conserved hypothetical protein ylmf] [gn:ylmf] [or:bacillus subtilis] [db:pir] |
| 4414831_c1_32 | 2082 | 4685 | 192 | 63 | 46 | 0.43 | [ac:s50856] [pn:whn protein] [cl:unassigned fork head proteins:fork head dna-binding domain homology] [or:rattus norvegicus] [sr:, norway rat] [db:pir] |
| 4422075_f1_1 | 2083 | 4686 | 1083 | 360 | 1238 | 3.80E-126 | [ln:llu74322] [ac:u74322] [pn:6-phosphogluconate dehydrogenase] [or:lactococcus lactis] [db:genpept-bct] [ec:1.1.1.44] [de:lactococcus lactis 6-phosphogluconate dehydrogenase gene, completecds, and potassium transporter homolog gene, partial cds.] [le:898 |
| 4422963_c3_58 | 2084 | 4687 | 342 | 113 | 234 | 9.30E-20 | [ac:p45677] [gn:peb1c] [or:campylobacter jejuni] [de:probable abc transporter atp-binding protein peb1c] [sp:p45677] [db:swissprot] |
| 4424050_c1_78 | 2085 | 4688 | 249 | 82 | 76 | 0.22 | [ln:cer10e8] [ac:z81576] [pn:r10e8.e] [or:caenorhabditis elegans] [db:genpept-inv] [de:caenorhabditis elegans cosmid r10e8, complete sequence.] [nt:protein predicted |

TABLE 2-continued

| Orf | NT Seq ID | AA Seq ID | NT Orf Length | AA Orf Length | Score | Probability | Description |
|---|---|---|---|---|---|---|---|
| 444050_c1_27 | 2086 | 381 | 378 | 126 | | 5.10E-35 | using genefinder; preliminary [ ][e:251:2228:2985:4079:4338][re:657:2930:3253:4295:4757] [fn:spnana] [ac:x72967] [or:streptococcus pneumoniae] [db:genpept-bct] [de:s.pneumoniae nana gene.] [nt:orf2] [le:193] [re:495] [di:direct] |
| 445312_c1_39 | 2087 | 210 | 60 | 69 | | 0.042 | [fn:spac17a2] [ac:z9929] [pn:hypothetical protein] [gn:spac17a2.11] [or:schizosaccharomyces pombe] [sr:fission yeast] [db:genpept-pln] [de:s.pombe chromosome i cosmid c17a2.] [nt:author-given protein sequence is in conflict with] [le:26511] [re:27413] [d |
| 4453568_f2_34 | 2088 | 627 | 148 | 208 | | 1.00E-09 | [fn:d90818] [ac:d90818:ab001340] [gn:yqed] [or:escherichia coli] [sr:escherichia coli (strain:k12) dna, clone_lib:kohara lambda minise] [db:genpept-bct] [de:e.coli genomic dna, kohara clone #327(39.2–39.5 min.).] [nt:orf_id:o327#7; similar to [swissprot a |
| 4454713_f2_17 | 2089 | 639 | 337 | 212 | | 1.10E-30 | [ac:p50846] [gn:kdga] [or:bacillus subtilis] [ec:4.1.3.16:4.1.2.14] [de:(2-keto-3-deoxy-6-phosphogluconate aldolase) (kdpg-aldolase)] [sp:p50846] [dbsswissprot] |
| 446900_f2_22 | 2090 | 1167 | 685 | 388 | | 1.50E-67 | [ac:39301] [gn:sgat] [or:escherichia coli] [de:sgat protein] [sp:p39301] [dbsswissprot] |
| 447177_c3_51 | 2091 | 633 | 446 | 210 | | 3.20E-42 | [ac:39788] [gn:nth:joob] [or:bacillus subtilis] [ec:4.2.99.18] [de:apyrimidinic site) lyase)] [sp:39788] [dbsswissprot] [d |
| 4476693_c3_16 | 2092 | 354 | 195 | 117 | | 1.30E-15 | [ac:p26942] [gn:ysxb] [or:bacillus subtilis] [de:hypothetical 12.3 kd protein in plu-rpma intergenic region (orf x)] [sp:p26942] [dbsswissprot] |
| 4484812_f1_10 | 2093 | 372 | 59 | 123 | | 0.35 | [ac:p54052] [gn:mj0595] [or:methanococcus jannaschii] [de:50s ribosomal protein 1x] [sp:p54052] [dbsswissprot] |
| 4486328_c1_10 | 2094 | 216 | 117 | 71 | | 2.30E-07 | [ac:b69453] [pn:repressor protein homolog] [or:archaeoglobus fulgidus] [dbpir] |
| 4492143_c1_73 | 2095 | 1623 | 1528 | 540 | | 7.00E-157 | [ac:f69884] [pn:conserved hypothetical protein ynda] [gn:ynda] [or:bacillus subtilis] [dbpir] |
| 4492188_f2_18 | 2096 | 1257 | 1046 | 418 | | 8.40E-106 | [fn:szu50357] [ac:u50357] [pn:zoocin a immunity factor] [gn:zif] [fn:encodes producer cell immunity for the] [or:streptococcus zooepidemicus] [db:genpept-bct] [de:streptococcus zooepidemicus zoocin a immunity factor (zif) andzoocin a endopeptidase (zooa) |
| 4492193_f2_35 | 2097 | 1005 | 678 | 334 | | 8.30E-67 | [fn:spcinrec] [ac:z34303] [pn:hypothetical protein] [or:streptococcus pneumoniae] [db:genpept-bct] [de:streptococcus pneumoniae cin operon encoding the cina, reca, dinf,lyta genes, and downstream sequences.] [nt:orf1] [le:7592] [re:8176] [di:direct] |
| 4492307_f3_36 | 2098 | 1095 | 893 | 364 | | 1.40E-89 | [ac:af030361] [ac:af030361] [pn:transposase] [or:streptococcus pneumoniae strain sp-va92 glucose-1-phosphatethymidyl transferase (cpsl) gene, partial cds; anddtdp-4-keto-6-deoxyglucose-3,5-epimerase (cpsm).dt |
| 4492838_c2_60 | 2099 | 1923 | 2092 | 640 | | 1.20E-216 | [fn:11u80409] [ac:u80409] [pn:glucose inhibited division protein homolog gida] [gn:gida] [or:lactococcus lactis cremoris] [db:genpept-bct] [de:lactococcus lactis cremoris glucose inhibited division proteinhomolog gida (gida) gene, partial cds.] [nt:simila |
| 4494087_f3_44 | 2100 | 912 | 210 | 303 | | 7.20E-16 | [ac:p06613:p76834] [gn:cysb] [or:escherichia coli] [de:cys regulon transcriptional activator] [sp:p06613:p76834] [dbsswissprot] |
| 4495287_f2_12 | 2101 | 216 | 62 | 71 | | 0.15 | [ac:p56026] [gn:rpss:hp1315] [or:helicobacter pylori] [sr:.campylobacter pylori] [de:30s ribosomal protein s19] [sp:p56026] [dbsswissprot] |
| 4501501_c1_43 | 2102 | 1449 | 479 | 482 | | 1.80E-52 | [ac:s14959] [pn:proline-rich protein] [or:triticum aestivum] [sr:, common wheat] [dbpir] |
| 4534665_f1_4 | 2103 | 671 | 647 | 224 | | 1.60E-63 | [fn:d78182] [ac:d78182] [gn:orf2] [or:streptococcus mutans] [sr:streptococcus mutans (strain:xe) dna] [db:genpept-bct] [de:streptococcus mutans dna for dtdp-rhamnose synthesis pathway,complete cds.] [le:335] [re:1030] [di:direct] |
| 4554637_c2_17 | 2104 | 2190 | 834 | 730 | | 2.40E-83 | [ac:p38050] [gn:pbpf:pona] [or:bacillus subtilis] [de:penicillin-binding protein 1a (pbp-1a)] [sp:p38050] [dbsswissprot] |

TABLE 2-continued

| Orf | NT Seq ID | AA Seq ID | NT Orf Length | AA Orf Length | Score | Probability | Description |
|---|---|---|---|---|---|---|---|
| 4558567_f3_26 | 2105 | 4708 | 456 | 151 | 216 | 7.50E-18 | [ac:17893] [gn:ahrc] [or:*bacillus subtilis*] [de:arginine hydroximate resistance protein] [sp:p17893] [db:swissprot] |
| 4562838_c1_71 | 2106 | 4709 | 1107 | 368 | 343 | 6.80E-47 | [ac:b69875] [pn:conserved hypothetical protein ylbm] [gn:ylbm] [or:*bacillus subtilis*] [db:pir] |
| 4564717_f3_35 | 2107 | 4710 | 996 | 331 | 407 | 4.30E-38 | [fn:spcps14e] [ac:x85787] [pn:ss-1,4-galactosyltransferase] [gn:cps14j] [fn:capsular polysaccharide synthesis] [or:*streptococcus pneumoniae*] [db:genpept-bct] [de:*s.pneumoniae* cps14 locus.] [le:9524] [re:10480] [di:direct] |
| 4572755_f1_1 | 2108 | 4711 | 243 | 80 | 108 | 2.10E-06 | [n:cet0488] [ac:z66565] [pn:t0488.8] [or:*caenorhabditis elegans*] [db:genpept-inv] [de:*caenorhabditis elegans* cosmid t0488, complete sequence.] [nt:cdna est yk121f1.5 comes from this gene] [le:34969] [re:35259] [di:direct] |
| 4574037_f2_3 | 2109 | 4712 | 1218 | 405 | 1131 | 8.20E-115 | [ac:23034] [or:*bacillus* sp] [sr:ym-2.] [ec:2.6.1.1] [de:aspartate aminotransferase, (transaminase a) (aspat)] [sp:p23034] [db:swissprot] |
| 4578400_f3_33 | 2110 | 4713 | 408 | 135 | 61 | 0.72 | [ac:a35666] [pn:transcriptional activator krox-24 88k] [or:*mus musculus*] [sr:, house mouse] [db:pir] |
| 4586068_f2_13 | 2111 | 4714 | 216 | 71 | 156 | 1.70E-11 | [ac:p12873] [gn:rpmc] [or:*bacillus subtilis*] [de:50s ribosomal protein 129] [sp:p12873] [db:swissprot] |
| 46875_f3_30 | 2112 | 4715 | 234 | 77 | 64 | 0.092 | [n:nae001171] [ac:ae000783] [pn:*b. burgdorferi* predicted coding region bb0711] [gn:bb0711] [or:*borrelia burgdorferi*] [sr:lyme disease spirochete] [db:genpept-bct] [de:*borrelia burgdorferi* (section 57 of 70) of the complete genome.] [nt:hypothetic |
| 4687750_f3_29 | 2113 | 4716 | 183 | 60 | 53 | 0.76 | [n:yscdmcla] [ac:m87549] [gn:pdh-alpha1] [or:*saccharomyces cerevisiae*] [sr:*saccharomyces cerevisiae* (strain grf88) (library:m. d. rose (ros)] [db:genpept-pln] [de:*saccharomyces cerevisiae* yeast homolog of reca (dmc1) gene, partialcds.] [le:1] [re:262] [d |
| 4687762_f3_28 | 2114 | 4717 | 651 | 216 | 713 | 1.60E-70 | [ac:q02141] [gn:leua] [or:*lactococcus lactis*] [sr:subsplactis:*streptococcus lactis*] [cc:4.1.3.12] [de:synthase) (alpha-ipm synthetase)] [sp:q02141] [db:swissprot] |
| 4688812_c3_88 | 2115 | 4718 | 222 | 73 | 82 | 0.04 | [n:hssa1] [ac:z75330] [pn:nuclear protein sa-1] [or:*homo sapiens*] [sr:human] [db:genpept-pri2] [de:*h.sapiens* mrna for nuclear protein sa-1.] [le:401] [re:4177] [di:direct] |
| 4692251_f1_9 | 2116 | 4719 | 777 | 258 | 910 | 2.20E-91 | [ac:p42360] [or:*streptococcus gordonii challis*] [de:(orf1)] [sp:p42360] [db:swissprot] |
| 4692556_c3_203 | 2117 | 4720 | 408 | 135 | 56 | 0.7 | [ac:p22597] [or:equine herpesvirus type 4] [sr:1942,ehv-4,equine herpesvirus type 1 subtype 2] [de:membrane protein u143 homolog (orf1) (fragment)] [sp:p22597] [db:swissprot] |
| 4695327_f3_27 | 2118 | 4721 | 678 | 225 | 294 | 4.10E-26 | [ac:p05194] [gn:arod] [or:*escherichia coli*] [ec:4.2.1.10] [de:3-dehydroquinate dehydratase, (3-dehydroquinase)] [sp:p05194] [db:swissprot] |
| 470157_f2_18 | 2119 | 4722 | 675 | 224 | 920 | 1.90E-92 | [ac:p30299] [gn:ptsi] [or:*streptococcus salivarius*] [ec:2.7.3.9] [de:(phosphotransferase system, enzyme i)] [sp:p30299] [db:swissprot] |
| 4704390_c3_53 | 2120 | 4723 | 858 | 285 | 87 | 0.043 | [ac:jc4004] [pn:carbomycin 4-o-methyltransferase,:midecamycin 4-o-methyltransferase homolog] [or:*streptomyces* sp.] [ec:2.1.1.—] [db:pir] |
| 4704678_c2_69 | 2121 | 4724 | 195 | 64 | 57 | 0.044 | [n:cee03h4] [ac:z81492] [pn:e03h4.13] [or:*caenorhabditis elegans*] [db:genpept-inv] [de:*caenorhabditis elegans* cosmid e03h4, complete sequence.] [nt:similarity to zinc finger proteins] [le:38799:38897:39024] [re:38852:38965:39443] [di:complementjoin |
| 4718750_c1_51 | 2122 | 4725 | 2460 | 819 | 399 | 2.50E-56 | [ac:p54394] [gn:ding] [or:*bacillus subtilis*] [de:probable atp-dependent helicase ding homolog] [sp:p54394] [db:swissprot] |
| 47192_f1_1 | 2123 | 4726 | 648 | 215 | 71 | 0.65 | [n:pbu42580] [ac:u42580:u17055:u32570] [gn:a426rf] [or:*paramecium bursaria chlorella* virus 1] [de:*paramecium bursaria chlorella* virus 1, complete genome.] [le:207339] [re:207683] [di:direct] |
| 4719712_f3_27 | 2124 | 4727 | 246 | 81 | 323 | 3.40E-29 | [n:soorfs] [ac:z79691] [gn:yorfe] [fn:putative transcription regulator] [or:*streptococcus pneumoniae*] [db:genpept-bct] [de:*s.pneumoniae* yorf[a,b,c,d,e], ftsl, pbpx and regr genes.] [le:2388] [re:2582] [di:complement] |

TABLE 2-continued

| Orf | NT Seq ID | AA Seq ID | NT Orf Length | AA Orf Length | Score | Probability | Description |
|---|---|---|---|---|---|---|---|
| 4721017_f1_1 | 2125 | 2256 | 1938 | 751 | 2.50E−200 | | [ac:a47331:s56464:a65236] [pn:ribonucleoside-triphosphate reductase,, oxygen-sensitive:anaerobic ribonucleotide reductase] [gn:nrdd] [cl:oxygen-sensitive ribonucleoside-triphosphate reductase:oxygen-sensitive ribonucleoside-triphosphate reductase carboxyl |
| 472563_c1_15 | 2126 | 4728 | 79 | 61 | 0.015 | | [ac:s67482:s52150] [pn:serine o-acetyltransferase, cytosolic:serine acetyltransferase:serine acetyltransferase] [cl:serine acetyltransferase] [or:arabidopsis thaliana] [sr:mouse-ear cress] [ec:2.3.1.30] [db:pir] |
| 4726436_c3_66 | 2127 | 4729 | 89 | 139 | 0.0076 | | [ac:p29834] [gn:grp 0.9:grp-1] [or:oryza sativa] [sr:rice] [de:glycine-rich cell wall structural protein 2 precursor] [sp:p29834] [db:swissprot] |
| 4726688_f2_2 | 2128 | 4730 | 1530 | 420 | 4.30E−157 | | [ac:p20964] [gn:obg] [or:bacillus subtilis] [de:spo0b-associated gtp-binding protein] [sp:p20964] [db:swissprot] |
| 472806_c1_37 | 2129 | 4731 | 198 | 439 | 6.10E−16 | | [ln:spnana] [de:x72967] [or:streptococcus pneumoniae] [db:genpept-bct] [de:s.pneumoniae nana gene.] [nt:orf2] [le: 93] [re:495] [di:direct] |
| 4728161_c2_50 | 2130 | 4732 | 309 | 74 | 1.10E−27 | | [ln:spnana] [ac:x72967] [or:streptococcus pneumoniae] [db:genpept-bct] [de:s.pneumoniae nana gene.] [nt:orf2] [le:193] [re:495] [di:direct] |
| 4729017_c3_113 | 2131 | 4733 | 131 | 171 | 7.60E−09 | | [ac:g69876] [pn:conserved hypothetical protein ylmg] [gn:ylmg] [or:bacillus subtilis] [db:pir] |
| 4745377_c3_71 | 2132 | 4734 | 275 | 90 | 4.20E−24 | | [ac:p37557] [gn:yabo] [or:bacillus subtilis] [de:hypothetical 9.7 kd protein in mfd-divic intergenic region] [sp:p37557] [db:swissprot] |
| 475067_c2_36 | 2133 | 4735 | 322 | 93 | 4.40E−29 | | [ln:lmu40604] [ac:u40604] [fn:unknown] [or:listeria monocytogenes] [db:genpept-bct] [de:listeria monocytogenes clpc atpase (mec)gene, complete cds.] [nt:orf1; putative 17 kda protein] [le:207] [re:665] [di:direct] |
| 476550_f3_7 | 2134 | 4736 | 76 | 185 | 0.15 | | [ac:p44222] [gn:hi1498] [or:haemophilus influenzae] [de:hypothetical protein hi1498] [sp:p44222] |
| 4769003_c2_14 | 2135 | 4737 | 456 | 133 | 2.80E−43 | | [ac:q08352] [gn:aldspovn] [or:bacillus subtilis] [ec:1.4.1.1] [de:alanine dehydrogenase, (stage v sporulation protein n)] [sp:q08352] [db:swissprot] |
| 4770087_c1_24 | 2136 | 4738 | 726 | 144 | 6.80E−72 | | [ac:a33595:a30868] [pn:probable transposase (insertion sequence is861)] [gn:is861-orf 2] [or:streptococcus agalactiae] [db:pir] |
| 4770087_c1_96 | 2137 | 4739 | 391 | 197 | 2.10E−36 | | [ac:a33595:a30868] [pn:probable transposase (insertion sequence is861)] [gn:is861-orf 2] [or:streptococcus agalactiae] [db:pir] |
| 4770087_c2_73 | 2138 | 4740 | 730 | 136 | 2.60E−72 | | [ac:a33595:a30868] [pn:probable transposase (insertion sequence is861)] [gn:is861-orf 2] [or:streptococcus agalactiae] [db:pir] |
| 4772507_f3_29 | 2139 | 4741 | 1442 | 197 | 9.10E−148 | | [ln:silct] [ac:y07622] [pn:lactate oxidase] [gn:lcto] [fn:lactate utilisation] [or:streptococcus iniae] [db:genpept-bct] [de:s. iniae lctp & lcto genes and orf1.] [le:2763] [re:3974] [di:direct] |
| 4775028_f1_11 | 2140 | 4742 | 122 | 366 | 6.90E−08 | | [ac:p53071] [gn:ygl235w] [or:saccharomyces cerevisiae] [sr:baker's yeast] [de:hypothetical 19.3 kd protein in hap2-ade5,6 intergenic region] [sp:p53071] [db:swissprot] |
| 47760_c2_18 | 2141 | 4743 | 74 | 228 | 0.24 | | [ac:b70008] [pn:hypothetical protein yuei] [gn:yuei] [or:bacillus subtilis] [db:pir] |
| 4776578_c2_183 | 2142 | 4744 | 85 | 411 | 0.0024 | | [ac:p20327] [gn:5.3] [or:bacteriophage t3] [de:hypothetical gene 5.3 protein] [sp:p20327] [db:swissprot] |
| 4781312_f3_30 | 2143 | 4745 | 55 | 774 | 0.58 | | [ac:p10132] [gn:rpss] [or:mycoplasma capricolum] [de:30s ribosomal protein s19] [sp:p10132] [db:swissprot] |
| 4784401_c3_47 | 2144 | 4746 | 4412 | 195 | 0 | | [ac:p13252] [gn:pola] [or:streptococcus pneumoniae] [ec:2.7.7.7] [de:dna polymerase i, (pol i)] [sp:p13252] [db:swissprot] |
| 4788452_f3_5 | 2145 | 4747 | 69 | 2679 | 0.028 | | [ln:meampa] [ac:m12668] [pn:unknown protein] [or:measles virus] [sr:measles virus cdna to genomic rna] [db:genpept-vrl] [de:measles virus genes encoding matrix proteins, complete cds.] [nt:mx1 orf; putative] [le:10701] [re:11447] [di:direct] |
| 4792202_c1_52 | 2146 | 4748 | 129 | 892 | 5.70E−09 | | [ac:p07908] [gn:dnab] [or:bacillus subtilis] [de:replication initiation and membrane |

TABLE 2-continued

| Orf | NT Seq ID | AA Seq ID | NT Orf Length | AA Orf Length | Score | Probability | Description |
|---|---|---|---|---|---|---|---|
| 4798588_f3_46 | 2147 | 252 | 83 | 296 | 2.50E-26 | | attachment protein] [sp:p07908] [db:swissprot] [ln:spz82002] [ac:zs82002] [pn:unknown] [or:streptococcus pneumoniae] [db:genpept-bct] [de:s.pneumoniae pcpb and pcpc genes.] [nt:similar to the prepropeptide of the glutamic] [le:238] [re:432] [di:direct] |
| 4800700_c1_23 | 2148 | 330 | 109 | 224 | 1.10E-18 | | [ac:a69742] [pn:conserved hypothetical protein yaza] [gn:yaza] [or:bacillus subtilis] [db:pir] |
| 4804629_c2_6 | 2149 | 995 | 331 | 1652 | 5.10E-170 | | [ln:spr61dh] [ac:aj000336] [pn:1-lactate dehydrogenase] [gn:ldh] [fn:conversion of pyruvate to lactate] [or:streptococcus pneumoniae] [db:genpept-bct] [ec:1.1.1.27] [de:streptococcus pneumoniae ldh gene.] [le:187] [re:1173] [di:direct] |
| 4804785_c1_57 | 2150 | 225 | 74 | 71 | 0.018 | | [ln:bsu80627] [ac:u80627] [pn:cytochrome b] [gn:cytb] [or:mitochondrion bothriechis schlegelii] [sr:bothriechis schlegelii] [db:genpept-vrt] [de:bothriechis schlegelii cylochrome b (cytb) gene, mitochondrial geneencoding mitochondrial protein, partial cds |
| 4806592_c1_37 | 2151 | 396 | 131 | 55 | 0.77 | | [ac:h69859] [pn:hypothetical protein ykol] [gn:ykol] [or:bacillus subtilis] [db:pir] |
| 4806506_c2_93 | 2152 | 633 | 210 | 491 | 5.40E-47 | | [ac:54455] [gn:yqej] [or:bacillus subtilis] [de:hypothetical 22.2 kd protein in arod-comer intergenic region] [sp:p54455] [db:swissprot] |
| 4806576_f2_22 | 2153 | 591 | 196 | 76 | 0.97 | | [acp40214] [gn:ymr144w:ym19375.13] [or:saccharomyces cerevisiae] [sr:baker's yeast] [de:hypothetical 38.6 kd protein in rps16a-tif34 intergenic region] [sp:p40214] [db:swissprot] |
| 4806592_c1_43 | 2154 | 366 | 121 | 169 | 8.80E-13 | | [ac:f64819] [pn:hypothetical protein b0822] [or:escherichia coli] [db:pir] |
| 4808317_c1_80 | 2155 | 207 | 68 | 75 | 0.043 | | [acc42756] [pn:hypothetical protein f-327] [or:mamestra brassicae nuclear polyhedrosis virus:mbmpv] [db:pir] |
| 4820807_c1_23 | 2156 | 219 | 72 | 60 | 0.79 | | [ac:d69835] [pn:alcohol dehydrogenase homolog yihxc] [gn:yihxc] [or:bacillus subtilis] [db:pir] |
| 484437_c1_7 | 2157 | 2505 | 834 | 349 | 2.30E-51 | | [acp:38050] [gn:pbpf:pona] [or:bacillus subtilis] [de:penicillin-binding protein 1a (pbp-1a)] [sp:p38050] [db:swissprot] |
| 48515520_c3_46 | 2158 | 210 | 69 | 165 | 1.90E-12 | | [ln:celzk354] [ac:u88172] [gn:zk354.7] [or:caenorhabditis elegans] [sr:caenorhabditis elegans strain=bristol n2] [db:genpept-inv] [de:caenorhabditis elegans cosmid zk354.] [le:7269:81332] [re:7868:8206] [di:complementjoin] |
| 4860077_f2_22 | 2159 | 579 | 192 | 54 | 0.98 | | [acp:50152] [gn:gng11] [or:homo sapiens] [sr:.human] [de:guanine nucleotide-binding protein g(i)/g(s)/g(o) gamma-11 subunit] [sp:p50152] [db:swissprot] |
| 4860633_f3_13 | 2160 | 654 | 217 | 193 | 2.10E-15 | | [ln:af040570] [ac:af040570] [pn:phosphatase] [gn:rifm] [or:amycolatopsis mediterranei] [db:genpept-bct] [de:amycolatopsis mediterranei rifamycin biosynthetic gene cluster.] [nt:rifm; similar to phosphoglycolate phosphatases] [1e:60804] [re:61502] [di:dire |
| 4860767_c2_26 | 2161 | 966 | 321 | 128 | 0.00016 | | [ac:s61441.s27982] [pn:surface-associated protein csha precursor] [gn:csha] [or:streptococcus gordonii] [db:pir] |
| 4861068_f3_32 | 2162 | 651 | 216 | 713 | 1.60E-70 | | [ac:p27143] [gn:adk] [or:lactococcus lactis] [sr:.subsplactis:streptococcus lactis] [ec:2.7.4.3] [de:adenylate kinase, (atp-amp transphosphorylase)] [sp:p27143] [db:swissprot] |
| 4866012_f1_9 [db:swissprot] | 2163 | 1992 | 663 | 392 | 6.70E-36 | | [acq02425] [or:streptococcus mutans] [de:hypothetical protein in mtlf 5′region (orfx) (fragment)] [sp:q02425] [db:swissprot] |
| 4870892_f1_7 | 2164 | 198 | 65 | 49 | 0.068 | | [ac:c64612] [pn:2-hydroxy-6-oxohepta-2,4-dienoate hydrolase] [or:helicobacter pylori] [db:pir] |
| 4875002_f3_28 | 2165 | 336 | 111 | 318 | 1.20E-28 | | [ln:sgu81957] [ac:u81957] [pn:comyc] [or:streptococcus gordonii] [db:genpept-bct] [de:streptococcus gordonii ma polymerase beta' subunit (rpoc),putative dna binding protein, putative abc transporter subunitcomya (comya), putative abc transport |
| 4875088_f3_27 | 2166 | 813 | 270 | 374 | 1.40E-34 | | [ac:e64128] [pn:lic-1 protein d] [gn:lied] [or:haemophilus influenzae] [db:pir] |
| 4875300_c3_93 | 2167 | 192 | 63 | 183 | 2.10E-13 | | [ln:spspsa2] [ac:aj002054] [pn:spsa protein] [fn:iga binding protein] [or:streptococcus |

TABLE 2-continued

| Orf | | NT Seq ID | AA Seq ID | NT Orf Length | AA Orf Length | Score | Probability | Description |
|---|---|---|---|---|---|---|---|---|
| 4875318_c1_35 | 2168 | 4771 | 4590 | 1529 | 342 | 7.50E-48 | | *pneumoniae*] [db:genpept-bct] [de:*streptococcus pneumoniae* siga binding.] [le:1] [re:1620] [di:direct] |
| 4875318_c2_45 | 2169 | 4772 | 1440 | 479 | 1744 | 9.10E-180 | | [ac:p16271] [gn:ptp] [or:*lactococcus lactis*] [sr:,subspcremoris:*streptococcus cremoris* ec:3.4.21.—] [de:proteinase]] [sp:p16271] [db:swissprot] [ac:d69813] [pn:abc transporter (atp-binding protein) homolog yfmm] [gn:yfmm] [or:*bacillus subtilis*] [db:pir] |
| 4875643_c2_61 | 2170 | 4773 | 1287 | 428 | 265 | 5.90E-26 | | [ac:d69740] [pn:cell-cycle protein homolog yaca] [gn:yaca] [or:*bacillus subtilis*] |
| 4876510_c1_55 | 2171 | 4774 | 387 | 128 | 94 | 0.00025 | | [ac:q91085] [or:*meleagris gallopavo*] [sr:,common turkey] [de:(fragment)] [sp:q91085] [db:swissprot] |
| 4877257_f3_25 | 2172 | 4775 | 327 | 108 | 274 | 5.10E-23 | | [ac:p80868:p70980] [gn:fusa:fus] [or:*bacillus subtilis*] [de:elongation factor g (ef-g) (vegetative protein 19) (veg19)] [sp:p80868:p70980] [db:swissprot] |
| 4877318_f2_11 | 2173 | 4776 | 666 | 221 | 867 | 7.80E-87 | | [ln:bsu43929] [acu43929] [pn:s3] [gn:rpsc] [or:*bacillus subtilis*] [db:genpept-bct] [de:*bacillus subtilis* ribosomal protein gene cluster, rpsj, rplc, rpld,rplw, rplb,rpss,rpiv and rpsc genes, complete cds, and rplp gene,partial cds.] [nt:ribosomal prote |
| 4878463_c1_14 | 2174 | 4777 | 282 | 93 | 64 | 0.68 | | [ln:mbod2dcpil] [ac:132967] [pn:pilin] [db:genpept-bct] [sr:*moraxella bovis*] [sr:*moraxella bovis* (strain d2d serogroup c) dna] [db:genpept-bct] [de:*moraxella bovis* (strain d2d serogroup c) pilin gene, partial cds.] [nt:putative] [le:67] [re:498] [di:direct] |
| 4878780_f1_8 | 2175 | 4778 | 270 | 89 | 68 | 0.38 | | [ac:i47141:s55315] [pn:gastric mucin (clone pgm-2a)] [or:*sus scrofa domestica*] [sr:, domestic pig] [db:pir] |
| 4879625_f3_18 | 2176 | 4779 | 1128 | 375 | 1832 | 4.30E-189 | | [ln:spu43526] [acu43526] [or:*streptococcus pneumoniae*] [db:genpept-bct] [de:*streptococcus pneumoniae* neuraminidase b (nanb) gene, complete cds,and neuraminidase (nana) gene, partial cds.] [nt:orf-5] [le:7207] [re: |
| 4879663_f2_7 | 2177 | 4780 | 1326 | 441 | 84 | 0.6 | | [ac:24755] [gn:ompa] [or:*serratia odorifora*] [de:outer membrane protein a (outer membrane protein ii) (fragment)] [sp:p24755] [db:swissprot] |
| 4881302_f3_43 | 2178 | 4781 | 900 | 299 | 482 | 4.90E-46 | | [ac:g64876] [pn:hypothetical protein b1284] [or:*escherichia coli*] [db:pir] |
| 4881306_f1_1 | 2179 | 4782 | 240 | 79 | 66 | 0.17 | | [ac:q11075] [gn:b0403.1] [or:*caenorhabditis elegans*] [de:hypothetical 23.2 kd protein b0403.1 in chromosome x] [sp:q11075] [db:swissprot] |
| 4881531_f1_20 | 2180 | 4783 | 912 | 303 | 710 | 3.40E-70 | | [ac:p75089] [gn:fba:tsr] [or:*mycoplasma pneumoniae*] [ec:4.1.2.13] [de:fructose-bisphosphate aldolase,] [sp:p75089] [db:swissprot] |
| 4882062 4_c2_40 | 2181 | 4784 | 276 | 92 | 128 | 1.80E-07 | | [ac:s19933] [pn:glycine-rich protein atgrp-7] [or:*arabidopsis thaliana*] [sr:, mouse-ear cress] [db:pir] |
| 4882312_f1_5 | 2182 | 4785 | 888 | 295 | 684 | 1.90E-67 | | [ac:g69726] [pn:trna pseudouridine 5s synthase trub] [gn:trub] [or:*bacillus subtilis*] [db:pir] |
| 4882760_f3_28 | 2183 | 4786 | 273 | 90 | 387 | 5.70E-36 | | [ln:strcomaa] [ac:m36180:115190] [pn:transposase] [or:*streptococcus pneumoniae*] [sr:*streptococcus pneumoniae* (strain rx1) dna] [db:genpept-bct] [de:*streptococcus pneumoniae* transposase, (coma and comb) and saicarsynthetase (purc) genes, complete cds.] [nt |
| 4882800 3_f2_15 | 2184 | 4787 | 204 | 68 | 181 | 3.80E-14 | | [ln:celc34d4] [ac:c58755] [gn:c34d4.11] [or:*caenorhabditis elegans*] [sr:*caenorhabditis elegans* strain=bristol n2] [db:genpept-inv] [de:*caenorhabditis elegans* cosmid c34d4.] [le:13972:14090:14398] [re:14036:14143:14493] [di:complementjoin] |
| 4882805 2_c1_36 | 2185 | 4788 | 327 | 108 | 156 | 1.70E-11 | | [ac:49193] [pn:ger 101 protein] [gn:anon-pen101] [or:*drosophila melanogaster*] |
| 4882810 0_f2_19 | 2186 | 4789 | 1002 | 333 | 813 | 4.10E-81 | | [ln:spz82002] [acz82002] [pn:pcpc] [gn:pcpc] [fn:unknown] [or:*streptococcus pneumoniae*] [db:genpept-bct] [de:*s.pneumoniae* pcpb and pepe genes.] [nt:pcpc contains a choline binding domain] [le:1401] [re:2285] [di:direct] |
| 4882812 4_c2_39 | 2187 | 4790 | 204 | 67 | 158 | 1.50E-10 | | [ac:p13816] [gn:garp] [or:*plasmodium falciparum*] [sr:,isolate fc27/papua new guinea] [de:glutamic acid-rich protein precursor] [sp:p13816] [db:swissprot] |
| 4882828_f3_22 | 2188 | 4791 | 1416 | 471 | 2452 | 8.60E-255 | | [ac:p11546] [gn:lacg] [or:*lactococcus lactis*] [sr:,subsplactis:*streptococcus lactis*] [ec:3.2.1.85] [de:galactohydrolase) (pgalase) (p-beta-gal) (pbg)] [sp:p11546] [db:swissprot] |

TABLE 2-continued

| Orf | NT Seq ID | AA Seq ID | NT Orf Length | AA Orf Length | Score | Probability | Description |
|---|---|---|---|---|---|---|---|
| 4882937_f1_9 | 2189 | 4792 | 258 | 85 | 76 | 0.11 | [ac:q60282] [gn:mjec123] [or:methanococcus jannaschii] [de:hypothetical protein mjec123] [sp:q60282] [db:swissprot] |
| 4882943_c3_55 | 2190 | 4793 | 237 | 79 | 69 | 0.31 | [ac:g02522] [pn:sorting nexin 1] [gn:snx1] [cl:px domain homology] [or:homo sapiens] [sr:,man] [db:pir] [mp:15q22–15q23] |
| 4882962_f1_2 | 2191 | 4794 | 888 | 295 | 204 | 2.30E-21 | [ac:q58487] [gn:mj1087] [or:methanococcus jannaschii] [ec:2.7.1.36] [de:mevalonate kinase, (mk)] [sp:q58487] [db:swissprot] |
| 4883418_c1_16 | 2192 | 4795 | 1092 | 363 | 656 | 1.80E-64 | [ac:c69813] [pn:rna helicase homolog yfml] [gn:yfml] [or:bacillus subtilis] [db:pir] |
| 4884642_f3_65 | 2193 | 4796 | 660 | 219 | 359 | 5.30E-33 | [ac:q47744] [gn:vanrb] [or:enterococcus faecalis] [sr:,streptococcus faecalis] [de:regulatory protein vanrb] [sp:q47744] [db:swissprot] |
| 4884687_f2_7 | 2194 | 4797 | 528 | 175 | 250 | 1.90E-21 | [ln:ehcopayz] [ac:z46807] [gn:orf u] [or:enterococcus hirae] [db:genpept-bct] [de:e.hirae copa, copy and copz genes,] [re:646] [re:1185] [di:direct] |
| 4885927_c3_77 | 2195 | 4798 | 777 | 258 | 540 | 3.50E-52 | [ac:q06753] [gn:yaco] [or:bacillus subtilis] [de:hypothetical rma methylase in cyss 3region] [sp:q06753] [db:swissprot] |
| 4886030_f2_83 | 2196 | 4799 | 333 | 110 | 91 | 0.0017 | [ac:p31948] [or:homo sapiens] [sr:,human] [de:transformation-sensitive protein ief ssp 3521] [sp:p31948] [db:swissprot] |
| 4886068_c1_52 | 2197 | 4800 | 621 | 206 | 704 | 1.50E-69 | [ln:laclpagap] [ac:136907] [fn:unknown] [or:lactococcus lactis] [sr:lactococcus lactis (individual_isolate lm0230, sub_specie] [db:genpept-bct] [de:lactococcus lactis atp-dependent protease (clpa) gene, 3' end;complete orf156; glyceraldehyde-3-phosphate d |
| 4886086_f1_5 | 2198 | 4801 | 552 | 183 | 551 | 2.40E-53 | [ln:bacrgb] [ac:m57622;j05723] [pn:ribosomal protein 16] [gn:ribosomal protein 16] [or:bacillus stearothermophilus] [sr:b.stearothermophilus dna] [db:genpept-bct] [de:b.stearothermophilus ribosomal protein 16 gene, complete cds.] [le:1] [re:537] [di:direc |
| 4886087_f1_2 | 2199 | 4802 | 792 | 263 | 324 | 2.70E-29 | [ac:23553] [gn:xync] [or:caldocellum saccharolyticum] [ec:3.1.—.—] [de:acetyl esterase,] [sp:23553] |
| 4891092_c1_148 | 2200 | 4803 | 366 | 121 | 75 | 0.47 | [ac:q57978] [gn:mj0558] [or:methanococcus jannaschii] [de:hypothetical protein mj0558] [sp:q57978] [db:swissprot] |
| 4895327_f3_47 | 2201 | 4804 | 294 | 97 | 226 | 6.10E-18 | [ac:a41971:a60282:a33134] [pn:surface protein pspa precursor;pneumococcal surface protein a] [gn:pspa] [cl:cpl repeat homology] [or:streptococcus pneumoniae] [db:pir] |
| 4897188_c2_28 | 2202 | 4805 | 837 | 278 | 751 | 1.50E-74 | [ln:11aj642] [ac:aj222642] [gn:purr] [fn:activator of purine biosynthetic genes] [or:lactococcus lactis] [db:genpept-bct] [de:lactococcus lactis purr gene,.] [le:98] [re:913] [di:direct] |
| 4898568_c2_44 | 2203 | 4806 | 1095 | 364 | 978 | 2.60E-102 | [ac:f69878] [pn:conserved hypothetical protein ylon] [gn:ylon] [or:bacillus subtilis] [db:pir] |
| 4899038_f2_15 | 2204 | 4807 | 219 | 72 | 66 | 0.057 | [ln:pbu42580] [ac:u42580:u17055:u32570] [gn:a669r] [or:paramecium bursaria chlorella virus 1] [db:genpept-vrl] [de:paramecium bursaria chlorella virus 1, complete genome.] [nt:similar to chlorella virus cvk2 unknown orf.] [le:319062] [re:319313] |
| 4899183_c1_154 | 2205 | 4808 | 714 | 237 | 254 | 7.10E-22 | [ln:u88974] [ac:u88974] [pn:orf19] [or:streptococcus thermophilus] [db:genpept-bct] [de:streptococcus thermophilus bacteriophage 01205 dna sequence,] [le:10397] [re:10864] [di:direct] |
| 4899187_f1_13 | 2206 | 4809 | 567 | 325 | 325 | 4.80E-55 | [ac:c69763] [pn:ferrichrome abc transporter (binding prote) homolog yclq] [gn:yclq] [or:bacillus subtilis] [db:pir] |
| 4899188_f1_17 | 2207 | 4810 | 487 | 219 | 660 | 1.40E-46 | [ln:shgcpir] [ac:x86780] [pn:abc-transporter] [gn:orfx] [or:streptomyces hygroscopicus] [db:genpept-bct] [de:s.hygroscopicus gene cluster for polyketide immunosuppressantrapamycin.] [le:3056] [re:3763] [di:complement] |
| 4900260_f1_1 | 2208 | 4811 | 234 | 150 | 453 | 9.50E-19 | [ac:p54745] [gn:hrsa] [or:escherichia coli] [ec:2.7.1.69] [de:hrsa protein,] [sp:p54745] [db:swissprot] |
| 4900262_f1_15 | 2209 | 4812 | 343 | 65 | 198 | 2.60E-31 | [ac:p06653] [gn:lyta] [or:streptococcus pneumoniae] [ec:3.5.1.28] [de:hydrolase (mucopeptide aminohydrolase) (cell wall hydrolase)] [sp:p06653] [db:swissprot] |
| 4900286_c2_104 | 2210 | 4813 | 264 | 171 | 516 | 6.20E-23 | [ac:g69878] [pn:conserved hypothetical protein yloo] [gn:yloo] [or:bacillus subtilis] |

TABLE 2-continued

| Orf | NT Seq ID | AA Seq ID | NT Orf Length | AA Orf Length | Score Probability | Description |
|---|---|---|---|---|---|---|
| 4900308_f3_59 | 4814 | 192 | 59 | 63 | 0.28 | [ac:s75091] [pn:hypothetical protein slr0270] [or:synechocystis sp.] [sr:pcc 6803, , pcc 6803] [sr:pcc 6803, ] [db:pir] |
| 4901517_f2_22 | 4815 | 726 | 283 | 241 | 6.00E-25 | [ac:q57424] [gn:hi0647] [or:haemophilus influenzae] [de:hypothetical protein hi0647] [sp:q57424] [db:swissprot] |
| 4901588_f1_4 | 4816 | 1332 | 1344 | 443 | 2.20E-137 | [ac:p44917] [gn:hi0883] [or:haemophilus influenzae] [de:hypothetical protein hi0883] [sp:p44917] [db:swissprot] |
| 49192_f1_3 | 4817 | 948 | 661 | 315 | 5.30E-65 | [ac:q04796] [gn:dapa] [or:bacillus subtilis] [ec:4.2.1.52] [de:dihydrodipicolinate synthase, (dhdps)] [sp:q04796] [db:swissprot] |
| 492341_c3_240 | 4818 | 774 | 103 | 257 | 0.0015 | [ac:p18015] [gn:cop] [or:clostridium perfringens] [de:copy number protein (orf4)] [sp:p18015] [db:swissprot] |
| 4937505_f1_12 | 4819 | 225 | 72 | 74 | 0.23 | [ac:s26427] [pn:structural protein, 70k] [or:phage i3] [db:pir] |
| 4947130_f3_58 | 4820 | 1329 | 1475 | 442 | 2.90E-151 | [ln:spdnagcpo] [ac:y11463] [or:streptococcus pneumoniae] [db:genpept-bct] [de:streptococcus pneumoniae dnag, rpod, cpoa genes and orf3 and orf5.] [nt:orf5] [ec:3192] [re: db:pir] |
| 495276_f1_11 | 4821 | 210 | 69 | 69 | 0.028 | [ln:abrpab] [ac:x94765] [pn:dna-directed rna polymerase i] [gn:rpab] [or:agaricus bisporus] [sr:cultivated mushroom] [db:genpept-pln] [ec:2.7.7.6] [de:a.bisporus rpab mrna for dna-directed polymerase 1.] [le:<1] [re: |
| 4953201_f3_12 | 4822 | 1137 | 658 | 378 | 1.10E-64 | [ac:p42100] [gn:yxaa:as14a] [or:bacillus subtilis] [de:hypothetical 39.4 kd protein in gntr-htpg intergenic region] [sp:p42100] [db:swissprot] |
| 4953312_f3_3 | 4823 | 1269 | 1114 | 422 | 5.20E-113 | [ac:p19670:q03225] [gn:mura:murz] [or:bacillus subtilis] [ec:2.5.1.7] [de:enolpyruvyl transferase) (ept)] [sp:p19670:q03225] [db:swissprot] |
| 4954087_c2_26 | 4824 | 819 | 782 | 272 | 7.90E-78 | [ac:p70090] [pn:hypothetical protein yycj] [gn:yycj] [or:bacillus subtilis] [db:pir] |
| 4954713_f1_13 | 4825 | 1176 | 1928 | 391 | 2.90E-199 | [ac:p30758] [gn:reca] [or:streptococcus pneumoniae] [de:reca protein] [sp:p30758] [db:swissprot] |
| 4954837_f1_7 | 4826 | 816 | 306 | 271 | 2.20E-27 | [ac:q57233] [gn:thim:hi0415] [or:haemophilus influenzae] [ec:2.7.1.50] [de:hydroxyethylthiazole kinase) (thz kinase) (th kinase)] [sp:q57233] [db:swissprot] |
| 4960818_c2_86 | 4827 | 738 | 608 | 245 | 2.20E-59 | [ac:e69372] [pn:osmoprotection protein (prov) homolog] [or:archaeoglobus fulgidus] [db:pir] |
| 4960887_c1_13 | 4828 | 363 | 80 | 120 | 0.23 | [ac:e69324] [pn:polysaccharide biosynthesis protein homolog] [or:archaeoglobus fulgidus] [db:pir] |
| 4961703_c3_26 | 4829 | 894 | 295 | 297 | 3.20E-26 | [ac:p49330] [gn:rgg] [or:streptococcus gordonii challis] [de:rgg protein] [sp:p49330] [db:swissprot] |
| 4962756_f2_7 | 4830 | 291 | 271 | 96 | 1.10E-23 | [ac:d69979] [pn:conserved hypothetical protein yyrk] [gn:yyrk] [or:bacillus subtilis] [db:pir] |
| 4963512_f2_9 | 4831 | 201 | 50 | 66 | 0.38 | [ac:b69480] [pn:cobalamin biosynthesis protein (cbim-2) homolog] [or:archaeoglobus fulgidus] [db:pir] |
| 4963963_c3_22 | 4832 | 573 | 489 | 190 | 8.90E-47 | [ac:p44321] [gn:tag:hi0654] [or:haemophilus influenzae] [ec:3.2.2.20] [de:glycosylase) (tag)] [sp:p44321] [db:swissprot] |
| 4964213_c1_13 | 4833 | 873 | 307 | 290 | 8.50E-27 | [ac:q11046] [gn:mtcy50.09] [or:mycobacterium tuberculosis] [de:hypothetical abc transporter atp-binding protein cy50.09] [sp:q11046] [db:swissprot] |
| 4964562_c1_50 | 4834 | 285 | 382 | 94 | 1.90E-35 | [ln:llu76424] [ac:u76424] [pn:putative gtp binding protein] [or:lactococcus lactis] [db:genpept] [de:lactococcus lactis dnaa (dnaa) gene, partial cds; polymerase iiisubunit dnan (dnan), exonuclease rexb (rexb), and exonuclease rexa(rexa) genes, complete c |
| 4964682_f3_56 | 4835 | 1065 | 865 | 354 | 1.30E-86 | [ln:scu96107] [ac:u96107] [pn:n5,n10-methylenetetrahydromethanopterin] [or:staphylococcus carnosus] [db:genpept-bct] [de:staphylococcus carnosus n5,n10-methylenetetrahydromethanopterinreductase homolog, sceb precursor (sceb) and putative transmembraneprot |
| 4964687_c2_14 | 4836 | 750 | 97 | 249 | 0.03 | [ln:af007261] [ac:af007261] [pn:secy-type transporter protein] [gn:secy] |

TABLE 2-continued

| Orf | NT Seq ID | AA Seq ID | NT Orf Length | AA Orf Length | Score | Probability | Description |
|---|---|---|---|---|---|---|---|
| 4964687_c2_15 | 2234 | 4837 | 405 | 134 | 130 | 9.80E-09 | [or:mitochondrion reclinomonas americana] [sr:reclinomonas americana] [db:genpept-inv] [de:reclinomonas americana mitochondrial dna, complete genome.] [le:28012] [re:29244] [di:direc |
| 4978383_c1_57 | 2235 | 4838 | 843 | 280 | 731 | 2.00E-72 | [n:llu74322] [ac:u74322] [pn:unknown] [or:lactococcus lactis] [db:genpept-bct] [de:lactococcus lactis 6-phosphogluconate dehydrogenase gene completecds and potassium transporter homolog gene, partial cds.] [nt:orf1] [le:204] [re:764] [di:direct] |
| 506878_f2_22 | 2236 | 4839 | 306 | 101 | 64 | 0.092 | [ac:e69742] [pn:abc transporter (atp-binding protein) homolog ybae] [gn:ybae] [or:bacillus subtilis] [db:pir] |
| 5079035_f3_8 | 2237 | 4840 | 495 | 164 | 235 | 7.30E-20 | [ac:a53203] [pn:hypothetical protein 1] [or:desulfovibrio vulgaris] [db:pir] |
| 5081275_c2_40 | 2238 | 4841 | 303 | 100 | 97 | 3.10E-05 | [ac:s31638] [pn:hypothetical protein] [or:lactobacillus curvatus] [db:pir] |
| 5083586_f1_1 | 2239 | 4842 | 252 | 83 | 103 | 5.20E-05 | [ac:p00212] [gn:fer] [or:bacillus stearothermophilus] [de:ferredoxin] [sp:p00212] [db:swissprot] |
| 5084525_c2_57 | 2240 | 4843 | 3243 | 1080 | 4863 | 0 | [ac:d69029] [pn:pantothenate metabolism flavoprotein] [gn:mth1216] [or:methanobacterium thermoautotrophicum] [db:pir] [ln:strhyaluro] [ac:120670] [pn:hyaluronidase] [or:streptococcus pneumoniae] [sr:streptococcus pneumoniae (serotype 23) dna] [db:genpept-bct] [de:streptococcus pneumoniae hyaluronidase gene, complete cds.] [nt:putative] [le:90] [re:2939] |
| 5085775_c1_39 | 2241 | 4844 | 264 | 87 | 67 | 0.05 | [ac:p18389] [gn:yjb] [or:escherichia coli] [de:14.1 kd protein in dnat-bglj intergenic region (protein p-14) (f108)] [sp:p18389] [db:swissprot] |
| 5086066_f3_26 | 2242 | 4845 | 1416 | 471 | 1861 | 3.60E-192 | [ac:p80868;p70980] [gn:fusa:fus] [or:bacillus subtilis] [de:elongation factor g (ef-g) (vegetative protein 19) (veg19)] [sp:p80868:p70980] [db:swissprot] |
| 5088932_f3_11 | 2243 | 4846 | 609 | 202 | 721 | 2.30E-71 | [ac:p33170] [gn:tuf] [or:streptococcus oralis] [de:elongation factor tu (ef-tu)] [sp:p33170] [db:swissprot] |
| 509827_c3_70 | 2244 | 4847 | 3510 | 1169 | 2572 | 1.60E-267 | [ac:p37474] [gn:mfd] [or:bacillus subtilis] [de:transcription-repair coupling factor(trcf)] [sp:p37474] [db:swissprot] |
| 5101507_f2_5 | 2245 | 4848 | 438 | 145 | 305 | 2.80E-27 | [ac:d69843] [pn:conserved hypothetical protein yjbd] [gn:yjbd] [or:bacillus subtilis] [db:pir] |
| 5110087_c3_18 | 2246 | 4849 | 234 | 77 | 69 | 0.088 | [ln:mtcy7h7b] [ac:z95557] [pn:gcha] [gn:gcha] [or:mycobacterium tuberculosis] [db:genpept-bct] [de:mycobacterium tuberculosis region b of cosmid scy07h7.] [nt:mtcy07h7b.13, gcha, len:202 aa, similar to] [le:10907] [re:11515] [di:direct] |
| 5110207_c2_62 | 2247 | 4850 | 444 | 147 | 159 | 8.30E-12 | [ac:e69786] [pn:ribosomal-protein-alanine n-acetyltransfer homolog ydid] [gn:ydid] [or:bacillus subtilis] [db:pir] |
| 5111052_c3_16 | 2248 | 4851 | 531 | 176 | 892 | 1.70E-89 | [ac:p04043] [gn:dpnm] [or:streptococcus pneumoniae] [ec:2.1.1.72] [de:methyltransferase dpnii 1) (m.dpnii 1)] [sp:p04043] [db:swissprot] |
| 5111552_c1_74 | 2249 | 4852 | 666 | 221 | 173 | 2.80E-13 | [ac:s74490] [pn:type 4 prepilin peptidase hofd:hypothetical protein slr1120:hypothetical protein slr1120] [gn:hofd] [or:synechocystis sp.] [sr:pcc 6803, , pcc 6803] [sr:pcc 6803,] [db:pir] |
| 5120262_c3_15 | 2250 | 4853 | 744 | 247 | 613 | 6.40E-60 | [ac:p25813] [gn:gidb] [or:bacillus subtilis] [de:glucose inhibited division protein b] [sp:p25813] [db:swissprot] |
| 5120278_f1_4 | 2251 | 4854 | 1014 | 337 | 99 | 1.30E-05 | [ac:o69536] [pn:mevalonate kinase (mvk) homolog] [or:archaeoglobus fulgidus] [db:swissprot] |
| 5120338_c2_31 | 2252 | 4855 | 732 | 243 | 136 | 6.40E-07 | [ac:o69537] [pn:hypothetical protein af2299] [or:archaeoglobus fulgidus] [db:pir] |
| 5120338_f2_14 | 2253 | 4856 | 684 | 227 | 614 | 5.00E-60 | [ln:d78182] [ac:d78182] [gn:orf3] [or:streptococcus mutans] [sr:streptococcus mutans (strain:xc) dna] [db:genpept-bct] [de:streptococcus mutans dna for dtdp-rhamnose synthesis pathway,complete cds.] [le:1020] [re:1718] [di:direct] |
| 5134626_f1_3 | 2254 | 4857 | 204 | 67 | 121 | 5.00E-07 | [ln:cdu02617] [ac:u02617] [pn:dtxr/iron regulated lipoprotein precursor] [gn:irp1] [fn:iron transport] [or:corynebacterium diphtheriae] [db:genpept-bct] [de:corynebacterium diphtheriae dtxr/iron-regulated lipoproteinprecursor (irp1) gene, |
| 5136001_f1_11 | 2255 | 4858 | 204 | 67 | 48 | 0.039 | [ln:atac002341] [ac:ac002341] [gn:t14g11.28] [or:arabidopsis thaliana] [sr:thale cress] [db:genpept-pln] [de:arabidopsis thaliana chromosome ii bac t14g11 genomic |

TABLE 2-continued

| Orf | NT Seq ID | AA Seq ID | NT Orf Length | AA Orf Length | Score Probability | Description |
|---|---|---|---|---|---|---|
| 5136510_f1_4 | 2256 | | | | | sequence, complete sequence.] [nt:unknown protein] [le:77038:77428:77577:77729] [re:77157:774 |
| | | 3309 | 1303 | | 4.90E-133 | [ln:llu76424] [accu76424] [pn:exonuclease rexb] [gn:rexb] [or:lactococcus lactis] [db:genpept] [de:lactococcus lactis dnaa (dnaa) gene, partial cds; polymerase iiisubunit dnan (dnan), exonuclease rexb (rexb), and exonuclease rexa(rexa) genes, complete cds |
| 5189162_f2_22 | 2257 | 867 | 266 | 288 | 3.80E-23 | [ac:e64128] [pn:tlic-1 protein d] [gn:tlicd] [or:haemophilus influenzae] [db:pir] |
| 5195885_c3_122 | 2258 | 1215 | 335 | 404 | 1.80E-30 | [ln:ae001169] [ac:ae001169;ae000783] [pn:3-hydroxy-3-methylglutaryl-coa synthase] [gn:bb0683] [or:borrelia burgdorferi] [sr:lyme disease spirochete] [db:genpept-bct] [de:borrelia burgdorferi (section 55 of 70) of the complete genome.] [nt:similar to gb:x8 |
| 5209426_f1_4 | 2259 | 954 | 1061 | 317 | 2.20E-107 | [ac:q08510] [gn:mala] [or:streptococcus pneumoniae] [de:mala protein] [sp:q08510] [db:swissprot] |
| 522562_f2_19 | 2260 | 207 | 59 | 68 | 0.75 | [ln:aadoxp24h] [ac:y08730] [pn:c-terminal part of hydrophobic protein] [gn:orf2] [or:acidianus ambivalens] [db:genpept-bct] [de:a.ambivalens doxa gene locus with doxd and doxa genes.] [le:<1] [re:667] [di:direct] |
| 5251878_c3_72 | 2261 | 1347 | 106 | 448 | 0.014 | [ln:ae001115] [ac:ae001115:ae000783] [pn:phosphoglucomutase (femd)] [gn:bb0004] [or:borrelia burgdorferi] [sr:lyme disease spirochete] [db:genpept-bct] [de:borrelia burgdorferi (section 1 of 70) of the complete genome.] [nt:similar to gb:177117 pid:159174 |
| 5251967_f1_4 | 2262 | 888 | 1066 | 295 | 6.40E-108 | [ln:ab009314] [ac:ab009314] [pn:proton-translocating atpase, gamma subunit] [gn:atpg] [or:streptococcus bovis] [sr:streptococcus bovis (strain:jb-1) dna] [db:genpept-bct] [de:streptococcus bovis gene for proton-translocating atpase subunits,complete cds.] |
| 5266578_f2_6 | 2263 | 909 | 1194 | 302 | 1.70E-121 | [ln:af017421] [ac:af017421] [pn:putative heat shock protein htpx] [gn:htpx] [or:streptococcus gordonii] [db:genpept-bct] [de:streptococcus gordonii putative heat shock protein htpx (htpx)gene, complete cds.] [le:127] [re:1020] [di:direct] |
| 5267213_c3_83 | 2264 | 654 | 358 | 217 | 6.70E-33 | [ac:p00888] [gn:arof] [or:escherichia coli] [ec:4.1.2.15] [de:synthetase] (3-deoxy-d-arabino-heptulosonate 7-phosphate synthase)] [sp:p00888] [db:swissprot] |
| 5267213_f1_1 | 2265 | 879 | 1439 | 292 | 1.90E-147 | [ac:p72535] [gn:thrb] [or:streptococcus pneumoniae] [ec:2.7.1.39] [de:homoserine kinase, (hk)] [sp:p72535] [db:swissprot] |
| 5267812_c1_29 | 2266 | 1236 | 982 | 411 | 5.10E-99 | [ac:e69988] [pn:conserved hypothetical protein ytbj] [gn:ytbj] [or:bacillus subtilis] [db:pir] |
| 5267968_f2_25 | 2267 | 501 | 450 | 166 | 1.20E-42 | [ac:a70024] [pn:conserved hypothetical protein yutg] [gn:yutg] [or:bacillus subtilis] [db:pir] |
| 5271967_f2_17 | 2268 | 222 | 120 | 73 | 1.10E-07 | [ac:p43914] [gn:xseb:thi1437] [or:haemophilus influenzae] [db:swissprot] subunit)] [sp:p43914] |
| 5273265_c2_55 | 2269 | 1791 | 645 | 596 | 2.60E-63 | [ac:p22638] [gn:heta] [or:anabaena sp] [srpcc 7120,] [de:heterocyst differentiation atp-binding protein heta] [sp:p22638] [db:swissprot] |
| 5273403_f3_23 | 2270 | 261 | 70 | 86 | 0.15 | [ln:celk05f6] [ac:af040653] [pn:k05f6.9] [or:caenorhabditis elegans] [sr:caenorhabditis elegans strain=bristol n2] [db:genpept-inv] [de:caenorhabditis elegans cosmid k05f6.] [le:31566:32526] [re:32478:32611] [di:complementjoin] |
| 5273463_f2_24 | 2271 | 885 | 719 | 294 | 3.80E-71 | [ln:pbu42580] [ac:u42580:u17055:u32570] [gn:a78r] [or:paramecium bursaria chlorella virus 1] [db:genpept-vrl] [de:paramecium bursaria chlorella virus 1, complete genome.] [nt:contains atp/gtp-binding site motif a; similar to] [le:40886] [re:41782] [di:dir |
| 5274012_c2_14 | 2272 | 768 | 321 | 255 | 5.60E-29 | [ln:sadired] [ac:z16422] [pn:unknown] [gn:orf2] [or:staphylococcus aureus] [db:genpept-bct] [de:s.aureus dfrb gene for dihydrofolate reductase,] [le:646] [re:1230] |
| 5274192_c2_80 | 2273 | 579 | 292 | 192 | 6.60E-26 | [ac:p35155] [gn:ypuh] [or:bacillus subtilis] [de:hypothetical 22.0 kd protein in ribt-dacb intergenic region (orfx8)] [sp:p35155] [db:swissprot] |
| 5275250_c1_59 | 2274 | 795 | 69 | 264 | 0.017 | [ln:ae001158] [ac:ae001158:ae000783] [pn:conserved hypothetical integral membrane] [gn:bb0574] [or:borrelia burgdorferi] [sr:lyme disease spirochete] [db:genpept-bct] [de:borrelia burgdorferi (section 44 of 70) of the complete genome.] [nt:similar to pir: |

TABLE 2-continued

| Orf | NT Seq ID | AA Seq ID | NT Orf Length | AA Orf Length | Score | Probability | Description |
|---|---|---|---|---|---|---|---|
| 5275332_f3_9 | 4878 | 723 | 240 | 692 | 2.70E-68 | | [ac:f69725] [pn:trna methyltransferase trmd] [gn:trmd] [or:bacillus subtilis] [db:pir] |
| 5275337_c2_60 | 4879 | 225 | 74 | 69 | 0.028 | | [ln:spu11955] [acc:u11955] [gn:emm] [or:streptococcus pyogenes] [db:genpept-bct] [de:streptococcus pyogenes m type 22 (emm) gene, partial cds.] [le:<1] [re: |
| 5275338_f1_14 | 4880 | 801 | 266 | 509 | 6.70E-49 | | [ln:adu92287] [acc:u92287] [pn:pyrroline-5-carboxylate reductase] [or:actinidia deliciosa] [db:genpept-pln] [de:actinidia deliciosa pyrroline-5-carboxylate reductase mrna,complete cds.] [le:30] [re:866] [di:direct] |
| 5282950_c1_17 | 4881 | 198 | 65 | 59 | 0.05 | | [ln:s74025] [acc:s74025] [pn:map-2] [or:bos taurus] [sr:cattle brain] [db:genpept-mam] [de:map-2=microtubule-associated protein-2 {3' region} [cattle, brain,mrna partial, 963 nt].] [nt:microtubule-associated protein-2; method:] [le:1] [re:963] |
| 5291062_f1_2 | 4882 | 540 | 179 | 129 | 3.30E-07 | | [ac:h69815] [pn:hypothetical protein ygae] [gn:ygae] [or:bacillus subtilis] [db:pir] |
| 5292177_f1_2 | 4883 | 5904 | 1967 | 1280 | 5.00E-142 | | [ln:smiga1pt] [acc:y10285] [pn:igal protease] [gn:iga1] [or:streptococcus mitis] [db:genpept-bct] [ec:3.4.24.13] [de:s.mitis iga gene.] [nt:iga-specific metalloendopeptidase] [le:64] [re:5628] [di:direct] |
| 5292213_f2_9 | 4884 | 1416 | 471 | 2109 | 1.90E-218 | | [ln:ab009314] [acc:ab009314] [pn:proton-translocating atpase, beta subunit] [gn:atpd] [or:streptococcus bovis] [sr:streptococcus bovis (strain:jb-1) dna] [db:genpept-bct] [de:streptococcus bovis gene for proton-translocating atpase subunits,complete cds.] |
| 5292287_c1_18 | 4885 | 858 | 285 | 149 | 9.80E-09 | | [ac:q58322] [gn:mj0912] [or:methanococcus jannaschii] [de:hypothetical protein mj0912] [sp:q58322] [db:swissprot] |
| 5292962_c2_19 | 4886 | 462 | 153 | 109 | 1.60E-06 | | [ac:a69783] [pn:transcriptional regulator (marr family) homolog ydgg] [gn:ydgg] [or:bacillus subtilis] [db:pir] |
| 5318788_c1_6 | 4887 | 981 | 326 | 497 | 1.30E-47 | | [ac:p54545] [gn:yqjh] [or:bacillus subtilis] [de:hypothetical 47.0 kd protein in glnq-ansr intergenic region] [sp:p54545] [db:swissprot] |
| 5320291_c3_44 | 4888 | 222 | 73 | 68 | 0.21 | | [ln:ab004537] [acc:ab004537] [pn:pas4 protein] [gn:p1036] [or:schizosaccharomyces pombe] [sr:schizosaccharomyces pombe (strain:972 h-) dna, clone _lib:mizukan] [db:genpept-pln] [de:schizosaccharomyces pombe 37 kb genomic dna, clone c213.] [nt:similar to s.c |
| 5322707_c3_15 | 4889 | 357 | 118 | 123 | 4.70E-07 | | [ln:s75490] [acc:s75490] [gn:orf2] [or:neisseria gonorrhoeae] [sr:neisseria gonorrhoeae ms11] [db:genpept-bct] [de:competence region:iga=iga protease coma=transformation competence[neisseria gonorrhoeae, ms11, genomic, 3 genes 2664 nt].] [le:889] [re:22 |
| 5322817_c2_51 | 4890 | 360 | 119 | 90 | 0.00082 | | [ac:so0743] [pn:secreted antigen p36/p34 precursor] [or:mycobacterium bovis] [db:pir] |
| 5323526_f1_1 | 4891 | 282 | 93 | 120 | 1.10E-07 | | [ln:humbindc] [acc:110405] [pn:dna-binding protein] [sr:homo sapiens] [sr:homo sapiens cdna to mrna] [db:genpept-pri1] [de:homo sapiens dna binding protein for surfactant protein b mrna,complete cds.] [le:1577] [re:1930] [di:direct] |
| 5323817_c2_38 | 4892 | 879 | 292 | 122 | 2.50E-05 | | [ac:s75891] [pn:hypothetical protein] [or:synechocystis sp] [sr:pcc 6803, , pcc 6803] [sr:pcc 6803, ] [db:pir] |
| 5330008_c2_32 | 4893 | 201 | 67 | 65 | 0.096 | | [ac:q00779] [gn:atp2a2] [or:felis silvestris catus] [sr:,cat] [ec:3.6.1.38] [de:calcium pump) (serca2)] [sp:q00779] [db:swissprot] |
| 5344687_c2_13 | 4894 | 213 | 70 | 67 | 0.045 | | [ac:p20624] [gn:fdxb] [or:rhodobacter capsulatus] [sr:rhodopseudomonas capsulata] [de:ferredoxin iii (fdiii)] [sp:p20624] [db:swissprot] |
| 5355015_f3_48 | 4895 | 1041 | 346 | 1405 | 7.60E-144 | | [ln:spz82002] [acc:z82002] [pn:pcpe] [gn:pcpe] [fn:unknown] [or:streptococcus pneumoniae] [db:genpept-bct] [de:s.pneumoniae pcpb and pcpe genes.] [nt:pcpc contains a choline binding domain] [le:1401] [re:22285] [di:direct] |
| 5367312_c1_56 | 4896 | 657 | 218 | 148 | 6.90E-09 | | [ln:bsu87792] [acc:u87792] [pn:unknown] [or:bacillus subtilis] [db:genpept-bct] [de:bacillus subtilis trna-ala, phosphatidylglycerophosphate synthase(pgsa) and cina (cina) genes, complete cds, and reca (reca) gene,partial cds.] [nt:orf307; hypothetical |
| 5367767_f1_5 | 4897 | 741 | 246 | 121 | 2.10E-05 | | [ac:h69779] [pn:antibiotic resistance protein homolog yulc] [gn:yulc] [or:bacillus subtilis] [db:pir] |
| 5369162_f1_4 | 4898 | 1452 | 483 | 771 | 1.20E-76 | | [ac:c70014] [pn:rhamnulokinase homolog yulc] [gn:yulc] [or:bacillus subtilis] [db:pir] |

TABLE 2-continued

| Orf | NT Seq ID | AA Seq ID | NT Orf Length | AA Orf Length | Score | Probability | Description |
|---|---|---|---|---|---|---|---|
| 5370313_c1_20 | 2296 | 4899 | 198 | 65 | 74 | 0.13 | [ln:cef22d3] [ac:u28993] [gn:f22d3.1] [or:caenorhabditis elegans] [sr:caenorhabditis elegans strain=bristol n2] [db:genpept-inv] [de:caenorhabditis elegans cosmid f22d3.] [nt:coded for by c. elegans cdna yk34n2.5; coded for by] [le:27077-27160:27520:2775 |
| 54702_f1_10 | 2297 | 4900 | 753 | 250 | 1294 | 4.40E-132 | [ln:spu33315] [ac:u33315] [pn:response regulator] [gn:come] [or:streptococcus pneumoniae] [db:genpept-bct] [de:streptococcus pneumoniae orf1 gene, partial cds, competencestimulating peptide precursor (comc), histidine protein kinase(comd) and response reg |
| 547760_f3_42 | 2298 | 4901 | 1095 | 364 | 670 | 5.80E-66 | [ln:llpyrc] [ac:x78999] [gn:unknown] [or:lactobacillus leichmannii] [db:genpept-bct] [de:l.leichmannii pyrc gene.] [le:1827] [re: |
| 548512_f2_11 | 2299 | 4902 | 1206 | 401 | 969 | 1.20E-97 | [ac:p50853] [gn:ribd:nibg] [or:actinobacillus pleuropneumoniae] [sr:haemophilus pleuropneumoniae] [ec:3.5.4.—] [de:riboflavin-specific deaminase] [sp:p50853] [db:swissprot] |
| 549090_f3_10 | 2300 | 4903 | 405 | 134 | 94 | 0.00021 | [ac:s57993] [pn:chalcone reductase homolog] [or:sesbania rostrata] [db:pir] |
| 550002_f3_11 | 2301 | 4904 | 264 | 87 | 82 | 0.0021 | [ln:msimtfr4a] [ac:m83759] [pn:nadh dehydrogenase] [gn:nd1] [or:mitochondrion mytilus edulis] [sr:mitochondrion mytilus edulis (organelle mitochondrion mytilu [db:genpept-inv] [de:mytilus edulis mitochondrial nadh dehydrogenase subunit 1 (nd1)gene, 3′ en |
| 554503_f2_26 | 2302 | 4905 | 771 | 273 | 822 | 1.20E-76 | [ln:ctsialida] [ac:y08695] [pn:putative acylneuraminate lyase] [or:clostridium tertium] [db:genpept-bct] [ec:4.1.3.3] [de:clostridium tertium nanh gene.] [nt:monomer] [le:2481] [re: |
| 555127_c2_30 | 2303 | 4906 | 1443 | 480 | 1679 | 7.00E-173 | [ac:s52736] [pn:glucosyltransferase] [or:streptococcus pneumoniae] [db:pir] |
| 556567_c2_87 | 2304 | 4907 | 216 | 71 | 53 | 0.11 | [ln:pfcompirb] [ac:x95276] [gn:rps4] [or:plasmodium falciparum] [sr:malaria parasite] [db:genpept-inv] [de:p.falciparum complete gene map of plastid-like dna (ir-b).] [le:340] [re:966] [di:direct] |
| 569688_c3_50 | 2305 | 4908 | 213 | 70 | 50 | 0.47 | [ln:af019757] [ac:af019757] [pn:aggrecan interglobular domain] [or:sus scrofa] [sr:pig] [db:genpept-mam] [de:sus scrofa aggrecan interglobular domain mrna, partial cds.] [le:<1] [re: |
| 569688_c3_68 | 2306 | 4909 | 213 | 70 | 50 | 0.47 | [ln:af019757] [ac:af019757] [pn:aggrecan interglobular domain] [or:sus scrofa] [sr:pig] [db:genpept-mam] [de:sus scrofa aggrecan interglobular domain mrna, partial cds.] [le:<1] [re: |
| 569688_c3_94 | 2307 | 4910 | 213 | 70 | 50 | 0.47 | [ln:af019757] [ac:af019757] [pn:aggrecan interglobular domain] [or:sus scrofa] [sr:pig] [db:genpept-mam] [de:sus scrofa aggrecan interglobular domain mrna, partial cds.] [le:<1] [re: |
| 572836_f1_7 | 2308 | 4911 | 909 | 302 | 742 | 1.40E-73 | [ac:a69879] [pn:conserved hypothetical protein yloq] [gn:yloq] [or:bacillus subtilis] [db:pir] |
| 579462_f1_8 | 2309 | 4912 | 210 | 69 | 205 | 1.10E-16 | [ln:spnana] [ac:x72967] [or:streptococcus pneumoniae] [db:genpept-bct] [de:s.pneumoniae nana gene.] [nt:orf2] [le:193] [re:495] [di:direct] |
| 580306_f2_12 | 2310 | 4913 | 828 | 275 | 72 | 0.07 | [ln:glav14131] [ac:y14131] [pn:hypothetical protein] [or:grapevine leafroll-associated virus 2] [db:genpept-vrl] [de:grapevine leafroll-associated virus 2 genes encoding ma polymeraseand coat protein, hsp70, hsp90 gene and orf2, orf7 and orf8.] [nt:orf2] |
| 581875_c3_13 | 2311 | 4914 | 633 | 210 | 1.90E-60 | | [ac:f69708] [pn:uridylate kinase smba] [gn:smba] [or:bacillus subtilis] [db:pir] |
| 585952_f3_41 | 2312 | 4915 | 660 | 219 | 77 | 0.11 | [ac:d69481] [pn:transcriptional regulatory protein, arsr family homolog] [or:archaeoglobus fulgidus] [db:pir] |
| 5863902_f3_26 | 2313 | 4916 | 1011 | 336 | 4.20E-79 | | [ac:p37465] [gn:mets] [or:bacillus subtilis] [ec:6.1.1.10] [de:(mets)] [sp:p37465] [db:swissprot] |
| 5876531_f1_5 | 2314 | 4917 | 915 | 304 | 1542 | 2.30E-158 | [ln:spu43526] [ac:u43526] [or:streptococcus pneumoniae] [db:genpept-bct] [de:streptococcus pneumoniae neuraminidase b (nanb) gene, complete cds,and neuraminidase (nana) gene, partial cds.] [nt:orf-3] [le:3367] [re:4251] [di:direct] |
| 5881937_f2_27 | 2315 | 4918 | 1047 | 348 | 829 | 8.30E-83 | [ac:p37567] [gn:yacf] [or:bacillus subtilis] [de:hypothetical 37.1 kd protein in folk-lyss |

TABLE 2-continued

| Orf | NT Seq ID | AA Seq ID | NT Orf Length | AA Orf Length | Score | Probability | Description |
|---|---|---|---|---|---|---|---|
| 2316 | 4919 | 2013 | 3322 | 670 | | 0 | intergenic region] [sp:p37567] [db:swissprot] [ln:spgyrborf] [ac:z67740] [pn:dna gyrase] [gn:gyrb] [or:streptococcus pneumoniae] [db:genpept-bct] [de:s.pneumoniae gyrb gene and unknown orf.] [nt:gyrb subunit] [e:452] [re:2398] [di:direct] |
| 2317 | 4920 | 444 | 82 | 147 | | 0.51 | [ac:p75207] [or:mycoplasma pneumoniae] [de:hypothetical atp-binding protein mg390 homolog] [sp:p75207] [db:swissprot] |
| 2318 | 4921 | 246 | 64 | 81 | | 0.092 | [ac:p01627] [or:mus musculus] [sr:,mouse] [de:ig kappa chain precursor v-ii region (vkappa167)] [sp:p01627] [db:swissprot] |
| 2319 | 4922 | 906 | 294 | 301 | | 4.10E-26 | [ac:c69858] [pn:conserved hypothetical protein yknx] [gn:yknx] [or:bacillus subtilis] [db:pir] |
| 2320 | 4923 | 918 | 221 | 305 | | 6.00E-22 | [ln:lcu28163] [ac:u28163] [pn:eiic-man] [gn:manc] [or:lactobacillus curvatus] [db:genpept-bct] [de:lactobacillus curvatus phosphoenolpyruvate:mannosephosphotransferase eiia-man (mana), eiib-man (manb), and eiic-man(manc) genes, complete cds and eiid-man ( |
| 2321 | 4924 | 399 | 107 | 132 | | 2.70E-06 | [ac:h69267] [pn:cytochrome c oxidase, subunit ii (cbab) homolog] [or:archaeoglobus fulgidus] [db:pir] |
| 2322 | 4925 | 1353 | 409 | 450 | | 2.70E-38 | [ln:u93688] [ac:u93688] [or:staphylococcus aureus] [db:genpept-bct] [de:staphylococcus aureus toxic shock syndrome toxin-1 (tst),enterotoxin (ent), and integrase (int) genes, complete cds.] [nt:orf11] [le:7956] [re:8729] [di:complement] |
| 2323 | 4926 | 399 | 85 | 132 | | 0.12 | [ac:b64701] [pn:60 kda inner-membrane protein] [or:helicobacter pylori] [db:pir] |
| 2324 | 4927 | 201 | 62 | 66 | | 0.52 | [ac:s65062] [pn:fiber protein e6 (clone cke6-4a)] [or:gossypium hirsutum] [sr:, upland cotton] [db:pir] |
| 2325 | 4928 | 1239 | 169 | 412 | | 7.80E-10 | [ac:s74444] [pn:hypothetical protein s111204] [or:synechocystis sp.] [sr:pcc 6803, , pcc 6803] [sr:pcc 6803, ] [db:pir] |
| 2326 | 4929 | 321 | 66 | 106 | | 0.057 | [ln:spz282001] [ac:z82001] [pn:unknown] [or:streptococcus pneumoniae] [db:genpept-bct] [de:s.pneumoniae pcpa gene and open reading frames.] [le:<1] [re:174] [di:direct] |
| 2327 | 4930 | 474 | 314 | 157 | | 3.10E-28 | [ac:h69278] [pn:glutamine abc transporter, permease protein (glnp) homolog] [or:archaeoglobus fulgidus] [db:pir] |
| 2328 | 4931 | 207 | 63 | 68 | | 0.42 | [ln:af036708] [ac:af036708] [pn:ribosomal protein 13] [gn:rp13] [or:mycoplasma gallisepticum] [db:genpept-bct] [de:mycoplasma gallisepticum strain a5969var.b ribosomal proteins s10(rps10), 13 (rp13), 14 (rp14), 123 (rp123), 12 (rp12), s19 (rps19),122 (rp |
| 2329 | 4932 | 249 | 64 | 82 | | 0.23 | [ac:q01223] [gn:b19r] [or:vaccinia virus] [sr:wr,] [de:protein b19] [sp:q01223] [db:swissprot] |
| 2330 | 4933 | 219 | 64 | 72 | | 0.15 | [ln:ceic49d10] [ac:af016665] [gn:c49d10.7] [or:caenorhabditis elegans] [sr:caenorhabditis elegans strain=bristol n2] [db:genpept-inv] [de:caenorhabditis elegans cosmid c49d10.] [nt:contains similarity to acyltransferases] [e:1188:1374:1757] [re:1304:1589 |
| 2331 | 4934 | 969 | 370 | 323 | | 3.60E-34 | [ac:p05149] [gn:mro] [or:acinetobacter calcoaceticus] [ec:5.1.3.3] [de:aldose 1-epimerase precursor, (mutarotase)] [sp:p05149] [db:swissprot] |
| 2332 | 4935 | 225 | 59 | 74 | | 0.93 | [ac:24970] [gn:mtnd2:nadh2] [or:balaenoptera physalus] [sr:,finback whale:common roqual] [ec:1.6.5.3] [de:nadh-ubiquinone oxidoreductase chain 2,] [sp:24970] [db:swissprot] |
| 2333 | 4936 | 241 | 73 | 80 | | 0.061 | [ac:p87378] [gn:crk] [or:xenopus laevis] [sr:,african clawed frog] [de:sh2/sh3 adaptor crk (adapter molecule crk) (crk2)] [sp:p87378] [db:swissprot] |
| 2334 | 4937 | 360 | 76 | 119 | | 0.65 | [ln:d64052] [ac:d64052] [pn:cytochrome p450 like _tbp] [gn:ctbp] [or:nicotiana tabacum] [sr:nicotiana tabacum (strain:bright yellow 2) cdna to mrna] [db:genpept-pln] [ec:1.14.14.1] [de:tobacco mrna for cytochrome p450 like _tbp, complete cds.] [le:155] [re: |

TABLE 2-continued

| Orf | NT Seq ID | AA Seq ID | NT Orf Length | AA Orf Length | Score | Probability | Description |
|---|---|---|---|---|---|---|---|
| 5968801_c1_7 | 2335 | 4938 | 783 | 260 | 295 | 3.20E-26 | [ac:p39153] [gn:ywlc;ipc-29d] [or:*bacillus subtilis*] [de:hypothetical 37.0 kd protein in spoiir-glyc intergenic region] [sp:p39153] [db:swissprot] |
| 597058_f3_9 | 2336 | 4939 | 297 | 98 | 256 | 4.30E-22 | [ac:b64666] [pn:glutamine abc transporter, permease protein] [or:*helicobacter pylori*] [db:pir] |
| 5970678_f3_43 | 2337 | 4940 | 312 | 103 | 59 | 0.28 | [ac:s43286] [pn:murf4 protein] [or:*trypanosoma cruzi*] [db:pir] |
| 5977188_f3_40 | 2338 | 4941 | 318 | 105 | 69 | 0.028 | [ac:p01058] [or:*phaseolus angularis*] [sr:,adzuki bean;*vigna angularis*] [de:bowman-birk type proteinase inhibitor] [sp:p01058] [db:swissprot] |
| 5978942_f1_1 | 2339 | 4942 | 858 | 285 | 472 | 5.60E-45 | [ac:g69295] [pn:oxalate/formate antiporter (oxlt-2) homolog] [or:*archaeoglobus fulgidus*] [db:pir] |
| 5984525_f3_49 | 2340 | 4943 | 258 | 85 | 111 | 1.60E-05 | [ac:a30374;q90796] [pn:hypothetical 77k protein (spot 3' region)] [or:*escherichia coli*] [db:pir] [mp:82 min] |
| 5991712_f2_2 | 2341 | 4944 | 1929 | 642 | 1116 | 2.30E-183 | [ac:g69773] [pn:conserved hypothetical protein ydci] [gn:ydci] [or:*bacillus subtilis*] [db:pir] |
| 5992081_c2_47 | 2342 | 4945 | 207 | 68 | 66 | 0.46 | [ln:cel40g12] [ac:z77661] [pn:f40g12.10] [or:*caenorhabditis elegans*] [db:genpept-inv] [de:*caenorhabditis elegans* cosmid f40g12, complete sequence,] [nt:similar to protein-tyrosine phosphatase] [le:28215:28401:28641:29132] [re:28298:28592:28964:29521] [di: |
| 5992836_f1_7 | 2343 | 4946 | 195 | 64 | 60 | 0.23 | [ac:p20958] [or:*chlorobium limicola f. spthiosulfatophilum*] [de:cytochrome subunit of sulfide dehydrogenase (flavocytochrome c)] [sp:p20958] [db:swissprot] |
| 5992836_f3_20 | 2344 | 4947 | 198 | 65 | 48 | 0.64 | [ln:nau13256] [ac:u13256] [pn:rnase ne] [fn:extracellular ribonuclease] [or:*nicotiana alata*] [sr:persian tobacco] [db:genpept-pln] [de:*nicotiana alata* mase ne mrna, complete cds.] [le:26] [re:721] [di:direct] |
| 6015662_c3_54 | 2345 | 4948 | 222 | 73 | 58 | 0.75 | [ln:sc23cds] [ac:x86470] [pn:unknown] [gn:orf] [or:*saccharomyces cerevisiae*] [sr:baker's yeast] [db:genpept-pln] [de:*s.cerevisiae* pms1, tpm1, mks1, ymk1, mskl, odp2, y19a, & fkh2 genes.] [nt:n2348, len:191, cai:0.061] [le:10953] [re:11528] |
| 601627_c2_17 | 2346 | 4949 | 990 | 329 | 235 | 9.60E-20 | [ln:ssu34305] [ac:u34305] [or:*shigella sonnei*] [sr:*shigella sonnei* strain=53g] [db:genpept-bct] [de:*shigella sonnei* form i operon orf protein genes, complete cds,insertion sequence is630 protein gene, complete cds.] [nt:orf7; method: conceptual translatio |
| 6016963_f3_23 | 2347 | 4950 | 678 | 225 | 75 | 0.093 | [ac:p29383] [gn:ag13] [or:*arabidopsis thaliana*] [sr:mouse-ear cress] [de:floral homeotic protein ag13 (fragment)] [sp:p29383] [db:swissprot] |
| 602193_f1_1 | 2348 | 4951 | 1131 | 376 | 749 | 2.50E-74 | [ac:s66080;i40018] [pn:cell division protein tms26] [gn:tms26] [or:*bacillus subtilis*] [db:pir] |
| 6022510_f3_39 | 2349 | 4952 | 237 | 78 | 55 | 0.14 | [ac:p11449] [gn:vm26a;vm26a.1] [or:*drosophila melanogaster*] [sr:,fruit fly] [de:sv17.5)] [sp:p11449] [db:swissprot] |
| 6026712_f1_3 | 2350 | 4953 | 1488 | 495 | 1077 | 4.30E-109 | [ac:p21885;p26934] [gn:cad] [or:*bacillus subtilis*] [db:swissprot] [de:lysine decarboxylase, (ldc)] [sp:p21885;p26934] |
| 604087_c3_44 | 2351 | 4954 | 309 | 102 | 52 | 0.83 | [ac:p49828] [or:*odontella sinensis*] [de:hypothetical 5.5 kd protein in yct5-rps6 intergenic region (orf46)] [sp:p49828] [db:swissprot] |
| 6048200_f2_22 | 2352 | 4955 | 267 | 88 | 69 | 0.028 | [ac:ps0142] [pn:replication-associated protein] [gn:11"] [or:sugarcane streak virus] [db:pir] |
| 6048437_f1_10 | 2353 | 4956 | 1026 | 341 | 630 | 1.00E-61 | [ac:b69763] [pn:ferrichrome abc transporter (permease) homolog ycln] [gn:ycln] [or:*bacillus subtilis*] [db:pir] |
| 6053378_c3_49 | 2354 | 4957 | 840 | 279 | 351 | 3.70E-32 | [ac:s42925] [pn:probable transport protein] [or:*staphylococcus aureus*] [db:pir] |
| 6054075_f2_21 | 2355 | 4958 | 426 | 141 | 251 | 1.50E-21 | [ac:s56085] [pn:regulatory protein copy] [gn:copy] [or:*enterococcus hirae*] [db:pir] |
| 6054812_c2_19 | 2356 | 4959 | 264 | 87 | 94 | 0.00017 | [ln:mtcy22d7] [ac:z83866] [pn:unknown] [gn:mtcy22d7.23] [or:*mycobacterium tuberculosis*] [db:genpept-bct] [de:*mycobacterium tuberculosis* cosmid scy22d7. nt:mtcy22d7.23, len:216. function: unknown, resembles] [le:24752] [re:25402] [di:direct] |

TABLE 2-continued

| Orf | NT Seq ID | AA Seq ID | NT Orf Length | AA Orf Length | Score | Probability | Description |
|---|---|---|---|---|---|---|---|
| 6057827_f1_3 | 2357 | 4960 | 267 | 88 | 67 | 0.093 | [ac:c32322] [pn:lignin peroxidase, v4] [cl:lignin peroxidase] [or:phanerochaete chrysosporium] [ec:1.11.1.—] [db:pir] |
| 6064537_f3_25 | 2358 | 4961 | 282 | 93 | 79 | 0.097 | [ac:p12351] [gn:cyp1:hap1:yh256w] [or:saccharomyces cerevisiae] [sr:,baker's yeast] [de:cyp1 activatory protein] [sp:p12351] [db:swissprot] |
| 6070932_c1_28 | 2359 | 4962 | 357 | 118 | 89 | 0.00022 | [ln:spnana] [ac:x72967] [or:streptococcus pneumoniae] [db:genpept-bct] [de:pneumoniae nana gene.] [nt:orf2] [le:193] [re:495] [di:direct] |
| 6094412_c3_101 | 2360 | 4963 | 516 | 171 | 176 | 6.50E-13 | [ln:u93688] [ac:u93688] [pn:integrase] [gn:int] [or:staphylococcus aureus] [db:genpept-bct] [de:staphylococcus aureus toxic shock syndrome toxin-1 (tst),enterotoxin (ent), and integrase (int) genes, complete cds.] [nt:similar to staphylococcal phage integ ent |
| 6124068_f2_6 | 2361 | 4964 | 303 | 100 | 72 | 0.3 | [ac:b48529] [pn:mitochondrial processing peptidase, beta chain precursor:p-53:ubiquinol—cytochrome-c reductase, core protein ii] [cl:mitochondrial processing peptidase alpha chain] [or:solanum tuberosum] [sr:, potato] [ec:3.4.99.41:1.10.2.2] [db:pir] |
| 6132952_c1_53 | 2362 | 4965 | 897 | 298 | 519 | 5.90E-50 | [ac:p06567] [gn:dnaJ] [or:bacillus subtilis] [de:primosomal protein dnaJ] [sp:p06567] [db:swissprot] |
| 6148963_f3_39 | 2363 | 4966 | 609 | 202 | 615 | 3.90E-60 | [ln:lmu15554] [ac:u15554] [pn:p-type adenosine triphosphatase] [gn:ctpa] [fn:involved in cation transport] [or:listeria monocytogenes] [db:genpept-bct] [de:listeria monocytogenes p-type adenosine triphosphatase (ctpa) gene,partial cds.] [nt:similar to ent |
| 6149127_c1_68 | 2364 | 4967 | 456 | 151 | 97 | 0.00024 | [ln:ssk3meca1] [ac:y13052] [gn:orf145] [or:staphylococcus sciuri] [db:genpept-bct] [de:s.sciuri mecaI gene, strain k3(mm2).] [le:3749] [re:4186] [di:direct] |
| 6251700_f1_3 | 2365 | 4968 | 201 | 66 | 61 | 0.39 | [ac:p15553] [gn:nd6] [or:strongylocentrotus purpuratus] [sr:purple sea urchin] [ec:1.6.5.3] [de:nadh-ubiquinone oxidoreductase chain 6,] [sp:p15553] [db:swissprot] |
| 6254758_c1_9 | 2366 | 4969 | 228 | 75 | 103 | 7.10E-06 | [ln:spzs82001] [ac:z82001] [pn:unknown] [or:streptococcus pneumoniae] [db:genpept-bct] [de:s.pneumoniae pcpa gene and open reading frames.] [le:<1] [re:174] [di:direct] |
| 6258467_c3_39 | 2367 | 4970 | 786 | 261 | 439 | 1.80E-41 | [ac:p39610] [gn:thid:ipa-52r] [or:bacillus subtilis] [ec:2.7.4.7] [de:(hmp-p kinase)] [sp:p39610] [db:swissprot] |
| 6260875_c1_170 | 2368 | 4971 | 414 | 137 | 77 | 0.004 | [ac:a72760] [pn:divergicin a precursor] [or:carnobacterium divergens] [db:pir] |
| 6265677_f2_21 | 2369 | 4972 | 555 | 184 | 477 | 1.70E-45 | [ac:q02140] [gn:ilvn] [or:lactococcus lactis] [sr:,subsplactis:streptococcus lactis] [ec:4.1.3.18] [de:(acetohydroxy-acid synthase small subunit) (als)] [sp:q02140] [db:swissprot] |
| 6272637_f2_5 | 2370 | 4973 | 225 | 74 | 97 | 0.00022 | [ac:71558] [pn:probable cell wall-plasma membrane linker protein prp precursor:hybrid-proline-rich protein] [or:brassica napus] [sr:, rape] [db:pir] |
| 6272686_c3_117 | 2371 | 4974 | 699 | 232 | 429 | 2.00E-40 | [ac:698878] [pn:rna-binding sun protein homolog ylom] [gn:ylom] [or:bacillus subtilis] [db:pir] |
| 6272968_f2_4 | 2372 | 4975 | 435 | 144 | 175 | 1.70E-13 | [ln:lcu28163] [ac:u28163] [pn:eiia-man] [gn:mana] [or:lactobacillus curvatus] [db:genpept-bct] [de:lactobacillus curvatus phosphoenolpyruvate:mannosephosphotransferase eiia-man (mana), eiib-man (manb), and eiic-man(manc) genes, complete cds and eiid-man ( |
| 6273333_f2_13 | 2373 | 4976 | 2013 | 670 | 173 | 4.10E-09 | [ln:navialgeb] [ac:139096:129009] [pn:mannuronan c-5-epimerase] [gn:alge1] [or:azotobacter vinelandii] [sr:azotobacter vinelandii (strain e) dna] [db:genpept-bct] [de:azotobacter vinelandii mannuronan c-5-epimerase (alge4, alge1,alge2 and alge3) genes, com |
| 6273577_c3_237 | 2374 | 4977 | 375 | 124 | 52 | 0.95 | [ac:p19155] [gn:psbj] [or:cyanophora paradoxa] [de:photosystem ii reaction centre j protein] [sp:p19155] [db:swissprot] |
| 6273592_c2_177 | 2375 | 4978 | 495 | 164 | 79 | 0.64 | [ac:h69867] [pn:conserved hypothetical protein ykvi] [gn:ykvi] [or:bacillus subtilis] [db:pir] |
| 6276049_c1_49 | 2376 | 4979 | 592 | 197 | 379 | 4.00E-35 | [ac:p26946] [or:bacillus firmus] [de:hypothetical abc transporter atp-binding protein] [sp:p26946] [db:swissprot] |

TABLE 2-continued

| Orf | NT Seq ID | AA Seq ID | NT Orf Length | AA Orf Length | Score | Probability | Description |
|---|---|---|---|---|---|---|---|
| 629005_f1_6 | 2377 | 4980 | 750 | 249 | 391 | 2.10E-36 | [ac:q25052] [gn:tena] [or:bacillus subtilis] [de:transcriptional activator tena] [sp:p25052] [db:swissprot] |
| 631377_c2_23 | 2378 | 4981 | 1128 | 375 | 437 | 2.90E-41 | [ac:p42599:p42600:p76661] [gn:ygil] [or:escherichia coli] [de:hypothetical 37.0 kd protein in ebgc-uxaa intergenic region] [sp:p42599:p42600:p76661] [db:swissprot] |
| 632943_c2_30 | 2379 | 4982 | 1110 | 369 | 349 | 6.10E-32 | [ac:c69901] [pn:two-component sensor histidine kinase [yoc homolog yocf] [gn:yocf] [or:bacillus subtilis] [db:pir] |
| 6336408_f1_1 | 2380 | 4983 | 1428 | 475 | 538 | 5.70E-52 | [ac:q03523] [gn:mure] [or:bacillus subtilis] [ec:6.3.2.13] [de:(ec 6.3.2.13) (udp-n-acetylmuramyl-tripeptide synthetase)] [sp:q03523] [db:swissprot] |
| 6354583_c2_100 | 2381 | 4984 | 243 | 80 | 70 | 0.2 | [ac:p53982] [gn:yn1009w:n2870] [or:saccharomyces cerevisiae] [sr:baker's yeast] [ec:1.1.1.42] [de:decaboxylase] (idh) (nadp+specific icdh) (idp)] [sp:p53982] [db:swissprot] |
| 6360012_c2_34 | 2382 | 4985 | 1245 | 414 | 1069 | 3.10E-108 | [ac:p37464] [gn:sers] [or:bacillus subtilis] [ec:6.1.1.11] [de:seryl-trna synthetase, (serine-trna ligase) (serrs)] [sp:p37464] [db:swissprot] |
| 636527_f3_35 | 2383 | 4986 | 1224 | 407 | 1418 | 3.20E-145 | [ac:b69620] [pn:enolase eno] [gn:eno] [or:bacillus subtilis] [db:pir] |
| 641718_f2_7 | 2384 | 4987 | 2736 | 911 | 582 | 2.90E-69 | [ac:s54746:p57753] [gn:ybgg] [or:escherichia coli] [de:hypothetical 100.0 kd protein in hrsa-cyda intergenic region] [sp:p54746:p57753] [db:swissprot] |
| 6417500_f2_13 | 2385 | 4988 | 552 | 236 | 190 | 1.90E-53 | [ac:h69744] [pn:conserved hypothetical protein ybbp] [gn:ybbp] [or:bacillus subtilis] [db:pir] |
| 6427137_c3_57 | 2386 | 4989 | 279 | 92 | 80 | 1.80E-23 | [ac:f69866] [pn:tetrahydrodipicolinate succinylase homolog ykuq] [gn:ykuq] [or:bacillus subtilis] [db:pir] |
| 6427_f2_26 | 2387 | 4990 | 480 | 159 | 172 | 1.30E-52 | [ac:q02420] [gn:mtlf] [or:streptococcus mutans] [ec:2.7.1.69] [de:(ec 2.7.1.69) (eiii-mtl)] [sp:q02420] [db:swissprot] |
| 6430393_f1_14 | 2388 | 4991 | 396 | 131 | 316 | 1.90E-28 | [ac:c69742] [pn:conserved hypothetical protein yazc] [gn:yazc] [or:bacillus subtilis] [db:pir] |
| 6431256_f2_2 | 2389 | 4992 | 2037 | 678 | 110 | 2.30E-07 | [ac:s70010] [pn:glutamate/proline-rich protein (clone bb.1.4.1)] [or:rattus norvegicus] [sr:, norway rat] [db:pir] |
| 6447838_f1_3 | 2390 | 4993 | 1515 | 504 | 1320 | 7.70E-135 | [ln:spadca] [ac:z71552] [pn:zn-binding lipoprotein] [gn:adca] [or:streptococcus pneumoniae] [db:genpept-bct] [de:streptococcus pneumoniae adccba operon.] [le:1527] [re:2471] [di:direct] |
| 649043_f2_5 | 2391 | 4994 | 261 | 86 | 268 | 2.30E-23 | [ac:g69633] [pn:glutamine abc transporter (atp-binding protein) glnq] [gn:glnq] [or:bacillus subtilis] [db:pir] |
| 6516713_c1_21 | 2392 | 4995 | 1359 | 452 | 542 | 2.10E-52 | [ac:p39301] [gn:sgat] [or:escherichia coli] [de:sgat protein] [sp:p39301] [db:swissprot] |
| 6523577_c1_145 | 2393 | 4996 | 201 | 66 | 68 | 0.11 | [ac:p27500:p27530] [or:rice tungro baciliform virus] [sr:isolate philippines:rtbv] [de:hypothetical 24 kd protein (p24) (orf1)] [sp:p27500:p27530] [db:swissprot] |
| 6525191_c3_12 | 2394 | 4997 | 426 | 141 | 96 | 0.00035 | [ac:q04344] [gn:hnt1:hit1:ydl125c] [or:saccharomyces cerevisiae] [sr:baker's yeast] [de:hit family protein 1] [sp:q04344] [db:swissprot] |
| 6532311_f1_1 | 2395 | 4998 | 276 | 91 | 325 | 2.10E-29 | [ac:p10539] [gn:asd] [or:streptococcus mutans] [ec:1.2.1.11] [de:dehydrogenase] [sp:p10539] [db:swissprot] |
| 657001_c1_23 | 2396 | 4999 | 219 | 72 | 67 | 0.31 | [ln:celc50h11] [ac:af016449] [gn:c50h11.4] [or:caenorhabditis elegans] [sr:caenorhabditis elegans strain=bristol n2] [db:genpept-inv] [de:caenorhabditis elegans cosmid c50h11.] [le:29010:29260:29728:29922] [re:29156:29682:29874:30266] [di:direct:join] |
| 657513_c2_40 | 2397 | 5000 | 306 | 101 | 96 | 3.90E-05 | [ln:d78257] [ac:d78257] [pn:orf11] [gn:orf11] [or:enterococcus faecalis] [sr:enterococcus faecalis plasmid:pyi17 dna] [db:genpept-bct] [de:enterococcus faecalis plasmid pyi17 genes for baca, bacb, orf3,orf4, orf5, orf6, orf7, orf8, orf9, orf10, dinf,lyta genes, and downstream sequences.] [le:2799] [re:4169] [di:direct] |
| 657760_f1_14 | 2398 | 5001 | 1383 | 460 | 2252 | 1.30E-233 | [ln:spcinrec] [ac:z24303] [de:streptococcus pneumoniae cin operon encoding the cina, reca, dinf,lyta genes, and downstream sequences.] [db:genpept-bct] [pn:dinf protein] [gn:dinf] [or:streptococcus pneumoniae] |
| 660877_f1_14 | 2399 | 5002 | 888 | 295 | 720 | 2.90E-71 | [ac:f69880] [pn:conserved hypothetical protein ylqf] [gn:ylqf] [or:bacillus subtilis] |

TABLE 2-continued

| Orf | NT Seq ID | AA Seq ID | NT Orf Length | AA Orf Length | Score | Probability | Description |
|---|---|---|---|---|---|---|---|
| 6647557_f1_12 | 2400 | 5003 | 1959 | 652 | 273 | 4.80E-37 | [db:pir] [ln:ab001341] [ac:ab001341] [pn:mcrb] [gn:mcrb] [fn:essential for mcrb] [or:escherichia coli] [sr:escherichia coli dna] [db:genpept-bct] [de:escherichia coli dna for mcrb, mcrc, complete cds.] [nt:mcrb protein recognizes and restricts the sequence] [le:12 deor intergenic region] [sp:p54947] [db:swissprot] |
| 6648262_c3_96 | 2401 | 5004 | 891 | 296 | 385 | 9.30E-36 | [ac:p54947] [gn:yxeh:jplb] [or:bacillus subtilis] [de:hypothetical 30.2 kd protein in idh-deor intergenic region] [sp:p54947] [db:swissprot] |
| 6650286_f3_25 | 2402 | 5005 | 864 | 287 | 521 | 3.60E-50 | [ac:q00753] [gn:msmr] [or:streptococcus mutans] [de:msm operon regulatory protein] [sp:q00753] [db:swissprot] |
| 6650306_f2_12 | 2403 | 5006 | 417 | 138 | 570 | 2.30E-55 | [ac:p14577] [gn:rplp] [or:bacillus subtilis] [de:50s ribosomal protein l16] [sp:p14577] [db:swissprot] |
| 6672805_c1_40 | 2404 | 5007 | 261 | 86 | 73 | 0.1 | [ln:celb0238] [ac:af016450] [gn:b0238.13] [or:caenorhabditis elegans] [sr:caenorhabditis elegans strain=bristol n2] [db:genpept-inv] [de:caenorhabditis elegans cosmid b0238.] [nt:strong similarity to c. elegans esterase cm06b1] |
| 6675286_c3_61 | 2405 | 5008 | 276 | 91 | 66 | 0.22 | [ln:mdgc10] [ac:z72425] [pn:major allergen mal d 1] [or:malus domestica] [sr:apple tree] [db:genpept-pln] [de:m.domestica gene for major allergen mal d 1 (clone mdgc10).] [le:1] [re:480] [di:direct] |
| 6679005_c3_54 | 2406 | 5009 | 207 | 68 | 62 | 0.034 | [ln:natceld] [ac:z78855] [pn:ssugar-binding transport protein] [or:anaerocellum thermophilum] [db:genpept-bct] [de:a.thermophilum celd gene.] [nt:putative] [le:3925] [re:4836] [di:direct] |
| 6663211_f3_19 | 2407 | 5010 | 255 | 84 | 64 | 0.18 | [ac:s26672:s08661] [pn:peroxidase,] [cl:peroxidase] [or:lupinus polyphyllus] [sr:, large-leaved lupine] [ec:1.11.1.7] [db:pir] |
| 6695942_c3_85 | 2408 | 5011 | 396 | 131 | 197 | 1.20E-15 | [ln:spcps14e] [ac:x85787] [pn:ss-1,4-galactosyltransferase] [gn:cps14j] [fn:capsular polysaccharide synthesis] [or:streptococcus pneumoniae] [db:genpept-bct] [de:pneumoniae cps14 locus.] [le:9524] [re:10480] [di:direct] |
| 6711083_f2_31 | 2409 | 5012 | 459 | 152 | 279 | 1.60E-24 | [ac:p21977] [gn:gale] [or:streptococcus thermophilus] [ec:5.1.3.2] [de:galactose 4-epimerase] [sp:p21977] [db:swissprot] |
| 6721011_c1_67 | 2410 | 5013 | 786 | 261 | 375 | 1.10E-34 | [ac:p54456] [gn:yqek] [or:bacillus subtilis] [de:hypothetical 21.3 kd protein in arod-comer intergenic region] [sp:p54456] [db:swissprot] |
| 6734502_f1_2 | 2411 | 5014 | 1074 | 357 | 131 | 5.00E-06 | [ln:ppbplg] [ac:x80272] [gn:pptb] [or:pseudomonas putida] [db:genpept-bct] [de:p.putida pptb gene.] [le:77] [re:973] [di:direct] |
| 6765635_c2_55 | 2412 | 5015 | 1578 | 525 | 285 | 2.00E-45 | [ac:s06097] [pn:type i site-specific deoxyribonuclease, cfra chain s:restriction endonuclease cfra, polypeptide s] [gn:hsds] [cl:type i site-specific deoxyribonuclease ecoa chain s] [or:citrobacter freundii] [ec:3.1.21.3] [db:pir] |
| 6765635_f3_25 | 2413 | 5016 | 1596 | 531 | 251 | 2.10E-18 | [ln:sehsdms] [acy:11005] [pn:styski methylase] [gn:hsds] [or:salmonella enterica] [db:genpept-bct] [de:s.enterica hsdr, hsdm and hsds genes,] [le:2206] [re:3969] [di:direct] |
| 6775262_c2_3 | 2414 | 5017 | 225 | 74 | 232 | 3.90E-19 | [ac:p03764] [or:bacteriophage lambda] [de:hypothetical protein orf401] [sp:p03764] [db:swissprot] |
| 678125_f3_11 | 2415 | 5018 | 189 | 62 | 293 | 5.20E-26 | [ac:s49404:s38206] [pn:h+-transporting atp synthase, chain c] [gn:atpc] [or:streptococcus pneumoniae] [ec:3.6.1.34] [db:pir] |
| 679592_c3_54 | 2416 | 5019 | 1035 | 344 | 1228 | 4.30E-125 | [ln:lppyrbsop] [ac:z54240] [pn:glutaminase of carbamoyl-phosphate synthase] [gn:pyraa] [or:lactobacillus plantarum] [db:genpept-bct] [de:l.plantarum pyrimidine biosynthetic operon (pyrr, pyrb, pyrc,pyraa, pyrab, pyrd, pyrf, and pyre) |
| 6814382_f3_16 | 2417 | 5020 | 285 | 94 | 108 | 2.10E-06 | [ln:stu93029] [ac:u93029] [pn:amphipathic pore-forming peptide precursor] [gn:thma] [or:streptococcus thermophilus] [db:genpept-bct] [de:streptococcus thermophilus thermophilin 13 operon; amphipathicpore-forming peptide precursor (thma), enhancer peptide |
| 6815680_c2_25 | 2418 | 5021 | 315 | 104 | 64 | 0.87 | [ln:cek07a12] [ac:z81098] [pn:f39j2.3] [or:caenorhabditis elegans] [db:genpept-inv] [de:caenorhabditis elegans cosmid k07a12, complete sequence,] [nt:similarity to |

TABLE 2-continued

| Orf | NT Seq ID | AA Seq ID | NT Orf Length | AA Orf Length | Score | Probability | Description |
|---|---|---|---|---|---|---|---|
| 6820337_f3_55 | 2419 | 1908 | 635 | 1787 | | 2.50E-184 | s.pombe hypothetical protein] [le:<1:106:325:535] [re:35:190:419:702] [di:directjoin] [ac:b69633] [pn:1-glutamine-d-fructose-6-phosphate amidotransferase glms] [gn:glms] [or:bacillus subtilis] [db:pir] |
| 682199_c1_9 | 2420 | 502 | 167 | 459 | | 1.30E-43 | [ac:c69830] [pn:glucanase homolog yhfe] [or:bacillus subtilis] [db:pir] |
| 6834838_c2_7 | 2421 | 435 | 144 | 494 | | 2.60E-47 | [ac:p04969] [gn:rpsk] [or:bacillus subtilis] [de:30s ribosomal protein s11 (bs11)] [sp:p04969] [db:swissprot] |
| 6837692_c3_35 | 2422 | 582 | 193 | 789 | | 1.40E-78 | [ln:spu09239] [acu09239] [gn:cps19fd] [or:streptococcus pneumoniae] [db:genpept-bct] [de:streptococcus pneumoniae type 19f capsular polysaccharidebiosynthesis operon, (cps19fabcdefghijklmno) genes, complete cds,and alia gene, partial cds.] |
| 6839087_f1_6 | 2423 | 474 | 157 | 71 | | 0.7 | [ac:d69830] [pn:hypothetical protein yhff] [gn:yhff] [or:bacillus subtilis] [db:pir] |
| 6839212_f1_2 | 2424 | 768 | 255 | 1016 | | 1.30E-102 | [ac:p37282] [gn:groel] [or:lactococcus lactis] [sr:subsplactis:streptococcus lactis] [de:60 kd chaperonin (protein cpn60) (groel protein)] [sp:p37282] [db:swissprot] |
| 6839715_f3_47 | 2425 | 1428 | 475 | 1685 | | 1.60E-173 | [ac:q46130] [gn:abga] [or:clostridium longisporum] [ec:3.2.1.86] [de:6-phospho-beta-glucosidase,] [sp:q46130] [db:swissprot] |
| 6844187_f2_9 | 2426 | 711 | 236 | 144 | | 4.70E-09 | [ln:spu65899] [acu65899] [pn:m protein] [or:streptococcus pyogenes] [db:genpept-bct] [de:streptococcus pyogenes m protein gene, partial cds.] [le:<1] [re: |
| 6844215_c1_15 | 2427 | 225 | 74 | 104 | | 2.10E-05 | [acs52544] [pn:is12 protein] [or:lactobacillus helveticus] [db:pir] |
| 6845260_f3_25 | 2428 | 987 | 328 | 1019 | | 6.10E-103 | [acp37465] [gn:mets] [or:bacillus subtilis] [ec:6.1.1.10] [de:(metrs)] [sp:p37465] [db:swissprot] |
| 6846882_c1_65 | 2429 | 342 | 113 | 203 | | 1.80E-16 | [ac:q07211] [gn:scrk] [or:streptococcus mutans] [ec:2.7.1.4] [de:fructokinase,] [sp:q07211] [db:swissprot] |
| 6847840_f2_7 | 2430 | 429 | 142 | 291 | | 8.50E-26 | [acp12039] [gn:purd] [or:bacillus subtilis] [ec:6.3.4.13] [de:ribonucleotide synthetase] (phosphoribosylglycinamide synthetase) [sp:p12039] [db:swissprot] |
| 6852008_c3_15 | 2431 | 1815 | 604 | 2962 | | 0 | [acp10564] [gn:hexa] [or:streptococcus pneumoniae] [de:dna mismatch repair protein hexa] [sp:p10564] [db:swissprot] |
| 6852301_f2_16 | 2432 | 372 | 123 | 211 | | 2.50E-17 | [acp45808p77478] [gn:yban] [or:escherichia coli] [de:hypothetical 14.8 kd protein in pric-apt intergenic region] [sp:p45808:p77478] [db:swissprot] |
| 6900212_f3_57 | 2433 | 255 | 84 | 376 | | 8.30E-35 | [ln:spdnagcpo] [acy11463] [gn:cpoa] [or:streptococcus pneumoniae] [db:genpept-bct] [de:streptococcus pneumoniae dnag, rpod, cpoa genes and orf3 and orf5.] [le:2160] [re:3176] [di:direct] |
| 6902137_f2_14 | 2434 | 258 | 85 | 73 | | 0.093 | [ac:a34832] [pn:tat-binding protein-1] [cl:ftsh/sec18/cde48-type atp-binding domain homology] [or:homo sapiens] [sr:, man] [db:pir] |
| 6906302_f1_6 | 2435 | 366 | 121 | 83 | | 0.00093 | [ln:d782577] [acd782577] [pn:bacb] [gn:bacb] [or:enterococcus faecalis] [sr:enterococcus faecalis plasmid:pyi17 dna] [db:genpept-bct] [de:enterococcus faecalis plasmid pyi17 genes for baca, bacb, orf3,orf4,orf5,orf6, orf7, orf8, orf9, orf10, orf11,partia |
| 6914218_f2_21 | 2436 | 1338 | 445 | 2246 | | 5.80E-233 | [ln:spu33315] [acu33315] [pn:histidine protein kinase] [gn:comd] [or:streptococcus pneumoniae] [db:genpept-bct] [de:streptococcus pneumoniae orf1 gene, partial cds, competencestimulating peptide precursor (comc), histidine protein kinase(comd) and respon |
| 6914712_f2_21 | 2437 | 477 | 158 | 123 | | 4.80E-07 | [ac:b41313] [pn:probabletransposase] [or:acetobacter pasteurianus] [db:pir] |
| 6914827_f3_61 | 2438 | 264 | 87 | 74 | | 0.0084 | [ln:apul8449] [acu18449] [pn:cytochrome b] [gn:cylb] [or:mitochondrion arctocephalus pusillus pusillus] [sr:south african fur seal] [db:genpept-mam] [de:arctocephalus pusillus pusillus cytochrome b (cylb) gene, mitochondrial geneencoding |
| 6917253_f2_13 | 2439 | 1890 | 629 | 79 | | 0.038 | [ln:hivu88757] [acu88757] [pn:gp120] [gn:env] [or:human immunodeticiency virus type 1] [db:genpept-vrl] [de:hiv-1 isolate tp95091 from ethiopia, gp120 (env) gene, partial cds.] [ntv3 region] [le:<1] [re: |
| 6917302_c3_34 | 2440 | 888 | 295 | 605 | | 4.50E-59 | [acp30295] [gn:livh:livа] [or:salmonella typhimurium] [de:livh (liv-1 protein h)] [sp:p30295] [db:swissprot] |
| 6924180_c1_11 | 2441 | 240 | 79 | 67 | | 0.3 | [ln:bmu47917] [acu47917] [pn:transposase] [or:bombyx mori] [sr:silkworm] |

TABLE 2-continued

| Orf | NT Seq ID | AA Seq ID | NT Orf Length | AA Orf Length | Score | Probability | Description |
|---|---|---|---|---|---|---|---|
| 6929713_c3_28 | 2442 | 942 | 313 | 313 | 4.00E-28 | | [db:genpept-inv] [de:*bombyx mori* mariner transposon bmmar1 transposase gene, completecds.] [le:144] [re:11184] [di:direct] |
| 6930437_f2_76 | 2443 | 207 | 73 | 68 | 0.028 | | [ln:af035376] [ac:af035376] [pn:inner membrane lipoprotein] [gn:apbe] [fn:synthesis of the pyrimidine moiety of thiamine] [or:*salmonella typhimurium*] [dbgenpept-bct] [de:*salmonella typhimurium* inner membrane lipoprotein (apbe) gene, complete cds.] [nt:apb |
| 6931886_c2_37 | 2444 | 375 | 73 | 124 | 0.14 | | [ln:mus11m9] [ac:m29325] [or:*mus musculus*] [sr:*mus musculus domesticus* (strain balb/c) dna, clone ba4] [db:genpept-rod] [de:mouse 11md-9 repetitive sequence.] [nt:orfl1] [le:1429] [re:1995] [di:direct] |
| 6931886_c3_27 | 2445 | 327 | 70 | 108 | 0.022 | | [ac:p21457] [gn:rcv1] [or:*bos taurus*] [sr:,bovine] [de:recoverin (p26)] [sp:p21457] [db:swissprot] |
| 6931886_c3_66 | 2446 | 327 | 77 | 108 | 0.24 | | [ac:g69918] [pn:hypothetical protein yopy] [gn:yopy] [or:*bacillus subtilis*] [db:pir] [ln:yscsfp1aa] [ac:m62577] [gn:sfp1] [or:*saccharomyces cerevisiae*] [sr:*saccharomyces cerevisiae* dna] [db:genpept-pln] [de:*s.cerevisiae* sfp1 gene, complete cds.] [le:320] [re:2356] [di:direct] |
| 6931886_f1_1 | 2447 | 327 | 66 | 108 | 0.065 | | [ac:g69918] [pn:hypothetical protein yopy] [gn:yopy] [or:*bacillus subtilis*] [db:pir] |
| 6931886_f3_10 | 2448 | 327 | 65 | 108 | 0.5 | | [ac:p21457] [gn:rev1] [or:*bos taurus*] [sr:,bovine] [de:recoverin (p26)] [sp:p21457] [db:swissprot] |
| 6931886_f3_8 | 2449 | 336 | 72 | 111 | 0.78 | | [ac:cq57864] [gn:mj0421] [or:*methanococcus jannaschii*] [de:hypothetical protein mj0421] [sp:q57864] [db:swissprot] |
| 6933512_f2_77 | 2450 | 966 | 128 | 321 | 1.20E-05 | | [ln:lactnaabid] [ac:135176] [gn:abid1] [fn:phage abortive infection] [or:*lactococcus lactis*] [sr:*lactococcus lactis* (strain i1964) dna] [db:genpept-bct] [de:*lactococcus lactis* transposase (tnase) and abid1 genes, completecds.] [le:1230] [re:2285] [di:dire |
| 7031278_c2_14 | 2451 | 342 | 150 | 113 | 2.50E-10 | | [ac:jc2110] [pn:tropomyosin-related protein:strp protein] [or:*saccharomyces cerevisiae*] [db:pir] |
| 7034451_f3_19 | 2452 | 279 | 134 | 92 | 2.80E-08 | | [ac:q10525] [gn:mtcy427.27] [or:*mycobacterium tuberculosis*] [ec:2.3.1.41] [de:(beta-ketoacyl-acp synthase 2) (kas 2)] [sp:q10525] [db:swissprot] |
| 7036526_c1_30 | 2453 | 195 | 68 | 64 | 3.20E-07 | | [ac:c64571] [pn:hypothetical protein hp0411] [or:*helicobacter pylori*] [db:pir] |
| 7039675_f1_2 | 2454 | 255 | 75 | 84 | 0.017 | | [ln:u67523] [ac:u67523;177117] [pn:*m.jannaschii* predicted coding region mj0785.1] [gn:mj0785.1] [or:*methanococcus jannaschii*] [db:genpept-bct] [de:*methanococcus jannaschii* section 66 of 150 of the complete genome.] [nt:brute force orf, identified by gene |
| 7039712_f3_7 | 2455 | 246 | 76 | 82 | 0.045 | | [ac:i39974] [pn:serine proteinase] [cl:subtilisin:subtilisin homology] [or:*bacillus* sp.] [db:pir] |
| 7053806_c1_47 | 2456 | 2448 | 2803 | 815 | 5.50E-292 | | [ac:q48656] [gn:pepn] [or:*lactococcus lactis*] [sr:,subsplactis:*streptococcus lactis*] [ec:3.4.11.2] [de(alanine aminopeptidase)] [sp:q48656] [db:swissprot] |
| 7055431_c3_91 | 2457 | 945 | 426 | 314 | 4.20E-40 | | [ac:c69986] [pn:conserved hypothetical protein ysna] [gn:ysna] [or:*bacillus subtilis*] [db:pir] |
| 7056275_f1_2 | 2458 | 207 | 56 | 68 | 0.49 | | [ln:pumpol1] [ac:d12837] [pn:reverse transcriptase] [gn:pol] [or:*petroselinum crispum*] [sr:*petroselinum hortense* dna] [db:genpept-pln] [de:*petroselinum hortense* pol gene for reverse transcriptase, partialsequence.] [le:<1] [re: |
| 7064638_f3_32 | 2459 | 657 | 209 | 218 | 4.20E-17 | | [ln:lhpepign] [ac:z56283] [gn:orf2] [or:*lactobacillus helveticus*] [db:genpept-bct] [de:*l.helveticus* pepi gene.] [le:1522] [re:2175] [di:direct] |
| 7066542_c2_58 | 2460 | 660 | 226 | 219 | 6.60E-19 | | [ln:axu22323] [ac:u22323] [pn:unknown] [or:*acetobacter xylinum*] [db:genpept-bct] [de:*acetobacter xylinum* insertion sequence element is1238 orfa gene complete cds and orfb gene, partial cds.] [le:<585] [re:1154] [di:direct] |
| 7066667_c3_83 | 2461 | 297 | 54 | 98 | 0.67 | | [ac:b36359] [pn:vsg expression site-associated protein cs88] [cl:regulatory protein esag8c] [or:*trypanosoma brucei*] [db:pir] |
| 7066667_f1_2 | 2462 | 660 | 229 | 219 | 3.20E-19 | | [ln:axu22323] [ac:u22323] [pn:unknown] [or:*acetobacter xylinum*] [db:genpept-bct] |

TABLE 2-continued

| Orf | NT Seq ID | AA Seq ID | NT Orf Length | AA Orf Length | Score | Probability | Description |
|---|---|---|---|---|---|---|---|
| 7068758_f3_11 | 5066 | 189 | 62 | 56 | | 0.49 | [de:acetobacter xylinum insertion sequence element is1238 orfa gene,complete cds, and orfb gene, partial cds.] [nt:orfb] [re:<585] [re:1154] [di:direct] |
| 7070313_c2_91 | 5067 | 1262 | 3789 | 2724 | | 1.70E-297 | [ac:h64559] [pn:conserved hypothetical secreted protein hp0320] [cl:conserved hypothetical secreted protein hp0320] [or:helicobacter pylori] [db:pir] |
| 7070443_f2_5 | 5068 | 696 | 608 | 231 | | 2.20E-59 | [ln:d78258] [ac:d78258] [pn:alkaline amylopullulanase] [or:bacillus sp.] [sr:bacillus sp. (strain:ksm-1378) dna] [db:genpept-bct] [de:bacillus sp. dna for alkaline amylopullulanase, complete cds.] [re:145] [re:5961] [di:direct] |
| 7073299_c1_19 | 5069 | 1303 | 147 | 434 | | 3.00E-07 | [ac:p46536] [or:bacillus caldolyticus] [de:hypothetical 27.6 kd protein in pyrab-pyrd intergenic region (orf2)] [sp:p46536] [db:swissprot] |
| 7073887_f3_11 | 5070 | 264 | 104 | 88 | | 5.60E-06 | [ac:p27850] [gn:yigrl] [or:escherichia coli] [de:(o475)] [sp:p27850] [db:swissprot] [ln:af020798] [ac:af020798] [pn:putative host cell surface-exposed lipoprotein] [or:streptococcus thermophilus bacteriophage tp-j34] [db:genpept] [de:streptococcus thermophilus bacteriophage lysogeny module, integrasehomolog (int), putative host cell surf |
| 7073937_f1_8 | 5071 | 1134 | 377 | 1167 | | 1.30E-118 | [ac:p17921;p94539] [gn:phes] [or:bacillus subtilis] [ec:6.1.1.20] [de:-trna ligase alpha chain] (phers)] [sp:p17921;p94539] [db:swissprot] |
| 7078407_c2_31 | 5072 | 354 | 117 | 423 | | 8.70E-40 | [ac:p16680] [gn:rpha] [or:escherichia coli] [de:phna protein] [sp:p16680] |
| 7081341_c1_17 | 5073 | 402 | 133 | 266 | | 3.80E-23 | [ac:p37686] [gn:yiay] [or:escherichia coli] [de:hypothetical 40.2 kd protein in avta-selb intergenic region (f382)] [sp:p37686] [db:swissprot] |
| 7081662_c3_58 | 5074 | 894 | 297 | 598 | | 2.50E-58 | [ac:g69657] [pn:trna isopentenylpyrophosphate transferase miaa] [gn:miaa] [or:bacillus subtilis] [db:pir] |
| 7084500_f2_18 | 5075 | 183 | 60 | 62 | | 0.78 | [ac:q49398] [gn:glf-mg137] [or:mycoplasma genitalium] [ec:5.4.99.9] [de:udp-galactopyranose mutase.] [sp:q49398] [db:swissprot] |
| 7116313_f2_32 | 5076 | 1011 | 336 | 485 | | 2.30E-46 | [ac:c69763] [pn:ferrichrome abc transporter (permease) homolog yclo] [gn:yclo] [or:bacillus subtilis] [db:pir] |
| 7128390_c3_44 | 5077 | 186 | 61 | 131 | | 7.60E-09 | [ln:spnana] [ac:x72967] [or:streptococcus pneumoniae] [pn:spnana nana gene.] [nt:orf2] [re:193] [re:495] [di:direct] [de:s.pneumoniae nana gene.] |
| 7148578_f1_13 | 5078 | 447 | 148 | 400 | | 2.40E-37 | [ac:d69999] [pn:conserved hypothetical protein ytqa] [gn:ytqa] [or:bacillus subtilis] [db:pir] |
| 7151588_c2_51 | 5079 | 285 | 94 | 75 | | 0.016 | [ac:s52654.s49028] [pn:cold acclimation protein lti30] [gn:lti30] [or:arabidopsis thaliana] [sr:, mouse-ear cress] [db:pir] |
| 7210092_c2_11 | 5080 | 885 | 294 | 296 | | 2.50E-26 | [ac:f69777] [pn:conserved hypothetical protein yded] [or:bacillus subtilis] [db:pir] |
| 7221006_c2_52 | 5081 | 474 | 157 | 632 | | 6.20E-62 | [ac:c70015] [pn:gmp reductase homolog yumd] [gn:yumd] [or:bacillus subtilis] [db:pir] |
| 7224063_c3_48 | 5082 | 219 | 72 | 104 | | 1.00E-05 | [ln:bsz75208] [ac:z75208] [pn:hypothetical protein] [gn:ysoc] [or:bacillus subtilis] [db:genpept-bct] [de:b.subtilis genomic sequence 89009bp.] [nt:unknown function; putative] [re:80592] [re:81206] [di:complement] |
| 7230308_f1_1 | 5083 | 996 | 331 | 466 | | 8.70E-49 | [ac:c69521] [pn:2-nitropropane dioxygenase (ncd2) homolog] [or:archaeoglobus fulgidus] [db:pir] |
| 7234591_f1_4 | 5084 | 324 | 107 | 54 | | 0.68 | [ac:b42056] [pn:hypothetical protein g6:ribosomal protein s12-related hypothetical protein] [or:mitochondrion leishmania tarentolae] [db:pir] |
| 7236385_f1_13 | 5085 | 321 | 106 | 75 | | 0.0066 | [ac:a69885] [pn:hypothetical protein ysha] [gn:ysha] [or:bacillus subtilis] [db:pir] |
| 7239692_f2_1 | 5086 | 192 | 63 | 82 | | 0.0012 | [ln:mtv003] [ac:a1008883] [pn:hypothetical protein mtv003.12] [de:mycobacterium tuberculosis] [db:genpept-bct] [de:mycobacterium tuberculosis sequence v003.] [nt:mtv003.12, unknown, len:87 aa] [re:10108] [re:10371] [di:direct] |
| 7241032_f3_4 | 5087 | 567 | 188 | 194 | | 1.60E-15 | [ac:c69895] [pn:conserved hypothetical protein yoaa] [gn:yoaa] [or:bacillus subtilis] [db:pir] |
| 7242137_f2_24 | 5088 | 687 | 228 | 416 | | 4.80E-39 | [ln:cbaj2527] [ac:aj002527] [pn:orfx] [gn:orfx] [fn:putative transaldolase (37.4% identity to talc] [or:clostridium beijerinckii] [db:genpept-bct] [de:clostridium |

TABLE 2-continued

| Orf | NT Seq ID | AA Seq ID | NT Orf Length | AA Orf Length | Score Probability | Description |
|---|---|---|---|---|---|---|
| 7243800_f3_18 | 2486 | 5089 | 915 | 304 | 131 | 4.40E-06 | *beijerinckii* glucitol transport gene system.] [le:1833] [re:2513] [di:direct] [acp44741] [gn:tehathi0511] [or:*haemophilus influenzae*] [de:tellurite resistance protein teha homolog] [sp:p44741] [db:swissprot] |
| 7245425_f1_9 | 2487 | 5090 | 642 | 213 | 61 | 0.54 | [ac:s75007] [pn:hypothetical protein ss11922] [or:*synechocystis* sp.] [srpcc 6803, , pcc 6803] [srpcc 6803, ] [db:pir] |
| 7275087_f2_22 | 2488 | 5091 | 561 | 186 | 418 | 3.00E-39 | [ac:e70045] [pn:two-component response regulator [yvqe] homolog yvqc] [or:*bacillus subtilis*] [db:pir] |
| 7275683_c3_8 | 2489 | 5092 | 195 | 64 | 60 | 0.62 | [ln:cicos2] [ac:z796440] [pn:cos2.3] [or:*ciona intestinalis*] [db:genpept-inv] [de:*ciona intestinalis* dna sequence from cosmid cos2.] [le:20349:20988:21282] [re:20665:21140:21441] [di:complementjoin] |
| 7312643_c1_28 | 2490 | 5093 | 288 | 95 | 71 | 0.11 | [acp31706] [gn:outk] [or:*erwinia carotovora*] [de:outk] [sp:p31706] [db:swissprot] |
| 78192_f1_17 | 2491 | 5094 | 405 | 134 | 52 | 0.5 | [acb69544] [pn:hypothetical protein af2354] [or:*archaeoglobus fulgidus*] [db:pir] |
| 782086_f2_33 | 2492 | 5095 | 669 | 222 | 603 | 7.40E-59 | [acd69763] [pn:ferrichrome abc transporter (atp-binding p) homolog yclp] [gn:yclp] [or:*bacillus subtilis*] [db:pir] |
| 782917_c2_59 | 2493 | 5096 | 1854 | 617 | 889 | 3.60E-89 | [acp18158] [gn:glpd] [or:*bacillus subtilis*] [ec:1.1.99.5] [de:aerobic glycerol-3-phosphate dehydrogenase,] [sp:p18158] [db:swissprot] |
| 783563_f2_28 | 2494 | 5097 | 882 | 293 | 180 | 3.00E-12 | [ac:jc6007] [pn:transcriptional activator plcr] [gn:plcr] [or:*bacillus thuringiensis*] [db:pir] |
| 787806_c3_33 | 2495 | 5098 | 195 | 64 | 50 | 0.28 | [ln:af014795] [ac:af014795] [pn:cytochrome p450 30] [gn:cyp 30] [or:*mercenaria mercenaria*] [sr:northern quahog] [db:genpept-inv] [de:*mercenaria mercenaria* cytochrome p450 30 (cyp 30) mrna, completecds.] [le:81] [re:1628] [di:direct] |
| 788906_c3_110 | 2496 | 5099 | 1512 | 503 | 345 | 1.70E-31 | [ln:xaiedh1b] [ac:x84038] [pn:transposase] [or:*xanthobacter autotrophicus*] [db:genpept-bct] [de:x.*autotrophicus* insertion element and dh1b gene.] [nt:putative] [le:127] [re:1482] [di:direct] |
| 789062_f2_8 | 2497 | 5100 | 864 | 287 | 166 | 8.80E-12 | [ln:spu89711] [ac:u89711] [pn:pspa] [gn:pspa] [or:*streptococcus pneumoniae*] [db:genpept-bct] [de:*streptococcus pneumoniae* pneumococcal surface protein a pspa(pspa) gene, complete cds.] [nt:pneumococcal surface protein a; gram positive] [le:81] [re:2042] [ |
| 789175_c1_21 | 2498 | 5101 | 303 | 100 | 386 | 7.30E-36 | [ln:nhsth] [ac:y11213] [gn:hsth] [or:*streptococcus thermophilus*] [db:genpept-bct] [de:s.*thermophilus* hsth gene.] [le:1543] [re:1818] [di:direct] |
| 790_f3_35 | 2499 | 5102 | 288 | 95 | | 0.375 | [ac:s75589:s74533:s74837:s74924:s75040:s75118:s754489:s76373:s76470] [or:*synechocystis* sp.] [srpcc 6803, , pcc6803] [srpcc 6803, ] [db:pir] |
| 792812_f2_35 | 2500 | 5103 | 882 | 293 | 410 | 2.10E-38 | [pn:transposase] [ln:ecu74302] [ac:u74302] [pn:5,10-methylenetetrahydrofolate reductase] [gn:metf] [or:*erwinia carotovora*] [db:genpept-bct] [de:*erwinia carotovora* oxidative stress transcriptional regulatotr(oxyr) and 5,10-methylenetetrahydrofolate reductase (metf) genes,co |
| 7951_f2_6 | 2501 | 5104 | 585 | 194 | 240 | 2.20E-20 | [ac:q57127:o05062] [gn:hi1453] [or:*haemophilus influenzae*] [de:hypothetical protein hi1453 precursor] [sp:q57127:o05062] [db:swissprot] |
| 799193_c2_56 | 2502 | 5105 | 1359 | 452 | 618 | 1.90E-60 | [ac:q45400] [gn:celb] [or:*bacillus stearothermophilus*] [de:permease iic component (phosphotransferase enzyme ii, c component)] [sp:q45460] [db:swissprot] |
| 808377_f2_11 | 2503 | 5106 | 363 | 120 | 499 | 7.70E-48 | [ln:smu88582] [ac:u88582] [pn:ylxm] [gn:ylxm] [fn:unknown] [or:*streptococcus mutans*] [db:genpept-bct] [de:*streptococcus mutans* sat operon:putative glycinebetaine-bindingprotein prox (prox) gene, partial cds, ylxm (ylxm) gene, completecds and signal recog |
| 808442_c3_63 | 2504 | 5107 | 510 | 169 | 237 | 1.20E-18 | [ac:g69708] [pn:chromosome segregation smc protein homolg smc] [gn:smc] [or:*bacillus subtilis*] [db:pir] |
| 812952_c1_138 | 2505 | 5108 | 228 | 75 | 69 | 0.028 | [acp54323] [gn:sdh4:sdhd] [or:*chondrus crispus*] [sr:carragheen] [de:dehydrogenase, subunit iv] [sp:p54323] [db:swissprot] |
| 813785_f1_14 | 2506 | 5109 | 708 | 235 | 352 | 2.90E-32 | [ac:q54430] [gn:scrr] [or:*streptococcus mutans*] |

TABLE 2-continued

| Orf | NT Seq ID | AA Seq ID | NT Orf Length | AA Orf Length | Score | Probability | Description |
|---|---|---|---|---|---|---|---|
| 81631_f3_16 | 2507 | 5110 | 210 | 69 | 54 | 0.064 | subunit iv)] [sp:p54323] [db:swissprot] [ac:js0723] [pn:cytochrome p450 alk5-a, alkane-inducible] [gn:alk5-a] [cl:cytochrome p450] [or:candida maltosa] [db:pir] |
| 820437_f2_24 | 2508 | 5111 | 456 | 151 | 160 | 2.40E-11 | [ac:q07606] [gn:bcgib] [or:bacillus coagulans] [ec:3.1.21.—] [de:restriction enzyme bgci bcta subunit,] [sp:q07606] [db:swissprot] |
| 820887_f3_45 | 2509 | 5112 | 333 | 110 | 60 | 0.23 | [ac:p55846] [or:cancer pagurus] [sr:,rock crab] [de:molt-inhibiting hormone (mih)] [sp:p55846] [db:swissprot] |
| 823337_c1_21 | 2510 | 5113 | 702 | 233 | 352 | 2.90E-32 | [ac:p39760] [gn:ykqb] [or:bacillus subtilis] [de:hypothetical 24.3 kd protein in kinc-adec intergenic region (orf4)] [sp:p39760] [db:swissprot] |
| 823427_f1_7 | 2511 | 5114 | 246 | 81 | 109 | 3.20E-06 | [ln:sesirr] [ac:x99128] [pn:putative iron dependant repressor] [gn:sirr] [or:staphyloccocus epidermidis] [db:genpept-bct] [de:s.epidermidis sirr gene.] [le:14] [re:658] [di:direct] |
| 828181_f2_17 | 2512 | 5115 | 334 | 150 | 453 | 9.80E-30 | [ac:p11552] [gn:fuci] [or:escherichia coli] [ec:5.3.1.—] [de:1-fucose isomerase,] [sp:p11552] [db:swissprot] |
| 832657_f1_8 | 2513 | 5116 | 646 | 295 | 888 | 2.00E-63 | [ac:p42063] [gn:appc] [or:bacillus subtilis] [de:oligopeptide transport permease protein appc] [sp:p42063] [db:swissprot] |
| 835328_f3_36 | 2514 | 5117 | 68 | 75 | 228 | 0.036 | [ln:mmucasgp4] [ac:u06749] [gn:psmc] [or:rattus norvegicus] [sr:rat] [db:genpept-rod] [de:rattus norvegicus fisher 344 pre-sialomucin complex (psmc) mma,repeat c, partial cds.] [nt:repeat sequence c] [le:<1] [re: |
| 835887_c3_54 | 2515 | 5118 | 235 | 188 | 567 | 7.30E-20 | [ac:f70023] [pn:hypothetical protein yutd] [gn:yutd] [or:bacillus subtilis] [db:pir] |
| 836562_c1_23 | 2516 | 5119 | 136 | 89 | 270 | 2.30E-09 | [ac:p24022] [gn:lafa1a] [or:lactobacillus acidophilus] [de:bacteriocin lactacin f precursor] [sp:p24022] [db:swissprot] |
| 837753_c2_73 | 2517 | 5120 | 486 | 344 | 1035 | 1.80E-46 | [ac:p44303] [gn:arog:hi1547] [or:haemophilus influenzae] [ec:4.1.2.15] [de:d-arabino-heptulosonate 7-phosphate synthase)] [sp:p44303] [db:swissprot] |
| 839212_f1_1 | 2518 | 5121 | 423 | 298 | 897 | 8.70E-40 | [ac:p26832] [or:clostridium perfringens] [de:hypothetical protein in nagh 5'region (orfa) (fragment)] [sp:p26832] [db:swissprot] |
| 8467_f3_9 | 2519 | 5122 | 214 | 512 | 1539 | 2.70E-15 | [ln:spu89711] [ac:u89711] [pn:pspa] [gn:pspa] [or:streptococcus pneumoniae] [db:genpept-bct] [de:streptococcus pneumoniae pneumococcal surface protein a pspa(pspa) gene, complete cds.] [nt:pneumococcal surface protein a; gram positive] [le:81] [re:2042] |
| 85802_c3_39 | 2520 | 5123 | 284 | 258 | 777 | 4.70E-25 | [ac:b70039] [pn:hypothetical protein yvfs] [or:bacillus subtilis] [db:pir] |
| 860803_c3_13 | 2521 | 5124 | 67 | 79 | 240 | 0.65 | [ln:scylr139c] [ac:z73311] [gn:nhal] [or:saccharomyces cerevisiae] [sr:baker's yeast] [db:genpept-pln] [de:s.cerevislae chromosome xii reading frame of ylr139c.] [nt:orf ylr138w] [le:<1] [re:2526] [di:direct] |
| 864057_c3_45 | 2522 | 5125 | 459 | 159 | 480 | 1.30E-43 | [ac:b69589] [pn:argininosuccinate synthase argg] [gn:argg] [or:bacillus subtilis] [db:pir] |
| 869687_f3_56 | 2523 | 5126 | 830 | 201 | 606 | 6.50E-83 | [ac:p72500] [or:streptococcus pneumoniae] [ec:1.11.1.—] [de:probable thiol peroxidase,] [sp:p72500] [db:swissprot] |
| 87693_c2_72 | 2524 | 5127 | 97 | 233 | 702 | 9.40E-05 | [ln:d78257] [ac:d78257] [pn:orf8] [or:enterococcus faecalis] [sr:enterococcus faecalis plasmid pyi17 faecalis plasmid:pyi17 dna] [db:genpept-bct] [de:enterococcus faecalis plasmid pyi17 genes for baca, bacb, orf3,orf4, orf5, orf6, orf7, orf8, orf9, orf10, orf11,partia |
| 882151_c3_69 | 2525 | 5128 | 67 | 163 | 492 | 0.6 | [ac:s67141:s67145] [pn:hypothetical protein yor248w:hypothetical protein o5276] [or:saccharomyces cerevisiae] [db:pir] |
| 886000_c1_34 | 2526 | 5129 | 87 | 120 | 363 | 0.012 | [ac:s61993:s66874:s72142] [pn:probable membrane protein yor009w:hypothetical protein o2549:hypothetical protein unb487] [or:saccharomyces cerevisiae] [db:pir] [mp:15r] |
| 898525_f1_12 | 2527 | 5130 | 233 | 155 | 468 | 1.20E-19 | [ac:a48897] [pn:6-n-acetyltransferase-ic,:aac(6')-icaminoglycoside resistance protein] [or:serratia marcescens] [ec:2.3.1.—] [db:pir] |
| 900026_f2_32 | 2528 | 5131 | 120 | 86 | 261 | 1.10E-07 | [ac:p27624:q54467] [pn:6-n-acetyltransferase-ic,:aac(6')-icaminoglycoside resistance protein] [or:streptococcus mutans] [gn:reca] [or:saccharomyces cerevisiae] [de:reca protein (fragments)] [sp:p27624:q54467] [db:swissprot] |

TABLE 2-continued

| Orf | NT Seq ID | AA Seq ID | NT Orf Length | AA Orf Length | Score | Probability | Description |
|---|---|---|---|---|---|---|---|
| 900252_c3_112 | 2529 | 5132 | 1263 | 420 | 1294 | 4.40E-132 | [n:ehy13922] [acy13922;y15222] [gn:ftsz] [or:enterococcus hirae] [db:genpept-bct] [de:enterococcus hirae mraz, pbp3s, mray, murd, murg, ftsq and ftsagenes, mraw, yllc and ftsz partial genes.] [le:10311] [re: bs5] [sp:p02357] [db:swissprot] |
| 915937_f2_20 | 2530 | 5133 | 498 | 165 | 621 | 9.10E-61 | [ac:p02357] [gn:rpse] [bacillus stearothermophilus] [de:30s ribosomal protein s5 |
| 917192_f1_1 | 2531 | 5134 | 201 | 66 | 116 | 1.70E-06 | [ac:p20709] [gn:int] [or:bacteriophage 154a] [de:integrase] [sp:p20709] [db:swissprot] |
| 94812_c1_23 | 2532 | 5135 | 1233 | 410 | 233 | 3.00E-17 | [ln:nspu83667] [ac:u83667] [pn:macrolide-efflux determinant] [gn:mefe] [or:streptococcus pneumoniae] [db:genpept-bct] [de:streptococcus pneumoniae macrolide-efflux determinant (mefe) gene,complete cds.] [nt:mefe] [le:1] [re:1218] |
| 95052_c2_48 | 2533 | 5136 | 228 | 75 | 70 | 0.025 | [ac:p17910] [gn:trak] [or:escherichia coli] [de:trak protein] [sp:p17910] [db:swissprot] |
| 953265_f3_96 | 2534 | 5137 | 246 | 81 | 82 | 0.0012 | [ac:s62853s73575] [pn:hypothetical protein d02_ orf122b] [or:mycoplasma pneumoniae] [sr:atcc 29342, , atcc 29342] [sr:atcc 29342, ] [db:pir] |
| 953579_c2_12 | 2535 | 5138 | 230 | 76 | 56 | 0.085 | [ln:musprimp] [ac:d00570;j00614] [or:mus musculus] [sr:mouse (male), cdna to mrna] [db:genpept-rod] [de:mouse putative primordial protein transcript.] [nt:open reading frame (251 aa)] [le:442] [re:1194] [di:direct] |
| 960452_c1_167 | 2536 | 5139 | 351 | 116 | 53 | 0.85 | dln:s83288] [acs:83288] [pn:ret1 alpha subunit] [gn:ret1] [or:rattus sp.] [sr:rattus sp. retinal pigment epithelium cells] [db:genpept-rod] [de:ret1=ret1 alpha subunit [rats, retinal pigment epithelium cells,mrna partial, 177 nt].] [nt:sodium channel/hnav |
| 960937_f3_59 | 2537 | 5140 | 201 | 67 | 86 | 0.00045 | [ac:23855] [gn:pspc] [or:escherichia coli] [de:phage shock protein c] [sp:p23855] [db:swissprot] |
| 962501_c3_35 | 2538 | 5141 | 1749 | 582 | 1698 | 6.80E-175 | [ac:d69591] [pn:aspartyl-trna synthetase asps] [gn:asps] [or:caenorhabditis elegans] [db:pir] |
| 9631_f3_31 | 2539 | 5142 | 1314 | 437 | 1474 | 3.70E-151 | [ac:p27148] [gn:secy] [or:lactococcus lactis] [sr:subsplactis.streptococcus lactis] [de:preprotein translocase secy subunit] [sp:p27148] [db:swissprot] |
| 96936_f3_22 | 2540 | 5143 | 2337 | 778 | 1838 | 9.90E-190 | [ac:22093] [gn:pepx] [or:lactococcus lactis] [sr:subspcremoris.streptococcus cremoris] [ec:3.4.14.11] [de:peptidase] (x-prolyl-dipeptidyl aminopeptidase) (x-pdap]) [sp:p22093] [db:swissprot] |
| 969538_c2_14 | 2541 | 5144 | 741 | 246 | 970 | 9.50E-98 | [ln:af030361] [ac:af030361] [pn:transposase] [or:streptococcus pneumoniae] [db:genpept-bct] [de:streptococcus pneumoniae strain sp-va92 glucose-1-phosphatethymidyl transferase (cpsl) gene, partial cds; anddtdp-4-keto-6-deoxyglucose-3,5-epimerase (cpsm).dt |
| 969635_c3_50 | 2542 | 5145 | 612 | 203 | 670 | 5.80E-66 | [ac:b69997] [pn:conserved hypothetical protein ytmq] [gn:ytmq] [or:bacillus subtilis] [db:pir] |
| 970260_f1_7 | 2543 | 5146 | 336 | 111 | 159 | 8.40E-12 | [ac:p34630] [gn:zk353.7] [or:caenorhabditis elegans] [de:hypothetical 27.3 kd protein zk353.7 in chromosome iii] [sp:p34630] [db:swissprot] |
| 972827_c3_69 | 2544 | 5147 | 570 | 189 | 489 | 8.90E-47 | [ac:p37470] [gn:spovc:pth] [or:bacillus subtilis] [ec:3.1.1.29] [de:sporulation protein c)] [sp:p37470] [db:swissprot] |
| 9765627_f1_1 | 2545 | 5148 | 399 | 132 | 95 | 0.00014 | [ac:p41479] [or:autographa californica nuclear polyhedrosis virus] [sr:,acmnpv] [de:hypothetical 24.1 kd protein in lef4-p33 intergenic region] [sp:p41479] [db:swissprot] |
| 976577_c3_86 | 2546 | 5149 | 1974 | 657 | 889 | 3.60E-89 | [ac:p37484] [gn:yybl] [or:bacillus subtilis] [de:hypothetical 74.3 kd protein in rpli-cotf intergenic region] [sp:p37484] [db:swissprot] |
| 9767583_f1_2 | 2547 | 5150 | 1332 | 443 | 71 | 0.17 | [ac:s62084] [pn:in-like protein precursor (clone enn74.1)] [cl:m5 protein] [or:streptococcus pyogenes] [db:pir] |
| 9767800_c1_35 | 2548 | 5151 | 387 | 128 | 149 | 1.60E-10 | [ac:p45024] [gn:hi1080] [or:haemophilus influenzae] [de:precursor] [sp:p45024] [db:swissprot] |
| 9770443_c3_52 | 2549 | 5152 | 549 | 182 | 553 | 1.50E-53 | [ln:naf044978] [ac:af044978] [pn:attenuation regulatory protein] [gn:pyrr] [fn:uracil phosphoribosyltransferase] [or:enterococcus faecalis] [db:genpept] [de:enterococcus faecalis pyr operon:attenuation regulatory protein(pyrr) and putative uracil permease |
| 9775217_c1_49 | 2550 | 5153 | 1215 | 404 | 1857 | 9.60E-192 | [ln:spdnaarg] [ac:af000658] [pn:beta subunit of dna polymerase iii] [gn:spdnan] |

TABLE 2-continued

| Orf | NT Seq ID | AA Seq ID | NT Orf Length | AA Orf Length | Score | Probability | Description |
|---|---|---|---|---|---|---|---|
| 9776915_f1_1 | 5154 | 186 | 61 | 211 | 2.50E-17 | | [or:*streptococcus pneumoniae*] [db:genpept-bct] [de:*streptococcus pneumoniae* r801 trna-arg gene, partial sequence, andputative serine protease (sphtra), spspoj (spspoj), trna arg gene partial sequence andputative serine protease (sphtra) spspoj (spspoj)] [ln:spadea] [ac:z71552] [pn:abc protein] [gn:adec] [or:*streptococcus pneumoniae*] [db:genpept-bct] [de:*streptococcus pneumoniae* adccba operon.] [le:20] [re:721] [di:direct] |
| 978562_c3_221 | 5155 | 192 | 63 | 58 | 0.035 | | [ac:p19200] [or:commelina yellow mottle virus] [sr:,coymv] [de:hypothetical 23 kd protein (orf1)] [sp:p19200] [dbs:swissprot] |
| 9792015_f2_32 | 5156 | 408 | 135 | 150 | 7.40E-11 | | [ac:p37542] [gn:yaba] [or:*bacillus subtilis*] [de:hypothetical 14.1 kd protein in xpac-abrb intergenic region] [sp:p37542] [dbs:swissprot] |
| 9792337_c2_59 | 5157 | 885 | 294 | 946 | 3.30E-95 | | [ac:p37518] [gn:yaaf] [or:*bacillus subtilis*] [de:region] [sp:p37518] [dbs:swissprot] |
| 9797961_f2_6 | 5158 | 1101 | 366 | 921 | 1.50E-92 | | [ac:c33496] [pn:hisc homolog] [or:*bacillus subtilis*] [db:pir] |
| 9798587_f1_4 | 5159 | 816 | 271 | 116 | 3.50E-05 | | [ac:p55548] [gn:y41h] [or:*rhizobium* sp] [sr:rng234,] [de:hypothetical 22.4 kd protein y41h] [sp:p55548] [dbs:swissprot] |
| 980277_c3_12 | 5160 | 378 | 125 | 507 | 1.10E-48 | | [ac:p45293] [gn:hi1647] [or:*haemophilus influenzae*] [de:hypothetical protein hi1647] [sp:p45293] [dbs:swissprot] |
| 980342_f1_3 | 5161 | 672 | 224 | 160 | 9.90E-11 | | [ac:p31847:p37951] [gn:ypua] [or:*bacillus subtilis*] [de:hypothetical 31.3 kd protein in lysa-ppib intergenic region (orfx19)] [sp:p31847:p37951] [dbs:swissprot] |
| 9804766_f1_15 | 5162 | 255 | 84 | 65 | 0.22 | | [ac:q03629] [gn:ym1079w] [or:*saccharomyces cerevisiae*] [sr:,baker's yeast] [de:hypothetical 22.5 kd protein in tubi-cpr3 intergenic region] [sp:q03629] [dbs:swissprot] |
| 9807962_c1_54 | 5163 | 1224 | 407 | 344 | 6.70E-31 | | [ac:p45861] [gn:ywja] [or:*bacillus subtilis*] [de:hypothetical abc transporter atp-binding protein in acda 5'region] [sp:p45861] [dbs:swissprot] |
| 9808200_c2_36 | 5164 | 201 | 66 | 109 | 4.90E-06 | | [ac:p37543] [gn:yabb] [or:*bacillus subtilis*] [de:hypothetical 28.3 kd protein in xpac-abrb intergenic region] [sp:p37543] [dbs:swissprot] |
| 9808468_c2_37 | 5165 | 702 | 233 | 143 | 1.40E-08 | | [ln:lpatovgns] [ac:x94434] [pn:plnu] [gn:plnu] [fn:unknown] [or:*lactobacillus plantarum*] [db:genpept-bct] [de:*l.plantarum* pln[a,h,c,d,e,f,g,h,i,j,k,l,m,n,o,p,r,s,t,u,v] genesand orf1.] [nt:putative] [le:15253] [re:15921] [di:direct] |
| 9816255_c3_34 | 5166 | 279 | 92 | 70 | 0.2 | | [ac:c69397] [pn:hypothetical protein af1180] [or:*archaeoglobus fulgidus*] [db:pir] |
| 9819842_f1_1 | 5167 | 591 | 196 | 205 | 1.10E-16 | | [ac:p05332] [gn:p20] [or:*bacillus licheniformis*] [de:hypothetical p20 protein] [sp:p05332] [dbs:swissprot] |
| 9822138_f2_5 | 5168 | 1035 | 344 | 150 | 5.20E-13 | | [ln:tpu70661] [ac:u70661] [pn:mccf-like protein] [or:*treponema pallidum*] [db:genpept-bct] [de:*treponema pallidum* gtp-binding protein, mccf-like protein andatp-dependent dna helicase (recg) genes, complete cds.] [le:1521] [re:2534] [di:direct] |
| 9822530_f1_1 | 5169 | 1593 | 530 | 735 | 7.60E-73 | | [ac:p36672] [gn:treb] [or:*escherichia coli*] [de:(ec:2.7.1.69) (eii-tre)] [sp:p36672] [dbs:swissprot] |
| 9824007_c2_47 | 5170 | 363 | 120 | 92 | 0.00032 | | [ln:eeu82664] [ac:u82664] [or:*escherichia coli*] [db:genpept-bct] [de:*escherichia coli* minutes 9 to 11 genomic sequence.] [nt:hypothetical protein] [le:133380] [re:134066] [di:direct] |
| 9844776_f3_4 | 5171 | 1041 | 347 | 99 | 0.11 | | [ac:p53753] [gn:ymro67:cn3547] [or:*saccharomyces cerevisiae*] [sr:,baker's yeast] [de:precursor] [sp:p53753] [dbs:swissprot] |
| 9845187_c1_27 | 5172 | 273 | 90 | 94 | 1.10E-07 | | [ac:p47251] [gn:sers:mg005] [or:*mycoplasma genitalium*] [ec:6.1.1.11] [de:seryl-trna synthetase, (serine–trna ligase) (serrs)] [sp:p47251] [dbs:swissprot] |
| 9844591_f2_35 | 5173 | 243 | 80 | 66 | 0.48 | | [ac:p29851:s27760] [pn:protein kinase 6,] [cl:unassigned ser/thr or tyr-specific protein kinases:protein kinase homology] [or:glycine max] [sr:, soybean] [ec:2.7.1.—] [db:pir] |
| 9849062_c2_56 | 5174 | 282 | 93 | 304 | 8.20E-26 | | [ac:g69708] [pn:chromosome segregation smc protein homolog smc] [gn:smc] [or:*bacillus subtilis*] [db:pir] |
| 9859758_c2_15 | 5175 | 255 | 84 | 103 | 7.10E-06 | | [ln:ehy14328] [ac:y14328] [pn:3el protein] [or:*entamoeba histolytica*] [db:genpept-inv] [de:*entamoeba histolytica* mrna for 3el protein.] [le:32] [re:418] [di:direct] |
| 9869086_f1_2 | 5176 | 1011 | 336 | 108 | 0.0023 | | [ac:p44896] [gn:hi0839] [or:*haemophilus influenzae*] [de:hypothetical protein hi0839] |

TABLE 2-continued

| Orf | NT Seq ID | AA Seq ID | NT Orf Length | AA Orf Length | Score | Probability | Description |
|---|---|---|---|---|---|---|---|
| 9869686_f3_32 | 5177 | 528 | 175 | 163 | 2.50E-11 | | [sp:p44896] [db:swissprot] |
| 9877268_f1_12 | 5178 | 1083 | 360 | 686 | 1.20E-67 | | [ac:p39301] [gn:sgat] [or:escherichia coli] [de:sgat protein] [sp:p39301] [db:swissprot] |
| 9881277_f3_52 | 5179 | 588 | 195 | 552 | 1.90E-53 | | [ac:d69682] [pn:gamma-glutamyl kinase prob] [gn:prob] [or:bacillus subtilis] [db:pir] [ac:p39815] [gn:gid] [or:bacillus subtilis] [de:gid protein (fragment)] [sp:p39815] [db:swissprot] |
| 9881285_c2_49 | 5180 | 234 | 77 | 115 | 3.80E-07 | | [ac:pq0452] [pn:extensin-like protein] [or:nicotiana alata] [sr:, persian tobacco] [db:pir] |
| 9882051_c2_32 | 5181 | 261 | 86 | 65 | | 0.24 | [ac:jc5598] [pn:mucin] [gn:muc5a] [or:rattus norvegicus] [sr:, norway rat] [db:pir] |
| 9883252_f2_15 | 5182 | 762 | 253 | 234 | 9.30E-20 | | [ac:q58813] [gn:mj1418] [or:methanococcus jannaschii] [de:hypothetical protein mj1418] [sp:q58813] [db:swissprot] |
| 9884550_c3_67 | 5183 | 432 | 143 | 184 | 1.90E-14 | | [ln:spnana] [ac:x72967] [or:streptococcus pneumoniae] [db:genpept-bct] [des:pneumoniae nana gene,] [nt:orf2] [le:193] [re:495] [di:direct] |
| 9884836_f1_46 | 5184 | 1308 | 435 | 825 | 2.20E-82 | | [ac:p40739] [gn:bgl;pn17c] [or:bacillus subtilis] [ec:2.7.1.69] [de:enzyme ii, abc component), (eii-bgl)] [sp:p40739] [db:swissprot] |
| 9892879_c2_12 | 5185 | 1184 | 394 | 82 | | 0.11 | [ln:d50453] [ac:d50453] [pn:multidurg resistance protein(emrb) homologue of] [gn:ycgd] [or:bacillus subtilis] [sr:bacillus subtilis (strain:168 trpc2) dna] [db:genpept-bct] [de:bacillus subtilis dna for 25–36 degree region containing theamye-sfra region, |
| 9897208_c2_26 | 5186 | 624 | 207 | 360 | 4.10E-33 | | [ln:msgtcwpa] [ac:m15467] [pn:unknown protein] [or:mycobacterium tuberculosis] [sr:mycobacterium tuberculosis (strain erdman) dna] [db:genpept-bct] [de:m.tuberculosis 65 kda antigen (cell wall protein a) gene,] [nt:orf f175; putative |
| 9900038_c1_36 | 5187 | 1476 | 491 | 2154 | 3.20E-223 | | [ac:a27626] [pn:sucrose phosphorylase,] [cl:gtfa protein] [or:streptococcus mutans] [ec:2.4.1.7] [db:pir] |
| 9922882_c2_91 | 5188 | 303 | 100 | 112 | 3.70E-06 | | [ln:spbc3d5] [ac:z95620] [pn:unknown] [gn:spbc3d5.14c] [or:schizosaccharomyces pombe] [sr:fission yeast] [db:genpept-pln] [des:pombe chromosome ii cosmid c3d5.] [nt:spbc3d5.14c, unknown; partial: serine rich,] [le:31398] [re: |
| 992887_c1_164 | 5189 | 429 | 142 | 74 | | 0.66 | [ln:ab000353] [ac:ab000353] [pn:outer surface protein c] [or:borrelia tanukii] [sr:borrelia tanukii (strain:hk501) dna] [db:genpept-bct] [de:borrelia tanukii dna for outer surface protein c, partial cds.] [nt:ospc] [le:<1] [re: |
| 9929150_f2_28 | 5190 | 351 | 116 | 95 | 5.00E-05 | | [ln:ehy14328] [ac:y14328] [pn:3el protein] [or:entamoeba histolytica] [db:genpept-inv] [de:entamoeba histolytica mrna for 3el protein.] [le:32] [re:418] [di:direct] |
| 9939437_c1_83 | 5191 | 402 | 133 | 362 | 2.50E-33 | | [ac:s52544] [pn:isl2 protein] [or:lactobacillus helveticus] [db:pir] |
| 994027_f3_38 | 5192 | 639 | 212 | 475 | 2.70E-45 | | [ac:a70049] [pn:conserved hypothetical protein yvye] [gn:yvye] [or:bacillus subtilis] [db:pir] |
| 994053_c2_184 | 5193 | 363 | 120 | 59 | | 0.33 | [ln:af031273] [ac:af031273] [pn:mhc class ii dr beta] [gn:hla-drb] [or:gorilla gorilla] [sr:gorilla] [db:genpept-pri2] [de:gorilla gorilla mhc class ii dr beta hla-drb gene (drb1*0201allele), partial cds.] [le:<1] [re: |
| 994086_f2_11 | 5194 | 813 | 270 | 1237 | 4.80E-126 | | [ac:p26593] [pn:lacd] [or:lactococcus lactis] [sr:,subsplactis:streptococcus lactis] [ec:4.1.—.—] [de:tagatose 1,6-diphosphate aldolase,] [sp:p26593] [db:swissprot] |
| 9942532_f2_21 | 5195 | 204 | 67 | 62 | | 0.18 | [ln:tdmatk] [ac:z70187] [pn:maturase] [gn:matk] [or:chloroplast tabernaemontana divaricata] [sr:tabernaemontana divaricata] [db:genpept-pln] [de:t.divaricata chloroplast matk gene,] [le:<1] [re:1545] [di:direct] |
| 9942943_c1_31 | 5196 | 228 | 75 | 64 | | 0.25 | [ac:s32107] [pn:85a protein] [or:mycobacterium leprae] [db:pir] |
| 9945327_f3_52 | 5197 | 1137 | 378 | 1350 | 5.10E-138 | | [ac:q02418] [gn:mtld] [or:streptococcus mutans] [ec:1.1.1.17] [de:mannitol-1-phosphate 5-dehydrogenase,] [sp:q02418] [db:swissprot] |
| 995437_f3_15 | 5198 | 876 | 291 | 933 | 7.90E-94 | | [ac:p45134] [gn:tehb:hi1275] [or:haemophilus influenzae] [de:tellurite resistance protein tehb homolog] [sp:p45134] [db:swissprot] |
| 9955393_c2_27 | 5199 | 486 | 161 | 814 | 3.20E-81 | | [ac:p23379] [gn:ung] [or:streptococcus pneumoniae] [ec:3.2.2.—] [de:uracil-dna glycosylase,] [sp:p23379] [db:swissprot] |
| 9956261_f2_20 | 5200 | 300 | 99 | 65 | | 0.59 | [ln:celt13a10] [ac:u56963] [gn:t13a10.4] [or:caenorhabditis elegans] [sr:caenorhabditis elegans strain=bristol n2] [db:genpept-inv] [de:caenorhabditis elegans cosmid t13a10, |

TABLE 2-continued

| Orf | NT Seq ID | AA Seq ID | NT Orf Length | AA Orf Length | Score | Probability | Description |
|---|---|---|---|---|---|---|---|
| 9957962_f1_1 | 2598 | 5201 | 1323 | 440 | 740 | 2.20E−73 | [le:2740:3678] [re:2882:3912] [di:complementjoin] [ln:spu66846] [ac:u66846] [or:*streptococcus pneumoniae*] [db:genpept-bct] [de:*streptococcus pneumoniae* cps3e and rpt pseudogenes, partialsequence, cps3c (cps3c), cps3p (cps3p) genes, partial cds.] [nt:orfs] [le:525] [re:1118] [di:complement] |
| 9959677_c3_116 | 2599 | 5202 | 1275 | 424 | 160 | 7.60E−09 | [ln:spu70055] [ac:u70055] [pn:macrolide-efflux protein] [gn:mef] [fn:effluxes erythromycin and other 14 and] [or:*streptococcus pyogenes*] [db:genpept-bct] [de:*streptococcus pyogenes* macrolide-efflux protein (mef) gene, complete cds.] [nt:allele: a; tetbsr h |
| 9962753_c3_98 | 2600 | 5203 | 618 | 205 | 1065 | 8.10E−108 | [ln:spu90721] [ac:u90721] [pn:signal peptidase i] [gn:spi] [or:*streptococcus pneumoniae*] [db:genpept-bct] [de:*streptococcus pneumoniae* signal peptidase i (spi) gene, completecds.] [nt:leader peptidase] [le:40] [re:654] [di:direct] |
| 9963178_f3_6 | 2601 | 5204 | 417 | 138 | 74 | 0.19 | [ac:a02453] [pn:hemoglobin beta chain, minor] [cl:globin homology] [or:*xenopus laevis*] [sr:, african clawed frog] [db:pir] |
| 9970338_c1_35 | 2602 | 5205 | 1086 | 361 | 1703 | 2.00E−175 | [ln:soorfs] [ac:z79691] [pn:regr] [gn:regr] [fn:putative transcription regulator, member galr] [or:*streptococcus pneumoniae*] [db:genpept-bct] [de:*s.pneumoniae* yorf[a,b,c,d,e], ftsl, pbpx and regr genes.] [le:684] [re:1685] [di:direct] |
| 9975958_c3_39 | 2603 | 5206 | 1059 | 352 | 1042 | 2.20E−105 | [ac:p12043] [gn:purm:ath] [or:*bacillus subtilis*] [ec:6.3.3.1] [de:(phosphoribosyl-aminoimidazole synthetase) (air synthase)] [sp:p12043] [db:swissprot] |

SEQUENCE LISTING (5206 sequences)

SEQ ID NO: 1 - DNA (genomic), 261 bp, Streptococcus pneumoniae; double-stranded, circular
  misc_feature (B) LOCATION 1...261
  hypothetical: NO
  anti-sense: NO
acaccttgttcattatcattatccactaaaactcaaagaaaggatagaagcaaaacgtcagctttattcagttctgaacaatttgcctcaagtgtccatatgactaacattgaccgccgtatcagcaaaaccaaaaaagccatctatcaagcttttatacaacttttgaatgctaagggctacgaggccactactgttcaggatatcattgatctcgcagatgtgggacgatccaccttttactgtcactatgagagatag

SEQ ID NO: 2 - DNA (genomic), 309 bp, Streptococcus pneumoniae; double-stranded, circular
  misc_feature (B) LOCATION 1...309
  hypothetical: NO
  anti-sense: NO
tggagctgttcaagtcaacattatggactatatttaaaagaggagatcgttatgtcgattaatgtatttcaagcgattttaattggattatggacagctttctgttttagtggaatgctgttaggaatttacaccaatagatgtattgttctgtcatttggtgtcggaattattctaggtgatctgcctactgctcttgcaatgggagctattggtgaattggcttatatgggattcggtgttggtgctggaggtactgttccaccaaaccccatcggactgataatgcgcggtatccacnngagttga

SEQ ID NO: 3 - DNA (genomic), 192 bp, Streptococcus pneumoniae; double-stranded, circular
  misc_feature (B) LOCATION 1...192
  hypothetical: NO
  anti-sense: NO
ttgattcgttcacattctattacaatctactataataaaatgatgagagttattacaaattataggtttgaaaaatcattaatttctttttcgagtattttaactaatgcctcttctttggttagtcgtaataaagttattcctttatcaatcaaatcggagttatgttgtagtattcccaagcgtacttga

SEQ ID NO: 4 - DNA (genomic), 903 bp, Streptococcus pneumoniae; double-stranded, circular
  misc_feature (B) LOCATION 1...903
  hypothetical: NO
  anti-sense: NO
ttttctagttcatttgtggtcattttttgtactcatatacctttaaaatataaaaggaggttgtacatgtatcgaattctaaatccaatgaatcacaatgtctcgtttgtcagaaatgataagggagaagaggtgattgtaattggtaaggggattgcattcggaaagaagaagggggatttgattgctgaaaatcaggttgagaaaatctttcggatgaagaccgaagagtccagagaaaactttatggctcttctcaaagatgttccgcttgattttatcacagtgacctatgaaatcattgataagctatcaaagaaatatcattatccgattcaagagtatctctatgtaaccttgacagatcatatttactgttcttatcaagctctaactcaaggaaggtacaaggatagtaatctgccagatatttccgctaagtatcctgtcgcttttcaaatcgcaaatgaagcttttgaaatttaccgtcagaagctagcagatcattttcctgaggacgaaattattcggattgcttatcatttcattaatgctgaaggtgaaaatgaagtggaacttgtggagtcgattgataagaggaaagaaattctcaggaatgttgaagaagttttaacggactatgcaattcaacgaactaaaaagaataaccatttctatgatcgctttatgatccatttgaattatttcttggattatttagacagatctagagatgataaccaatcacttctggatatggaagatcatattaaacaatcctatccaaaagccttcgagattggttccaagatctatgatgtgattacgcaacatacgggtcttgatttgtataaaagtgaacgagtttatctagttctacatatccaacgtttattgtcataa

SEQ ID NO: 5 - DNA (genomic), 696 bp, Streptococcus pneumoniae; double-stranded, circular
  misc_feature (B) LOCATION 1...696
  hypothetical: NO
  anti-sense: NO
tataatagttctatgagattagataaatttttagttgcctgtgcggtgggaagtcggactgaggtcaaaaacttgctcaaggctgggcgcgtgactgtaaatggtaaaaaagaaaaatcagctaaattgcagattgatgaaaaaatagatgagattcgctttgatgggcaagtgttggagtatgaagagtttgtctactacatgatgaacaagcccaaaggagttatatcagcgactgaggatcccaagcacagaaccgttctggacttgttggatgacttggcgcggagtaaggaaattttcccagtaggacgcttggatattgacacgcatggtcttttgctcttgaccaatgatggtcagctggctcatgttcttctttcgcccaagcgtcatgtggacaagacttatctggcacaagtcaagggaatcatgacccaagaagatgtggagatatttgctgagggtattcctctcaaagactttacctgtcaacccgctatactggagcttgtatccatagatacagaaaagaatcaaagccaaatccgtgtgaccattgcagaagggaagtttcatcagatcaagcgtatggtgggctactgtggcaaggaagtggtggacttgcaacgattgactatgggaactttagtattagatgagaacctggaacgagggggaagtggcgtcgcttga

SEQ ID NO: 6 - DNA (genomic), 510 bp, Streptococcus pneumoniae; double-stranded, circular
  misc_feature (B) LOCATION 1...510
  hypothetical: NO
  anti-sense: NO
tataatagttctatgttaaaatcagaaaaacaatcacgttatcaaatgttaaatgaagaattgtccttcctattggaaggcgaaaccaatgttttggctaatctttccaacgccagtgctctcataaaatcacgttttcctaataccgtatttgcaggcttttatttgttcgatggaaaggaattggttttaggccccttccaaggaggtgtttcctgcatccgtattgcactaggcaagggtgtttgtggtgaggcagctcactttcaggaaactgttattgttggagatgtgacgacctatctcaactatatttcttgtgatagtctagctaaaagtgaaattgtggtgccgatgatgaagaatggtcagttacttggagttctggatctggattcttcagagattgaggattacgatgctatggatcgagattatttggaacaatttgtcgctattttgcttgaaaagacagcatgggactttacgatgtttgaggaaaaatcttaa

SEQ ID NO: 7 - DNA (genomic), 276 bp, Streptococcus pneumoniae; double-stranded, circular
  misc_feature (B) LOCATION 1...276
  hypothetical: NO
  anti-sense: NO
aagaccagttcacagagtgtcactcctgttcttcaaacaaattactacatcgacacgcctgattttgaactgcgagaaaagaaagtcgctatgcgcattcgaacctttgaagactgggctgagttgacactcaaagtcccgcagagtgttggaaacatggaatacaaccaaaaattgcaactaaaagatgctgagaactatctgagtaaggaagaacttactcaagggctagtactagatgacttagcgacacatggtatccaaagtaagaactag

SEQ ID NO: 8 - DNA (genomic), 369 bp, Streptococcus pneumoniae; double-stranded, circular
  misc_feature (B) LOCATION 1...369
  hypothetical: NO
  anti-sense: NO
gagagaagttcaaaatttggtattatccctgagttgattggacgcttgcctgtttttgcggctcttgagcaattgaccgttgatgacttggttcgcatcttgaaagagccaagaaatgccttggtgaaacaataccaaaccttgctttcttatgatgatgttgagttggaatttgacgacgaagcccttcaagagattgctaataaagcaatcgaacggaagacaggggcgcgtggacttcgctccatcatcgaagaaaccatgctagatgtcatgtttgaggtgccgagtcaggaaaatgtgaaattggttcgcatcactaaagaaactgtcgatggaacggataaaccgatcctagaaacagcctag

SEQ ID NO: 9 - DNA (genomic), 924 bp, Streptococcus pneumoniae; double-stranded, circular
  misc_feature (B) LOCATION 1...924
  hypothetical: NO
  anti-sense: NO
aaggagagttcaatgagtaagcatcaggaaattctaagctatttggaggaattaccagtaggtaaaagggtcagtgttcgtagcatttcgaatcatctaggagttagtgatggaacagcctatcgggctattaaagaagctgaaaaccgtggaattgtggagacccgtcctagaagtggaacaattcgtgttaaatcccagaaagttgctatagagagattaacgtttgctgaaattgcagaagtgacttcttctgaggttctggctgggcaagaaggtttagagagagaatttagtaagttttcaattggtgccatgactgaacaaaatatcttgtcttaccttcatgatggggggctcttgattgtcggagaccgaacccgtattcagttgctagccttggaaaatgaaaatgcagttctggttacagggggatttcaggttcatgatgatgtgcttaaactggccaatcaaaaagggattcctgttctaagaagtaagcatgatacctttaccgtcgcgaccatgatcaataaagccttgtcaaatgtccaaatcaagactgatattctgacagttgagaaactttatcgccctagtcatgagtatggttttctgagagagacagatacagttaaagattatttggacttggttcgtaagaatcgtancagccgtttccctgttatcaatcaacatcaggtcgttgttggcgttgtaaccatgagagacgctggtgataaatcaccaagcacgacaattgataaggttatgtctcgtantctatntttggttggattatcgacaaatattgccaatgtgagtcaacggatgatcgcaaaaaactttgaattggtaccattttgtccgaancaatcaaactttgcttggcgttgtgacgcaacaaaatgtctgagaaaatga

SEQ ID NO: 10 - DNA (genomic), 432 bp, Streptococcus pneumoniae; double-stranded, circular
  misc_feature (B) LOCATION 1...432
  hypothetical: NO
  anti-sense: NO
aaagggagttcatctatcgtgtggaaaaagaagaaagttaaggcaggtgttctcctctacgcagtcaccatagcagccatctttagtcttttgttgcaattttatttgaaccgacaaatcgcccactatcaagactatgctttaaataaagaaaaattggttgcttttgccatggctaaacgaaccaaagataaggttgagcaagaaagtggggaacagttttttaatctaggtcaggtaagctatcaaaacaagaaaactggcttagtgacgagggttcgtacggataagagtcaatatgagtttctgtttccttcagtcaaaatcaaagaagagaaaagagataaaaaggaagaggtagcgaccgattcaagcgaaaaagtggagaagaaaaaatcagaagagaagcctgaaaagaaagagaattcctag

SEQ ID NO: 11 - DNA (genomic), 330 bp, Streptococcus pneumoniae; double-stranded, circular
  misc_feature (B) LOCATION 1...330
  hypothetical: NO
  anti-sense: NO
tccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtag

SEQ ID NO: 12 - DNA (genomic), 330 bp, Streptococcus pneumoniae; double-stranded, circular; identical to SEQ ID NO: 11
  misc_feature (B) LOCATION 1...330
  hypothetical: NO
  anti-sense: NO

SEQ ID NO: 13 - DNA (genomic), 330 bp, Streptococcus pneumoniae; double-stranded, circular; identical to SEQ ID NO: 11
  misc_feature (B) LOCATION 1...330
  hypothetical: NO
  anti-sense: NO

SEQ ID NO: 14 - DNA (genomic), 330 bp, Streptococcus pneumoniae; double-stranded, circular; identical to SEQ ID NO: 11
  misc_feature (B) LOCATION 1...330
  hypothetical: NO
  anti-sense: NO

SEQ ID NO: 15 - DNA (genomic), 1533 bp, Streptococcus pneumoniae; double-stranded, circular
  misc_feature (B) LOCATION 1...1533
  hypothetical: NO
  anti-sense: NO
ggagaaggttcttttgggatttttaaaggaaataatatgaaaaaatatatttttatgcgtgttttgcggtcattggtttcgattttcttagtaacgactttgacctacacgattatctataccttggttcctcgaaaattgattttcaagcaggatcctaactataataaaattgcgacaacggctgataaacgtgataactatgaaaatactgtgtttgagcgtatgggctacattgagtattacgatactagagagttgcaagaaaaggcaagtagcatggattcttctgtaacagtagaagcaaatgcgaccaataaagctatttatgaaaagtacatcaatcaattaggtcatggttggactttgggagaatttactgaaagtggtcaattctatgctactcgtgaaattccaatttttgaacgtgtttttcacttctatgctaacttgattgacattgaccatacaaataaaatccaagaccctgaaaatccagacttgaaacgctaccttcgttttgaaaatgatccagctatcggatggtcattggtcggttcaggaactaaacataaatatctcttgtactttaacagtcagttcccatttgttcatcaaaactttgtgaacttgaatttaggtgactcttacccaacctatgctaatacaccagttcttcaggttattactcaaggtcaaggacaaaccaaaactgcccaagttcagttcccaacaggtaagaaaacgtcttctgtaaatatttactcaagaacctacaagtcacctagtcaggctgactctcgtgaagtagctagctatgggaaagatgatccttatacagcgactgaaagtaattaccaatatccatctatgattgtcagctctgctattactggtttgattggtttggttcttgcctatgctcttgccgtgccacttggttcagccatggctcgtttcaagaacacttggattgatagcctctcaacagggactttgaccttcttgcttgctcttccaacgattgccttggtttacatcgttcgattgattggatcatctattgcccttccagattcattccctatcttgggagctggagattggcgttcttacgttttaccagcagtcatccttggtttgttgggtgctcctgttacagccatttggattcgtcgttacatgattgacttgcaatctcaagactttgttcgtttcgctcgtgcaaaaggtttgtctgaaaaagaaatttcaaacaaacacatctttaaaaatgccatggttccgctggtttcaggaattcctggtgccattattggggttatcggtggtgcaacccttactgaaacagtcttcgccttcccaggtatgggtaaaatgttgattgactctgtaaaagcatctaataactctatggtcgttggtcttgtcttcatctttacatgtatttctatcttctcacgtcttttgggagatatttggatgactattattgacccacgtattaaattgactgagaaaggaggcaaataa

SEQ ID NO: 16 - DNA (genomic), 1080 bp, Streptococcus pneumoniae; double-stranded, circular
  misc_feature (B) LOCATION 1...1080
  hypothetical: NO
  anti-sense: NO
aaaggaggttctaccatgaaacaagaatggtttgaaagtaatgattttgtaaaaacaacaagcaagaacaagcctgaagagcaagctcaagaggttgcagacaaggctgaagaaacgatagccgatctcgatacaccaattggaaaaaatactcaagtagaggaggaagtctctcaagctgaagtcgaattggaaagccagcaagaagagaaaattgaaactcctgaagtcggtgaagcgagaacagaaatagaagaaaagaaggcatctaattctactgaagaagagccagacctttctaaagaaacagaaaaagtcactatagctgaagagagccaagaagctcttcctcagcaaaaagcaaccacgaaagagccacttcttatcagtaaatctttagaaagtccttatatccccgaccaagctccaaaatctagggataaatggaaagagcaagtgcttgatttttggtcttggctagtggaagcgatcaaatctcctacaagtaagttggaaacaagtatcacacacagttacacagcctttctcttgctcattctgttttctgcatcttcctttttctttagtatctatcacatcaaacatgcttactatggacatatagcaagcattaacagtcgcttccctgagcagctagctcctttaactcttttttctatcatctctatcctagtagcgacaacactcttcttcttttcattcctcttgggtagtttcgttgtgagacgatttatccaccaggaaaagtactggacgctagacaaggttctccaacaatatagtcaactcttggcaattccaatcttcctcactgctattgctagtttctttgctttctttgatagcctacgatttacagccctcttgtgtgtgattagcattggaatcattctgcttgccagtctccatatcattacaagaccaagtcaagcaagtgaaaccgactccttctatcaattattcttgtctgtccttgtgaacggagttattatcctcctcttctttgtagctgaagtggcactgattggagattatcttcgtatcttggcctttctttaa

SEQ ID NO: 17 - DNA (genomic), 264 bp, Streptococcus pneumoniae; double-stranded, circular
  misc_feature (B) LOCATION 1...264
  hypothetical: NO
  anti-sense: NO
atctttttctcgttgttaacatcaaggcttgctgttatctcatctaagatcaatatcggcgcatcttttaagaaggctctggctattgataatctttgtctttctcctcctgatagctcagctccgttttcaccaataactgtatcgaaacctttatccattttttctataaaatctgtgcaatttgcaagttttgctgctcttttaacctcttcgtcacttgcatcttgcttaccgattctaatattttccataacgctttga

SEQ ID NO: 18 - DNA (genomic), 213 bp, Streptococcus pneumoniae; double-stranded, circular
  misc_feature (B) LOCATION 1...213
  hypothetical: NO
  anti-sense: NO
aacattctctcaactacaagtaccaaggggatttcccagtatgagattaagaagcgactggaaattacagctagaatcgcccatcagttggatgaagaaatgggtgaaattcgtgatgatatccaagaggcccaggcactttttgatcctttgagtagaaaattaaatgacggtgtaggaaacagtgacgatacagatgaagaatacaggtaa

SEQ ID NO: 19 - DNA (genomic), 375 bp, Streptococcus pneumoniae; double-stranded, circular
  misc_feature (B) LOCATION 1...375
  hypothetical: NO
  anti-sense: NO
actcttatctcatttgctattgccattgtcatcggaattatcttcggtatgtttagcgttagcccatacaaatctcttcgcgtcatctctgagattttcgttgacgttattcgtggtattccattgatgattcttgcagccttcatcttctggggaattccaaacttcatcgagtctatcacaggccaacaaagcccaattaacgactttgtagctggaaccattgccctctcactcaatgcggctgcttatatcgctgaaatcgttcgtggtggtattcaggccgttccagttggccaaatggaagccagccgaagcttgggtatctcttatggaaaaaccatgcgtaagattatcttgccacaaagcaactaa

SEQ ID NO: 20 - DNA (genomic), 996 bp, Streptococcus pneumoniae; double-stranded, circular
  misc_feature (B) LOCATION 1...996
  hypothetical: NO
  anti-sense: NO
ttgcaaatctccatgataagatccgtgaaaaaatgggatttgcccatctggctgactaggaggaaggaaatgtctgaaaaattagtagaaatcaaagatttagaaatttccttcggtgaaggaagtaagaagtttgtcgcggttaaaaatgctaacttctttatcaacaagggagaaactttctcgcttgtaggtgagtccggtagtgggaaaacaactattggtcgtgctatcatcggtctaaatgatacaagtaatggagatatcatttttgatggtcaaaagattaatggtaagaaatcgcgtgaacaagctgcggaattgattcgtcgaatccagatgattttccaagaccctgccgcaagtttgaatgaacgtgcgactgttgattatattatttctgaaggtctttacaatcaccgtttatttaaggatgaagaagaacgtaaagagaaagttcaaaatattatccgtgaagtaggtcttcttgctgagcacttgactcgttaccctcatgaattctcaggcggtcaacgtcaacgtatcggtattgcccgtgccttggtcatgcaaccagactttgttattgcagatgagccaatttcagccttggacgtttctgtacgtgcccaagtcttgaacttgctcaaaaaattccaaaaagagctcggcctgacctatctcttcatcgcccatgacttgtcggttgttcgctttatttcagatcgtatcgcagttatttacaagggtgttattgtagaggttgcagaaacagaagaattgtttaacaatccaattcacccatatactcaagccttgctttcagcggtaccaatcccagatccaatcttggaacgtaagaaggtcttgaaggtttacgacccaagtcaacacgactatgagactgataagccgtctatggtagaaatccgtccaggtcactatgtttgggcgaaccaaaccgaattggcacgttatcaaaaaggactaaactag

SEQ ID NO: 21 - DNA (genomic), 309 bp, Streptococcus pneumoniae; double-stranded, circular
  misc_feature (B) LOCATION 1...309
  hypothetical: NO
  anti-sense: NO
ctgtcctcctctagggcctctattcgggtgaagaagggcgatgtttttgactccaacgaagccatgtccactaagataaagcagggtggaacgacctacgatattgccattccaagtgaatacatgattaacaagatgaaggacgaagacctcttggttccgcttgattattcaaaaattgaaggaatcgaaaatatcggaccagagtttctcaaccagtcctttgacccaggtaataaattctccatcccttacttctggggcgactcactttgtggagaaactttcagacacggaacaactcaataa

SEQ ID NO: 22 - DNA (genomic), 201 bp, Streptococcus pneumoniae; double-stranded, circular
  misc_feature (B) LOCATION 1...201
  hypothetical: NO
  anti-sense: NO
tttaactcctctaaaattagttgtttacgttctgtttttaacactgaatcacctcctgttatcgtttacactattcattctatcatactttctttcgaagtcaagcattttttatcattttctttcaaaatctatcattttttcttatttctagaatttttattgcaagataagagcctttatggtagactatttgagtaa

SEQ ID NO: 23 - DNA (genomic), 390 bp, Streptococcus pneumoniae; double-stranded, circular
  misc_feature (B) LOCATION 1...390
  hypothetical: NO
  anti-sense: NO
gaaaacacctctgtgctatacttgttgttcaccacaaacacaaggaaaggcacagagatgcaagaacattataccccaaaagggaaacatttgacaatagataaccgtcgcttgattgagcggtggaagaatgaaaataagtccaatcgtgaaattgcaggcttgttaggaaaggcgcctcaaacgattcataatgaagtcaaaagaggtacaactttacaacaagtgagaaaagggctatacaaaaaggtctattctgccgattacgcacaaactgtttaccaattcaatcgaaaacggtcggtgaaaaagttaattttaacaaaggaaatcagagagaagatcttacactatcataagcacataagcaaaaattttcgcctgaaatga

SEQ ID NO: 24 - DNA (genomic), 1107 bp, Streptococcus pneumoniae; double-stranded, circular
  misc_feature (B) LOCATION 1...1107
  hypothetical: NO
  anti-sense: NO
gaaaacacctctgtgttatacttgttgttcaaccacaaacacaagaaaggcacagaaatgcaagacaattatactacaaaaggtaaacatttgacaatcgatagccgtcgcttaatcgaaagatggaaaaaagaaggaaaatcaaatagagaaattgcctctctacttggaaaagctcctcaaactatccacactaaaatcaagcgtaggacagtccgaaaatgtcttggaaaagggcgcttcaaagaggtttattctgccgactatgctcaacagtcttatgaaaacaatcgcaagcgctcggtcaagaaatcaagcttgaccaaggaactaaaggaaaagattctccactatcataaccaaaaattttcgcctgaaatgatggtgatggctaaaggggttaacgtgggaatttcaaccatttactattggattcatcatggaaaattggggttaagcaagcaggatctgctttaccctagaaaaggaaaagtgcttaagaaacaggctagcaccaactttaaacctgctggtcaatccatcgcacagcggcctgaagctatcaatcttcgcttggagaatgggcattatgagattgatacggttttacttacgagatcgaaaaactactgcttgcttgtcttgacggatcgaaagagtagacatcagatcatccgattgattccaaataaaagtgctgaggtggtcaatcaggctctaaaactcatcttaaaacaacacaagattctttccatcacggcagataatggaacggaattcaatcgcttgtctgatgtattttctgaggagcacatttattatgcgcacccctatgcctcttgggaaaggggaactaatgagaatcacaacaggctcattcatagatggttacctaagggaaccaagaaaatgactcccaaagaagtcgcattcatcgaaaagtggattaacaactatcctaaaaaatgcttgaactacaagtcacccagagaagacttcttgatggctaacttgaacttgaaatttagcgtcagaaacaaatcacgaaatcgattcaaattttgcaggtcgtttaaatatcctgcgcgcaggtgttcttggtgctaa

SEQ ID NO: 25 - DNA (genomic), 390 bp, Streptococcus pneumoniae; double-stranded, circular; identical to SEQ ID NO: 23
  misc_feature (B) LOCATION 1...390
  hypothetical: NO
  anti-sense: NO

SEQ ID NO: 26 - DNA (genomic), 456 bp, Streptococcus pneumoniae; double-stranded, circular
  misc_feature (B) LOCATION 1...456
  hypothetical: NO
  anti-sense: NO
gaaaacacctctgtgttatacttgttgttcaaccacaaacacaagaaaggcacagaaatgcaagacaattatactacaaaaggtaaacatttgacaatcgatagccgtcgcttaatcgaaagatggaaaaaagaaggaaaatcaaatagagaaattgcctctctacttggaaaagctcctcaaactatccacactaaaatcaagcgtaggacagtccgaaaatgtcttggaaaagggcgcttcaaagaggtttattctgccgactatgctcaacagtcttatgaaaataatcgcaagcactcggtcaagagatcaagcgtgaccaaggaactaaaggaaaagattctccactatcataaccaaaaatttttgcctgaaatgatggttatggctaaaggggttaacgtgggaatttcaaccatttactattggattcatcatggaaaattggggtaa

SEQ ID NO: 27 - DNA (genomic), 528 bp, Streptococcus pneumoniae; double-stranded, circular
  misc_feature (B) LOCATION 1...528
  hypothetical: NO
  anti-sense: NO
ctgtcgacctcgctcagtccatgcttaccttaccttgctaaaaggagttacattattatgaataaatcagaacaccgccaccaacttatacgcgctcttatcacaaaaaacaagattcatacacaggctgagttgcaagcccttcttgctgagaacgacattcaagtaacccaggcaaccctctcacgcgacatcaaaaatatgaacctatcaaaagtccgcgaagaagatagcgcttattatgttcttaacaatggttccatctcaaaatgggaaaaacgtctcgaactctacatggaagacgcccttgtctggatgcgcccagttcaacaccaagtcctactaaaaacccttcctggactggctcaatcctttggttctatcattgatactttgagcttccctgacgctatcgctaccctttgtggtaatgatgtctgtcttatcatctgtgaagatgcagatactgctcaaaagtgctttgaagaactgaaaaaattcgccccaccatttttctttgaagaataa

SEQ ID NO: 28 - DNA (genomic), 234 bp, Streptococcus pneumoniae; double-stranded, circular
  misc_feature (B) LOCATION 1...234
  hypothetical: NO
  anti-sense: NO
gcttctgcctcttctggttgtcaattgaccagccttgagcaattcattaaccaaggaatgatcgctcgtcaactgatggtattcttctccacgaatcaagccgatacgcgaatcaccaatatgagcatagatagcctgattatcaataatagcaaggacttccaaagtagttcccatgcctctgtaagcttcatcctgaccaagctggtgaatcttttgattttcaatttctag

SEQ ID NO: 29 - DNA (genomic), 1788 bp, Streptococcus pneumoniae; double-stranded, circular
  misc_feature (B) LOCATION 1...1788
  hypothetical: NO
  anti-sense: NO
gtattggcctcaggtttccatttgcaatcagaaagggattttatgtccattattcaaaaactttggtggtttttcaagttagaaaaacgccgttatctagtcggaattgtggccctggtcttggtttccgtcctcaatctcattcctcctatggttatggggcgggttattgatgccatcacatcggggcaattaacccagcaggacctccttcttagcctattttacttgctacttgcagcctttggtatgtactatttgcgctatgtgtggcgtatgtatatccttgggacctcttattgcttgggacagatcatgcggtctcgcttgtttaagcatttcacaaaaatgtcgtcagccttttatcaaacctatcggacgggtgatctgatggcacacgcaaccaatgatatcaatgccttgactcgtttagcaggtggcggtgtcatgtctgcggtggatgcctctatcacggctctggtgactttgttgaccatgctctttagcatctcatggcagatgactcttgttgccattctccccctacctttcatggcctatgcgactagtcgcctagggagaaagactcataaggcctttggcgaatcccaagctgctttttctgaactcaataacaaggtacaggagtccgtatcaggtatcaaagtgaccaagtctttcggttatcaggcagacgagttgaagtcttttcaggcagtcaatgaattaaccttccaaaagaacctgcaaaccatgaaatatgatagtctctttgaccctatggttctcttgtttgttggttcgtcctatgttttaacgcttttggttggctccttggtggttcaggaagggcagattacagttgggaatctagtcacctttatcagctatttggatatgctggtctggcctcttatggccatcggcttcctctttaatactactcagcgagggaaggtttcttaccagcggattgaaaatcttttgtctcaggaatctcctgtacaagacccggagtttcctctggatggtattgaaaatgggcgtttggagtatgccattgacagctttgcttttgaaaatgaggaaacactgacggatattcactttagtttggcaaaagggcaaacactgggcttggttgggcagacaggctctgggaaaacgtccttaatcaagctcctcttgcgtgaatacgatgtggataagggcgccatttatctaaacggtcacgatattcgggactatcgtctgacagaccttcgcagtctcatgggctatgttcctcaggaccagtttctttttgcgacttcaatcctagacaatatccgctttggtaatcctaacttgcccctttcagcggtcgaggaagctactaagctagcccgagtttaccaagatattgtagacatgcctcaaggatttgatacgctgattggtgaaaaaggagtcagtctttctggtggtcaaaagcaacggttggctatgagtcgggctatgattttagaccctgatatcttgattttggatgattccttatccgccgtagatgccaagacagagtatgcgattatcgacaacctcaaggagacgcgaaaggacaagacaaccattatcactgcccatcgcctcagtgcagttgtccatgcagatttgattttagtcctgcaaaatggtcaaattatcgaacgaggcaggcacgaagacttgctagctttggatggctggtatgcccaaacctaccagtctcagcagctggaaatgaagggagaagaagatgcagaataa

SEQ ID NO: 30 - DNA (genomic), 309 bp, Streptococcus pneumoniae; double-stranded, circular
  misc_feature (B) LOCATION 1...309
  hypothetical: NO
  anti-sense: NO
ctttttcgatttacaacaactaatcctgagtttccttctatgattgaactatttagtatcttaccagaatatccattaaagaaggacggtcgagaaattcccttacattttgaccaagatgctagtttatcagccttattattggatgaagattattataatatattggtgcatgaaaaagaaaccattcaggggtattcggtattgagtaattgtggtctatactcttcgaaaatctcttcaaaccacgtcagcttccatctacaacctcaaaacagtgttttgagcagcctgcagctagcttcctag

SEQ ID NO: 31 - DNA (genomic), 339 bp, Streptococcus pneumoniae; double-stranded, circular
  misc_feature (B) LOCATION 1...339
  hypothetical: NO
  anti-sense: NO
tttttatactcttcgaaaatctcttcaaaccacgtcagcgtcgccttaccgtatgtatggttactgacttcgtcagtttcatctacaatctcaaaaccatgttttgagctgacttcgtcagtttcatctacaacctcaaaaccatgttttgagctgacttcgtcagtttcatctacaacctcagaaccatgttttgagctgacttcgtcagtttcatctacaacctcaaaaccatgttttgagctgacttcgtcagtttcatctacaacctcaaaactgtgttttgaacaacctgcggctagcttcctagtttgctctttgattttcattgagtattaa

SEQ ID NO: 32 - DNA (genomic), 474 bp, Streptococcus pneumoniae; double-stranded, circular
  misc_feature (B) LOCATION 1...474
  hypothetical: NO
  anti-sense: NO
cgagctcactcgaggtttatgcccctgtcctttcgctaccaagtgtctgctctggattatattgataaggccctttcggcagaggagtttgaatctcgtatcgagacagccctcctctatgccaatggtcaagacagtaaaagtctagcggaagattgcttttactttaaatcaaaatttgctcaattccagtatccttttaaagaggtttactatctcgaaacgtccacaagaccccatcgtgttattctctataccaagacagacaggctggaatttacagcgagtctagaggaggttctcaagcaggagcctcgtttcttgcagtgccatcgctcttttctcatcaatcctgccaatgtggtgcatttagataagaaagaaaaactgcttttctttcccaatggtggaagttgtctaatcgcgcgttataaggtcagggaagtgtctgaggctattaataacttacactga

SEQ ID NO: 33 - DNA (genomic), 771 bp, Streptococcus pneumoniae; double-stranded, circular
  misc_feature (B) LOCATION 1...771
  hypothetical: NO
  anti-sense: NO
ttgctgcctttatcaatacaaaagggaaaaggcttcctacgaatcattccattcctctttgccattatcggtggttaccttttcgcactaactcttggcttggttgactttacaccagttcttaaagccaactggttcgaaagtcctggtttctacttgccatttagcacaggtggtgcctttaaagagtacaatctttactttggtccagaagccatcgctatcttgccaatcgctatcgtaacaatttctgaacatatcggagaccatactgttttgggtcaaatctgtggccgtcaattcttaaaagaaccaggtcttcaccgtactcttattggtgacggtatcgcaacttctgtttctgccttccttggtggaccagccaatacaacttacggagaaaatacaggggttatcggtatgactcgtatcgcttctgtctcagttatccgtaacgctgccttcatcgcgattgccctcagcttccttggtaaattcactgccttgatttcaactattccaaacgctgtacttggtggtatgtcaatccttctctatggggttatcgccagcaatggtttgaaagtcttgattaaagaacgtgttgatttcgctcaaatgcgaaacctcatcatcgcaagtgctatgttggttcttggacttggaggagctatccttaaacttggtccagttacactttcaggtactgccctttcagccatgacaggaatcatcttgaacttgatcttgccatacgaaaataaagactaa

SEQ ID NO: 34 - DNA (genomic), 204 bp, Streptococcus pneumoniae; double-stranded, circular
  misc_feature (B) LOCATION 1...204
  hypothetical: NO
  anti-sense: NO
aatataaactcaatgaaaatcaaagagcaaactaggaagctagccgcaggttgctcaaaacacagttttgaggttgtagataagactgacgaagtcagctcaaaacatggttttgaggttgtagatgaaactgacgaagtcagtaatcatatctacggcaaggcgacactgacgaagtttgaattggattttcgcagagtgtaa

SEQ ID NO: 35 - DNA (genomic), 465 bp, Streptococcus pneumoniae; double-stranded, circular
  misc_feature (B) LOCATION 1...465
  hypothetical: NO
  anti-sense: NO
ttaccaaactcaaggaagaatacggagaggagagagcaaaagccatctttgaaagcctgtagtctgcgaaacaaagccagtattcgtgtaacagacctaagtcgaaaagaggaaatccaagccttgttggaggcgaatgattcccttttagcaaccactcgtctggttaaggagcaagggcattttgcagggcataatttgtttgcggatggagccattaccatccaagacgagtccagtcagctggttgctccgacgcttgatttacaaggtgatgagcgagtgcttgatcctgtgcggctccaggtggaaaacagcccatatagcctcttatcttacgacaggtcaggttactgctctggacttgtacgaccacaagttggatttaattcaagaaaatgcccaacgtctgggagttgcagatcgggttcaaactcaaaaattggatgccagaaaggtgcatga

SEQ ID NO: 36 - DNA (genomic), 768 bp, Streptococcus pneumoniae; double-stranded, circular
  misc_feature (B) LOCATION 1...768
  hypothetical: NO
  anti-sense: NO
aaagaaaactcagctatctcatgtaaaatgcagagagttgagttttttttaaggcaaatttggtataatagttttaataaggaggagtttctcatgataaaaatcttattggttgaggatgacctaggtctgtcaaattcagtatttgactttttagacgattttgcggatgttatgcaggtatttgatggagaagaaggtctttacgaagctgagagtggtgtctatgacttgattttgctggatttgatgttgccagaaaaaaatggtttccaagtcttaaaagaattgcgtgaaaagggaattacgacaccagttctgattatgactgccaaggaaagtttggatgacaagggacatggatttgaactgggagcggatgattatctgaccaaacctttctacctagaagaacttaaaatgcggattcaggcccttctcaaacgttcagggaagtttaatgaaaacaccttgacttatgggaatatcgtggttaatttatcaaccaataccgttaaagttgaagatactcctgtcgaattgctggggaaagagttcgatttactagtttatttccttcaaaatcaaaatgtgattttgcctaagacgcagatttttgaccgtctatggggatttgatagtgatacaacgatttcggttgtcgaagtctatgtttcaaaagtccgtaagaaattaaagggaaccacttttgcagagaatttgcaaaccttgcgtagtgttgggtatcttttaaaagatgttcagtaa

SEQ ID NO: 37 - DNA (genomic), 954 bp, Streptococcus pneumoniae; double-stranded, circular
  misc_feature (B) LOCATION 1...954
  hypothetical: NO
  anti-sense: NO
atcatgaactctattcgaaaaactttgaacaagaaccagaacaaaaaaaagaaagacgcaagtatatccctccacaaacccatccgtggaaactcacatctttcaaacaatatcttcataaaaataaaaaggattatgaagagtttaaaggaggatttttcagtacgtgctgaaaaatatgagaactatcaggagacatttcaagggcctaacagtttttccaaaaccgatccagatgccacttttatgcggatgaaggaagatcatatgaaaaatggtcaactcaaggctgcttataatcttcaaatcgctacggaaaaccaatttgttcttcactatgatgtcttttcaaatccgacagataccaagactcttctgccattccttgaaacctatccgcatgacttgaagacagttgtcgcagatgctggatatggaagtgaagagaacctccttcgtttagatgaaaaggaggtaaaccatctgattaaatatgccatgtttgataaggaacagaagagaggctataaacagtcagctagaaacttagcgaattggcactataatgacaaggaggatagctatacacatcctgatggctggtattatcgttttcaccataccaaacatcagaaaacacagacagactttcaacaagaaatcaaggtttactacgccgacgaacctgaatcagcccctcaaaagggactgtatatgaacgaaggctatcaaaacttgaaggcgaaagaatgtcaagcgcttttatctccccaaggtagacagattttcgctcaacgcaagattgatgtggaacctgtctttgggcagataaaggcttgtttgggttacaagagatgtaatctgaggggcaagcgtcaagtgagaattgacatgggattggtacttatggccaataacctcctaaaatacaataagagaacgactcaaaattaa

SEQ ID NO: 38 - DNA (genomic), 198 bp, Streptococcus pneumoniae; double-stranded, circular
  misc_feature (B) LOCATION 1...198
  hypothetical: NO
  anti-sense: NO
tttcagaactctctacttctatcctctatcctcctctacaatgtcaaaacaagaacaatgactgtagctatttatacagaggttctcagaggaaattacggtgtagccgcagccttgtcaactatcctgactgttctaacagtaggttccttgctcttgtttatgaaaatctctaaaagcaatagcattacactttag

SEQ ID NO: 39 - DNA (genomic), 1764 bp, Streptococcus pneumoniae; double-stranded, circular
  misc_feature (B) LOCATION 1...1764
  hypothetical: NO
  anti-sense: NO
tcgttacgattgtttcaagtaaaaaaggagtttgatatgtctaatggacaactaatttatttaatggttgcaattgcagtcattttagttctggcttatgtagtggcaatctttctacgtaagcgaaacgaggggagattagaggcgctagaagaaagaaaagaagaactatacaatcttccagtaaatgatgaagtagaagctgtaaaaaatatgcacttgattggacaaagtcaagtggctttccgtgaatggaatcaaaaatgggtcgatttatctctcaactcttttgccgatattgaaaataatctctttgaagcagaaggttataaccattcatttcgttttctcaaggccagtcatcaaattgaccaaattgagagtcaaattactttgattgaagaagatattgcggcaattcgcaatgctttggcagacttagagaagcaagaatctaaaaatagtggtcgtgttcttcatgctttggatttatttgaggaacttcagcatagagttgctgaaaattcagaacagtatggtcaagccttggatgaaattgaaaaacaattagaaaatatccaatctgaattttcacaatttgtaaccttgaattcatcgggtgaccctgtggaagccgcagtgattttggataatacagaaaatcacattttggccttaagtcatattgtggatcgtgttccagccttggttacgacgctttctacagaattgccagatcaattacaggatttggaagccggttatcgtaaactaattgatgctaattatcattttgttgaaacggatattgaagcgcgtttccacttgctttatgaagcattcaagaaaaaccaagagaatattcgtcagttggaattggataatgccgaatatgagaatggacaggcacaagaggaaatcaatgccttgtatgatatttttactcgagaaattgctgctcagaaagtagtggaaaatctacttgcaactcttccaacttaccttcaacatatgaaagagaataatactttattgggagaagatattgcacgtttgaacaagacctatttacttcctgagacagctgcaagccatgttcgtcgtattcagacagaattagagagttttgaggcagctattgttgaggtaacttcaaatcaagaagaaccaacccaagcttattcagttcttgaagaaaatcttgaggatttacaaactcaactaaaagatattgaagatgagcaaatttcagttagtgagcgcctgacacaaattgagaaagatgatattaatgcacgtcaaaaggccaatgtttatgtcaatcgtctccatactatcaagcgatacatggaaaaacgcaatctgccaggtattccacaaactttcttgaagttattctttacggcaagcaataataccgaggatttaatggttgagttagaacaaaaaatgattaacattgaatctgttacccgagttcttgaaattgcaacgaatgatatggaagctttagaaacggaaacttataatattgtacaatatgcaactttgacagagcaactcttgcaatattctaaccgctatcgctcatttgatgaacgcattcaagaagcatttaacgaagctttagatatttttgaaaaagaatttgattatcacgcttcatttgataagatttctcaagcattggaagtggcagagcctggtgtaaccaatcgctttgttacctcatatgagaaaacacgtgaaacgattcgtttttaa

SEQ ID NO: 40 - DNA (genomic), 273 bp, Streptococcus pneumoniae; double-stranded, circular
  misc_feature (B) LOCATION 1...273
  hypothetical: NO
  anti-sense: NO
ttgccttgctcgatgatatttccatctttcatgaccaagatcaagtctgcatttcggatgattgacaagcggtgggcaatgacaaaggatgtgcgtccttccatcaaacggtccatggctttttggatcaattcctctgtccgtgtgtcaacagaagaagtcgcctcatccaaaatcaaaagcgatgcatccttaagaagggcacaagcaatagtcaatagttgtttttgtcctacagacaaggtcacggtgtcatccaagatggtatcatag

SEQ ID NO: 41 - DNA (genomic), 231 bp, Streptococcus pneumoniae; double-stranded, circular
  misc_feature (B) LOCATION 1...231
  hypothetical: NO
  anti-sense: NO
tccacttgctcccaaatcagaggattgtgggtcgcaataataatggtccgattcggattttttagagattctaggatggaaagtaattcctcagagtttttggggtctagtgaagcggttggttcatctgcgagaatcaaaggtggatcctttaaaattatcttcgctaatgcaacacgttgtgcttctcctcctgataactcaaatataggttgcttcaaatccaaataa

SEQ ID NO: 42 - DNA (genomic), 225 bp, Streptococcus pneumoniae; double-stranded, circular
  misc_feature (B) LOCATION 1...225
  hypothetical: NO
  anti-sense: NO
caaaaatgctctgaaatgacaagtaatcatttcagagcacgcaaaaagcacaaatatacttttatcttctttcatccagactatactgtcggctttggaatttcaccaaatcatgcctttcggctcgtgggctataccaccggtagggaattgcaccctgccctgaagatagttattcaattacagatgattatagtacttaattttgaatatgtcaacagataa

SEQ ID NO: 43 - DNA (genomic), 1080 bp, Streptococcus pneumoniae; double-stranded, circular
  misc_feature (B) LOCATION 1...1080
  hypothetical: NO
  anti-sense: NO
ccatggtgctctgggtgccaagatgagcggtggtgggctaggaggttgtatcatagccttggtaaccaatttgacacacgcacaagaactagcagaaagattagaagagaaaggagctgttcagacatggatagagagcctgtaacagtacgttcctacgcaaatattgctattatcaaatattggggaaagaaaaaagaaaaagagatggtgcctgctactagcagtatttctctaactttggaaaatatgtatacagagacgaccttgtcgcctttaccagccaatgtaacagctgacgaattttacatcaatggtcagctacaaaatgaggtcgagcatgccaagatgagtaagattattgaccgttatcgtccagctggtgagggctttgtccgtatcgatactcaaaacaatatgcctacggcagcgggcctgtcctcaagttctagtggtttgtccgccctggttaaggcttgtaatgcttatttcaagcttggattggatagaagtcagttggcacaggaagccaaatttgcctcaggctcttcttctcggagtttttatggaccactaggagcctgggataaggatagtggagaaatttaccctgtagagacagacttgaaactagctatgattatgttggtgctagaggacaagaaaaaaccaatctctagccgtgacgggatgaaactttgtgtggaaacctcgacgacttttgacgactgggttcgtcagtctgagaaggactatcaggatatgctgatttatctcaaggaaaatgattttgccaagattggagaattaacggagaaaaatgccctggctatgcatgctacgacaaagactgctagtccagccttttcttatctgacggatgcctcttatgaggctatggactttgttcgccagcttcgtgagaaaggagaggcctgctactttaccatggatgctggtcccaatgttaaggtcttctgtcaggagaaagacttggagcatttatcagaaattttcggtcagcgttatcgcttgattgtgtcaaaaacaaaggatttgagtcaagatgattgctgttaa

SEQ ID NO: 44 - DNA (genomic), 402 bp, Streptococcus pneumoniae; double-stranded, circular
  misc_feature (B) LOCATION 1...402
  hypothetical: NO
  anti-sense: NO
ctcaaaagctctatggaaaatcctctgagaaaagtgtttgcccctctggacaactcaacctttttgaggaagagtctccatctgaggaagatggagatgttcccagttgaaacagaggaaattacctacaaacgtaagaaatctaaagggaaacgccaagctcttcttgcccaatttgattcagaagaagttcatcatcaagtagaagagaggatttgccctgattgtcagggagatctaaaagagattggagggagtcttcaaggacaagaattggtctttattcctgcgcaattaaaacgcatagatcatatccaacacgcttacaaatgccaagcatgcagtgataaaaatccgagtgataaaatcgtgaaagctcctattcctaaagcccctttataa

SEQ ID NO: 45 - DNA (genomic), 324 bp, Streptococcus pneumoniae; double-stranded, circular
  misc_feature (B) LOCATION 1...324
  hypothetical: NO
  anti-sense: NO
ngcnnaagctcgcatattatcctgtacgtctccgacatgtatggtgcgaccatcttggtaccattgattttgggaatgcctgtatctgttgccctttttgcttcaggtgttggaacactcatctacatgattgctactggttttaaagttccagtttatctaggttcttcatttgcctttatcacagctatgtcactggctatgaaagaaatggggggggatgtatctgctgcccaaacaggggttatcttgactggtntggtctatgtccttgttgctaccagcatccgatntgtangaacaaaatggattgataaactctnn

SEQ ID NO: 46 - DNA (genomic), 918 bp, Streptococcus pneumoniae; double-stranded, circular
  misc_feature (B) LOCATION 1...918
  hypothetical: NO
  anti-sense: NO
acacacggctccccctttgggcatttttatgctaaaatagtagctatggataaaattattaaaactatatcagaaagcggagcctttcgtgcttttgtccttgatagcacggaaaccgtccgcactgctcaagaaaaacatcaaacccaagctagctcaactgtagcgcttggtcgaactcttatcgccagccagattctcgcagccaatgaaaaaggaaataccaaacttacagttaaggtgttgggatctagctctctaggtgctattatcaccgtcgctgataccaaggggaacgtcaaaggctacgttcaaaatcctggtgttgacatcaaaaagactgcgactggtgaagtcctagtcggaccttttgttggaaatggtcaattcctcgttatcacagactacggtactggaaatccttacaattctataactcccctcatctctggagaaatcggtgaagaccttgccttttaccttactgaaagccaacaaacgccttcagcggtcggcctcaatgtccttttggacgaggaagacaaggtcaaggttgcaggtggtttcctagttcaagtcttgccaggagccaagaaagaagagattgctcgctttgaaaaacgcatccaagaaatgccagctatctctactcttctcgaaagcgacgaccatatcgaagccctcctcaagactatctacggggacgaagcctacaagcgtctttctgaagaagaaatccgtttccaatgtgactgtagccatgaacgctttatgaacgctcttgccagccttccaagctcagacttacaggaaatgaaagaggaagaccacggggtagaaatcacttgtcaattctgccaaactacttacaactttgatgaaaaggacctggaggaactcattcgtgacaaatcttaa

SEQ ID NO: 47 - DNA (genomic), 606 bp, Streptococcus pneumoniae; double-stranded, circular
  misc_feature (B) LOCATION 1...606
  hypothetical: NO
  anti-sense: NO
tttttaggctctgtctttaaacgtttctttttagggatgattgcgacagccttcttttggctattaactttagcaggagggattatccttggtctagcgccggctagtgccaccttgatgagcttatatgcagaacatggttatagctttcgggaatacagtttgaaggaggcttggtctctttacaagcaaaattttgtctcaagcaacctgattttctatagctttttaggtgtgggtctagttttgacctatggtttgtatctattggtgcaattgcctcatcagaccattgttcatttgattgcgacccttttgaatgtcctagtagttgccctgatctttttggcttatacagtatctttaaaattacaagtttattttgccttgtcctatcgaaatagtctcaaattatccttgattggcatctttatgagtctagcagctgtggccaaggttctccttgggactgtgctacttgtagcaattggttactatatgcctgccctgctattttttgtaggaattgggatgtggcatttctttatcagtgatatgttggaacctgtctatgaaatcatccatgaaaaattggcgacaaaatag

SEQ ID NO: 48 - DNA (genomic), 924 bp, Streptococcus pneumoniae; double-stranded, circular
  misc_feature (B) LOCATION 1...924
  hypothetical: NO
  anti-sense: NO
acacagcctttaaaacagtgtttaagtgggaagtataagtcctggaggttaattgtggagaaaatcattaaagaaaaaatttcttccttacttagtcaagaagaagaagtcctcagtgttgaacaactgggtggaatgaccaatcaaaactatttggccaaaacaacaaataagcaatacattgttaaattctttggtaaagggacagaaaagcttatcaatcgacaagatgaaaagtacaatcttgaactactaaaggatttaggcttagatgtaaaaaattatctttttgatattgaagctggcatcaaagtaaatgagtatatcgaatctgcgattacgcttgattcaacgtcaatcaagaccaagttcgacaaaattgctccaatattacaaactattcatacatctgctaaggaattaagaggagaatttgctccttttgaagaaatcaaaaaatacgaatccttgattgaagaacaaattccttatgccaactatgaatctgttagaaatgcagtcttctccttagagaaaagactggctgacttaggtgttgacagaaaatcttgtcatatcgatttggtgcctgaaaactttatcgaatcacctcaaggacgactttatttgattgactgggaatattcatcaatgaatgatccaatgtgggatttggctgccctctttttagagtctgaattcacttcccaagaggaagaaactttcttatctcactatgagagtgaccaaacaccggtttctcatgaaaagattgctatttataaaattttacaagatactatttggagtctatggactgtctataaggaagagcaaggtgcagattttggttactatggtgtgaatcgttaccaaagagctgttaaaggtttggcttcttatggaggatcagatgaaaagtaa

SEQ ID NO: 49 - DNA (genomic), 318 bp, Streptococcus pneumoniae; double-stranded, circular
  misc_feature (B) LOCATION 1...318
  hypothetical: NO
  anti-sense: NO
aacgatagatttttgaataggaataagatcatgtttggattttttaagaaagataaggctgtggaagtagaggttccgacacaggttcctgctcatatcggcatcatcatggatggcaatggccgttgggctaaaaaacgtatgcaaccgcgagtttttggacataaggcgggcatggaagcattgcaaaccgtgaccaaggcagccaacaaactgggcgtcaaggttattacggtctatgctttttcatacggaaaactggacccgtccagatcaggaagtcaagtttatcatgaacttgccagtagagttttatga

SEQ ID NO: 50 - DNA (genomic), 234 bp, Streptococcus pneumoniae; double-stranded, circular
  misc_feature (B) LOCATION 1...234
  hypothetical: NO
  anti-sense: NO
cacaccagattgtggctctggcatgcgtgggttcgatccccatcactcgcctattttatattggggtatagccaagcggtaaggcaagggactttgactccctcatgcgttggttcgaatccagctaccccagttactatttgccggcgtggcggaattggcagacgcgctggactcaaaatccagtgtccgcaaggacgtgccggttcgaccccggccgccggtatagtatag

SEQ ID NO: 51 - DNA (genomic), 225 bp, Streptococcus pneumoniae; double-stranded, circular
  misc_feature (B) LOCATION 1...225
  hypothetical: NO
  anti-sense: NO
gtgctaagattcagcggattgaggcaagcgatgaagatgaataagaaatcaagctacgtaatcaatcgtttacttttagtcatcatagtactgattttaggtactctggctctaggaatcggtctaatggtaggttatggaatcttgggcaagggtcaagatccatgggctatcctgtctccagcaaaatggcaggaattgattcataaatttacaggaaattag

SEQ ID NO: 52 - DNA (genomic), 648 bp, Streptococcus pneumoniae; double-stranded, circular
  misc_feature (B) LOCATION 1...648
  hypothetical: NO
  anti-sense: NO
agtgatttatccatgttcacaggaataattgaagaaatcggaaaagttgaaagaatacagaaagactctcgtaattgtaaactatcaattaaagcctcaaaaatattaacggatatccatttaggtgatagtatagcagtaaatggtatctgtcttacagttactcatttcaatcatcaatcctttacagttgatgtaatgaatgaaacatggagtcgaacagctcttactctattaaaacatggaagtgaggtgaatctagaaagagccttatctgtcaacggtcgacttgggggtcacgtcgttacaggacacattgatggtacaggaaaaatctcgtcaataaaaaaagatgataatgctgtatggtatcaaatcaacacacaaaaagaaattttagatttaatagttgaaaaaggatctattacaattgacggcattagtctgactgtcgctaaagtctccaaagtaaacttttcagtatctgttatccctcataccttggaacaaaccattcttaagagtaaacaagtcgggagtacagtaaatcttgaaaatgatatcttaggtaaatatgtgcaaaaactgatggataactctccaaaatcagaaatatctaaggaactattatatcaaaatggattttag

SEQ ID NO: 53 - DNA (genomic), 396 bp, Streptococcus pneumoniae; double-stranded, circular
  misc_feature (B) LOCATION 1...396
  hypothetical: NO
  anti-sense: NO
acgagtttatctagttctacatatccaacgtttattgtcataaaaatttatttaaaactatataaggagaattctatcatgaatagagaagaagtaacattgttaggttttgaaatcgtagcctatgctggcgatgctcgttcaaaactattggaagccttgaaggctgctgaagctggtgattttgaaaaagcggacgctctggtagaggaagctggtagctgtattgcagaggctcaccacgcgcaaacaagtctattgactaaggaagcttctggtgaggacttagcgtatagtgtgaccatgatgcatggtcaagatcacttgatgacaactatcttgttaaaagacctaatgcaccatttaattgaactttacaagagaggagttaaataa

SEQ ID NO: 54 - DNA (genomic), 546 bp, Streptococcus pneumoniae; double-stranded, circular
  misc_feature (B) LOCATION 1...546
  hypothetical: NO
  anti-sense: NO
aagcccttatccgtttctacaaagactggaacctatattggtaggaggagaaatatgacaatgccaaatattattatgacccgtatcgatgaacggttgattcatggacaaggacaactttgggtaaaatacctaggttgtaatacggtcattgttgccaatgacgaagtaagcacggacaagatgcaacaaactctgatgaaaacagttgtgccagactcagttgccatgcgtttcttccctttgcaaaaggtgattgatatcattcacaaggctaatcctgctcaaacgatctttatcgttgtaaagaatgtgaaggatgctttaaccttggtagaaggtggtgtccctatcaaagaaatcaatattgggaacattcacaatgctactggtaaagagcaagtgacacgctccatcttcctaggtgaagaggacaaggtggccctcaaggaattgagccaaactcatcaagtaacatttaatacgaaaacaactccaacaggaaatgatggagctgttcaagtcaacattatggactatatttaa

SEQ ID NO: 55 - DNA (genomic), 1413 bp, Streptococcus pneumoniae; double-stranded, circular
  misc_feature (B) LOCATION 1...1413
  hypothetical: NO
  anti-sense: NO
gacagcttatctgctcagtgctggtatccagtcttttgggattggggattctctggtatcaaggtgccttgtttatggcaacggtgcaactggtcatcattgctcttctactttatggattgcaccttggcagggatttctaccttactaagtgtcgtctatctacttggtttacaggaaaatagtctggtggatctattgaaagggaaactccctctcaaacgtatgatgacattgatgatggtggggcaactcttagctgtattggtggtcggatcgagtgcgacacgtctcctaccccactaccgtgaaatgcaggaaatggagagagctagcaataaatggagccagtcctcagaccgttaccgtctatcctttggttggtctagtgcatttgccgatgaagaaggaacgcgtaaggataatcgtgagtggcagacatttactgaagaacggttagccaatacagactctttttatattatgagcaatgttgacaatttctcagatggagcagaagtggacctagatggcaatcgtctcagtgactacacaccgtcagggaatgttatctatgtctcaccgcgctatctgatagaagaaaagattaccgtttcttcagagtttatggacaagatgcaaaacttgtctgagggagagtttgggctgatcttgcctgagagcttgcgagagcagtctatctactaccaaggattgtttacagattacctgcaaaacttttcatctgaaagtgtagaagtgacgagtcagaaacactacctcccacaggtaaggctagcttttacagaaataggacaggaacgtttcctctataatgatgggtacaagacaacacgccagtacctaaaagatccgattattgtagttctaacgccgcaagcgactggaacaagacctgttgcagggatgttgtggggaactacggctaatagtgccttgaaactagatcgatatggagacagcatcacagctctaaaagagcaaggtctgtatcacaaggtttcttacttggtaaaaagccagctattttttgccaaggtactaaatgacaaacgggtggagttttactctctccttattgggacgattttgaccctgtctacggctatcttgttatttgattccatgaatcttctctattttgagcagttcagacgggatcttatgattaaacgtcttgctggtatgacaatctatgagcttcatggcaagtatttactggcgcaaggaggagttctcttgcttggcctagtcctatctagtattttgacaagagatggtttgattagcgctctagttgtagctttgtttacgcttaacgccctcttgattttagtaaggcaggacaaaaaagaagaagctggtagcatggcagtattgaaaggaaaataa

SEQ ID NO: 56 - DNA (genomic), 309 bp, Streptococcus pneumoniae; double-stranded, circular
  misc_feature (B) LOCATION 1...309
  hypothetical: NO
  anti-sense: NO
cagaaattatcagtccctgtcctagacaccatcaagccagatcccttcccagaacaatatttcctagaaattaccagtccaggcttggaacgtcctttgaaaaccaaggatgccgtcgctggagcggttggaaaatacatccatgtcggactctaccaagccatcgataagcaaaaggtctttgaaggaactttgttggccttcgaagaggacgagttgactatggaatatatggacaagacgcgtaagaaaaccgtccgaattccatacagtttagtatcaaaagcacgtttagcagttaaattatag

SEQ ID NO: 57 - DNA (genomic), 372 bp, Streptococcus pneumoniae; double-stranded, circular
  misc_feature (B) LOCATION 1...372
  hypothetical: NO
  anti-sense: NO
aagaaattatcggaggttagccatatggcatttgaaaaaatcattcagttaaaaaattgtcgttacgattacactcttagcccttctgttaaaaaattcaccctcaaagataacaccttttttgaaactaaggttggtaactatgaactgactcgccttttggaaaaagtgccaaacagcggtgaaggcttccaactcaaaatcatcattaacaaggaacttacaggggctaaaatcaatatcactgacaagtttggccttcgtctagttgatattttcaaatcagaagaccaccatattcatcaggaaaaattctacttcctcatggatagcttggtagaacgtggtatctttacaaaatcggaaagatag

SEQ ID NO: 58 - DNA (genomic), 228 bp, Streptococcus pneumoniae; double-stranded, circular
  misc_feature (B) LOCATION 1...228
  hypothetical: NO
  anti-sense: NO
agcggattatcactggcggaaagacccagaattaggttttttctcgcacattgttgggaacggttgcatcatgctagggtaggacctgttgataatggtgcctgggacgttgggggcggttggaatgctgagacctatgcagcggttgaactgattgaaagccattcaactaaagaagagttcattagacggactaccgcctttatatcgaactcttacgcaatctag

SEQ ID NO: 59 - DNA (genomic), 999 bp, Streptococcus pneumoniae; double-stranded, circular
  misc_feature (B) LOCATION 1...999
  hypothetical: NO
  anti-sense: NO
ttctggttatcctatcaaacttgcttgcaagacgagtcgatccaaactcagctttgttctagaaaggaggagaatatggcaaaaaagaaaattaaaaaagaaaaaattgataatgtcggcattcactccttcagtaagaaagcagatatcttcttcagtatcatttcgggtttgattgccctctcttgtatcctaccttttgtattcgttatcattatttcagtgacagacgagaaaagcctcctccaatacggctatagcttcttcccatcccaatttggcttagacggttttgagtttttggcacagtttaaggataaaatcctacaagccctcttcatctctgtctttgtaaccgtagttgggacattgacaaatgtctttatcacaacaacctatgcctacgctatttcacggacaacctttaagtatcgcagattctttaccatcttcgttctgctcagtatgttgttcaacgctggtttggtaccaggttatatcatggtgactcgtgtgcttcagcttggggatactgtttgggccttgattgttccaatgcttctctcaccatttaacatcatcttgatgcgttccttcttcaagaagaccattccagaagccattctagaatcggctcgtatcgatggtgccagtgaagcccggattttcttccaaatctgtttgccattgtcactaccaggtatcgcaaccatcacgctcttaacagctcttggtttctggaatgactggttcaacgcccttctttacatcaagagtgacaacttgtatccattgcaatatttgctcatgcaaatccaacaaaatatggactacattgccaaagcggtcggcttgactggtcaactgggagttgctctaccgaaagaaacaggtcgtatggccatggttgtggttgcaacccttccaatcgcgattttgtatccatttttccaacgctactttgtaaaaggtttgactatcggtggtgtgaaagaatag

SEQ ID NO: 60 - DNA (genomic), 921 bp, Streptococcus pneumoniae; double-stranded, circular
  misc_feature (B) LOCATION 1...921
  hypothetical: NO
  anti-sense: NO
ttatctctatcattgtcatctcaatctctatggttgcattcaagaaactacacgcatttgatatggaggacgtctaagatgaataactcaattaaactcaaacgtagactgactcaaagccttacttacctttacctgattggtctatcaattgtaattatctatccactgttgattaccattatgtcagcctttaaagcaggtaacgtctcagcctttaaactagatactaatatcgacctcaattttgataattttaaaggcctcttcactgaaaccttgtacggtacttggtacctcaacactttgattatcgccttaattaccatggctgttcaaacaagtatcatcgtacttgctggttatgcttacagccgttacaacttcttggctcgtaaacaaagtttggtcttcttcttgatcatccaaatggtgccaactatggccgctttgacagccttcttcgttatggcgcttatgttgaacgcccttaaccacaactggttcctcatcttcctctacgttggtggtggtatcccgatgaatgcttggctcatgaaaggctacttcgatacagtgccaatgtctttagacgaatctgcaaaactagacggtgcaggacacttccgccgcttctggcaaattgttcttccacttgttcgcccaatggttgccgtacaagctctctgggccttcatgggacctttcggggactatatcctctctagtttcttgcttcgtgagaaagaatactttactgttgccgtaggtctccaaaccttcgttaacaatgcgaaaaacttgaagattgcctacttctcagcaggtgctatcctcatcgcccttccactctgtattctcttcttcttcctacaaaagaactttgtttcaggacttacaagtggtggcgacaagggataa

SEQ ID NO: 61 - DNA (genomic), 1272 bp, Streptococcus pneumoniae; double-stranded, circular
  misc_feature (B) LOCATION 1...1272
  hypothetical: NO
  anti-sense: NO
ttgcaactatcgaagagaaattgtcaaaacgctaaggggaagcctatgttagatgtagaagcgattcgcaaggattttccaattttagatcagattgtcaatgatgaacctctggtctatctggacaatgctgcgacgacacaaaaaccactagtagttctgaaagctattaacagttactatgagcaggacaatgccaatgttcaccgtggtgtccataccttagcggaacgagcgacagcttcttatgaagctgctcgtgaaaccattcgtaagtttattaatgcaggctctacaaaggaagttctctttaccagaggaacgacaaccagccttaactgggtggcacgctttgctgaggaaattctcgctgagggagaccgggtcttgatttcagtaatggaacaccattctaatatcattccatggcaggaagcttgtcgaaagactggagcagagcttgtctatgtctatcttaaagacggtgccttggatatggaggatttgcgagctaaattgactgataaggttaaatttgtttccctagctcatgcctccaatgttcttggtgtggtcaatccgatcaaggaaatcactcaattagcccaccaagttggggcaattatggtagtggatggtgctcaatctacacctcatatgaagattgatgtccaggacttggatctggactttttcgccttttcgggtcacaagatggctggtccgactggtatcggtgtcctttacggcaaagaaaagtatcttgagcaaatgtctccagtagaatttggcggcgagatgattgattttgtctacgagcaatttgctagttggaaggaattgccttggaaatttgaggctggaacgccaaatatggcaggagctattggacttgcgactgcagttgattatctggaaaagattggtatggatgccgttgaagctcatgaacaggaattgattgcgtacgtctatccaaaactgcaggcaattgagggattgaccatttacggttctcaggatttggctcaacgttcgggtgttattgcctttaacctaggtgatctccatcctcacgatcttgcgacggctctggattatgaaggagtggctgttcgtgctggtcaccattgtgcgcaacccttgcttcagtatttggaagtcccagcaacagctcgtgcaagtttttatatctacaataccaaggcagattgcgacaaactagtcgatgccctacaaaagacaaaggagtttttcaatggcactttctaa

SEQ ID NO: 62 - DNA (genomic), 213 bp, Streptococcus pneumoniae; double-stranded, circular
  misc_feature (B) LOCATION 1...213
  hypothetical: NO
  anti-sense: NO
aagatgctatccgtgaatactattttagaaaaattttataaagaacaccaagtcaaacccttcatatcgcctgaacgagagttggatacttggcttctaagtcccaagcccgttcccaagcgaaatatggacttattagtagatgattcactagcaggagatatcattttactatggagaatccagtttggtacttttaccactgaaacatga

SEQ ID NO: 63 - DNA (genomic), 195 bp, Streptococcus pneumoniae; double-stranded, circular
  misc_feature (B) LOCATION 1...195
  hypothetical: NO
  anti-sense: NO
actcttatatctaattcattcaacattgaagcaagtgtgagagatgctgatgtggtgattggagccattctcatccctggtgcaaaagcaccggaattggtgacagatgagatggtcaaacaaatgcgtccaggctctgtatcgttgaccttgctgttgaccaaggtggccttatcgaaacagctgaccgtgtga

SEQ ID NO: 64 - DNA (genomic), 330 bp, Streptococcus pneumoniae; double-stranded, circular
  misc_feature (B) LOCATION 1...330
  hypothetical: NO
  anti-sense: NO
ttggagagattagcaaaatcccttggtattgcctatttcactgccaaccagcttgaagtcaaagaaggtcttttaacaggaaaattagttggacaaattataagtccccaggtcaaaaaagaaactctggaaaaatggagaaagaaactaaaactttctaaagaaagaacggtggcaatcggtgatggggtcaataatctattaatgttgaagtcggcggagttaggaatcgccttttgtgccaaagaagtgctcaaaaaagaaataccacatcatgttgacaagagggattttttagaagttcttcctttgattgactgtttagaatga

SEQ ID NO: 65 - DNA (genomic), 267 bp, Streptococcus pneumoniae; double-stranded, circular
  misc_feature (B) LOCATION 1...267
  hypothetical: NO
  anti-sense: NO
ccatctgtatctgtaaagtgggtatcaatagcgtcacgagttgttccagcaacaggactggcaataacacggtcttcgcccaagatagcattgatcaagcttgattttccaacgtttggacgaccaatcaggctaaacttaatgacatctggattttcttcctcatattcatttggaagattttctacgatagcatctagtacatcccctgtaccgattccatggacagatgagataggcagtggttcacccaaaccgagagcatag

SEQ ID NO: 66 - DNA (genomic), 609 bp, Streptococcus pneumoniae; double-stranded, circular
  misc_feature (B) LOCATION 1...609
  hypothetical: NO
  anti-sense: NO
aagggagtatccgccatgacaagaactgaatacctgactcagctagaactctatctcaagaaactacctgaagctgaccgtatcgaagccatggactatttcagagagctctttgacgatgctggagtcgaaggagaagaagaactcatcgctagtttgggaactcccaaagaagtggcccacgaagttctatccaatcttctcgataaaaaaatcaatgaagcacccgctcaaaaaaataaccgacaaattttacatatcgccttgttagccctccttgcagcacctatcggcattcctctgggaatcgccatcctcgtgaccctgttcgcaatccttgtagccgctttgactgtcattctggctttctttgcagtttccatactgggtatcatcggcggattcctatttttagttgaaagtttcactgtcctcgcccaagccaaatcagcctttatcttgatttttggttctggtttactggctatcggtgcttcttcgctagttttactaggcatttcctatgtagctcgcttcttcggtctactcattgttcgtctggtacaatttgttcttaaaaaaggaaagagaggtaatcagcatgcgtaa

SEQ ID NO: 67 - DNA (genomic), 357 bp, Streptococcus pneumoniae; double-stranded, circular
  misc_feature (B) LOCATION 1...357
  hypothetical: NO
  anti-sense: NO
aaattggtatcttcttgtcagtctgtgtatgctacaagagctagtttcttggatggacagggaattacagttgatgagatggcttggataattaggggcattgtgaatgcattgattggtagatacataaaattaggtacttatgcggctaagtatggtattagtatggcgcgttctatcttaaatagggcagctgcaactgcggcagcaagagtaggattattgactaagatttttggatggattttacgaatagctgtgctcgcagctgatgtatatggtaattttgccaacaatattgctgtagcttgggatgcacatgataaaatccctaacaatggtcgtataaacttttaa

SEQ ID NO: 68 - DNA (genomic), 231 bp, Streptococcus pneumoniae; double-stranded, circular
  misc_feature (B) LOCATION 1...231
  hypothetical: NO
  anti-sense: NO
aacgtggtatctttacaaaatcggaaagatagagccaaaatgtttgaactgacctataaggactgctatcatgtagagcgtactctcaagtatgaggatcatgaggctctcatgttgactttgtcaggatgttgtacaccttaccnagatacactttatgtgacttctctgacttttaggggccaaaaagtttatcagggtctgtcggagacctctaccgttttctatctc

SEQ ID NO: 69 - DNA (genomic), 294 bp, Streptococcus pneumoniae; double-stranded, circular
  misc_feature (B) LOCATION 1...294
  hypothetical: NO
  anti-sense: NO
ataatttcatcaaaattattacccaatgttattttacctaggttaattattttttcggtgatgtacaccaactccaaaggaacgttaataaacatctctgtaaaacgggtcatattatctctatttttgagaaaaaaacttttctcaatatcaattggatttactttatctccagtttttcttccaaaagctattccccttccaaaaagaagaatatcgatatcttttttactttgcgcaattacggcattgtggtttagtattcgttttatgatcataaaatttcccttttaa

SEQ ID NO: 70 - DNA (genomic), 216 bp, Streptococcus pneumoniae; double-stranded, circular
  misc_feature (B) LOCATION 1...216
  hypothetical: NO
  anti-sense: NO
gcaatttcatcacgggtcatcttttcatccgcatcatcgaatgacataggagtcaaatggctcaagaaattggtcgaagcagctaaaagccaaacaaaaggactgactagttttccgatcccaatgataaccggcgctgtacgaattcgcaaggcatcctttagattaagagcgattctcttaggatataattccccaaaaacgatggaaatatag

SEQ ID NO: 71 - DNA (genomic), 315 bp, Streptococcus pneumoniae; double-stranded, circular
  misc_feature (B) LOCATION 1...315
  hypothetical: NO
  anti-sense: NO
acatattcatcgtctcaagaaaaacagtctgattggaaagtacaatacactcgttgtcttgatatcatctttcctgagttggataaaatcgttggaaagcattcagaatatacctaccaactcttgacacgctaccctaatcctcagaaaaggattgaggcaggatttgataagctgatagaaattaagcgattgaccgcttctaattcaagggctttttgccgtgctctaaaatcatcgccaaatcatcaaattgaaataagaaatagtttagataaaactattgacttttcttatagtttgtctttctcttaa

SEQ ID NO: 72 - DNA (genomic), 405 bp, Streptococcus pneumoniae; double-stranded, circular
  misc_feature (B) LOCATION 1...405
  hypothetical: NO
  anti-sense: NO
ttcaattcatcatctttgcacttggagttcttctatacattccatttatcaaagttaatgacaaagttgttgaacaagaaatggaaggttaagattatgaaacaaattttattagtatgtaatgcgggaatgtcgacaagtatgcttgttaaaaaaatgcaacaaagtgcgactgaacgtgggattgaaatctctatccaagcaaaatcaatgacagaagctaaaaagaatatccatgaagcagatgtcattctaattgggccacaaattcgttatgagttacttgctgtgaaagaaattgcaggaaatatccctgtagataccattgatatgcgggattacggaatgatgaatggagcaaaagttctggaacaagcacttgcatggataggagaaataagatga

SEQ ID NO: 73 - DNA (genomic), 702 bp, Streptococcus pneumoniae; double-stranded, circular
  misc_feature (B) LOCATION 1...702
  hypothetical: NO
  anti-sense: NO
actctatcatcaaactctagacttaatcgatcatactcaagaggaggtaatccaatgaacactagtcttaaactcagcaaacaactcagttttggagaggagattgctaatagcgtgacccatgctgtgggtgcagtcatcatgcttatcttgctgcctatttcatccatctatagttatgaagcacacggatttttatcctctatcggcgtttccattttcgtcatcagtctctttctcatgttcctatcatccaccatttatcactctatggcctatggttcgacccacaaatatgtcttgcgaatcattgaccattctatgatttacgttgccattgccggctcatacacgcccgttgtcttgaccttgatgaataactggtttggctatctgattattgtcatccattggggaacgaccatctttggtactctctataaaatctttgctataaatgtcaatgataaatttagccttgctctttacctgattatgggctggttggttctggctatcattcctgccattatcaatcaaacgacacccgttttctggagtctcatggtaactggcggactctgttatacagttggagctggattttatgccaagaaaaaaccttatttccacatgatttggcatctctttatcctagctgcgtccgtactccaatacatcgctattgtttattacatgtaa

SEQ ID NO: 74 - DNA (genomic), 453 bp, Streptococcus pneumoniae; double-stranded, circular
  misc_feature (B) LOCATION 1...453
  hypothetical: NO
  anti-sense: NO
aggcaatcatcgctttatattatttttcaaggaggaagaatgaaaattttaccgtttatagcaagaggaacaagttattacttgaagatgtcagttaaaaagcttgttccttttttagtagtaggattgatgctagcagctggtgatagtgtctatgcctattccagaggaaatggatcgattgcgcgtggggatgattatcctgcttattataaaaatgggagccaggagattgatcagtggcgcatgtattctcgtcagtgtacttcttttgtagcctttcgtttgagtaatgtcaatggttttgaaattccggcagcttatggaaatgcgaatgaatggggacatcgtgctcgtcgggaaggttatcgtgtagataatacaccgacgattggttccattacttgttctactgcaggaactaatgttcatggtgcctgggtgtcaaagtaa

SEQ ID NO: 75 - DNA (genomic), 843 bp, Streptococcus pneumoniae; double-stranded, circular
  misc_feature (B) LOCATION 1...843
  hypothetical: NO
  anti-sense: NO
tcgtcgtcatcgccgatttggaggagtttaggaggaaatatgacccaggatttacagaaaagaaccttgtttgcagggattgccctggctattttcctaccaattttaatgattgggggcctcttgcttcagatagcaatcggaatcatagccatgctagccatgcatgaacttttgaagatgagaggtctagagaccatgacgatggagggcctcttgaccctctttgcaacctttgcattgaccattcccttggagaattacctgacttttttgccagttgatgggaatgtggttgcctatagtgttttgatttcaatcatgttaggaacgaccgtttttagcaagtcttatacgattgaggatgcggttttccctcttgctatgagcttctacgtgggctttggatttaatgctttactagatgctcgtgttgcaggtttggacaaggctctcttagccttgtgtatcgtctgggcgacagacagtggtgcctatcttgttgggatgaactatgggaaacgaaagttagcaccaagggtatcgcctaataaaacccttgagggtgccttgggtggtattttaggagcaattttagtaaccattatctttatgatagttgacagtacagttgctcttccatatggaatttacaagatgtcagtctttgctattttctttagcattgctggacaatttggtgatttactagaaagttcgatcaaacgtcattttggtgttaaggattctgggaaatttatccctggacatggtggtgttttggatcgtttcgatagtatgttgcttgtatttccaatcatgcacttatttggactcttttaa

SEQ ID NO: 76 - DNA (genomic), 246 bp, Streptococcus pneumoniae; double-stranded, circular
  misc_feature (B) LOCATION 1...246
  hypothetical: NO
  anti-sense: NO
agcaatggattgaagctccatgtgtcggcggttcgattccgtctcgcgccatttatatattttggaagggtagcgaagaggctaaacgcggcggactgtaaatccgctccttcgggttcgggggttcgaatccctccccttccattttacgggcatagtttaaaggtagaactaaggtctccaaaaccttcagtgtgggttcaattcctactgcccgtgttaatagaattatggcgggtgtggtga

SEQ ID NO: 77 - DNA (genomic), 420 bp, Streptococcus pneumoniae; double-stranded, circular
  misc_feature (B) LOCATION 1...420
  hypothetical: NO
  anti-sense: NO
ccatttccatcaatccccgcaataccaacaatctctccagcacgaacatccaaggacagatttttaacagctggaacaccacggttttcattgaccaccaaatctttgatagacaaaaccacttcttttggtttagaggcttgcttctctgttttaaaggaaacagaacgtcctaccatcatttccgccaaatcagcattggtagcccctgcaatttcaacggtttcaattgatttcccacgacggataactgtaacacggtcagaaactgcgcgaatttcatccaatttgtgggtaatcaagataattgattttccttctttgacaagatttttcataatagccatcaactcatcaatttctgatggagtcaaaacagccgttggttcgtcaaagataaggatatcagcccccctataa

SEQ ID NO: 78 - DNA (genomic), 507 bp, Streptococcus pneumoniae; double-stranded, circular
  misc_feature (B) LOCATION 1...507
  hypothetical: NO
  anti-sense: NO
acgctgccatccgtgcagttgttcgtcaagcaatttcagaaggaatggaagtgtttggtatctatgacggatatgctggtatggttgccggtgaaaattcatcccctaaatgcagcttcagtaggggacatcatttctcgtggtggtacttttcttcactcagctcgttatccaaatttcgctcaacttgaagggcaacttaaagggattgagcaattgaaaaaacacggaattgaaggtgtagttgttatcggtggtgacggatcttaccacggcgctatgcgtttgactgaacatggcttcccagctattggtcttccaggtacaatcgataacgatatcgttggtactgactttacaatcggttttgacacagcggttactactgccatggacgctatcaataaaattcgtgatacatcatcaattcaccgtcgtacttttgtaatcgaatttatgggacgtaacgctggtgatatcgctctttgggctggtattgcaactggt

SEQ ID NO: 79 - DNA (genomic), 552 bp, Streptococcus pneumoniae; double-stranded, circular
  misc_feature (B) LOCATION 1...552
  hypothetical: NO
  anti-sense: NO
aatactacatctggaggtactcccatgctttatgtgggcattgatgtcgctaaaaataaacacgatgttacagccttgaatgttccaggaaaaactgttcttaaaccactcactttttcaaataataaagctggttttgaactcttagatctgtctcttcgacaactcaaccaagactgtctcatcgctcttgaaaataccggacattatgcctttaatctactgaacttcctgcatgaacaaggatataaagtttacacctacaatcctttgctcatcaaggaatttgccaaatcattatcacttcgcaagactaaaacggataagaaagacgctcatggcatcgctcttaaacttctttctgaccccaatcgtgaacaatttcaacacgataatcggcaagtagaactaaaaatactggctagacatattcatcgtctcaagaaaaacagtctgattggaaagtacaatacactcgttgtcttgatatcatctttcctgagttggataaaatcgttggaaagcattcagaatatacctaccaactcttga

SEQ ID NO: 80 - DNA (genomic), 333 bp, Streptococcus pneumoniae; double-stranded, circular
  misc_feature (B) LOCATION 1...333
  hypothetical: NO
  anti-sense: NO
aggaaaacatcaatggtagacatgcttacagaggatgactttaaagaattgaccaaagttaaaactgtaggagaaatttgttgtcgattttttgattcaaaaggtaaagaagtctatgaaaacttacaggaaagaacgatagcaatctctttggaagatttaaaaaatattcctcaaagtttagctgttgcttacggtgatacgaaagtatcttcgattctttctgtcttgcgtgctaatttagtaaatcatttgattacagataaaaatacaattttaaaagttttggaagaagatggtgatttgacttttagagagattctaggtgagtga

SEQ ID NO: 81 - DNA (genomic), 459 bp, Streptococcus pneumoniae; double-stranded, circular
  misc_feature (B) LOCATION 1...459
  hypothetical: NO
  anti-sense: NO
gtttgggcatcaatttctttgataatacgagctggaacacctgctactaccacgttttctgggacatcttgggtaacaatagctcctgctgcgacaactgaaccactaccgatttggactccttcgataaccactgcattagcaccgataagaacattgtctccgacacggactggttcagcactagctggctcaatcacacctgccaaaactgcacatgcaccaacgtggctattttatccaacgatggcacggccaccaaggatggcacccatgtcaatcatggttccagcaccgatttcagcaccgatattgataacagctcccatcatgataacagcattgtcaccaatttccacctggtcacggataatagcacctggctcgatacgagcgttgatagcacgcttatctagcaaaggaactgcagaattacgagcatcttgctcgacaacataa

SEQ ID NO: 82 - DNA (genomic), 555 bp, Streptococcus pneumoniae; double-stranded, circular
  misc_feature (B) LOCATION 1...555
  hypothetical: NO
  anti-sense: NO
atcaaaggattgataaatcagaaagaaggtgattttttgcgaacatacgaaaataaagaagaactaaaagctgagatagagaaaacatttgagaaatatattttagaatttgataatattccagaaaatttaaaagataagagagctgatgaagttgacagaactccagcagaaaaccttgcttatcaggttggttggaccaacttggttcttaaatgggaagaagatgaaagaaaggggcttcaagtaaaaacaccatcggataaatttaaatggaatcaacttggtgaattatatcagtggttcacagatacctacgctcatttatctctgcaagagttgaaagcaaaattaaatgaaaatattcattctatctctgcaatgattgattcgttgagtgaggaagaattatttgaaccgcatatgagaaagtgggctgatgaagcgactaaaacagcgacttgggaagtgtataagtttattcatgtaaatacggttgcaccttttggaactttcagaactaaaatcagaaaatggaagaagatagtattataa

SEQ ID NO: 83 - DNA (genomic), 1293 bp, Streptococcus pneumoniae; double-stranded, circular
  misc_feature (B) LOCATION 1...1293
  hypothetical: NO
  anti-sense: NO
gatatgggattatttgaccgtctattcggaaaaaaagaagaacctaaaatcgaagaagttgtaaaagaagctctggaaaatcttgatttgtctgaagatattgagcctgccttcacagaagctgaggaagtttctcaagaagaagcagaggttgaaagttctgaagaatctgtgttccaagaagaggatagtcaagacacagtcgaagaaaatctggatttagagccagttgtagaggtttctcaagaagaagtagaagaatttccaaactcacaagaagtcacagaggaagagaagcttgagcacgaaggaactgtagaagaaaataattttgaagtgcttgaaccagaagctcctcaaacagaagaaactgttcaggaaaaatatgaccgcagtcttaagaaaactcgcacaggtttcggtgcccgcttgaatgccttctttgctaacttccgctctgttgacgaagaatttttcgaggaactggaagaactgttgattatgagtgatgttggtgtccaagtcgcttctaacttaacggaggaactacgttacgaagccaagcttgaaaatgccaagaaacctgatgcacttcgtcgtgtcatcattgagaaattggttgagctttatgaaaaggatggtagctacgatgaaagcatccacttccaagataacttgacagttatgctctttgttggtgtgaatggtgttgggaaaacaacttctatcggaaaactagcccaccgctacaaacgagctggtaagaaggtcatgctggttgcagcagataccttccgtgcgggtgcagtagctcagctagctgaatggggccgacgagtagatgttccagtagtaactggacctgaaaaagctgatccagccagcgtggtctttgatggtatggaacgtgccgtggctgaaggtatcgatattctcatgattgatactgctggtcgtctgcaaaataaggataaccttatggctgagttggaaaagattggtcgtattatcaaacgtgttgtgccagaagcaccacatgaaaccttcttggcacttgatgcatcaacaggtcaaaatgccctagtacaggccaaagaattttcgaaaatcacacctttaacgggaattgttttgactaagattgatggaactgctcgaggaggtgtggttctagccattcgtgaagaactcaatattcctgtaaaattgattggttttggtgaaaaaatcgatgatattggagagtttaactcagaaaacttcatgaaaggtctcttggaaggtttaatctaa

SEQ ID NO: 84 - DNA (genomic), 381 bp, Streptococcus pneumoniae; double-stranded, circular
  misc_feature (B) LOCATION 1...381
  hypothetical: NO
  anti-sense: NO
tatgcgggattacggaatgatgaatggagcaaaagttctggaacaagcacttgcatggataggagaaataagatgacagaagaaatggaatatatctgttttcagctcattgccaatagtggagcagccaaatcatcctttattgaagccatccaactagctaaggcaggaaatttaaaagaagcgaaaattaaagttgaagaagcggaagactccttagtagaagcgcacaagattcactctaatctcatacaaaaagaagctactggagaaaaaataggattctccttgctatttatgcatgcagaagaccaaatggcttcaacagagattattcagttgctatctaaagaattcatcgatctctatcaaaataaatag

SEQ ID NO: 85 - DNA (genomic), 585 bp, Streptococcus pneumoniae; double-stranded, circular
  misc_feature (B) LOCATION 1...585
  hypothetical: NO
  anti-sense: NO
cacctcaaatcaagcaatctgctaactatgacaaggaaaattttcaaaaccgtcaacaaatccgtagaagccggcttttaccaagctatcttagatgctgtatctgacttgcttgcaagctcaaaaactaccataacaattttggatatcggttgtggtgaaggattctattctcgcaaactacaagaaagtcactctgaaaaaactttctatgcctttgacatctccaaagattcagtccaaatcgctgctaaaagtgaacccaactgggcagtcaattggttcgttggcgacttggcacgccttcctataaaagacgctagcatggatatcctgcttgatatcttctcacctgccaactatggagaatttcgtcgcgttttatccaaagatggtatcttgataaaggttatcccaactgaaaatcacctcaaagaaatccgtcaaagagtacaggaccagctgacaaacaaggagtattctaaccaagatatcaaggagcatttccaggaacactttaccatcctatctagtcaaactgcgtctctgactaagactatcacagcagaaaaactccaagcctaa

SEQ ID NO: 86 - DNA (genomic), 183 bp, Streptococcus pneumoniae; double-stranded, circular
  misc_feature (B) LOCATION 1...183
  hypothetical: NO
  anti-sense: NO
accatcaaatctagtacaaaaagagaaaatatcctccttttcattaccttacttgccttaaagattctgtttaatagaacctttatcgtagtatctacacaaatttttatcaaaaagataagagccaatacacctgctgctgcaccaataagccaacctccaaggcctccaaccttaatatag

SEQ ID NO: 87 - DNA (genomic), 198 bp, Streptococcus pneumoniae; double-stranded, circular
  misc_feature (B) LOCATION 1...198
  hypothetical: NO
  anti-sense: NO
gcttacaaatccagtcaaatcactctcctgataggcggtccaaacttgcagtgtcgtggttccttttatataggcttatgtgctttctgggattccaaaccattctggcaaatccttcaaaacctcagcgacaactgcctttttttgattttacatcttgacttcttcaattacaaacatcataagttcctttcttga

SEQ ID NO: 88 - DNA (genomic), 375 bp, Streptococcus pneumoniae; double-stranded, circular
  misc_feature (B) LOCATION 1...375
  hypothetical: NO
  anti-sense: NO
tttataaaatcttatttttctgtcaaggctgcaagttgtggaagaaccttaccttcaagaagttccattgatgctccaccacccgtactaatccatgagaacttgtctgcacggccaaggttaatcgctgcggcagctgagtcaccaccaccgatgattgatttaactcctggttgtttcacgatagcgtccatcacaccgattgtaccagcttggaaatctgggttttcaaatacacccataggtccgttccatacaactgttttggcaccagtcaaagcttcgtcaaatttggcgatagattttggaccgatgtcaagaccaaggaagccttcagaaactgcttcaccttcagtgtcacgcacttcagtgtaa

SEQ ID NO: 89 - DNA (genomic), 330 bp, Streptococcus pneumoniae; double-stranded, circular
  misc_feature (B) LOCATION 1...330
  hypothetical: NO
  anti-sense: NO
aaaataaaatcggaggaaatccaaatgattaaaattcttgctgcctgcggtgcaggtgttaactcaagtcaccaaattaaaagtgctctagaagaagaactttcaaaccgtggttatgatgttcactgtgatgcagtcatggtgaaagatgtaaacgaagaccttatgaaaggttacgatatctttacaccaatcgctgcaacagaccttggttttgaaccaggtatcccagttatcgaagctggaccaatcttattccgtatcccagcaatgagcgctccagtatttgacaatattgaagcagctattaaagaacacggattaagctaa

SEQ ID NO: 90 - DNA (genomic), 327 bp, Streptococcus pneumoniae; double-stranded, circular
  misc_feature (B) LOCATION 1...327
  hypothetical: NO
  anti-sense: NO
aaaataaaatcggaggaaatccaaatgattaaaattcttgctgcctgcggtgcaggtgttaactcaagtcaccaaattaaaagtgctctagaagaagaactttcaaaccgtggttatgatgttcactgtgatgcagtcatggtgaaagatgtaaacgaagaccttatgaaaggttacgatatctttacaccaatcgctgcaacagaccttggttttgaaccaggtatcccagttatcgaagctggtccaatcttattctgtatcccagcaatgagcgttccagtatttgacaatattatacttcctgcgaaacaaaatatggtatag

SEQ ID NO: 91 - DNA (genomic), 252 bp, Streptococcus pneumoniae; double-stranded, circular
  misc_feature (B) LOCATION 1...252
  hypothetical: NO
  anti-sense: NO
agcacaaaatccgcttgggaaaccaaacggattttttacgtgtcaaagcatttgccagaaaaagtcaataatataggtcagaccgtaggtataaaccacgagggtaaagggtttggtcagaatgatgatggtcatgtagcgcttgaaactcatcttggtcagggcagccagcatacagagaaagtcagctgggctaatgggccaaatcatcataaaaataaagaagcggtcaaaacgattgcccttatctag

SEQ ID NO: 92 - DNA (genomic), 231 bp, Streptococcus pneumoniae; double-stranded, circular
  misc_feature (B) LOCATION 1...231
  hypothetical: NO
  anti-sense: NO
ctaccgaaatcacggagatttccacgaaaactgtatcaacaccatcgggaaagacttggtcaacttggtagaccttcgctatttagaaatcgggggaaatttattccgcgcggtggcatgtcaatcgacccctattacaattacggtaagcaaggaaataagtatgaggncttggcagaacaacgcgttttccaacacgacgtttatccagagaaaattgacaaccgctaa

SEQ ID NO: 93 - DNA (genomic), 621 bp, Streptococcus pneumoniae; double-stranded, circular
  misc_feature (B) LOCATION 1...621
  hypothetical: NO
  anti-sense: NO
aaaaggaaatcgattatgaaatttcttgaattaaataaaaaacgtcatgcgactaagcattttactgataagcctgttgatcccaaagatgtgcgtacggctatcgaaattgcaaccttggcgccaagcgcccacaacagccagccttggaaatttgtggtggtacgtgagaaaaatgctgaactggcaaagttagcttatggttccaattttgaacaggtatcatcagcgcctgtaaccattgccttgtttacagatacggacttagccaaacgtgctcgtaagattgcccgtgttggtggtgctaataacttttctgaagagcaacttcaatattttatgaaaaatctgccagctgagtttgcccgttacagtgagcaacaagtcagcgactacctagctctcaatgcaggtttggttgccatgaacttggttcttgcattgacagaccaaggaattggttctaacattattcttggttttgacaaatcaaaagttaatgaagttttggaaatcaaagaccgtttccgcccagaactcttgatcacagtgggttatacagacgaaaaattggaaccaagctaccgcttgccagtagatgaaatcatcgagaaaagatag

SEQ ID NO: 94 - DNA (genomic), 1620 bp, Streptococcus pneumoniae; double-stranded, circular
  misc_feature (B) LOCATION 1...1620
  hypothetical: NO
  anti-sense: NO
aaagaggaatctatgtctacgaaatatatttttgtaactggtggtgtggtatcgtctattgggaaagggattgtggcagcgagtctaggccgtctcttgaaaaatcgtggtctcaaagtaaccattcaaaagtttgacccttatatcaatattgatccgggaaccatgagtccttaccagcacggggaagtttttgtgacagatgacggagctgagacagatttggacttgggtcactatgaacgtttcatcgatatcaatctcaacaaatattccaacgtgacaactgggaaaatttatagtgaagttcttcgtaaagaacgccgtggagaataccttggggcaactgttcaagtcattcctcatatcacagatgctttgaaagaaaaaatcaagcgtgccgctctaacgaccgactctgatgtcattatcacagaggttggtggaacagtaggagatatcgagtccttgccattcctagaggctcttcgtcagatgaaggcagatgtgggtgcggataatgtcatgtatatccatacaaccttgcttccttacctcaaggctgctggtgaaatgaaaaccaaaccaacccaacactctgtcaaagaattgcgtggcttgggaatccaaccaaatatgttggttattcgtacagaagagccagctggtcaaggaattaaaaataaactggcccagttctgtgatgtggcaccagaagccgttatcgaatcgttggatgttgaacacctttaccaaattccactgaacttgcaggcacaagggatggaccaaattgtttgtgatcatttgaaattagacgcaccagcagcggatatgacagaatggtcagccatggtggacaaggtcatgaacctcaagaaacaagttaagatttcccttgttggtaagtatgtggagttgcaagatgcctatatctcagtggtcgaagccttgaaacactctggctatgtcaatgatgtagaagttaaaatcaattgggtcaatgccaatgatgtgacagcagagaatgtagcagaactcttgtctgatgcggacgggatcatcgtaccaggtggttttggtcaacgtggtacagaagggaaaatccaagccatccgctatgcgcgtgaaaatgatgttccaatgttgggagtctgcttgggaatgcagttgacatgtatcgagtttgctcgtcacgttttaggtcttgaaggtgccaattctgcagagcttgcaccagaaacaaaataccctatcattgatatcatgcgtgatcagattgatattgaggatatgggtggaacccttcgtttgggactttatccgtctaagttgaaacgtggctctaaggctgctgctgcttatcacaatcaagaagtggtgcaacgccgtcaccgtcaccgttatgagtttaataatgccttccgtgagcagtttgaggcagcaggttttgtcttttcaggagtttctccagacaatcgtttggtagaaatcgtggaaattcctgaaaataaattctttgtagcttgtcagtatcaccctgaactgtcaagccgtccaaaccgaccagaagaactctacactgcctttgttactgcagcggttgagaacagcaattag

SEQ ID NO: 95 - DNA (genomic), 1107 bp, Streptococcus pneumoniae; double-stranded, circular
  misc_feature (B) LOCATION 1...1107
  hypothetical: NO
  anti-sense: NO
aaaacacgatcactggtcgcctcaacggtaaaaactatacgactgttgctggtactggcatcaatatctttgatgctgaagctcacttcctttcaacataaagtcatcgaaatccaagctggtgatgaaaaacaagaattgactgctgaaactatcgtcatcaacactggtgctgtttcaaacgtcttgccaatccctggacttgctacaagcaaaaacgtctttgactcaacaggtatccaaagcttggataaattgcctgaaaaacttggagtccttggtggcggaaatatcggtcttgaatttgctggcctttacaataaactaggaagcaaggttacagtcctagatgccttggatacattcctacctcgtgcagaaccttccatcgcagctcttgctaaacaatacctggaagaagacggtattgaattgcttcaaaatatccatactactgaaattaaaaacgacggtgaccaagtgcttgtcgtaactgaagacgaaacttaccgtttcgacgcccttctctacgcaactggacgcaaaccaaatgtagaaccacttcaacttgaaaatacagatattgaactaactgaacgtggcgctattaaagtagataaacactgtcaaacaaacgttcctggtgtctttgcagttggagatgtcaacggtggtcttcaatttacttacatttcacttgatgacttccgtgttgtttacagctaccttgctggagatggcagctacacacttgaggaccgtctcaatgtgccaaatactatgttcatcacacctgcactttcacaagttggtttgactgaaagccaagcagctgatttgaaacttccatacgcagtgaaagaaatccctgttgcagccatgcctcgtggtcacgtaaatggagaccttcgcggagctttcaaagctgttgttaatactgaaacaaaagaaattcttggtgcaagcatcttctcagaaggttctcaagaaatcatcaacatcattactgttgctatggacaacaagattccttacacttacttcacaaaacaaatcttcactcacccaaccttggctgagaacttgaatgacttgtttgcgatttaa

SEQ ID NO: 96 - DNA (genomic), 864 bp, Streptococcus pneumoniae; double-stranded, circular
  misc_feature (B) LOCATION 1...864
  hypothetical: NO
  anti-sense: NO
ggaggcagatctctaatgcaaactcaagaaaaacactcgcaagcagccgttcttggcttgcagcacttactagccatgtactcaggatctatcctggttcccatcatgattgcgacagcccttggctattcagctgagcagttgacctacctgatttctacagatatcttcatgtgtggggtggcaaccttcctccaactccaactcaacaaatactttgggattggactcccagtcgttcttggagttgccttccaatcggtcgctcccttaattatgattgggcaaagccatggtagtggcgctatgtttggtgcccttatcgcatctgggatttacgtggttcttgtttcaggcatcttctcaaaagtagccaatcttttcccatctatcgtaacaggatctgttattaccacaattggtttaaccttgatccctgtcgctattggaaatatgggaaataacgttccagagccaactggtcaaagtctcttgctttcagctattactgttctgattatcctcttgatcaacatctttaccaaaggatttattaagtctatctctattttgattggtctggttgttggaactgccattgctgctagcatgggcttggttgacttctctcctgttgcagcagcaccggttgtccatgtcccaactccattctactttgggatgccaacctttgaaatctcatctattgtcatgatgtgtatcatcgcaacggtgtctatggttgagtcaactgggttgtttatctggccttgtctgatatcacaaaggatccaatcgacagcaccgcctgcgcaacggataccgcgcagaaggtttggcctaaatttttggggggatttttaa

SEQ ID NO: 97 - DNA (genomic), 2334 bp, Streptococcus pneumoniae; double-stranded, circular
  misc_feature (B) LOCATION 1...2334
  hypothetical: NO
  anti-sense: NO
actgttttgtcttcatcgaagacttcgtcagtttcctatttttactttgcttttgacgtccttggtatcttgatctttgtaggcaaggcgtataatttcatcaatccaaaggggattaaaatggcaaaacaagtgtttcaaacgacttttgcgggtcgtgagttaattgtagagactggtcaggttgctaagcaagcaaatggctctgttgttgtacgttacggtgagtcaactgtcttgactgctgccgttatgtctaagaaaatggcaactggggatttcttcccactccaagtcaactacgaagaaaaaatgtatgcggctgggaagtttcctggtggctttatgaaacgtgaaggacgtccttcaacagatgcgaccttgacagcgcgtttgattgaccgtccgattcgtcctatgtttgcggaaggtttccgtaatgaagtccaagtcatcaatacagtgctttcttatgatgaaaatgcatctgcaccaatggctgctatgtttggttcatctttggcactgtctatttcagatattccatttgacggaccaattgctggggtacaagtgggatatgtagatggccaaatcatcatcaacccaagtcaagaacaagcagagcaatctcttcttgaattgacagtagctggaaccaagcacgctgtcaacatggtagagtctggtgccaaagaattgtcagaagaaatcatgttggaagcgctccttaaagggcacgaagctgtcaaagaattgattgccttccaagaagaaatcgttgctgctgtcggtaaagaaaaagcagaagtggaattgcttcacgtggatgctgaattgcaagctgaaatcattgcagcctacaacagtgacctccaaaaggcagttcaagtagaagagaaattggcccgtgaagctgcgactcaagtagtgaaagaccaagtgactgccgtttacgaagaaaaatatgcggaccacgaagaatttgaccgtattatgcgtgatgtggctgaaatcttggaacaaatggaacacgcagaagtgcgacgtttaattacagaagacaaggtgcgtcctgatggtcgtaaggtcgatgaaatccgtcctttggatgcggttgtcgacttccttcctcgtgtacatggttcaggtctctttactcgtgggcaaactcaagctctttcagtcttgaccttggctccgatgggagaaactcaaatcattgatggtttggatccagagtacaagaaacgctttatgcaccactataacttccctcaatattctgtaggggaaacaggtcgttacggtgcgccaggtcgtcgtgaaatcggtcacggtgcccttggtgagcgtgctcttgctcaagtcttgccaagcttggaagaattcccatacgctatccgtctagtagcagaagttttggaatcaaacggttcttcatctcaagcttctatctgtgcgggaactcttgcccttatggctggtggtgtgccaatcaaggcgccagtagctggtattgctatgggacttatctcagatggaaataactacacagtattgacagatatccaaggtttggaagatcactttggagatatggacttcaaggttgcaggtactcgtgatgggattacagcccttcaaatggatatcaagattcaagggattactgcagaaatcttgacggaggctcttgctcaagccaagaaagcgcgttttgaaatccttgatgtcattgaagcaaccattccagaagttcgtctagaattggctccaactgctccgaaaattgatacgatcaagattgatgtagacaagattaagattgtcatcggtaagggtggagaaaccatcgacaagattatcgctgaaacaggtgttaagattgatatagacgaagaaggaaatgtgtctatctactctagtgaccaagatgctattaaccgtgccaaagaaattattgctggtttggttcgtgaagccaaagtggatgaagtttaccgtgctaaagtcgttcgtatcgagaaatttggtgcctttgttaacctctttgataagacagatgcccttgttcatatctctgagatggcttggactcgtaccaatcgtgtagaggatttggtagaaatcggggatgaagttgatgttaaggttatcaagattgatgaaaaaggccgtatcgatgcctctatgaaggctcttctacctcgtccgccaaaacctgagcatgatgaaaaaggtgaaaagtctgagcgccctcaccgcccacgtcatcacaaggatcacaaacctaagaaagaatttacagaaacaccaaaagattcagagtaa

SEQ ID NO: 98 - DNA (genomic), 1074 bp, Streptococcus pneumoniae; double-stranded, circular
  misc_feature (B) LOCATION 1...1074
  hypothetical: NO
  anti-sense: NO
gactgtttgtctcaactctgcgacagcgctctggagttgattttacgcgttttggaagtgggacctggtgatgaagtcatcgttccagccatgacctatacggcttcatgtagtgtcattacgcacgtgggagcaacccctgtcatggtggatatccaagcagatacgtttgagatggactatgacctgcttgagcaagctatcactgagaaaactaaggtgattatcccagtagagctcgcagggattgtttgcgattatgaccgtttgttccaagtcgtggagaaaaaacgtgacttctttaccgcttcaagcaagtggcaaaaggcctttaaccgtattgtcattgtctctgatagtgcccacgctttgggatctacttataaaggacaaccttctggttctatcgctgattttacttccttctcattccatgccgttaagaactttacaacggcagaaggtggaagtgcgacttggaaagccaatccagtgattgatgacgaagagatgtacaaggaattccaaatcctttcccttcacgggcaaactaaggatgctcttgccaagatgcaactggggtcatgggaatacgatatcgttacaccagcctataagtgcaacatgaccgatatcatggcttcacttggtttggtacaattggaccgctatccaagtttgttgcaacgccgtaaggacattgtggaccgctatgatagtggttttgcaggttctcgcatccatcctttggcacacaagactgaaactgtcgaatcttcacgccacctctacatcacccgtgtagaaggagcaagcctagaagaacgcagcctcatcatccaagaattggctaaagcaggaattgcaagtaatgttcactacaaaccgcttcctctcttgacagcctataagaatcttggatttgatatgacgaactatcctaaggcctatgccttctttgagaatgaaattaccctccctcttcatactaaattaagcgatgaagaagtagactatatcattgagactttcaaaacagtttctgaaaaagtgctaactttatcaaaaaaatga

SEQ ID NO: 99 - DNA (genomic), 510 bp, Streptococcus pneumoniae; double-stranded, circular
  misc_feature (B) LOCATION 1...510
  hypothetical: NO
  anti-sense: NO
aatcccttgtctgttcaaatggttcacaatatagcaggtacgtcattttggttgtgtaaaaaagaggtgctagaattaattaatggttttgagaaaatagattcacatcaggacggtgttgttttattaaaactacttgctcaaggataccaaattgatatagtgcgagaattcttggtgaattactacgctcacagtaaagaaaacggtatcactggagtgacacaaaaaacaattaatgcagatgaagaatattataattactgtaggaaatattttaatttattgagtttcaacgagagaatattggttacaaagaaatattattctttaaacataaagcggttactattaataggagacaaatgcaaggctttaaaagtaatcaagaaggcaagagaagaaaaaatttttaacgaatttctttttttgaaatatatgttattatataatttgggttttttctattgtatatatgacaactatgttcaattaaaatttagaaagtga

SEQ ID NO: 100 - DNA (genomic), 399 bp, Streptococcus pneumoniae; double-stranded, circular
  misc_feature (B) LOCATION 1...399
  hypothetical: NO
  anti-sense: NO
tacatattgtcgactcacttcgtattgcaagagctaaaaaagaccaggattaggaagtgccttatgaaatcactagctagactactgaacattcatgtttttatcagtattttccttttctttgcccttatttcaggagctgtttctcatacagttttactactcctactcctctttcttcctgcgctcaataaaggacttgagaaaatacaatcaaaacggatacctgtcctcaacgcagccctcttctttctcctcatatcctttccacaacttttaaccaaccctgtccaatggaaattttcaatattcctagtcgtaaccatcatttcaagtttggcctacttctataacttttatcaagtagttaaagaagtagatcaaaaacagttgatttag

SEQ ID NO: 101 - DNA (genomic), 519 bp, Streptococcus pneumoniae; double-stranded, circular
  misc_feature (B) LOCATION 1...519
  hypothetical: NO
  anti-sense: NO
agactcctgtcattgagcagatggacaagaatagggatgaggtcaatgacctcttgcgccagcgaactaccaangaaaaacctctttgccctgtctgatttggagactggtatggtttatctgacggcagctgccaaacaaaatcggattttgttagagcatattcaaggtcatgccttgtatcgtagttttgatgagattgagagagaacagtttgatgatgccatgattgaggctcatcagctggtatccatgacagacctaatctctcagattttacagcagctttcagcctcttacaacaatattctaaacaataatctgaatgacaatttgacaaccttgactatcatttcagtcttgctagctgttttggcagtcgtgacaggctttttcggaatgaatgttcccttacctttaacagatgagccccatgcttggctctatatcagtttggctagtgcaggtttgtggattgttttatccttgttactaaggaaaattgcgaaaaaaagttaa

SEQ ID NO: 102 - DNA (genomic), 819 bp, Streptococcus pneumoniae; double-stranded, circular
  misc_feature (B) LOCATION 1...819
  hypothetical: NO
  anti-sense: NO
gcttggctgtcttgtcaacaacaacatgctacttctgaggggacgaatcaaaggcaaagcagttcagcgaaagttccatggaaagcttcatacaccaacctaaacaaccaggtaagtacagaagaggtcaaatctctcttatcagctcacttggatccaaatagtgttgatgcattttttaatctcgttaatgactataataccattgtcggctcaactggcttatcaggagatttcacttcctttactcacaccgaatacgatgttgagaaaatcagtcatctctggaatcaaaagaagggcgattttgttgggaccaactgccgtatcaatagttattgtcttttgaaaaattcagtcaccattccaaagcttgaaaagaatgaccagttgcttttcctagataatgatgcgattgataaaggaaaggtctttgattcacaagataaggaagagtttgatattctattttcgagagttccaactgaggcaactacagatgtcaaggttcacgctgaaaagatggaaacattcttctcacaatttcaattcaatgaaaaagctcgaatgctgtctgtagtcttgcacgacaatctggatggcgagtatctgtttgtaggccacgttggggtcttagtacctgctgatgacggtttcttatttgtagagaaattgactttcgaagagccctaccaagcgattaaatttgctagtaaggaagattgctacaagtatttgggcaccaagtatgcggattatacaggcgagggactggctaagccttttatcatggataatgataagtgggttaaactttaa

SEQ ID NO: 103 - DNA (genomic), 474 bp, Streptococcus pneumoniae; double-stranded, circular
  misc_feature (B) LOCATION 1...474
  hypothetical: NO
  anti-sense: NO
cagtctatgtcagataagattggcttattcacaggctcatttgatccgatgacaaatgggcatctggatatcattgaacgggcgagcagactctttgataagctctatgtcggtattttttttaatccccacaaacaaggatttcttcctatcgaaaatcgtaaacgggggctagaaaaggctttgggacatctggaaaatgttgaagtcgtggcttctcatgatgaattggtggtcgatgttgcaaaaagattgggtgctacttgtctagtgcgtggtttgaggaatgcgtcggatttgcaatatgaagccagttttgattactacaatcatcagctgtcttctgatatagagactatttatttacatagtcgacctgaacatctctatatcagttcatcaggcgttagagagcttttgaagtttggtcaggatattgcctgctatgttcccgagagtatttggaggaaataa

SEQ ID NO: 104 - DNA (genomic), 294 bp, Streptococcus pneumoniae; double-stranded, circular
  misc_feature (B) LOCATION 1...294
  hypothetical: NO
  anti-sense: NO
gagaatatgtctgataacaaaactagtaaaattccaaccaatccagctaatattggacttcttttcttgccaatatttaaggctattgggccagctaaaaaagatatacaagctattggtcctgtaattgaagtagaaaaagcagttaaagatacagcgcaaaaaattaaaacaagccttgaaagctcgggatttgctccaagtccgattgctatttcttcaccaagttcaataatttctagtcttttattaaaaaataaaactaatatagtagcaataatacttactnattag

SEQ ID NO: 105 - DNA (genomic), 1284 bp, Streptococcus pneumoniae; double-stranded, circular
  misc_feature (B) LOCATION 1...1284
  hypothetical: NO
  anti-sense: NO
gggagtatgtcttgttctatcgatttattaaaacatcggtatttgaaaaatattaaagaaaatcctgaattgtttgtcggaattgagttggagtatcctgttgcaagtttagaaggggatgctacagatgttgaagttatgaaggatctatttcattatttagtttctactttggatctcaccgtagcaaaggtagatgattttggcaatctgatccagttagtagatccgataagtcaggatgctattttatttgaagtttcctatacaacgattgagtttgcatttggtaaggctgaaacgattcaagaggtcgaaaatcgtttcaataattatatgaatgtaattcagagaaagttagctgaatcaaatcatgctattgttggctgtggtatccatcccaactgggataaaaatgagaattgtccagtggcttatccacgctatcagatgttgatggattatttgaatttgagtagaaatattattaaatcagatttacatcatttccctgaatatggtacttttatctgtgggagccaggttcagctggatatttcaaaaaccaactacttacgggtgattaatgcttttactcaaattgaagcggctaaggcttatttatttgcaaactctgaattttcgggtgcggattgggatacgaaaatttcaagggatattttctgggaagaatctatgcatggtatctatccagagaatgttggggtcaatgctagactccttaatgatgaaactgatttttttgactatctaaatcattctgcgatttttactgcggaacgtgatgggcagacctattatttttatcctattcaggctggggactatttggctacgtccgaaatccaagcatttgctctgaatggggatgaggttattatttacccccaagagaaggattttgaaactcatcgtagttaccagtaccaagatttaacgactcgaggaacagttgagtttcgtagtgtgtgtacacagccacttgataggacttttgcttctgcagcttttcacttgggattattggttaatttagacaagttagaagcttacttagaaacagcacctttctttaaagtatttggttatgattacaagtctttaaggagacaattttctaagaaaaatcttacagatgaggaagaaactacgattattgaattttccaaagacttactcctactagctgaggagggactagtggtgagaaataaggaagaaatgacctatttacagcctttgagagaagaattgagcctataa

SEQ ID NO: 106 - DNA (genomic), 717 bp, Streptococcus pneumoniae; double-stranded, circular
  misc_feature (B) LOCATION 1...717
  hypothetical: NO
  anti-sense: NO
agcctaatgtctatgttaaaagttgaaaatctttctgtgcattacggtatgatccaagcagtccgtgatgtaagctttgaagttaatgaaggagaagttgtttcccttatcggtgccaacggtgcaggtaagacaactattcttcgcaccttgtcaggtttggttcgaccaagttcaggaaagattgaatttttaggtcaagaaatccaaaaaatgccagctcagaaaatcgtggcaggtggtctttcacaagttccagaaggacgccacgtctttcctggcttgactgttatggaaaatcttgaaatgggagctttcttaaagaaaaatcgtgaagaaaatcaagctaacttgaagaaggttttctcacgctttcctcgtcttgaagaacggaagaaccaagatgcagctactctttcaggaggggaacaacaaatgcttgccatgggacgcgctcttatgtcaacaccaaaacttcttcttttagatgaaccatcaatgggacttgccccaatcttcatccaagagatttttgatatcattcaagatattcagaagcaaggaacaaccgtcctcttgattgaacaaaatgccaataaagcacttgcaatctctgaccgaggatatgtattggaaacaggaaaaatcgtcctatcagggtcaggaaaagaactcgcttcatcagaagaagtcagaaaagcatatctaggtggctaa

SEQ ID NO: 107 - DNA (genomic), 750 bp, Streptococcus pneumoniae; double-stranded, circular
  misc_feature (B) LOCATION 1...750
  hypothetical: NO
  anti-sense: NO
agcataatgtctcaaaaaaataataaaaagaaaaacaagcgaaaaaatctgctgacaaatatcctagcaggatttctgatattactgtcactggctttgatttttaatactcaaattcgaaatattttcatagtctggaataccaataagtatcaagttagccaggtatcaaaagaaaaattagaagaaaatcaggatacagaaggcaattttgactttgattctgtcaaagctatctcttcggaagctgttctaacttctcaatggaatgctcaaaaattaccagttattgggggaattgcaattcctgaattggaaatgaatttgccgatttttaaaggacttgataatgttaatctcttctacggagctggtacaatgaaacgcgagcaagtaatgggagaaggaaattatagtctagctagtcaccatatctttggtgttgataatgctaataaaatgttattttctcctttagataatgctaaaaatggcatgaagatttatctaaccgataaaaataaagtttatacttatgaaatacgtgaagtcaaacgtgtgacaccggatcgtgttgatgaagttgatgatagagatggggtcaatgaaatcacattagtaacctgtgaagaccttgctgctacagaacgtattattgtcaaaggtgatttgaaagaaacaaaagattattcacaaacatctgatgaaatcctaacagctttcaatcaaccatataaacaattttattaa

SEQ ID NO: 108 - DNA (genomic), 375 bp, Streptococcus pneumoniae; double-stranded, circular
  misc_feature (B) LOCATION 1...375
  hypothetical: NO
  anti-sense: NO
aagaaaatgtctaaaaatattgtacaattgaataattcttttattcaaaatgaataccaacgtcgtcgctacctgatgaaagaacgacaaaaacggaatcgttttatgggaggggtattgattttgattatgctattatttatcttgccaacttttaatttagcgcagagttatcagcaattactccaaagacgtcagcaattagcagacttgcaaactcagtatcaaactttgagtgatgaaaaggataaggagacagcatttgctaccaagttgaaagatgaagattatgctgctaaatatacacgagcgaagtactattattctaagtcgagggaaaaagtttatacgattcctgacttgcttcaaaggtga

SEQ ID NO: 109 - DNA (genomic), 510 bp, Streptococcus pneumoniae; double-stranded, circular
  misc_feature (B) LOCATION 1...510
  hypothetical: NO
  anti-sense: NO
acaggaatgtcatttaagaataactggatagacaaggaaggcagagtatttatctattttactgtcgaagaaattatgaaaagaagaaatatctcaaagccaactgccataaaaacattagatgagcttgatataaaaaaaggaataggactgatcgaaagagtaaggcttggacttggtaagccgaacatcatttatgttaaagactttatgagtatatttcaggtaaaagaaaatgacttacagaagtcaaaaaacttaacttcagaagtaaaagattttaacctcagaagtaaagaaaatgaacttcaagaggttaagaaccttgactctaactatatagagaataataagagtaagtatagtaagagagaatatagttttggtgaaaacggacttggaacatttcaaaatgtgtttttagctgctgaagatatatcggatttacaaatcataatgaactcacagcttgagaattacattagacttcctgcaaaactagaatcctag

SEQ ID NO: 110 - DNA (genomic), 357 bp, Streptococcus pneumoniae; double-stranded, circular
  misc_feature (B) LOCATION 1...357
  hypothetical: NO
  anti-sense: NO
gtaaagatgtctattataaccttgctccccctcttggtgtcttctatgctgatttactcagcacctctcatctttacaagtatcggtggtgttttctctgaacgtggtggtgtggtaaacgttggccttgaaggaattatggttatgggtgccttttctggagttgtctttaaccttgaatttgcagaacaatttggagcagcaactccatggctatccttgcttgtagcaggattgttgggtagggtnttcttattcatccaaggcagcggcgacggttcatttccgtgcagaccatgtggtcagcggtacggtattgaacttgatggcgcctgccttggctgttttcttagttaa

SEQ ID NO: 111 - DNA (genomic), 1044 bp, Streptococcus pneumoniae; double-stranded, circular
  misc_feature (B) LOCATION 1...1044
  hypothetical: NO
  anti-sense: NO
tggcctgtgtccactttttttgtttttaatgtgaactatacacgagaagtggttcggattcaagaaatgggaaagactgtaaattctttggatttgtatttgaaagatattaacgaacctgcagcgtctgttcttcgattttttgaggatgtatcaaaggattataaagtctccatcatcaaaacagacagtggtgatgaggtggtcaagtctggtgtttttgataaagataccttcccctaccaagagtttgggatttcttctcttgattttaccacagatggtgaaggagtctatagtaataaagaaatttccaataaacttggtacgattccgacctttctaaaagccaaacctattcagcttatgacttttcaaacctatatcaaggatacatctcgtagtttaaatggtcgctatacgataacttctacacaagagatggacaaggataggattgtacagaaatggagcgattttttcaagatagaccaggctaccttgctagagccgacctacaaaagtgcagtggaagtcataaatcgagatttgcttttatctgccattgtttttgtcttggctattttgcttcttgtgttagtgacagtgtatcaaccgatgatggagatgaaaagagttggggtacaaaaattacttggttttcaagatagggctgttttagctgatgttgtaaaaggcaacctttacctcctcctaggtggggctcttgtgatcaatctaggcgtgtttttcttgcttgattataaacccaaaagatttgtttcctatactgtggttgtctcattttttgctgttgcagctttatctctttatcagttggttgacttacctcttaatccaaaaaatgacaatcagctctctgctgaaaggtttttcatctttcaaatttggtcttatcttcaattatgtgatgaaaatagggacaactattttactgacggccttactgattggggtgggcagaagtttagaacaagaaaacaaagaacttgcttatcagcaacagtgggtaagtcaaggtaa

SEQ ID NO: 112 - DNA (genomic), 1131 bp, Streptococcus pneumoniae; double-stranded, circular
  misc_feature (B) LOCATION 1...1131
  hypothetical: NO
  anti-sense: NO
cagccagtgtcattttggaggaaaatcatgaaagctagtccacatagaccaaccaaggttctgattcatctgggagctattcgacaaaatattcagcaaatgggggctcatatccctcaaggaacgctcaagtgggctgtggtcaaggccaatgcttatggccatggagctgttgccgttgccaaggcaattcaagatgatgttgatggcttttgcgtttccaatatcgatgaagccattgaactcagacaagctggactcagcaagccaatcctcattttaggagtttctgaaatcgaagctgttgctctagctaaagaatatgacttcaccttgacagtggctggactggagtggattcaagcactcttagataaggaagtggacctaactggattgacagtccacctcaagattgattcagggatgggacggattggttttagagaggccagtgaggttgagcaggctcaagatttgctacaacaacacggtgttcgtgttgaaggaatctttacccactttgctactgctgatgaggaatcagatgactattttaatgcccagttagaacggtttaaaactattttagctagtatgaaggaagttccagagctggttcatgctagcaattctgcaacgactctttggcatgtagagactattttcaatgcggttcgtatgggagatgccatgtatggcctcaatccaagtggagcggtcttggatttgccttatgatttgataccggccttgaccttggagtctgctctggttcatgtcaagacagttccagcaggagcttgcatgggctatggagcaacttatcaagcggatagcgagcaagtcatcgcgaccgtgccaatcgggtatgcagatggatggacaagagacatgcaaaatttctctgtcttggtagatggccaagcttgcccaattgtcggcagggtttcgatggaccaaatcactattcgattgcctaagctttatccgctaggaaccaaggtaaccttgattggctccaatggggataaggaaatcactgcaactcaggtagcgacctaccgcgtaaccattaactatgaggtggtttgcctcctcagcgaccgtattccgagagaatattattag

SEQ ID NO: 113 - DNA (genomic), 375 bp, Streptococcus pneumoniae; double-stranded, circular
  misc_feature (B) LOCATION 1...375
  hypothetical: NO
  anti-sense: NO
attaaagtgtcgataatgattaaagttatagccaagacgaatgacaatggagccagcgccgttcccataacaataccaattggagcaggtgttgtccaaggtaaaataatactgaaactattcatttgtagaacatctacaaaaaatttcataatccaaacattgataataggagcagtaacaaacggaataaagaagataggatttaaaacaattggagcaccaaataggattggttcatttacgccaaagaaagtaggaactacagacgcacgtccgacaattctatttctttttgatttacataaccacataaacataaatggaactactagtgttgcaccagtaccacccattgttacaacaaaagtttga

SEQ ID NO: 114 - DNA (genomic), 243 bp, Streptococcus pneumoniae; double-stranded, circular
  misc_feature (B) LOCATION 1...243
  hypothetical: NO
  anti-sense: NO
tggaaggtgtctcaagcgaggcagcttcatatgcaggcttgcaaaaacttgataagttggttgttctttatgattcaaatgatatcaacttggatggtgagacaaaggattcctttacagaaagtgttcgtgaccgttacaatgcctacggttggcatactgccttggttgaaaatggaacagacttggaagccatccatgctgctatcgaaacagcaaaagcttcaggcaagccatctttga

SEQ ID NO: 115 - DNA (genomic), 996 bp, Streptococcus pneumoniae; double-stranded, circular
  misc_feature (B) LOCATION 1...996
  hypothetical: NO
  anti-sense: NO
cttccttcgtctggaaaatggcggtgccttccacgatggagatttgattgtggacgagttgatgcgcattatacaggtgaaaaaatgagtttcacagtagcagtaaaagaagaaatcctgggccaacaccatctgagctggcatgaattatctgccattatcaaaatgtctggtagcatcggtctctcgacttcgggcttgactttgtcagttgtgacagaaaatgccaaactggcccgtcacctctatgagtcctttctccatttctatgaaatcaaatctgaaattcgtcaccaccaacggagcaatcttcgcaagaatcgcgtctataccgtttttacagatgaaaaggtgcaggatttgttaagtgatttgcacttggcagactctttctttggcctggaaacaggtattgatgaggcgattttatcggatgaggaagcaggtcgtgcctatctctgtggcgctttcttggcaaatgggagcattcgtgaccctgagtcaggcaagtaccagttggaaatcagttctgtttatctggaccacgcgcaaggaattgcctcccttctccaacagtttttactggatgccaaggtgcttgagcgcaagaagggggctgtgacctatctccagcgagcagaagacattatggacttcttgatagtaatcggagccatgcaggcacgtgatgattttgagcgggttaagattttgcgagaaacccgtaacgacctcaatcgggctaataatgccgagacagctaatatcgctcggacagtttctgccagcatgaagaccattaacaatatcagtaaaatcaaagatatcatgggcttagaaaatttgccagtagatttgcaggaagtggcgcaactgaggattcagcacccagactactctatccagcagttagcagatagtctcagcacccctctgaccaaaagtggtgtcaatcacagactcagaaaaatcaataagatagcggatgaattataa

SEQ ID NO: 116 - DNA (genomic), 1620 bp, Streptococcus pneumoniae; double-stranded, circular
  misc_feature (B) LOCATION 1...1620
  hypothetical: NO
  anti-sense: NO
ctgacttcgtcagtcttatctacaacctcaaagcagtgctttgagcagcctgcggctagttttctagtttgctctttgattttcattgagtataagatcattacattgtttataagtttaaaaataaaaaaaggagtttttatcatgaaaaactggaaaaaatatgcttttgcatctgctagtgtagtcgctctggctgcaggtcttgctgcttgtggaaatttgacaggtaacagcaaaaaagctgctgattcaggtgacaaacctgttatcaaaatgtaccaaatcggtgacaaaccagacaacttggatgaattgttagcaaatgccaacaaaatcattgaagaaaaagttggtgccaaattggatatccaataccttggctggggtgactatggtaagaaaatgtcagttatcacatcatctggtgaaaactatgatattgcctttgcagataactatattgtaaatgctcaaaaaggtgcttacgctgacttgacagaattgtacaaaaaagaaggtaaagacctttacaaagcacttgacccagcttacatcaagggtaatactgtaaatggtaagatttacgctgttccagttgcagccaacgttgcatcatctcaaaactttgccttcaacggaactctccttgctaaatatggtatcgatatttcaggtgttacttcttacgaaactcttgagccagtcttgaaacaaattaaagaaaaagctccagacgtagtaccatttgctattggtaaagttttcatcccatctgataactttgactacccagtagcaaacggtcttccattcgttatcgaccttgaaggcgatactactaaagttgtaaaccgttacgaagtgcctcgtttcaaagaacacttgaagactcttcacaaattctatgaagctggctacattccaaaagacgtcgcaacaagcgatacttcctttgaccttcaacaagatacttggttcgttcgtgaagaaacagtaggaccagctgactacggtaacagcttgctttcacgtgttgccaacaaagatatccaaatcaaaccaattactaacttcatcaagaaaaaccaaacaacacaagttgctaactttgtcatctcaaacaactctaagaacaaagaaaaatcaatggaaatcttgaacctcttgaatacgaatccagaactcttgaacggtcttgtttacggtccagaaggcaagaactgggaaaaaattgaaggtaaagaaaaccgtgttcgcgttcttgatggctacaaaggaaacactcacatgggtggatggaacactggtaacaactggatcctttacatcaacgaaaacgttacagaccaacaaatcgaaaattctaagaaagaattggcagaagctaaagaatctccagcgcttggatttatcttcaatactgacaatgtgaaatctgaaatctcagctattgctaacacaatgcaacaatttgatacagctatcaacactggtactgtagacccagataaagctattccagaattgatggaaaaattgaaatctgaaggtgcctacgaaaaagtattgaacgaaatgcaaaaacaatacgatgaattcttgaaaaacaaaaaataa

SEQ ID NO: 117 - DNA (genomic), 243 bp, Streptococcus pneumoniae; double-stranded, circular
  misc_feature (B) LOCATION 1...243
  hypothetical: NO
  anti-sense: NO
ccctcctcgtcttcattttttacttattcttgtgaacaagctgctagactcaaggctagcaaagctgctcaagacaaggtatctttttttcatttctactcctttatttctaatagtttatctacttctgacgataaacattcgactaatcttttaatctcttcccggttttacttggcaagtttctgctgtcatttcttcaaagggacccaccaaactggcccacgtcccttgagaccgtga

SEQ ID NO: 118 - DNA (genomic), 201 bp, Streptococcus pneumoniae; double-stranded, circular
  misc_feature (B) LOCATION 1...201
  hypothetical: NO
  anti-sense: NO
gagggctcgtcagtgaaactggaaaacattgacaaatccattcaaaaacaggatattttgcaaggcatttcgcttgaagtcagtcctcaaaaactgacagcctttattggtccaaatggtgctggaaaatcgactcttcctctccatcatgagcagactaaccaagaaagatcagggagttctcagtatcaaaggacgtga

SEQ ID NO: 119 - DNA (genomic), 237 bp, Streptococcus pneumoniae; double-stranded, circular
  misc_feature (B) LOCATION 1...237
  hypothetical: NO
  anti-sense: NO
agaatgccgtctttgataaagagtacacgtttagctctgctagctgctgctgttgagtgggttaccatgagaatggtttggccgcgctcattgatttcatcaaagacatcaagtaaggctgcagatgacttggagtcaagagctcctgtcggttcgtccgcaaggagaatttcaggttcagtgatgatggcgcgtgctactgctacacgctgtttctggccaccagaaatctcgtaa

SEQ ID NO: 120 - DNA (genomic), 291 bp, Streptococcus pneumoniae; double-stranded, circular
  misc_feature (B) LOCATION 1...291
  hypothetical: NO
  anti-sense: NO
atactaacgtccagaagaaaactttctctttctcttgaagagtgtcaactaatgttagaggagggaacaaaggatcaactagctgaactgacctacccctttggtcgtggagtcaatctctcctttggcataaaggatgttccaaaactctatcaaaaagtgatggaggcaaactatcctatttatcgtctcttgaccaaaagaaagtttcgtgtcagtgatccctatatctatcctcataaatttgcagttttggatccagatggctattttttaagatttagcgagtag

SEQ ID NO: 121 - DNA (genomic), 219 bp, Streptococcus pneumoniae; double-stranded, circular
  misc_feature (B) LOCATION 1...219
  hypothetical: NO
  anti-sense: NO
aaagaaacgtcaaatgctcatgaaacaacgaatacaggtatcaaaactatgacaaaacaaatccctaaatttactaaagatactgctcaactttacacctgtaaatggttgttgtataataaagttacaaagatgtacgaccacactgttgtaaatcatagtgttcgcgaatatattactgatagcatttctacaaatacaagtaaagagagcggatga

SEQ ID NO: 122 - DNA (genomic), 840 bp, Streptococcus pneumoniae; double-stranded, circular
  misc_feature (B) LOCATION 1...840
  hypothetical: NO
  anti-sense: NO
agcgttgcgtccgaaagtctatccagacacggctctttaaaaacaaaaggagaaatgatgcatacttatttgcaaaagaaaattgaaaatatcaaaacaaccctaggtgaaatgtcaggtggttaccgtcgtatggttgcggctatggctgatttaggattttcaggaactatgaaggctatctgggatgacctctttgcccatcgtagttttgcccagtggatttatttgctggttttaggaagttttcctctctggctggagttggtttacgaacatcgtattgttgactggattgggatgatttgtagcttgacagggattatctgtgtaatctttgtatcggaaggtcgagcaagtaattatctttttggcttgattaactctgttatttaccttattttggccctacagaaaggcttttatggtgaggtgctgacgacactttacttcacagtcatgcagccaattggacttctagtttggatttatcaggcacagtttaagaaggaaaagcaggagtttgtcgcgcgtaaactggacggcaagggctggacaaagtatctttccattagtgtgctttggtggttggcctttggcttcatttatcagtctattggtgccaatcgtccctatcgtgattcaatcacagatgcaaccaatggggtagggcaaatcctcatgacagctgtttaccgtgaacagtggatattctgggcggctaccaatgttttttcaatctatctctggtggggaaaaagcctgcaaattcaagggaaatatctaatttatctcattaacagtctaatttggttggtatcaatggaacaaggccactaa

SEQ ID NO: 123 - DNA (genomic), 237 bp, Streptococcus pneumoniae; double-stranded, circular
  misc_feature (B) LOCATION 1...237
  hypothetical: NO
  anti-sense: NO
cgctctgcgtcttctgtaaaaggagcttccaagtcaatggtatctcccaaaacgttgaagacacgtcccaaagtttctttacctactggtacagagattggacgacctgtgtccaatacttccattccacgagtcaacccatctgttgattccatggcgatagtacgaaccataccatctcctaactccaaggctacttcaaggacgatttttgtttttctttcgtcatttttgtag

SEQ ID NO: 124 - DNA (genomic), 702 bp, Streptococcus pneumoniae; double-stranded, circular
  misc_feature (B) LOCATION 1...702
  hypothetical: NO
  anti-sense: NO
aatttagcgtcagaaacaaatcacgaaatcgattcaaattttgcaggtcgtttaaatatcctgcgcgcaggtgttcttggtgctaacgatggaattatttccattgctggtgtggttatcggggttgccagtgccacgaccaatatctggattatctttttatcaggatttgcggctatcttagctggtgccttttcaatggctggtggagaatatgtatccgtttcaactccaaaagataccgaggaagctgccgtttcgcgagaaaaactcttgttagaccaagatagggaactagccaaaaaatccctctatgctgcttatatccaaaatggagaatgcaaaacttctgcccaactcttgaccaataagatctttcttaaaaatccactcaaggctctggtagaggaaaaatatgggattgagtatgaagaatttaccaatccttggcacgctgccatttctagcttcgttgcctttttccttagaagtttgcctccaatgctgtcagtgaccatattcccaagtgaatatcgcatccctgctactgtccttattgtcggtgtggcccttcttctcactggttacactagtgccagacttggaaaggatccgactagaacagctatgattcggaaccttgctattggtctcttgaccaggggagttaccttcctgctcgaacaacttttcagcatttag

SEQ ID NO: 125 - DNA (genomic), 240 bp, Streptococcus pneumoniae; double-stranded, circular
  misc_feature (B) LOCATION 1...240
  hypothetical: NO
  anti-sense: NO
aaaatggcgtcttgttacgccaagtcatcaatgttattgatgaagttgatttcaatagccctgaagatcgtcattcgtttaatgatatttacgaaaaaattcttaaagatattcaaaatgctgggaactcaggagaattttatacgccacgtgcagcgactgattttattgccgaagttcttgacccaaaacttggagaatcaatggcagaccttgcttgcggaacaggaggcttcttga

SEQ ID NO: 126 - DNA (genomic), 303 bp, Streptococcus pneumoniae; double-stranded, circular
  misc_feature (B) LOCATION 1...303
  hypothetical: NO
  anti-sense: NO
atgaatactttaggagataaattgatggaattgagtgctatttaccataggactgagtcggagtatgcctatctttataaggataagaaactccatattcgaattcgaactaagaaaggggacattgaaagcatcaacttgcactatggggacccttttatctttatggaggagttttatcaggatacaaaagaaatggtcaagataacttctggtaccttatttgaccattggcaggttgaagtgtcagttgactttgcacgtatccagtatctttttgagctcagagatacagaaggttaa

SEQ ID NO: 127 - DNA (genomic), 249 bp, Streptococcus pneumoniae; double-stranded, circular
  misc_feature (B) LOCATION 1...249
  hypothetical: NO
  anti-sense: NO
cttcgtcagtcttatccggcaacctcaaagcagtgctttgagcagcctgcggctagtttcctacagattttagttggaactcgattcaattcatgtgacaacgtgaaaatcgttagagcattttatatagaatatacatgggaatggagcttactcccattcccatatttaatagaaaaagaggaactcaatgctacattatacaaaagaagacttgctcgaattgggtgcagaaatcactacgcgtga

SEQ ID NO: 128 - DNA (genomic), 276 bp, Streptococcus pneumoniae; double-stranded, circular
  misc_feature (B) LOCATION 1...276
  hypothetical: NO
  anti-sense: NO
caaagtcagtcacatatatacggtaaggcgacgttggcgcggtttgaagagatttttgaagagtataaaaatcctcaagatactttcttctatcctttagtttataaggagaatacctatgaaaaaactgctatttctatctttgctctcctaatgttaggagtttgctgcctgttcctattcagccagcaaagctataaaaaactcgttcaatactatgctaacgaccagaacctgcccagtaggataacttatagtgaatatagcgacaaatga

SEQ ID NO: 129 - DNA (genomic), 927 bp, Streptococcus pneumoniae; double-stranded, circular
  misc_feature (B) LOCATION 1...927
  hypothetical: NO
  anti-sense: NO
agatgccagtcacagatcgtctggtttgtagaggatacctatatgattcaagcaagaaacaagttaagccaagaagagctatctgaggcgaaaaaagtaattaactgttgccaaaactatgacggtacctatcgcgatccctatctctctaacatgcttaattttgatccaaacatgcccgcctttttcctttattatgaaaaaggcgaacttgttggtttattaactgtctatgcagatgaccaagatgtagaagtgacgatactggttcatccaggtcatcgccgtcaggggattgcgcgtgcattgtttactagttttgagagagaaacagcttctttccccattcggtcagtcacttttcagacagaacgtatttttttagagaatcatcctgactttgccagtaactggggactaatcgaggatgaagagacagaaacctggttaggtaaggatagaagaccatatcagttagcaaaactttctaatcttgaagttttgttagcagatagttcgtatcaggagcaaattagccagttaaaatttcaggcattttcaggggaacatgaatcgagagaagttgtggatagatatgtcgctgaagctctgaaggatccagaaagtcgcttatatattttgttaaaagacggtcaggttattgggacttgcacggttgatttatcgagcgatacgaattacttctacggtttagcaatatcagaacctgaacgtgggaaaggctatggaagctacttagcaaaatcccttgtcaaccaactaattgagcaaaatgataaggaatttcagattgcagtggaagatagcaatgtaggtgccaaacgtttgtatgaaaaaattggctttgtcaaacagacacaggtggtttatctgaatgagaaaggagcaagggattccgaagtgtag

SEQ ID NO: 130 - DNA (genomic), 686 bp, Streptococcus pneumoniae; double-stranded, circular
  misc_feature (B) LOCATION 1...686
  hypothetical: NO
  anti-sense: NO
tttgtactttattccagttgccatcggtatgcttctgggaatcggcttattttcctacccgattgaatgacctgcttgaaaattatcaggtttttgtattatggagctttgcgggagctattatcggtacagttcctagcctcctcaaagaatcaactcgagaatctgaccgagacaagattgatttagcttggttatggacaacctttatcatttctggattaggactctatgccttaaattttgtcgttggaaccttaagcgccagctttcttaacttcgtcctagcaggcgcactattggcccttggcgtcttggttcctggcctcagtccatcaaatttacttttgattttgggactctatgctcctatgttgactggttttaaaacttttgatctcttgggaaccttctttccgattggaattggtgcaggtgcaactctcatcgttttttcaaaattgatggattatgccttaaacaactaccactcacgcgtctatcatttcatcatcggtatcgtcctatcaagtacccttttgatcttaattccaaatgcaggaaacgctgaaagtatccaatacacaggactttcacttgtcggttatgtcatcatcgccttcttctttgcgctgggaatctggcttggtatttggatgagtcaattggaggataaatataaataa

SEQ ID NO: 131 - DNA (genomic), 240 bp, Streptococcus pneumoniae; double-stranded, circular
  misc_feature (B) LOCATION 1...240
  hypothetical: NO
  anti-sense: NO
tgccgaaagtcatttgggacaggatgcttattaggagctgtagtagcaagctttatcggactagaaaaaggtcaagaattgaaatcattagaaacagcaatgttagtttacaatatcgctggagaaatggcagaaaaacgtccaaatggacatcttcctgggacatttaaagttgaatttataaatgccttatacgagattacagatgaagatgtaaaggaattcaaaagagtgaagtaa

SEQ ID NO: 132 - DNA (genomic), 198 bp, Streptococcus pneumoniae; double-stranded, circular
  misc_feature (B) LOCATION 1...198
  hypothetical: NO
  anti-sense: NO
gcgctctggtcgaaaagaagggataggattcgaacgaggaacttgccagagaactggctgatatcatttactacaccgtgcgcaatcgtagctattaatcatattgaccttaccaagactgtctttgagaaagacaaaaccgcagccgttaattaccaacataaacataatttggaaggattcttgaagggaaagtag

SEQ ID NO: 133 - DNA (genomic), 675 bp, Streptococcus pneumoniae; double-stranded, circular
  misc_feature (B) LOCATION 1...675
  hypothetical: NO
  anti-sense: NO
ggaggctggtctatgaagtgcttgttatgtgggcagactatgaagactgttttaacttttagtagtctcttacttctgaggaataatgactcttgtctttgttcagactgtgattctacttttgaaagaattggggaagagaactgtccaaattgtatgaaaacagagttgtcaacaaagtgtcaagattgtcaactttggtgtaaagaaggagttgaagtcagtcatagagcgatttttacttacaatcaagctatgaaggattttttcagtcggtataagtttgatggagacttcctgttaagaaaagttttcgcttcatttttaagtgaggagttgaaaaagtacaaagagtatcaatttgttgtaattcccctaagtcctgatagatatgctaacagaggatttaatcaggttgagggcttggtagaggcagcaggctttgagtatctggatttattagagaaaagagaagagagagccagttcttctaaaaatcgttcagagcgcttggggacagaacttcctttctttattaaaagtggagtcactattcctaaaaaaatcttacttatagatgatatctatactacaggagcaactataaatcgtgttaagaaactgttggaagaagctggtgctaaggatgtaaaaacattttcccttgtaagatga

SEQ ID NO: 134 - DNA (genomic), 1017 bp, Streptococcus pneumoniae; double-stranded, circular
  misc_feature (B) LOCATION 1...1017
  hypothetical: NO
  anti-sense: NO
tattcatggtcatggtcgtcaagctggcaaactcttgcgagaagcccgtcagaactagcccagttactaaggacaaaacctcaacatatctttttcacttctggtgggactgaaggcaataatactaccatcattggctactgtcttcgtcaccaagaacaaggaaaacatatcatcacaactgccatcgagcaccatgctgtccttgaaacaattgattacttggttcaacactttgggtttgaagcaaccattatccagccagaaaatcaagaaatcacagcccagcaaattcaaaaggctttacgtgacgatacgattttggtttctactatgtttgccaataatgagacaggaaacctacttcccatcgctgaaattggccaaatactcaagcaacaccctgctgcctatcatgttgatgcagttcaggctattggtaaaatcccaattcattcagaagaattgggcattgattttctcactgcttctgcccacaaattccatggtcctaagggaatcggttttctctacgcatctagcatggactttgattcctatctacatggcggagaccaggaacagaaaaaacgtgcaggaactgaaaatctgcctgccatcgtaggcatggttgcagccctaaaagaagacctagaaaaacaagaagaacattttcaacatgtacaaaatctagaaactgcctttctggcagagctggagggcattcagtattacttgaatagaggaaaacatcatctcccttatgttctcaatattggatttcctggtcagaaaaatgacctcttactccttcggctagatttagctggaatttcaatctctactggctcagcctgtactgcaggcgttgtccaatccagccatgttcttgaagccatgtatggcgcaaattcagaacgcttgaaggaatcccttcgcatcagtttgtcgccacaaaataccgttgaagacctacaaaccctcgcaaaaaccttaaaagaaattatcggaggttag

SEQ ID NO: 135 - DNA (genomic), 774 bp, Streptococcus pneumoniae; double-stranded, circular
  misc_feature (B) LOCATION 1...774
  hypothetical: NO
  anti-sense: NO
atacgatggtcattgatttgtaccatgatttactttcaaaatgttagtaagttgtatggtgataaagacgccttgagtaatctcaatttgcagattgaaaatggagagattatgggcttgattggtcataatggggctggaaaatcgaccactataaaatccctagtcagtatcatttcacccagcagtggtcgtattttggtagacggtcaggagttatcggaaaatcgcttggctattaaacgaaagattggctacgtagcagactcgcctgacttatttttacgcttaacggccaatgaattttgggaattgatcgcctcatcctatgatctgagtagatctgacttggaggctagtctagctaggctattgaacgtttttgattttgctgaaaatcgctatcaggttattgaaactctttctcacggaatgcgtcagaaagtctttgtcatcggagcactcttgtctgatcccgatatttgggtcttggatgaacccttgactggtttggatccccaggctgcctttgatttgaaacagatgatgaatgaacatgcactaaaagggaagacagtcttgttttcaactcatgtcctagaggtggcagagcaagtctgtgatcggattgccattttgacaaaggggcatctgatttattgtggtantgtaaaggacttgagaaaagattacccagaccagtctttggaaagtatctaccttagtcttgctggtagaaaagaggaggttgcggatgcgtctcaaggtcattaa

SEQ ID NO: 136 - DNA (genomic), 216 bp, Streptococcus pneumoniae; double-stranded, circular
  misc_feature (B) LOCATION 1...216
  hypothetical: NO
  anti-sense: NO
ggctgcaggtctggtgacagaaactcctgttatcatcaccaaccaagatgcttatacagcgactattactggaacttatccgacaacgatccaagctggagcatctctcatggtcgctacacgaatctaatactcttcgaaaatctcttcaaaccacgtcagctctatctgcaacctcaaaatagtgttttgagcaacctgtggctagcttcctag

SEQ ID NO: 137 - DNA (genomic), 309 bp, Streptococcus pneumoniae; double-stranded, circular
  misc_feature (B) LOCATION 1...309
  hypothetical: NO
  anti-sense: NO
tcaaccactttgggcaatagtgagaactgccccgtgcttttttattttgagaaaatatggagtttgtcgttgaaattacttgattgtattttggactatcaagaaagattcaatggaaaaacatgtcaagtatcaacgaattataagtatttagagattttcaaagtgaatttttgtttgactgatttacatcatttatttgacttatacaaaatcacacgagattatgctagtcaaacaaaacctgctattcaagctggtgtttttattttagaagattttagaaatatcctatgtacaatgatgtaa

SEQ ID NO: 138 - DNA (genomic), 1512 bp, Streptococcus pneumoniae; double-stranded, circular
  misc_feature (B) LOCATION 1...1512
  hypothetical: NO
  anti-sense: NO
ctactttttccttttcctcattataaaagagtaaatagctataatctcccttttcatgcacttccacatcataaagctggtcaatcacttccaactgctcatcaaactgaatcgtatttcgcatccgaatcttcacatcaagtcctctttcttgtctcttgtcctactatnttaccaaaaagagcaggattttgctataatggtcatatgaacgaaaaagtattccgtgacccagttcacaactacatccatgtcaataatcaaatcatctatgacttgattaatacaaaagaatttcagcgtttgcgccggatcaaacaactgggaacttccagttataccttccacggtggagaacacagtcgcttctctcactgtctaggagtctatgaaattgcacgacgcatcacagagattttcgaagaaaaatatcctgaggaatggaatcctgccgagtctctcttgaccatgaccgctgctctcctacatgaccttgggcatggcgcctactcccatacttttgaacatctctttgatacagaccatgaagccattactcaggagattattcaaaatcctgagacagagattcaccaagtcttgctacaagtagcgcccgattttccagaaaaagttgccagtgtcatagaccatacctatcctaataagcaggtcgtgcagctcatttctagtcagattgacgcagatcgcatggactatctcttgcgcgactcctattttacaggagcatcctatggggaatttgacctgactcgcatcctccgagtcattcgtcctgtcgaaaatggtatcgcctttcagcgcaatggcatgcacgccatcgaagactacgtcctcagtcgctaccagatgtacatgcaggtttatttccacccagcaacacgcgccatggaagttctcctacagaatcttctcaagcgcgccaaggaactctaccctgaggacaagaatttctttgcacgaacttccccacatctcctgcctttcttcgaaaaaaatgtgaccttgactgactatctggctctggatgatggcgtgatgaatacctacttccagctttggatgactagtcctgacaaaattcttgcagatttatctcaacgctttgtcaaccgcaaggtctttaaatccattaccttttcacaagaggaccaagatcaacttactagcatgagaaaattggttgaggacatcggctttgatcccgactactatactgccattcataagaactttgacctcccttatgatatctatcgtcccgaatctcaaaatccacggacacagattgagattttacaaaaaaatggagaactggccgaactctctagcctgtctcctatcgtccaatcccttgctggcagtcgccacggagataatcgcttttattttccaaaagaaatgttggaccaaaacagcatctttgcaagcattacccagcaatttttacacttgattgagaacgatcattttaccccaaataaaaactag

SEQ ID NO: 139 - DNA (genomic), 510 bp, Streptococcus pneumoniae; double-stranded, circular
  misc_feature (B) LOCATION 1...510
  hypothetical: NO
  anti-sense: NO
cacgcttttcctgatggggtgacgattgatgctcaattttcaacattgaatgggcgtcccctaacagaagctacagtcggagatgatttatatgctaccgagactgagtctccaacccaaaccattaaagtcggaaaacagcagatgaatggctcgaccctgctcaattatgctcgtttccgtgatgatgatgaggcggattacggccgtacaaaaagacagcaacaagttttaacagcaattttagagcaaattaaagatcccactaaacttttcactggttctgaagctcttggaaaggtttttgctatgacctcaaccaacgtaccttatactttcctcctaacaaacggtttatctgttttggatggagcaaaaaatggtattgaaaaattgacgattccagaactgggtgactgggtagacgcctatgatgtttatggaggcttgggcttgctggttgatcaaaacaaatatcaaaccaagctcgctcaaatgggcttgagataa

SEQ ID NO: 140 - DNA (genomic), 984 bp, Streptococcus pneumoniae; double-stranded, circular
  misc_feature (B) LOCATION 1...984
  hypothetical: NO
  anti-sense: NO
ggagcttttccaagtagagaggcaatttctctatttgattttccttcttttttcccatcttctaatcttaacatttggctatctacccaacctatcttggcacagatttatgccttccccttagctactgcaactatggctgctattttaagtttcttattttttttcctatctttttacaagaaaaataaacaaatacggttttactctggcattttgctcttactatcgctcatattactattattcggaacagataaaaccctttcttctgcatcaaataagactaaaaccttaaaattagtaacttggaacgtcgctaatcaaatagaagcacaacatattgagcgaatttttagccattttgacgccgatatggctatattccctgaactagctaccaatatcagaggtgagcaagaaaaccagagaatcaaactattgtttcatcaagttggactttctatggccaactatgatattttcacttctccacctaccaatagtggaatagctcctgtgactgtgattgtcaagaaaagttatggtttctatacagaagctaaaacttttcatacaacacggttcgggacaattgtattacattcgagaaaacaaaatataccagatatcattgccttgcatactgctcctcctctgccaggtttaatggaaatctggaagcaagacttaaacatcattcataatcaattggcttcaaaatatccaaaggctattattgcaggtgattttaatgcaactatgcgtcatggagcacttgcaaaaataagctctcatagggacgcattaaatgcactgccaccttttgaaagaggaacttggaatagccaaagtccaaaactttttaatgcaacaatagatcatattttattgcctaaaaaccactactatgttaaagatttagacattgtaagttttcaaaactctgatcatagatgtatttttacagaaatcacattttaa

SEQ ID NO: 141 - DNA (genomic), 216 bp, Streptococcus pneumoniae; double-stranded, circular
  misc_feature (B) LOCATION 1...216
  hypothetical: NO
  anti-sense: NO
tttgactttcctgatagagttgttcacatcttatttcaatctactatattttatagaacagactactctgaaagtagtttcagacctcttatgatttcgtatcagcttgaatgtcatcaaaaaaagatagcaggcttgaaaacctgctatctccttctatttttacaaaatcaaatgtttagaattcttctcttattgttctctctttttccctag

SEQ ID NO: 142 - DNA (genomic), 1308 bp, Streptococcus pneumoniae; double-stranded, circular
  misc_feature (B) LOCATION 1...1308
  hypothetical: NO
  anti-sense: NO
atgcaatttccagaaggatttgttgaaaaatataaagagatactaggagatgaggcaagagattttcttgcctcttttgaggaagaagcggtttcggcctttcgggtcaatcccttanaagaagaacaactttccttttctgatgccattactcaaaccccttggggccactatgggaaagtttcaggganatcgcctgancatgctacaggtttagtttatncgcaagaaactgctgctcaaatggtggctcaagtagcccaacccagtcctggtatgaaggtcttgaaattggctgctgcaccggggggcaaatcaactcaactggcagcctatctagcaggggaggggctacttgtttccaatgaaatttcaagcaaacgggctaagattttggttgaaaacatggagcgttttggagcgacaaatgtcgtggtgaccaatgaatctgccgaccgcttggtcaaggtctttaaaggctattttgacttaatcgttcttgatgccccttgctctggtgaaggaatgtttcgtaagcaacctgatgctatggactattggagcttagattatccgagtcaatgtgctagcttgcaaagagaaattctctgggaggatgcagtgaccatgttagctgaaggtggtcatctggtttattcgacctgtacctgggcacccgaggaaaacgaagagattgtcaattggttgctggaagagtatgattttgacttgttgccagtagagcatatcaatggaatggtagctggtattgacctgccagaaacggctcggatgtatcctcatcagtttaagggagagggtcagtttgttgcccatctacagtttaagggtaacaatccagctcctaaatttaaggcaagtaagagtaacctcagccgtgaacaagttgccttgtggcaggaatttgcccaaaaccatttgaaggtcaatctaccgggtatcttgcagacttttggagaccagctttatctcttgccagaacttttgccagatttagggaagctcaagattgctcgcaatggactgcatctgggcacttttaagaagaaacgctttgagcccagtttcgctcttggtttagccttgaaaccgagtcaggtcgaacagtcggttgaaattggccaagaagcgtttgtcaagtatgcggctggagaaatcgttcagctggcagaaagtctgccaaatggttggtaccaagttttggttaaaggcaatggcttgggctttgcaaaggttactggaaatgttttgaaaaattattttccaaaaggcctcagattcaaatga

SEQ ID NO: 143 - DNA (genomic), 360 bp, Streptococcus pneumoniae; double-stranded, circular
  misc_feature (B) LOCATION 1...360
  hypothetical: NO
  anti-sense: NO
ctatcgtttccaatagttatcccccgctaccaggcaggttacctacgcgttactcacccgttcgcaactcatccagagaagcaagctcctccttcagcgttctacttgcatgtattaggcacgccgccagcgttcgtcctgagccaggatcaaactctcattaaaagtttgagttctcactcatttctgtcactgacagatttattgtttttttcattgttcagtactacaacttatgttgtagcgccctgcacattggttcgtcttgttcagttttcaaaggtctttgtcacttgcttctctcaagcgacaactatattagtatatcacagccactttcacttgtcaacacttttttga

SEQ ID NO: 144 - DNA (genomic), 183 bp, Streptococcus pneumoniae; double-stranded, circular
  misc_feature (B) LOCATION 1...183
  hypothetical: NO
  anti-sense: NO
gcgcatttgtttcgtacctcgttaatattttttagaaaagatatcaaggtttctggtgggaaaacatcgttaaagtcaggtatgtttgtgcttataaaacttactaaatcccgtgcgatttcattttggagtgaattaggcaggttttcaataatcgtgcgtaaatctccaaactctagataa

SEQ ID NO: 145 - DNA (genomic), 768 bp, Streptococcus pneumoniae; double-stranded, circular
  misc_feature (B) LOCATION 1...768
  hypothetical: NO
  anti-sense: NO
aaggagcttcctagtatgggaacattttcagtcagacacctagacttattttacggggattttcaagccttaaaaaatatttcgattcaattaccagaaagacagattactgccttgataggcccatctggttgtggtaaatcaacttttctaaaaacccttaatcggatgaacgatttggttccttcttgccatattgaaggccaagtcctcttagatgagcaagatatttatagtagcaaattcaaccttaatcagctacgtaagcgtgtagggatggtttttcaacagcctaatccctttgccatgtctatctatgataacgtggcttatggcccaaggacacatggtattcgagacaaaaaacaattagatgccttagtggagaaatctttaaaaggggcagccatttgggaagaagtcaaagatgatcttaaaaagagtgccatgtccttatctggcggtcagcagcaacgcctttgcattgcgcgagctttagcagtagaacctgatattctgttaatggatgagccgacttcagccttagaccctatctccactttaaaaattgaagacctcattcagcaactaaaaaaggattatacgattatcattgttacccataacatgcaacaagcttcacgtatttcagataaaactgcttttttcttaacaggagaaatttgcgaatttggagataccgttgacgtgtttaccaatccaaaagatcagcgcacagaagactatatttcaggacggttcggataa

SEQ ID NO: 146 - DNA (genomic), 207 bp, Streptococcus pneumoniae; double-stranded, circular
  misc_feature (B) LOCATION 1...207
  hypothetical: NO
  anti-sense: NO
tttaacattcctaaaataattcctgatagaccaaaatctgcatctgagaaagttgatccttggaaaccgagtcctcccaaaactggcattaaaaagactggaagaaaactgattaaaataccttgtaaaaatgctccaatagtggctccacgaacaccaccagatgcattcccaatgacacctgcagtcgctccacagaagaaatga

SEQ ID NO: 147 - DNA (genomic), 888 bp, Streptococcus pneumoniae; double-stranded, circular
  misc_feature (B) LOCATION 1...888
  hypothetical: NO
  anti-sense: NO
aagccgattccctcaccgttaattcccatgcgcttgatttttaatggtattttttgtttcactttcagattcatacccctatcttatcacattttgagttataatagagctatgaaaatcacaaaacttgaaaagaaaaaaagactctatctgatggagcttgataatggcgacaaatgctatatcaccgaagatacaattgttcgttttatgttatcgagagataaggtgataagcgaagaggaattgaaagagattcaagactttgctcaattttcttatggtaagaatctggccctctaccacttatcctttaaagcacgcactgaaaaagaagtcagagaatatctgaaaaaatacgatattgataaaaacatcgtttctcaagttattgctaatcttaaagaagataagtggattaatgatggtcagtacgcttatgctatcatcaataccaatcaactttcaggagacaagggtccttatgtgctgactcagaaactagctcaaaaagggatttcaaaatctactatagaagagaacttgaaagaatttgatttttctgaagttgctcaacgtgtagctaataaactattgaaaaaatatgagggaaaacttccagctcgtgccctgcaagataagattatccagaacttgactaacaagggcttctcttattctgatgctaaaattgcctttgacgacttagatagccaagttgaccaagaaacgactcaagaactcatcttcaaggaacttgataagcaatatactaagtatgctcgaaagtatgaaggatacgaactgaagcagcgtttaactcaagttttagcacgaaagggctacgatttttcggatatagcaagcgctcttagagaatatctttaa

SEQ ID NO: 148 - DNA (genomic), 186 bp, Streptococcus pneumoniae; double-stranded, circular
  misc_feature (B) LOCATION 1...186
  hypothetical: NO
  anti-sense: NO
gcaatagttcctagaaaggctaggaaaaggaggaaaggatggcttgctaaatctacggctaaacgtttgagcgtctggtttacagtttgtcgtttcattctagtcctcctttccatgttgggatgcattgatttcacaatagacttggctggatttcatcaagtcatcgtgcttgccaacagctag

SEQ ID NO: 149 - DNA (genomic), 1080 bp, Streptococcus pneumoniae; double-stranded, circular
  misc_feature (B) LOCATION 1...1080
  hypothetical: NO
  anti-sense: NO
cccggctctcctattttcaaaaaatataggagaattaaaatggcagaaattacagctaaacttgtaaaagagttgcgtgaaaaatctggtgccggtgttatggacgctaaaaaagcgcttgtagaaacagacggtgacatcgaaaaagcgattgaattgcttcgtgaaaaaggtatggctaaggcagctaagaaagctgaccgtgttgctgcagaaggtttgactggtgtttatgttaacggtaatgttgcagcagttattgaagtaaacgctgaaactgacttcgttgcaaaaaacgctcaattcgttgaattggtaaatactacagctaaagtcattgctgaaggaaaacctgctaacaatgaagaagctcttgctttgataatgccttcaggtgaaactcttgaagctgcatacgtatctgcaacagcaactatcggagagaaaatctcattccgtcgctttgcattgattgaaaaaacagacgcacaacactttggagcataccaacataacggtggacgtatcggtgttatttcagttgttgaaggtggagacgaagcacttgctaaacaattgtcaatgcacatcgcagcgatgaaaccaacagttctttcttacaaagaattggatgagcaattcgttaaagatgagttggcacaattgaatcacgttatcgaccaagacaacgaaagccgtgcaatggttaataaaccagctcttccacacttgaagtatggatcaaaagctcaattaactgatgatgttattgctcaagctgaagctgacatcaaagctgaattggctgcagaaggcaaaccagaaaaaatctgggacaaaattattccaggtaaaatggatcgcttcatgcttgataacactaaagttgaccaagcttacacacttcttgcacaagtttacatcatggatgacagcaagacagttgaagcataccttgaatcagttaacgcttcggtagttgagtttgctcgctttgaagttggtgaaggtatcgagaaagctgcaaacgacttcgaagctgaagttgcagctacaatggcagcagccttgaataactaa

SEQ ID NO: 150 - DNA (genomic), 189 bp, Streptococcus pneumoniae; double-stranded, circular
  misc_feature (B) LOCATION 1...189
  hypothetical: NO
  anti-sense: NO
gggatgttgtttaggccgactcctccggttaccattacggaaacttgtgggatcggtgccttgactgcagagatatatgctggactgagagtactacctgggaagagtttgatgatttcactaccggcttcaagtgcagtcgtgatctctgtgagggtaatacagcctggaatgtacggtgtgctgtag

SEQ ID NO: 151 - DNA (genomic), 600 bp, Streptococcus pneumoniae; double-stranded, circular
  misc_feature (B) LOCATION 1...600
  hypothetical: NO
  anti-sense: NO
tcctgtactcctccccacctcccccgtccccactctggcgcgaggggcgcgacccgccgcaccccccagcgcagccggccgcagcctccccagatccgcggcaaccaaacggngcagcnggccaccacacacgcacccccccccgccccggcccncgcccacccgccacaacccagagcgcgccacgcagcccagcacagacagcaaggcgacgagccacccccgccccgcacgggacccccgggcccccgccccgcgacccccngccccccacagggagagaaaaccaagccaccccgacccaccaacgcaccaccgnggtccagcctcaccaanganattccaacnaagtcaataaagttcagaaggaagggaattnnggannggtcaggaagagccacttttgacaattttaaccaatgtagtaaacctcacccactcccaagtatcaggaatatcataaggaacatcaatttcttgagtacttccatcagcaaacttcccataatgtttcttatgtgcttcaagtatataaaaaggcgtaaaaatacgcctatagataatggggttgaaataggtttattgttgatgagattgtag

SEQ ID NO: 152 - DNA (genomic), 252 bp, Streptococcus pneumoniae; double-stranded, circular
  misc_feature (B) LOCATION 1...252
  hypothetical: NO
  anti-sense: NO
gtattcactccttggctgttaagaagcaatttcaatagtgagcgaagcaagagcactcctagagcagcaggcaaatccatgaccaccagacccacaaggactggcaagatactaaattcgatcttgaggaaagatgccgctggtaaaagcggaaagtcaaagtacatcagcacaaatgagatggctgataaaattgcaatggtcgaaagtcgacgtgtgtttgtcataacaggttcctccaattttctataa

SEQ ID NO: 153 - DNA (genomic), 225 bp, Streptococcus pneumoniae; double-stranded, circular
  misc_feature (B) LOCATION 1...225
  hypothetical: NO
  anti-sense: NO
acattcactccaaacaaagctgctgaaatcatcttgaaagttttgaactcagctgtagctaacgctgaaaacaactttggtttggataaagctaacttggtagtatctgaagcattcgcaaacgaaggaccaactatgaaacgtttccgtccacgtgcgaaaggttcagcttcaccaatcaacaaacgtacagctcacatcactgtagctgttgcagaaaaataa

SEQ ID NO: 154 - DNA (genomic), 348 bp, Streptococcus pneumoniae; double-stranded, circular
  misc_feature (B) LOCATION 1...348
  hypothetical: NO
  anti-sense: NO
gtaataactccttgccatccacccaccaaaaatcctgataaaatagctggtgtactccaaggcaatgttacccctgagaatggctgcatgaaacctgttgcaatagctccatatactatcacagctgcaagtacaggaacaagaatgaaaggtacaaacataactggattcatgacaatcggaaatccaaatacaactggctcatttacgttaaatattgctggaaaagctgcaacttttcctaaggcttggtattgttttgattttgctgcaaaaagcatggcaactacaagaccaaacgtaatccctgaacctgatagaattaaaaatgaatctaaaaattgttga

SEQ ID NO: 155 - DNA (genomic), 465 bp, Streptococcus pneumoniae; double-stranded, circular
  misc_feature (B) LOCATION 1...465
  hypothetical: NO
  anti-sense: NO
tttctagctccagctggaatttcagccaatgaagtaaagcaagatgtaacatctgaagtggtaataggtgtgctagattctaaggaggaattgaaagagtcagaaaatgatgctccaaaactagaaactcctcttagagaggagccaagactagctcctcaaacgcttccggaagcaagtgaagttcttgaaaacaaaagggaagagtcaaaagtagagataacagagccagctcaagcggatgatatccgcaaggttgttggggaattagccaaggatataagtattactaagttgtatatgacaggtcattctcttggaggctacctagctcagattgcagcggttgaagattaccaaaaatatcctgatttttataaccatgtattgaggaaagtgacaactttcagtgctcctaaagtcattacttccagaactgtttgggatgctaagaatggtttctga

SEQ ID NO: 156 - DNA (genomic), 537 bp, Streptococcus pneumoniae; double-stranded, circular
  misc_feature (B) LOCATION 1...537
  hypothetical: NO
  anti-sense: NO
gaacgagctccaccagcagccttgactcccatatcagatccaactgtttcacgcattaatctaacatctgctatcgtagcaccaccagttgaaaagccagtagatgttttaacaaagtcagccccagctttttgggccaattggcaaacaacaattttttcttggtctgtcagaaggcaagcttcaataatgactttcactaacttatcaccacttgcttccactactgcgcgaatatctgactcaaccaaggctaaattacctgatttgagagctccaacattgatcaccatatcaatctcatctgcaccattttggatagcttcttttgtctcaaatgctttcacggctgaagttgttgctcccaaagggaaacctactactgtgcaaaccttaacatctgtgccttcaagtccttttttagcatgttcaacccaggtcggattaacgcaaacactggcaaagtcatattctctagcctcagacaacaaactatcaatttgttttttctgtgcatcttgtttgcctagcgtatga

SEQ ID NO: 157 - DNA (genomic), 198 bp, Streptococcus pneumoniae; double-stranded, circular
  misc_feature (B) LOCATION 1...198
  hypothetical: NO
  anti-sense: NO
ttgttttatcctatttctatttcatttcactatataattgctattgttttctttttcatgattttaatcttactgtacagatttgatacagtaaactcctttctagctttatactttatcatttctaacttaattatagtcttatttttaataaagttcaattatttatatgtaaaattcctcatcagtaaaaaataa

SEQ ID NO: 158 - DNA (genomic), 399 bp, Streptococcus pneumoniae; double-stranded, circular
  misc_feature (B) LOCATION 1...399
  hypothetical: NO
  anti-sense: NO
ttgatttatcctgttcttatttcattttactatagttctatgaattatgaaggaagtaaacaactaactgatgcacgatttaaatgtcttgttggtgttcaacgcacgacttttgaagagatgttagctgtattaaaaacagcttatcaacttaaacacgcaaaaggtggacgaaaacctaaattaagcctagaagaccttcttatggccactcttcactatgtgcgagaatatcgaacttatgaagaaattgcggctgattttggtatccacgaaagcaacttactccgtcggagccaatgggttgaagtaactcttgttcaaagtggtgttacgatttcaagaactcctctcagctctgaggacacggtaatgattattgatgcgacggaagtataa

SEQ ID NO: 159 - DNA (genomic), 258 bp, Streptococcus pneumoniae; double-stranded, circular
  misc_feature (B) LOCATION 1...258
  hypothetical: NO
  anti-sense: NO
aaaggctatcccatgcatattcactataacacaaatcaaacaactttaccactagaaatcagttccttcttgccacaagatcatctcgtttttactattgaaaaagtggtgaataccttggaggattgtcacttccacgccttctatcatgcctttgatcgcccgtcttatcaccctaaaatgcttgtatctactcttctatttgcctattcacaagggattttctctggtcgaaaaattgaaaaatggaagagttag

SEQ ID NO: 160 - DNA (genomic), 531 bp, Streptococcus pneumoniae; double-stranded, circular
  misc_feature (B) LOCATION 1...531
  hypothetical: NO
  anti-sense: NO
aaaggctatcccatgcatattcactataacacaaatcaaacaactttaccactagaaatcaattctttcttgccgcaagaccatctcgtctttactattgaaaaagtggtgaataccgatgaaaaggaggtaaaccatctgattaaatatgccatgtttgataaggaacaaaagagaggctataaacagtcagctagaaacttagcgaattggcactataatgacaaggaggatagctatacacatcctgatggctggtattatcgttttcaccataccaaatatcagaaaacacagacagactttcaacaagaaatcaaggtttactacgccgacgaacctgaatcagcccctcaaaagggactgtatatgaacgaacgctatcaaaacttgaaagctaaagaatgtcaggcgcttttatctccccaaggtagacagattttcgctcaacgcaagattgatgtggaacctgtctttgggcagataaaggcttctttgggttacaagagatgtaatctgaggggcaagtga

SEQ ID NO: 161 - DNA (genomic), 183 bp, Streptococcus pneumoniae; double-stranded, circular
  misc_feature (B) LOCATION 1...183
  hypothetical: NO
  anti-sense: NO
ttgttgactttgtcagttttatctacaacctcaaaacagtattttgaactgtctgcgcctagctttctagtttgctctttgatttttattgagtataccactattttactccctctggcaagggactttgtctatgtggagggattgggctcctatgtggtggagcttttctgttctttctga

SEQ ID NO: 162 - DNA (genomic), 627 bp, Streptococcus pneumoniae; double-stranded, circular
  misc_feature (B) LOCATION 1...627
  hypothetical: NO
  anti-sense: NO
ttatgtctgttttctgtatgtctagcatttccccgtcgcttgtttgtttttgctgatgatagcttatcggcaaactctaaagttgtatctggtgaggctcagtttgagaatggctcatcagtgcggttcggagatacgcaagtaaatattttaagcgatgaagttcttgaggttgtcaatccagatggaagtgtagacactattgaacgacgtgctgacggcgtctatatcaatggggcattttatatggcttatcaaaagaatgaaatcgacctaaatatatcttttagatcatacgatcctaatgtttggaattacgtcaacacaatacatgggaataaacaagctaacacattcgctaacttcatgactggtgctggaatcagttatatgattggtaggataggtgctttattgggggggccatggggtgcaataattggtggagcatattttggtatacaagcttatcagtcttacttggattcacaaagcccatatccatactacataacaagtacttatatccatgttgctcaaagaaaatggaagtttatcactgaatactatagaaactcaaactatactgggtatgtaaaaaccgtaacaacctatgtgaatttctaa

SEQ ID NO: 163 - DNA (genomic), 396 bp, Streptococcus pneumoniae; double-stranded, circular
  misc_feature (B) LOCATION 1...396
  hypothetical: NO
  anti-sense: NO
gcacgccatcctctagtcctgtactcctccccacctcccccgtccccactctggcgcgaggggcgcgacccgccgcaccccccagcgcagccggccgcagcctccccagatccgcggcaaccaaacggngcagcnggccaccacacacgcacccccccccgccccggcccncgcccacccgccacaacccagagcgcgccacgcagcccagcacagacagcaaggcgacgagccacccccgccccgcacgggacccccgggcccccgccccgcgacccccngccccccacagggagagaaaaccaagccaccccgacccaccaacgcaccaccgnggtccagcctcaccaanganattccaacnaagtcaataaagttcagaaggaagggaattnn

SEQ ID NO: 164 - DNA (genomic), 1107 bp, Streptococcus pneumoniae; double-stranded, circular
  misc_feature (B) LOCATION 1...1107
  hypothetical: NO
  anti-sense: NO
ccaatcaatccatacttgcaacatcgttgcacatcttatttaggaggttcagtaatgaacaagaaacaatggctaggtcttggcctagttgcagtggcagcagttggacttgctgcatgtggtaaccgctcttctcgtaacgcagcttcatcttctgatgtgaagacaaaagcagcaatcgtcactgatactggtggtgttgatgacaaatcattcaaccaatcagcttgggaaggtttgcaggcttggggtaaagaacacaatctttcaaaagataacggtttcacttacttccaatcaacaagtgaagctgactacgctaacaacttgcaacaagcggctggaagttacaacctaatctttggtgttggttttgcccttcataatgcagttgaagaagcagctaaagaacacactgacttgaactatgtcttgattgatgatgtgattaaagaccaaaagaatgttgcgagcgtaactttcgctgataatgagtcaggttaccttgcaggtgtggctgcagcaaaaacaactaagacaaaacaagttggttttgtaggtggtatcgaatctgaagttatctctcgttttgaagcaggattcaaggctggtgttgcgtcagtagacccatctatcaaagtccaagttgactacgctggttcatttggtgatgcagctaaaggtaaaacaattgcagccgcacaatacgcagccggtgcagatattgtttaccaagtagctggtggtacaggtgcaggtgtctttgcagaggcaaaatctctcaacgaaagccgtcctgaaaatgaaaaagtttgggttatcggtgttgatcgtgaccaagaagcagaaggtaaatacacttctaaagatggcaaagaatcaaactttgttcttgtatctactttgaaacaagttggtacaactgtaaaagatatttctaacaaggcagaaaaaggagaattccctggcggtcaagtgatcgtttactcattgaaggataaaggggttgacttggcagtaacaaacctttcagaagaaggtaaaaaagctgtcgaagatgcaaaagctaaaatccttgatggaagcgtaaaagttcctgaaaaataa

SEQ ID NO: 165 - DNA (genomic), 1281 bp, Streptococcus pneumoniae; double-stranded, circular
  misc_feature (B) LOCATION 1...1281
  hypothetical: NO
  anti-sense: NO
caaatgaatccaatccaaagatcttgggcttatgtcagcagaaagcgactgagaagttttattttatttctgattttattggtcttattggccggaatttcagcctgtttgactctgatgaagtccaacaaaacagtagaaagcaatctttataaatcactcaatacatctttttctattaagaagatagagaatggtcagacattcaagttgtcagacctagcatctgtaagcaagattaaggggctggaaaatgtctctcctgaacttgagacggtcgcaaaactaaaagacaaggaagcagtgactggcgagcagagcgtggagcgtgatgatttatcagctgcagacaataacttggttagcttaacggctcttgaggattcatccaaggatgtaacctttaccagttcggctttcaatctaaaagaagggcgacaccttcaaaaaggggattccaagaaaatccttatccacgaagaattggctaagaagaacggtctttcacttcatgacaagattggcttggatgctggtcagtctgaatctggaaaaggacaaacagtagagtttgagattattggcatcttttctggtaaaaaacaagagaaattcacaggcttgtcttctgacttcagtgaaaatcaagtctttacagactatgaaagtagccaaacccttttgggcaatagtgaagctcaagtcagtgcagcacgcttctatgtagaaaatcctaaggaaatggacggactcatgaagcaggtagaaaacttggccttggaaaatcaaggctaccaagtcgaaaaggaaaacaaggcttttgaacaaatcaaagactcagttgcaactttccaaaccttcctgaccatcttcctttatgggatgttgatagcaggagctggagccttaattctggttttgtctctctggttgagagaacgggtctatgaagtggggattttacttgcacttggaaaaggcaagagctcgatcttcctacaattctgtttagaggtagttttggtatctcttggagctttgcttccagcatttgttgcaggaaatggaatcacaacttacctactccaaactctactagcaagtggagatcaggcaagcttacaagatacactagccaaagcaagcagtttatcaactagcatcttatcttttgcagaatcctatgtttttctagttctgcttagttgcttatctgtagccctttgtttcctattcttatttagaaaatcaccgaaagaaattttatcatctattagttaa

SEQ ID NO: 166 - DNA (genomic), 1176 bp, Streptococcus pneumoniae; double-stranded, circular
  misc_feature (B) LOCATION 1...1176
  hypothetical: NO
  anti-sense: NO
ctaaaggatcctattcaattactagaactatcacatactcaaggtcagctcacagatgagcaactattttggttacaatgtctactaaatttaagtcaaacaaataatttagtcaaaattaaaaaaatagaggaacataaatatgattacaaaacagaatgtaatagtgttctacaatttttactagataaaactgtaaattctgaaggaaggatcacttcttcaacagaatttggaaatttcgtaagtaatttatcattccaacacggaatagctggactactgtttcctctaaataaattgtaccccccagaactggattctaaaatactctctatcatcaagaaggcagtgacaattagaacgacacatacatatgaatatcaatactcactgctatttggtgatgcaggctatctatggttactcctacatttattttctatcagtaaaaatcaatactatctacaattagcaaacgtcaccgctaaaaaattaatagagaattatgatactctagaggaaatagactttgcattgggaaaatctggtgtcctattatcattaataaaatactatcaatttaccaatgacaatactcttaaaattttcatccacaatagtataggggaaatttatcattatttcctacaaagagatacagccaaagaaagcattttagactatagctttgctcatggatattgtggaattgcatatgctttatttgcctattctaaagtcttagaaccttctatgttctataatgatctccatacattccatactgaattaaaaaaattattagaaaaagttacttctaatactgaaaatttaggaaatttacaactttcttggtgcaaaggaatttccggaataatcttatatctttgtatgtacgattgtgacggaaacaaagatattattagtaaatatcaagaatttgtttttaaccatcatctaaaaatgatgacaggatattgccacggaataactagcttactacaaaccactgtctacaatcaaaacaaattactgatgaaaaaaatccaacaggtaattttagcatgttctgaacgagatgatcacggtttactgatgtttcaaggagatagtggtaaagcagatttgtttgacttcggaataggaagcatggggtatattggtgtctattaa

SEQ ID NO: 167 - DNA (genomic), 447 bp, Streptococcus pneumoniae; double-stranded, circular
  misc_feature (B) LOCATION 1...447
  hypothetical: NO
  anti-sense: NO
aagataagtccattgcggatgcacttgccaactttgctgaagaacaaggaaaaatcgcagaggagtcgtcaaatgagctcatctaaaacaatcggaattatcggtggcggtcaactgggtcagatgatggccatttctgctatctacatgggccacaaggttatcgcgctggatcctgcggcggattgcccggcctctcgcgtggcggaaatcattgtggcaccttataacgatgtggacgccctccgtcagttggcagaccgttgcgatgtcctcacttatgagtttgaaaatgtcgacgctgacggtttggatgccgttatcaaggatgacaactccctcaagaaacagattctgccgcatttcgcaaaatcgtattttagaaaaggactttttgtcaaacaaggctcaagtcactgtggcaccctacaaggtcgtgacttctag

SEQ ID NO: 168 - DNA (genomic), 300 bp, Streptococcus pneumoniae; double-stranded, circular
  misc_feature (B) LOCATION 1...300
  hypothetical: NO
  anti-sense: NO
gtacggagtccacgtatcgtatttgccaacaaaatggacaaaatcggtgctgacttcctttactctgtaagcacacttcacgatcgtcttcaagcaaatgcacacccaatccaattgccaatcggttctgaagatgacttccgtggtatcattgacttgatcaagatgaaagctgaaatctatactaacgaccttggtacggatatccttgaagaagacatcccagctgaataccttgaccaagctcaagaataccgtgaaaaattgattgaagcagttgctgaaactgacgagaattga

SEQ ID NO: 169 - DNA (genomic), 225 bp, Streptococcus pneumoniae; double-stranded, circular
  misc_feature (B) LOCATION 1...225
  hypothetical: NO
  anti-sense: NO
caagttggtccggaagttcaactcgttttcttagaccctccctataccaaggaacaaatcgtagcagatattgaaaaaatggctgagagagagcttttttctgaagatgttatggttgtgtgcgagacggataaggccgttgaacttccagaagaaattgcctgtctgggtatctggaaggaaaagatttatggaattagtaaggtgacagtctatgtcagataa

SEQ ID NO: 170 - DNA (genomic), 549 bp, Streptococcus pneumoniae; double-stranded, circular
  misc_feature (B) LOCATION 1...549
  hypothetical: NO
  anti-sense: NO
attaagacttttgtatcagcaaatttattggaaattttttcaaatacgatttgggtttcttccattatacttgtttttgtaacggagttattaaataaaacggaaagttactggggatattctaatacagcatactctattggtattataattagtggcttaattgcttttaggctatctgaaaagttccttgctgctaaatgggaaagtattctttttcctcttgtagctatggcaatagtgacactgactattctatattttccaaacgcacagatgtttttattattttcagctttagttggtatgttatcgcaactaaaagaagttcctgaaagtgtatttcttcaggaaacagtagaggaaaatcatttagttaatgtctattccgttcttgaagtgatttctacattagcattttcagtatttgttttgctaatgagctatattactgagagttttggtattagcatcagtttttggctatcagccatttgtctgatgatagaagctattttaatttatatcagacgagattattttaaatga

SEQ ID NO: 171 - DNA (genomic), 903 bp, Streptococcus pneumoniae; double-stranded, circular
  misc_feature (B) LOCATION 1...903
  hypothetical: NO
  anti-sense: NO
gtctatatgttacttgaaatttcgataaaaaactttgccattattgaggctatttccctcaattttgaaaaggggatgactgtcctgactggtgaaacgggtgcagggaagtcgattatcattgatgccatgaatatgatgttgggagctcgtgcgacgacagatgttattcgtcatggtgcaccaaaggcagagattgaggggcttttctcagttgagaatagtcgtcttttacaggaaatttttgatgagcaaggtttagagttaggtgatgaaattatcatccgtcgggaaatcttgcaaaatggtcgtagtatcagccgtgtaaatggtcagatggttaatctgtctgttttgcgagctattgggcaacatcttgtagatattcatggtcagcatgaccatgaggagttaatgcgtccccaactgcatatccagatgttggatgaatttggtgatgccgctttttgggacttgaaagaaacctatcaaacgagttttgatgcctatcggaaaatgcgcaagcaggttctggaagtcaagaaaaaccaacaggaacacaaggcacgtatcgaaatgttggaatttcaaatggcagagattgaggcagcaaacttgcaggctggagaagacttggatctcaatcaagagcgagataaactcctcaaccacaaaaatattgcggatacactgaccaatgcctacagtatgttggacaatgaagatttttcaagtctggccaatgttcgttcagccatgaatgacatggaaagtgtcgaagagtatgaccctgaataccgtgaaatttcaagctctctgtctgagacctactatgttttagaagacattagcaaacgtttggaagctatcattgaggaccttgattttgatggcaatcgctga

SEQ ID NO: 172 - DNA (genomic), 1995 bp, Streptococcus pneumoniae; double-stranded, circular
  misc_feature (B) LOCATION 1...1995
  hypothetical: NO
  anti-sense: NO
attagtatgtttcgattaaccaataagttagcggtatcgaacttgattaaaaaccgcaaactctactatccttttgcgctggctgttctcttggcagtcactctcacctatctcttttactctctaaccttcaatcctaagattgcggaaatccgtggaggaacaaccattcaggctacacttggatttggtatgtttgtcgtcacccttgcgtcagccattatcgttctctatgccaatagttttgtcatgaagaaacgttccaaggaactaggaatttatggcatgttgggcttggagaagcgtcatcttatcagtatgacctttaaggagttagtggtatttgggattctaactgttggagcgggtatcggtattggagccttgtttgacaagttaattttcgctttcctgctcaaactaatgaaattgaaggttgagctggttgctaccttccagacgaaagttgtcattacagtgcttgttgtcttcggtttgattttcctaggcctcatgttcctgaatgcccttcgaatcgcccgtatgaatgccctccagctctctcgtgagaaagctagtggagagaaaaaaggtcgcttccttcctctccaaaccattcttggttccataagtttaggaattggctattatcttgcccttacggtaaaagatcctcttacagccttaacaaccttcttcatagctgttttactggttatctttgggacttatctcttgtttaatgcagggattaccgttttcctccaaatcttaaagaaaaataagaaatactattaccaaccaaataacctcatatctgtttctaacttgattttccgtatgaagaaaaatgcagttggactagcaactatcgctattttgtcaacaatggttttggtaaccatgtcagcagcgacaagcattttcaattccgcagaatcctttaaaaaagttctaaatcctcatgattttggggtttcaggacaaaatgttgaaaaagaagatttggacaaactcttgagccagtttgcaagtgacaatggttataagattaaagaaaaagaagtgtttcgttacacttactttggtgttgcgaaccaagaaggaaataagttaaccttttttgaaaaaggacaaaatcgtgtccaacccacaacagttttcatggtatttgaccaaaaagattatgaaaatatgactggtcaaaaactgtctctatcaggaaatgaggtcggtctctttgccaaaaatgacggactgaaaggacagaaaactctaattctgaatgatcatcaattttctgtaaaagaagaatttaataaagattttattgtcaaccatgtcccaaatcagtttaatattttgactgctgattacaattaccttgttgtacctgatttacaagcctttttgaaccaattcccagattcggatatctataatcagttttacggtggtatgaatgtaaatgtcagtgaagaagaacaactcaaggtcgctgaggagtatgaaaactacctcaatcaatttaatgctcaattagacacagaaggtagctatgtttatggtagcaatctagcagatgctagttctcagatgagtgccctctttggtggtgtcttctttatcggtattttcctatccattatctttatggtcggaactgttctggtcatctactacaaacaaatttctgaaggctacgaagaccgtgaacgctttattatcttgcagaaagtcggtttggaccaaaagcaaatcaagcaaaccatccacaaacaggttttaactgttttcttccttcctttgctctttgccttcatacatctcgcctttgcctaccatatgcttagcctgattttaaaagtgattggtgtactggatacgactatgatgttgattgtgaccttgtctatctgcgctatcttcctcatcgcctatgtgctgattttcatgattacttcaagaagttatcgcaagattgtgcaaatgtaa

SEQ ID NO: 173 - DNA (genomic), 192 bp, Streptococcus pneumoniae; double-stranded, circular
  misc_feature (B) LOCATION 1...192
  hypothetical: NO
  anti-sense: NO
acattcatgtttttatcagtattttccttttctttgcccttatttcaggagctgtttctcatacagttttactactcctactcctctttcttcctgcgctcaataaaggacttgagaaaatacaatcaaaacggatacctgtcctcaacgcagccctcttctttctcctcatatcctttccacaacttttaa

SEQ ID NO: 174 - DNA (genomic), 213 bp, Streptococcus pneumoniae; double-stranded, circular
  misc_feature (B) LOCATION 1...213
  hypothetical: NO
  anti-sense: NO
atatccatgttttctcttgtccttattttaaccattcaggaaatttcgagaaccctctacaatttccagtcaaataaattgcattcgttttctcaagcaggtatactagtatggataaataaaaaatttagaaaatttaagaatagaaaagagaacaaatcttatggcaaaagatattcgtgtcttactttactacctttatactccaattga

SEQ ID NO: 175 - DNA (genomic), 348 bp, Streptococcus pneumoniae; double-stranded, circular
  misc_feature (B) LOCATION 1...348
  hypothetical: NO
  anti-sense: NO
tcgttaatgttggaacaggcattcaaagagaagcactacgagaatacgattctccatagtgaccaaggctggcaataccaacacgattcttatcatcgcttcctagagagtaagggaattcaagcatctatgtcacgcaaaggaaacagccaagacaacggtaggatggaatctttctttggcattttaaaatccgaaatgttttatggctatgagcaaacatttaaatcacttaatcaattggaacaagccattatagactatattgattattacaacaataagagaattaagataaaactaaaaggacttagctctgtgcaatacagaactaaatccttcggataa

SEQ ID NO: 176 - DNA (genomic), 789 bp, Streptococcus pneumoniae; double-stranded, circular
  misc_feature (B) LOCATION 1...789
  hypothetical: NO
  anti-sense: NO
ccttgtttcccaaaaatacggagaagcgaaggctcaggaactttttatagacaatcctcgaaaaattgtaatggatcaactaatttaggagaaatgatgaaagaacaaaacacgatagaaatcgatgtatttcaagtacttaaaaccttgtggaaacacaagttaataattttattagtggcgcttgtgacaggggcgggagcttttgcatatagcacttttattgttaaaccagaatatacgagcaccacgcgtatttacgtcgtcaaccgtaatcaagaaggtaagtcgggactgacgaatcaggacttgcaggcaggaacttatctggtaaaagactaccgcgaaattatcctttcgcaagatgtattggaaaaggtagcgacaaatttgaaattggatatgccagcaaaagcgttaactagcaaagttcaagtgactgtaccaaccgacactcgtatcgtctcaatctctgtcaaggataaagaaccagaggaagccagtcgcattgctaattctctacgagaagttgctgcaggaaagatcgtcgctgtaacgcgagtatctgatgtaacgacgcttgaagaagcgcggccagctacgactccctcttctcccaatgttcgacgtaacaccttagttggttttcttggaggagccgtcgtaacagtaattactgttcttttgattgagttgctcgatacccgtgtgaaacgtcctgaagaagttgaagaggtgctgcaagtgccacttctaggagtcgttccagatttggataaaatgaaatag

SEQ ID NO: 177 - DNA (genomic), 831 bp, Streptococcus pneumoniae; double-stranded, circular
  misc_feature (B) LOCATION 1...831
  hypothetical: NO
  anti-sense: NO
aaaatcttcccaggccttgatanatatgactttgatgctgctaaattgaacaagaaaatcggtttctggggatctaaattcttcatcggtttcatccttggtatcgttattggtattatgggaactccacatccaattgcaggtgttgcagatgcagataaatggcgtcttgttatcaaaggatggttgtctcttggtttgactgccggtgtatctttggaactcttctcacttatcggttcatggttcatcgcagccgtagaaccactatcacaaggtattacaaacgttgctactaaacgtcttcaaggacgtaaattcaatatcggtcttgactggccattcatcgctggtcgtgctgaaatctgggcttgtgccaacgtacttgcaccaatcatgttgattgaagcagtgcttctttcaaaagttggaaatggtatcttgccacttgcaggtatcatcgctaggggtgttactccagctctcttggttgtaactcgtggtaaattgctccgtatgattatcttcggaacactcttgttgccactcttccttctttcaggtacacttattgcaccatttgcaacagaacttgctaaaggtgtaggtgccttcccagaaggtgtgagccaaactcaattgattactcactctactcttgaaggaccaatcgaaaaacttcttggttggacaattggtaacactacaactggtgatatcaaagcaatccttggtgcagtagccttccttgtattctatatcggtatctttgcttggtacagaaaacaaatgatcaaacgtaacgaagagtacgcagcaaaagcaaaataa

SEQ ID NO: 178 - DNA (genomic), 198 bp, Streptococcus pneumoniae; double-stranded, circular
  misc_feature (B) LOCATION 1...198
  hypothetical: NO
  anti-sense: NO
acttcgctccccatcacagctcaatgttatagaattaagcatttgactcaattcacacctcactgcttagacagactcttccaatcgtctgctttagttagcctactgcgtccctccatcactacatactctagtacaggaatatcaacctgttgtccatcggatacacctttcggtctctccttaggtcccgactaa

SEQ ID NO: 179 - DNA (genomic), 636 bp, Streptococcus pneumoniae; double-stranded, circular
  misc_feature (B) LOCATION 1...636
  hypothetical: NO
  anti-sense: NO
agtaagatgtttcataaagaattactaaaactatattttatttgtggaacgactacttgccaaggaaaaaatctatatacagtcgttgaggaagccttaaaaggtggtataaccttatttcaatttcgagaaaaaggtgagagtgctttagaaggcttagaaaaacttgagctagctatccaaattaaagaactttgtaaaaaatacaatgttccatttatcgttaatgacgatatagatttagcaatggaaattgacgccgatggcgtacatgttggtcaagatgatattggtgttgatgaaattagaaaattgatgccagataaaataattggtctttctataagaaacgaagaagaatttcaacaatcaaaagttgaatatgtagattatgtaggtgttgggcctgtatttgatacccagtcaaaagatgatgctggtggtgctataggttatgaaggtcttgaattgatgagaaaactattgccacaaatgcctttagttgcaattggtgggatacagacgaaacatattaaagacattataaagaccaatgttgacggcgtttcaatcatttcggcaatatcgtatgcaaaaaatatagaaaaaactgttcgggaaatgagtgaacaatag

SEQ ID NO: 180 - DNA (genomic), 1332 bp, Streptococcus pneumoniae; double-stranded, circular
  misc_feature (B) LOCATION 1...1332
  hypothetical: NO
  anti-sense: NO
aggcggatgtttctggaacggtggtgtttgcaaatgagtcagacatatcagattaaacaaaacgatattgtcgttgacttacctaagacagtaggagctggatacggacagttctggcgctcaagaagtctttatcgtgtagtcaaagggtcccgtggttcgaagaagtccaagacaaccgctttgaattatgttatccgtcttttgaagtatccctgggccaacttgcttgttattcgtagatactcgaataccaacaagcaatcaacttatacggattttaaatgggcgtgtaatgtgttgggtgtgactcatttgtttaaatttaacgagtctttgcctgaaataaccataaaagcgactggtcaaaaaatcctattccgtggtttggatgatgaactcaaaattacatctattacagtcgatatcggtagtctgtgttgggcatggttcgaggaagcatatcaaattgagactgaagacaagttcagcacggttgttgagtctatccgtggtagcttagatgtacctgatttctttaaacaaatcacagtcacatttaacccgtggaatgagaggcattggctcaagcgtgtattcttcgatgaagagacgagacgggctgacacattcgctactacaaccacttataaatgcaatgagtggcttgatgaagtcgatatcaaacgctatgaggatttgtatcatacgaaccccagacgtgctagaatcgtttgtgatggcgaatggggagttgctgaaggtttaatctacgaaaacgtgactgtcaaggatttcaataaagatgaattactacaagattcagctaataaattatgtatcggtcttgactttggttttactcatgatccaactgctttgtgttgttcgttgataaatgacacgacgaaagagatttatgtctttgatgaggcgtataaagtcggattgataaccaaagaagttgcgaagatgataaaagacaaaggttatcatcgctcacaaatcattgctgatagcgcagagtcacggctgattgaagagctcaggtcagaacatggcatatctagaataaaagagagtcggaaaggtaaggatagtattatggcaggcgtatccaaattgcaaggatacgctatttatgtgcatccagattgtaaaaacatcatggatgaattttatagttactgctaccagcgagataaagaaggcaactggttgaataaaccagaggataaaaacaaccacttgatggacgctttgcgttacagccttcaatgtatcgaaggtggaaaagcaaccgtccgcagacgttctgattatggtctatag

SEQ ID NO: 181 - DNA (genomic), 393 bp, Streptococcus pneumoniae; double-stranded, circular
  misc_feature (B) LOCATION 1...393
  hypothetical: NO
  anti-sense: NO
aagcaaatcccgatattccgaggaggtggttgcatgaagaaagtgaaattagggcaagtggctacttttatcaatggctatgcttttaaacctcaagattggtcatctgaagggaaagagattatcagaatacagaatctgactaaaacttcaaaagggataaattattattcgggtacgattgataaaaaatacattgttgaagctggtgatattcttatttcgtggtcgggtacattaggggtttttcagtggtgtggaagatccgcagtgttaaatcagcacatttttaaagtggtttttgataagatagatatagataaatcgtattttaaatatgttgttgaaaaaggtttacaagatgctgtaaaacatactcatggtcaacaatga

SEQ ID NO: 182 - DNA (genomic), 1566 bp, Streptococcus pneumoniae; double-stranded, circular
  misc_feature (B) LOCATION 1...1566
  hypothetical: NO
  anti-sense: NO
aggagaatccctattgtgtcaaataaaccaatagcagatatgattgaaaccattgagcattttgctcagacacagcctagctatcctgtctataatgttttggggcaggaacacacttatggcgatttaaaggctgattcggatagtttggctgcagtcattgaccaactaggcttgcctgagaagtctcctgtggttgtttttggtggccaagaatatgaaatgttggcaacctttgtagcgctgactaagtcaggtcatgcctacattccaattgatagccattcggccttggagcgagtttcagctattttagaagtagcagagccaagcttgattattgccatttcagcctttcccttggagcaggtttctacaccaatgataaatctagctcaggttcaagaagcctttgcccaagggaacaactatgaaatcacgcatccagtcaagggagatgataattactacattatctttacttctggtacgactggtaagcctaagggagtgcagatttcacatgataatctcctcagctttacaaactggatgattacggataaggaatttgcgacaccgagtcgtccgcaaatgctggcacagccaccttattcttttgacttgtctgtcatgtattgggcaccgaccttggcacttggtggtacgcttttcactcttccttcagtcatcactcaggactttaagcaactctttgcggctatcttttcattgccaatcgctatctggacatcaacaccatcctttgcagatatggccatgttgtctgaatacttcaacagtgagaaaatgcctggaatcacgcatttctactttgatggtgaagaattgacggtcaaaacagctcaaaaactgcgcgagcgtttcccaaatgcccgtatcatcaatgcttacggcccaacagaagcgacagtagctctgtcagcagttgccgtgacagacgagatgttagcgactctcaaacgcctaccaatcggctataccaaggctgattctccaacctttatcattgacgaggaaggaaataaactgccaaatggtgagcagggagaaatcattgtttctgggccagctgtttcaaaaggttatatgaacaatcctgaaaaaacagcagaagccttctttgagtttgaaaatctgccagcctatcacacaggcgatgtgggaaccatgacagatgagggcttgcttctctacggcggacgcatggacttccagattaagtttaacggttaccgcattgagttagaagatgtctctcaaaacctcaacaagtctcgctttatcgaatctgctgtcgcagtaccgcgctataacaaggaccacaaggtacaaaatctattggcttatgtcatcttaaaagacggtgttcgtgagcagtttgagcgagatatcgatattaccaaggccatcaaggaagacctgacagacatcatgatgtcctacatgatgccatctaaattcctttaccgagacagtttgccactaactccaaatggaaagattgacatcaaaggattgattaacgaggtgaataagagatga

SEQ ID NO: 183 - DNA (genomic), 3093 bp, Streptococcus pneumoniae; double-stranded, circular
  misc_feature (B) LOCATION 1...3093
  hypothetical: NO
  anti-sense: NO
cactatgtgttccagaatatcttacaaaattatttgttattgaggaagttgtatgtaaataatgaggaaataaaaatggaaaataaaaaaatagcaaaacagattttaatagctacggctgttttaacaagttttttaggaagtaatttggtttatgcagatgtagttcaaagtaattctaataacagagctagtactgaaactgctagagtaacagggaataacttagaaaaacttattactaaagataaagaaattgataaagagatgacatatctttcagatatggattggtcttctgcaactcatggtgatatagataaaacaaaaacagtacaaaaagatgctccatttacaacaggaaataaaggagagcatactaagatttcattgctcacttctgatgataaagttaaatattttgataaaggaataggaacagtcgcagattctccatcagtaatcagctatgatatcagcggtcaagggtttgaaaaatttgaaacttatataggaattgatcaaagtgctaatagttctagatcagaccatgcagtagtggatagaatagaaatagaaattgatggaaaggttgtctattctagtagtgtaactaatccagaaggattcagatataatacccaggcacaatttattagtgtgacaattccacaaaacgctaaaaaaatatccttaaaatcattcgcaggagaacatacatggggtgatgaggttgtatttgctgatgctaaacttattaaaactgttagtactcaaactataactccagatcttcttaataaaggaattaatggaggagtatatctttctgatttagaatgggttgatgctactcatggtgatgacgataaatcaaaaacagttcagaaagataaaccgtttacacctggtaataacgggtctaataataaaataaaattactaattgacggtaaggaagtcgaatttaataagggattgggaactgtagcaagtaacccgtctagtataaaatatgatgtttcgggtgctaatgttacaagatttatttcctatgtcggaattgataggagtgcaaatcatttaaattcagattacgcagatattcaaaaatttgaagttgttgcggatggtaaagtcatttactcatcagattcaaaatatccaaaaggaattaagtatgatatatcggcatttctggttgatgttgaaattcccaaagatacacagacaatagaacttaaatcatattcagggaaatatacatgggctgacgaattggttttaggtggagccttgtttatggcaaatggtaaatttaagaatcctaatgattggtcagaagttgataaacgtcgtgaaattaataatgaacatccgttacttatgatgcctttatatgctaacggagaagagtttaaccaagggaaatatactttttggggaggagatacattaacaggtaagtgggagaatataccagatgacttaaaaccatatactgttatacagttacatccagatgatcttcctaaaagagatggagctgctagagatttttatgaacatatgctagaagaagcagcgaaatatgtaaatcctaagactggaaaaaatgaacctattccagttattctaacggtttacactgctggtaatatgccttattatacttcggcacattggttaagtaccagctggattgataaaatgtatcaaaaatatccaaatttgcatggtattttcagtactgagaattattggatttgggcaaatgatattgaaaataaggcggcagattacttaaaagtatcagctaaaaatggaggatattttatatgggctgaacaaaataatggttctgcaatagaaaaagcatttggaaaaaacggtaagatagcatttcagaaatctgttgataagtactggaagaaccttattttcatgttcaaaaatacacctgctgctgagggaaatgattcaactacagaaagttatatgaagggactttggctttcaaatcatacttatcaatggggtggtttgatggatacttggaagtggtatgagacaggtaaatggaaactgtttgcaagtggtaatatcggaaaaagtcaaggagatagacaatggttgactgaaccagagtctatgctaggagaagaagctttaggggtttaccttaatggaggtgtagtttataattttgaacacccagcttatacctatggtgtaaataataaagaaagcttactctttagcgaagtaataaaagaattttttagatatgtaatagcgcatccagcaccatccaaagaaaaggtacttgaggatacaaaagtattcatacatggagactattcaaataaaggaaatggtaagttctttgtaaacgtaaatactgatagagaacaaactccattatacatgactggtcgttataatgttattccagctattccaggtgttttaaaaacagataaattgaaagagtctgtttctggtagccgtattcagattaaggaaatcacttctccagaatttagctctactcaggctagaaaagaatacttaaataagctgtatcctatgaattatgaaggagatatctttgctcagaaattagataatagatggtttgtctataattataaggtaaatgagaatgttaaacagactgggaaattaaaatttaattctttagaaatggatgttgaatttgaacctcatacctatggtatttttgagagaataagtaatggattgaaagtgaatttaaataattttagaacaaataaagattcactatggtctaatgctcaagatgcaaatcaggcaaagaaactaccacaattgaccaagaaaggtgcgattaagtggattgaagaacattatatcaaagatactcagtttggagagaaaagggttacaaagatagtattaagaggtatagataaacttcctactattcattcattatcaggaacaaataattcctatgatcagccatctctcaattttgatcagaaaaatcatatggttactattaccattaacagtaacggaaatcttgaattcgaacttcatttttag

SEQ ID NO: 184 - DNA (genomic), 282 bp, Streptococcus pneumoniae; double-stranded, circular
  misc_feature (B) LOCATION 1...282
  hypothetical: NO
  anti-sense: NO
ccccccccccccccncccnccccnccccccccccccncccccccccccccccnncccncccccccccccccccccccccccccccnccccccccccccccccccccccnncnccccncnccccnnnnncccncnnnnnnnnnnnncnnnnnnnnnnnntttttttgnnnnnnnnnnnnnnnnnnnnnnnnnnnnnnnnnnnaacttaggattgctaggcagaaagacattggccaacatatggtcaatacggccacccaaggcaccgaaaatagtaacctga

SEQ ID NO: 185 - DNA (genomic), 209 bp, Streptococcus pneumoniae; double-stranded, circular
  misc_feature (B) LOCATION 1...209
  hypothetical: NO
  anti-sense: NO
cccccccccccccccncccnccccnccccccccccccncccccccccccccccnncccncccccccccccccccccccccccccccnccccccccccccccccccccccnncnccccncnccccnnnnncccncnnnnnnnnnnnncnnnnnnnnnnnntttttttgnnnnnnnnnnnnnnnnnnnnnnnnnnnnnnnnnnnaacttag

SEQ ID NO: 186 - DNA (genomic), 624 bp, Streptococcus pneumoniae; double-stranded, circular
  misc_feature (B) LOCATION 1...624
  hypothetical: NO
  anti-sense: NO
attgtctacccctttttttgtgtttcggaggtaactatgaaaagaataattccagtttatatattccaacaagtaaatgtcctattggtatctctatacttattgaaatttctttgtatcggtgagttaactatactacagattctctatggttcgtcactcatttcttttttatggatgtatggccaacgcaaacaagctcataaggtaaatatgaaatctaggatgaaatggcttggtattggattcgttagcctactgattataagtctatgttttagcctaatccatgcgcaagaaagcacgaatcaagcaaacttaattggacttcaacatcaagttccttggttttcatttttattgtttttaatcaatgcgagtatggttgaagaatttctgtatagagaaattttatggaacttggttagaaaattagatattcgagttgctttgacaagtgttttatttgccttagcacatcatccaggaaccattatagcttggtgtttgtatgtatcgctggggatgtttttagggcttgtacgctacaaattggacttatggggcagtatggggctacatttggtgtggagcctactagtttatagtttgctgcttttttaa

SEQ ID NO: 187 - DNA (genomic), 1110 bp, Streptococcus pneumoniae; double-stranded, circular
  misc_feature (B) LOCATION 1...1110
  hypothetical: NO
  anti-sense: NO
atccaatacccgtggtggaagatgtcaaatgtgatttgtagtgattcaagttactcttttcacaataaaaatttcatgattttcataaggaggaaatcactaatggtagttaaagttggtattaacggtttcggacgtatcggtcgtcttgctttccgtcgtatccaaaacgtaaaaggtgttgaagttacacgcatcaacgaccttacagatccagttatgcttgcacacttgttgaaatacgacacaactcaaggtcgtttcgacggtactgttgaagttaaagaaggtggattcgaagttaacggtaaattcgttaaagtttctgctgaacgtgatccagagcaaatcgactgggctactgacggtgtaaaaatcgttcttgaagctactggtttctttgctaagaaagaagcagctgaaaaacaccttaaaggtggagctaaaaaagttgttatcactgctcctggtggaaacgacgttaaaacagttgtattcaacactaaccacgacgttcttgacggtactgaaacagttatctcaggtgcttcatgtactacaaactgcttggctccaatggctaaagctcttcaagataactttggtgttgttgaaggattgatgactactatccacgcttacactggtgaccaaatgatccttgacggaccacaccgtggtggtgaccttcgccgtgctcgcgctggtgctgcaaacatcgttcctaactcaactggtgctgctaaagctatcggtcttgtaatcccagaattgaacggtaaacttgacggatctgcacaacgcgttccaactccaactggatcagttactgaattggtagcagttcttgaaaagaacgttactgttgatgaagtgaacgcagctatgaaagcagcttcaaacgaatcatacggttacacagaagatccaatcgtatcttcagatatcgtaggtatgtcttacggttcattgtttgacgcaactcaaactaaagttcttgacgttgacggtaaacaattggttaaagttgtatcatggtacgacaacgaaatgtcatacactgcacaacttgttcgtactcttgaatacttcgcaaaaattgctaaataa

SEQ ID NO: 188 - DNA (genomic), 963 bp, Streptococcus pneumoniae; double-stranded, circular
  misc_feature (B) LOCATION 1...963
  hypothetical: NO
  anti-sense: NO
accgcccacccgccgcggctatccgccatcggtgttcgccgcgctgccacgcttgatggagcgtgccgggcaatccgagcggggctcgatcaccgcgctctacaccgtgctggtggaaggcgacgacatgagcgagccggtggccgacgagacccgctcgattctcgacgggcacatcgtgctgtcgcgcaagctggccgccgccaaccactatccggccatcgacgtgctgcactcggtgagccgggtcatgaaccagatcgtcgacgacgatcagcgccatgcggccggacgcttgcgcgaatggctggcgaagtacgaggaagtcgagttgctgctgaagatcggcgaataccagaaaggccaggacagcgaagccgaccaggccatcgagaagatcgcggcgatccgccagtggctgcgccagggtacccacgaaaccagcgattacgcacaggcctgcgcgcagttgcggagcctctgcgcatgagcctggcgctgctgttgcgcgtccgacgcctgcgcctggaccgggccgagcgcgcccagggccgccaattgctacgggttcgcgccgcggcgcaggaacacaccgagcgccaggcggcgcaacgggactaccgcgactggcgactggccgaagagcaacggctgtttctcgcctgccaggcggccatgctcgaccgccggcgcctggaagcctggcagcagcaggtaggactgctgcgggaaaaggaagccggcctggaacaggactgcgccgagaccgcgcagcgcctcgaaggggagcgcgagcgcctgcggcagtgccggcgagaactgctggaacgccagcggcaactggagaagttcgccgaactggagcgccacgtcgacgccgagcgccaggggctgcgcgaacgcagcgaggaaggcgaactggaagaattcacccgccacgagacctggccatgctcaagctga

SEQ ID NO: 189 - DNA (genomic), 204 bp, Streptococcus pneumoniae; double-stranded, circular
  misc_feature (B) LOCATION 1...204
  hypothetical: NO
  anti-sense: NO
gcttttaaccctatcaataatgtggcttttcaaccacgcttcggcattcaaccctgcctgtccgtaggcattttttactcgggtttatatttgctagaaaacatcatctcattttctaagctttattactatatcatgtttttaagaacttgtaaagtattttttgataaaaaacaaaaatataatagattgaaactagaatag

SEQ ID NO: 190 - DNA (genomic), 459 bp, Streptococcus pneumoniae; double-stranded, circular
  misc_feature (B) LOCATION 1...459
  hypothetical: NO
  anti-sense: NO
ccaaacaacccttttgtgttttgcttagaagcggataatcaagaacaactctttgatcaggtagcaagcttgttggaagaacgagaaattgtcactcctacttatcgtgaagccttgatcacgcgtgaaaagtcatttccaactggtttagatatggaatttctaggaaaggacttgccaaatgtagcgattcctcacacagatattgttcacaatctggctgaaaaagttgtggtcgttcgattagagaaaccggtgactttccataatatgattgcgccaggtaaggaagtagaagtatccttgctcttctttatcatcaataattcaagttcaagtcaaacaaatattctggctcagttgatggactttttcacaggaaatggtcatcttgaagacctatcaaaaatttctgaaccagaaaaactttatgcttacattgctgaagcaaccgcttaa

SEQ ID NO: 191 - DNA (genomic), 747 bp, Streptococcus pneumoniae; double-stranded, circular
  misc_feature (B) LOCATION 1...747
  hypothetical: NO
  anti-sense: NO
actccaaaccctcctctacttcatgcgaaaagaggattagaaagcgaaaatcattttatgaaaaaaccagttattgggattacaggaaacgaaaaaactcatccagatgatgacatcatgatgagctacgcagcaaaaggctttgttgaaggcgttaaagatgctggagggattcccatcatcctaccgattggtgatcaagaaatggcctgccactatatcagtttgattgacaagctcatcttaacaggtgggcaaaatgtcgatccaaaattttatggcgaacccaaaaccattgatagcgatgactatcaccttcaaagagatatcttcgaactggccctcatcaaggaagctattaaacagaaaaagcccattttctctgtctgccgtggtacccaactctttaacgttgccatgggtggaactttgtaccaagatatcgaagaccattggcaggattcttctgttgagtacacaactcaacgcttggtgacagaaccagataccgttctccaagaaatctatggagaaatctctcatatcaactccttccaccaccagagcatcaaggacttagcaccaaatttaaaagttgtggctcatgatcctaaagatggtatcattgaggctgtcatgagtacggatgatgtcgcctttctcggtgtccaatggcatccagaacttctttttgaaaatcgtcccaaagataagaaactctttgactatgtcgttaatgaactttag

SEQ ID NO: 192 - DNA (genomic), 996 bp, Streptococcus pneumoniae; double-stranded, circular
  misc_feature (B) LOCATION 1...996
  hypothetical: NO
  anti-sense: NO
gtcatgagccccatttgtgaaccccatttctcagatacgagttatggtttcagaccaaataggtcatgtgaaaaagccatcatgaagctcttagaatacttaaatgacggctatgagtggatagtggatatagacctagagaaatttttcgatacagttcctcaagatagattgatgtccttagtacataacattatcgaagacggagatacggaatccttgattcgtaagtatcttcattcaggtgttatcattaatggtcaacgttataaaacactagttggtacaccacagggaggaaatttatctcctctcttatccaatatcatgcttaatgaattggacaaggaattagaaaagaggggacttcgatttgtgcgctacgcagatgattgtgtgattacggtcgtaagcgaggcagccgctaagcgtatgatgtattcagtcagtcgttttattgaaaaacggctaggtttgaaagtaaacatgaccaagactaagattaccagaccaagagagttgaaatatctaggttttgggttctggaaatcatcagatggttggaaaagtcgtccacatcaagatagtgttcggagatttaagcttaaattgaagaaactaacacagaggaaatggagtatagacctaacaagacgtattgagcaactgaatttgtctattcgaggatggataaactatttctcattgggaaatatgaaaagtatagtcgccagcatagatgagcgcttgcgtactcgcctacgagtgattatctggaagcaatggaagaagaaatcgagacgattatggggattgcttaagttaggggttcctaaatggatagcagataaggtatctggctggggcgaccattatcaattagtagctcagaagtcggtacttaaacgtgctatatcaaaaccagtcctggaaaaacgtggactggtttcgtgtttggattattaccttgaacgacatgcgttaaaagttagttga

SEQ ID NO: 193 - DNA (genomic), 666 bp, Streptococcus pneumoniae; double-stranded, circular
  misc_feature (B) LOCATION 1...666
  hypothetical: NO
  anti-sense: NO
tggttcttaccaaggctacgctacgatattgaactagggaaccaactagctcaagaccttggtgtcaaggttaaatacatttcagtcgatgctgccaaccgtgcggaatacttgatttcaaacaaggtagatattactcttgctaactttacagtaactgacgaacgtaagaaacaagttgattttgcccttccatatatgaaagtttctctgggtgtcgtatcacctaagactggtctcattacagacgtcaaacaacttgaaggtaaaaccttaattgtcacaaaaggaacgactgctgagacttattttgaaaagaatcatccagaaatcaaactccaaaaatacgaccaatacagtgactcttaccaagctcttcttgacggacgtggagatgccttttcaactgacaatacggaagttctagcttgggcgcttgaaaataaaggatttgaagtaggaattacttccctcggtgatcccgataccattgcggcagcagttcaaaaaggcaaccaagaattgctagacttcatcaataaagatattgaaaaattaggcaaggaaaacttcttccacaaggcctatgaaaaaacacttcacccaacctacggtgacgctgctaaagcagatgacctggttgttgaaggtggaaaagttgattag

SEQ ID NO: 194 - DNA (genomic), 1179 bp, Streptococcus pneumoniae; double-stranded, circular
  misc_feature (B) LOCATION 1...1179
  hypothetical: NO
  anti-sense: NO
aaggagttacctatgaattaccttgttatttctccctactatccacaaaactttcaacagtttaccatcgaactagctaataaaggcatcacagccttgggaattggtcaagagtcttacgagcaattggatgagcccttgcgcaatagcttgaccgagtattttcgtgttgataatcttgagaacatagatgaagtcaaacgtgcagttgcttttctcttttataaacatggtccaattgaccgcatcgagtctcacaatgaatactggcttgagctagacgcaacactcagagaacaattcaatgtttttggtgccaaaccagaggatctcaaaaagacgaaatataagtctgaaatgaagaaacttttcaaaaaagcaggtgttcctgtggtacctggagctgttatcaagacggaagcagatgttgatcaagcagtgaaagaaatcggtcttccaatgattgccaaacctgataatggagtgagagcagccgcaacctttaaacttgagacagaagacgatatcaatcacttcaagcaagaatgggaccattcaaccctttatttctttgaaaaatttgtcacttccagcgaaatctgtacctttgacgggctcgtggacaaggatggaaagattgtcttctcaacaacctttgactacgcctatacaccgcttgacctcatgatttataagatggacaattcttattatgtgctcaaggatatggatcctaaactgcgcaagtatggggaagcaattgtcaaagaatttggtatgaaagaacggtttttccatattgagttcttccgtgagggggacgattatattaccatcgagtacaataaccgccctgcaggtggttttaccattgatgtttataactttgctcattccttggacctttatcgtggctatgcagctattgtcgcaggagaggagttcccggcgtcagactttgaaactcagtattgtttggctacttctcgccgtgcaaatgctcactatgtttattcagaagaggatttgcttgccaaatatagccagcagttcaaggttaaaaaagtcatgccagctgccttcgcggaacttcaaggagattacctgtatatgctgaccactccgagtcgacaagaaatggagcagatgattgcagatttcggacaacgtcaagaataa

SEQ ID NO: 195 - DNA (genomic), 795 bp, Streptococcus pneumoniae; double-stranded, circular
  misc_feature (B) LOCATION 1...795
  hypothetical: NO
  anti-sense: NO
cccccgctaccaaccgtcacgcctcgcgagccacacttcgcacaccatagcggactaccactctacgccgctctaacacgcggagcctgctccaacttctcttcccccaccccccatacacccacgctccccctccagcagatcccatcgcaacttctccctttgttcccaaaccccgtggcctcaccacggcacacatccgtgcagcccatatctccctgccgacacggccctcctcacaccaactgccccccactcaccccactccacccgtccccggaccgcccccgcctcaaccccggccaccccacttccctccaccccccgttcccccgcatgccgcccccctccacgcggccaatcccccaccgcgcgcgagcaactccccccccccacccccaccaccgcccgccgcacgccaacccccccacgcccccccccgcaggaatccgccgccccaccccgggcccacaccgcaccggcctcaccgccccaccccgcccccgcacaccccccccactccgccaccagcccacaccggcccccctaccacacccccaacgaacgagccgccccgccccacgccagccccaaaacccccccgccacccaccccgccccgccgccnacctaccgcccatgctcgcgaccccccgcaccgagcnagccacnncnngnccnnnnnnnnnnttttcnnnnnnnnnnnnnnnnnnnnnnnnnnnnnnnnnnnnnnactacacaaactggcaagcagttggcgaccttgactttgctaacgaccgtactgcctacatga

SEQ ID NO: 196 - DNA (genomic), 351 bp, Streptococcus pneumoniae; double-stranded, circular
  misc_feature (B) LOCATION 1...351
  hypothetical: NO
  anti-sense: NO
tccatctcgtttgacgagacagccatttttggagaattgatccgctatctggaccagtatgaggatgtgattctacgggaaattaaggctcaatttccagatgttgcagttgataaactcatggaagagtatataaaggcaggcttgattctacgtgaaaataagcgctattacctcaattttcctacgcttgaatcacttgatagtcttgaactggatcaagagatttttgtcagagaagctagtccggtctatcaagccttgttggagcagagttttgagacggaattgcgcaatcaaatcaatgcagctattttagttgaaagacggactttgcgcgcattaaaatga

SEQ ID NO: 197 - DNA (genomic), 228 bp, Streptococcus pneumoniae; double-stranded, circular
  misc_feature (B) LOCATION 1...228
  hypothetical: NO
  anti-sense: NO
ttcttaataccagccattgttaagccagaagtttttagctctgccaagccacatagtgtgtttactactatgtgtccatgtcaccatgaatcgccgaacgatttaacgagaaagtatgacttttacgtttatcccaactcaattatgacatttttttcaaaagtcaatatatctcactttttcaacgacaagaaagaggctgccaatcgaccaacctcttgtttttaa

SEQ ID NO: 198 - DNA (genomic), 432 bp, Streptococcus pneumoniae; double-stranded, circular
  misc_feature (B) LOCATION 1...432
  hypothetical: NO
  anti-sense: NO
ttcttaataccagccattgttaaaccagaagtttttagctctgccaagccacatagtgtgtttactactatgtgtccatgtcaccatgaatcgccgaacgatttaacgagaaagtatgacttttacgtttatcccaactcaattatgacatttttttcaaaagtcaatatatctcactttttcaacgacaagaaagaggctaccaatcgaccaacctcttattctgaacccatcactccatcactttttagcttcattcgctttcttagcgactgcaatctggtattcgacttggtcattccccttaccggtacaaccatgagcaattgtagtcgctcctatctgatgcgctatttcaaccaattttttagaaatcagagggcggctcaaggcagataccaagggatacttttgttcataataggcatgtga

SEQ ID NO: 199 - DNA (genomic), 222 bp, Streptococcus pneumoniae; double-stranded, circular
  misc_feature (B) LOCATION 1...222
  hypothetical: NO
  anti-sense: NO
aaaccaatacctaatattatcagtcttgctgctgaaaaaccatcttttttagctagtaaaaataatattaaagatgatgttagtccacaagttattgaaataattccagtagttaaactatttgtttttaataccaatatgcaaaagaccgctgcaatagatgaagaacttgtgacaccgattatatcaggacttgcaagaggatttcttaacatagtttga

SEQ ID NO: 200 - DNA (genomic), 384 bp, Streptococcus pneumoniae; double-stranded, circular
  misc_feature (B) LOCATION 1...384
  hypothetical: NO
  anti-sense: NO
cagaaaataccgactatacagtcgtcatcaaataaggagaagaacatgtcaaatatttacgatagtgcaaacgaactcagtcgcggtctacgcggattaccagaatacaaggctgttaaagcagctaaagatgcgattgcagcagatgctgaggcaagcaaaatctttacagaatatcttgcctttcaagaggaaattcaaaaactagcacagacaggtcaaatgccagatgcgtccttccaagctaagatggaaggctttggtaaacagattcaaggaaatagcctcttgtcagaattctttaccaagcaacaacaattggccatttacctttctgacattgaaaaaattgtttttgaaccagtttcagaattgctgaaataa

SEQ ID NO: 201 - DNA (genomic), 1839 bp, Streptococcus pneumoniae; double-stranded, circular
  misc_feature (B) LOCATION 1...1839
  hypothetical: NO
  anti-sense: NO
acatcgataccagctcagaacttgagggccgtatcactgctcgccaacttgtcgaagaaaatcgcccagagtacaatatcgaatatatcgaactcttgtctgacaaattgctcgattacgaaaaagaaactggcgccttcgaaattacggagttctaatatggcctacactcttaaacctgaagaagttggtgtttttgccatcggtggtctaggagaaatcgggaaaaacacttacggaattgaataccaagacgagattatcatcgtcgatgctgggattaaattcccagaagatgacttgcttggtatcgactatgtcattcctgactactcttacatcgtagacaatatcgaccgcgtcaaggctgttttaatcacacacggacacgaggaccacattggtgggattccgttcctactcaagcaagcaaatgtccctatttatgctggaccgcttgccttggctttgatccgtgggaaactcgaagaacacggcctcttgcgcaacgccaaactttacgaaatcaaccacaacaccgagttgacctttaaaaatctcaaggcaactttctttagaacgactcactctattccagagcctttggggattgtcattcatactcctcaagggaaaatcgtctgtacgggtgactttaagttcgactttactccagttggagaacctgcggacttgcatcgtatggctgcgcttggtgaagaaggcgtgctctgtctcctgtctgactcgacaaatgcggaagtaccaacctttaccaactctgaaaaagtcgttggtcagtccattatgaagattatccaaggtattgaaggacgtatcatctttgcatcctttgcctcaaatatcttccgtctccagcaggcaacagaagctgctgttaagactggacgcaagattgcggtctttggtcgttctatggaaaaggccattgtcaacggaatcgatcttggctacatcaaagctcctaagggaacctttatcgagccaaatgaaatcaaagattatcctgcaggagaagttcttatcctctgtacaggtagtcagggtgagcctatggcagccctctctcgtatcgccaacggaacccaccgtcaagtacaattacaaccaggtgataccgttatcttctcttctagtcccatccctggaaacactactagcgtcaacaagctgattaacatcatttctgaagctggtgtcgaagttatccacggtaaagtgaacaatatccatacatctggacacggtggtcagcaagagcaaaaactcatgctctgcttgattaagccaaaatacttcatgcctgtccacggtgaataccgcatgcaaaaagtccacgctggactagcagtggatactggtgttgagaaggacaatatctttatcatgagcaatggcgatgtgcttgcccttactgctgactcagctcgtatcgcaggtcatttcaacgcccaagatatctatgtcgatggaaatcgtatcggtgaaattggcgcagctgtcctcaaagatcgtcgcgatctatctgaagacggtgtcgttctggcagtcgcaactgttgacttcaaatcgcagatgattctgtctggcccagatatcctcagccgaggctttgtctacatgagagagtctggagacttgattcgccaaagccagcgtatcctcttcaatgccattcgtatcgcactgaaaaataaggatgctagcgtgcaatctgtcaatggtgccattgtcaacgctattcgccccttcctctatgaaaataccgaacgtgaaccgatcatcatcccgatgatcctcacaccagatgaagaataa

SEQ ID NO: 202 - DNA (genomic), 246 bp, Streptococcus pneumoniae; double-stranded, circular
  misc_feature (B) LOCATION 1...246
  hypothetical: NO
  anti-sense: NO
agcattgtaccagggatgatggtgataccattaccagtaccagcaagtccaaggatagaagccaatccaccaccgattgcaccagcaatcaatgaaaggaagaatggtttacggaagcgcaagttcaccccgaagatagcaggctctgtaatacctaggaaggcagaaagagcagccgggaaagcaagtgttttcagttttggattttttgttttaacaccaaccgcaacagtagcagcaccttga

SEQ ID NO: 203 - DNA (genomic), 744 bp, Streptococcus pneumoniae; double-stranded, circular
  misc_feature (B) LOCATION 1...744
  hypothetical: NO
  anti-sense: NO
ggagactcgtttagaaggagtaaaccgtcgatgacagaaaccattaaattgatgaaggctcatacttcagtgcgcagatttaaggagcaagtccttcctcaggaagatttgactgaaatcctgacagcagcccagatggcatcatcttggaagaatttccaatcctactctgtgattgtggtacgaagccaagagaagaaagatgccttgtatgaattggtacctcaagaagccattcgccagtctgctgttttccttctctttgtcggagatttgaaccgagcagaaaagggagcccgacttcataccgacaccttccaaccccaaggtgtggaaggtctcttgattagttcggtcgatgcagctcttgctggacaaaatgccttgttggcagctgaaagcttgggctatggtggtgtgattatcggtttggttcgatacaagtctgaagaagtggcagagctctttaacctacctgactacacctattctgtctttgggatggcactgggtgtgccaaatcaaactcatgatgtgaaaccgagactgccactagataatgtagtctttgaggaagaataccaagaacagtcaactgaggcaatccaagcttatgaccgtgtgcaggctgactatgctggagcgcgtgcgaccacaagctggagtcagcgtctagcagaacagtttggccaagcagaaccaagctcaactagaaaaaatcttaaacagaagaagttattgtag

SEQ ID NO: 204 - DNA (genomic), 477 bp, Streptococcus pneumoniae; double-stranded, circular
  misc_feature (B) LOCATION 1...477
  hypothetical: NO
  anti-sense: NO
agctcagtacctcttccaattggacctgttcccttcactctgcaaaactttgcaatcggcttgattgctactgtctttagaccgagagaggctgtactttctgctggactctatcttcttctaggtgctatcggtcttcctgtctttgcaggaggtggagctggttttcaggctttagttggccctactgcaggctatctttggttttatctcgtttactctggacttacttcctctctaaccaacagcaagagtggtgttgttaagatttttcttgcaaacctcttgggtgatgcccttgtctttgtcggcgggattctcagcttgcatttcctagctggaatggcatttgaaaaagctcttgttgtgggggttcttccctttatcattccagaccttggcaaacttctggctattagttttattagccgtcccctacttcaacgccttaaaaatcagacttactttactaactaa

SEQ ID NO: 205 - DNA (genomic), 468 bp, Streptococcus pneumoniae; double-stranded, circular
  misc_feature (B) LOCATION 1...468
  hypothetical: NO
  anti-sense: NO
gattatccacctcaggaacccttcatcacggctactatgaaagaagttgatgaattggcagaactggacatcgaggtgatttctctggattgtaccaagcgtgaacgctacgatggtttggaaattcaagagttcattcgtcaggttaaggagaaatatcctaatcagcttttgatggctgatactagtatcttcgaagaagggctagcagctgtagaagcaggaattgactttgtcggaacaaccttatcaggctacacatcctacagtccaaaagtagacggtccagattttgaattgattaagaaactctgtgatgccggtgtagatgtcattgcagaaggaaaaattcatacaccagaacaagccaaacaaatccttgaatatggagtgcgaggcatcgttgttggtggcgccattactagaccaaaagagattacagaacgcttcgttgctagtcttaaataa

SEQ ID NO: 206 - DNA (genomic), 906 bp, Streptococcus pneumoniae; double-stranded, circular
  misc_feature (B) LOCATION 1...906
  hypothetical: NO
  anti-sense: NO
atgactgcttttcaacaactcccatctagtgtacttcaaactggagccatttttctctccattatcattgaagcccttcccttcgttctgataggaagtattgtctcagggctgattgaagtttatatcacacctgacaaggtttatcattttctccctcgaaatcgttgggggagaatcttttttgggacctttgtcggtatacttttcccttcctgtgaatgtggaatcgtccccatcatcaatcgttttctggaaaaaaaggttccaagttacacggccgttccttttcttgtgacagcacctgttatcaatcccattgttctttttgcgacctattctgcctttggcaactccttccatgtcgccctattacgagctctgggttccatcgttgtggctgtaatactaggaatttttctaggatttttctggcaagaaccgattcaaaaagaaaatcgtctagcctgtcatgagcatgatttttctcacttaagtcctgcaaaaaaagtttttcaggtctttgtgcaagccattgatgagttttttgatacgggacgttatttggtatttggctgtctctttgcctctgttatacaggtttatgttccgactcggattctgacctctatcagtgcgactcctctttttgccatcctgctcttgatgattttggcctttcttctttcgctctgtagtgaggcggatgcctttatcggggcttctctactctcgagtttcggtttggctccagttctggcttttctcgtcattggcccaatgctggatatcaaaaatattcttatgatgaaaaattacttgaaagcacgatttattagtcacttcattacgattgtgactctggtcgttttagcctattctctcttgattggagtcatcctatga

SEQ ID NO: 207 - DNA (genomic), 357 bp, Streptococcus pneumoniae; double-stranded, circular
  misc_feature (B) LOCATION 1...357
  hypothetical: NO
  anti-sense: NO
ttttcgtcgttgactttaacgataccacggtcgatacgtcctgaagcaactgtaccacgtccagtgattgagaatacgtcctcgactggaagaagcaatggtttgtcagtgtcacgttctggttctgggatatactcatcaactgtgttcatcaattccataacgatgtcttcgtatttagagtcaccttcaagagctttaagtgctgaaccttggataactggaagatcgtcacctgggaagtcgtattctgacaataggtcacggatttccatttcaaccaattcaagcaattcttcgtcgtcaaccaagtcaactttgttcatgaagacgataaggtgtttaacaccaacctga

SEQ ID NO: 208 - DNA (genomic), 1572 bp, Streptococcus pneumoniae; double-stranded, circular
  misc_feature (B) LOCATION 1...1572
  hypothetical: NO
  anti-sense: NO
ttgacaacaccagggcacgttgactttacctatgaagtttcacgttcgctagctgcctgtgagggtgctattttggtggtcgatgcggctcaaggaattgaggctcaaactcttgccaacgtttatctggctttggataatgatttggaaatcatgcctatcattaataaaattgacctgccggctgcagatccggagcgcgtgcgtacagagattgaagatgtgattggtttggatgccagtgaagcagttttggcttctgccaaggctggtattgggattgaagaaatcctcgagcaaattgtagaaaaagtaccagcaccaacgggtgatgtgacggcgccacttaaggccttgattttcgactctgtttacgatgcttaccgtggggttatcctccaagtgcgtgtcatggacggagtggtcaaacctggtgataagattcagctcatgagcaatagtaagacctttgatgtggccgaagtcggtatttttacaccaaaagcggttggtcgtgatttccttgcgactggtgatgttggttacattgcggcgtctatcaagacggttcaggatactcgtgtgggtgataccgttaccttggcaaccaatcctgcggcagaaccattacatggttataagcagatgaatcctatggtctttgcgggtctctacccaatcgaatcaaacaaatacaatgacctgcgtgaagcgcttgaaaaaatgcaactgaatgatgctagtcttcagtttgaaccagaaacatctcaggcacttggatttggtttccgttgtggatttcttggacttctccatatggatgttatccaggaacgtttagagcgtgagttcaatattgacctcatcatgacagctccgtctgttatttacaaagttaatttgaccgacggtgagtctatggatgtgtctaacccatctgagtttccagacccaactaagattgcgaccattgaagagccttatgtcaaggcgcaaatcatggtaccacaggagttcgtcggagcagtaatggagctagctcagcgtaagcgtggggactttgtgactatggactatattgatgataaccgtgtcaatgttatctatcaaattcctcttgctgaaattgtctttgacttctttgataaacttaagtcttcgacacgtggttatgcaagctttgactacgaattgtcagaatatcgcccatctaagctggtgaaaatggatatccttctcaatggagataaggtggatgccctcagctttatcgttcacaaggactttgcctacgaacgtgggaaactcatcgttgataaactcaagaaaatcatccctcgccaacaatttgaagttccaatccaagcggctattggacacaagattgtcgctcgtactgatatcaaggcccttcgtaagaacgtacttgctaaatgttatggtggtgacgtttctcgtaagcgtaaactccttgaaaaacaaaaagctggtaagaaacgcatgaaatccatcggatcagttgaagttccgcaagaagccttcctcagcgtcttgagtatggatgaagaataa

SEQ ID NO: 209 - DNA (genomic), 192 bp, Streptococcus pneumoniae; double-stranded, circular
  misc_feature (B) LOCATION 1...192
  hypothetical: NO
  anti-sense: NO
tcatatcgacccatacacngctgcngcattttcacatttcctaagttagagcatgttaagtttatcggtcttacccactgtggacgaatctgggaaggatggggtgttccaanagaacgtatcatcgttgttaaaccaggtgaccatattggaattaaaagatatgaagattcatgcagtagaatcatttga

SEQ ID NO: 210 - DNA (genomic), 519 bp, Streptococcus pneumoniae; double-stranded, circular
  misc_feature (B) LOCATION 1...519
  hypothetical: NO
  anti-sense: NO
gaagggcgaccaatctacatccgtcttgaagtggataagaaagaccgtatttggggcctcttggcttatcaagaagacttccaacgtcttgctcgtcctgcttacaacaacatgcagaaccaaaactggccagccattgtttaccgtctcaagctgtcaggaacttttgtttacctaccagaaaataatatgcttggttttattcatcctagcgagcgttacgcagagccacgtttggggcaagtattagatgcgcgcgttattggtttccgtgaagtggaccgcactctgaacctctccctcaaaccacgctcctttgaaatgttggaaaacgatgctcagatgattttgacttatttggaaagcaatggcggtttcatgaccttaaatgacaagtcatctccagacgacatcaaggcaacctttggcatttctaaaggtcagttcaagaaagctttaggtggtcttatgaaggctggtaaaatcaagcaagaccagtttgggacagagttgatttag

SEQ ID NO: 211 - DNA (genomic), 519 bp, Streptococcus pneumoniae; double-stranded, circular
  misc_feature (B) LOCATION 1...519
  hypothetical: NO
  anti-sense: NO
ggaacaagacccagaaaagtagccttatttcttaagaattttaatagtttaaagcacctagcacctgtttatattgatgaaacaggaatcgaccgctatctctatcgtccttatgcacgggctcctagaggggagaaagtctatgaaaagattagcggacgtcgttttgagcgaacttcaattgttgcaggacaagtagacggagagtttatagctcccatgatttacaagaaaagcatgacaagcgatttctttgtggagtggttcaaaacgcaactcctacctgctttgaagacacctcatgttattgtcatgggcaatgctagttttcatcccaagaacattttggatgaactctgcatccaagataaacactttttcttacctctaccaccttattcaccagatttgaatcctattgagcaagcttgggctatcttgaaaaagaaagtgacggatgtattaagggaagtttcaactatttttgaatgtttggaatgcttttttaaaactagatga

SEQ ID NO: 212 - DNA (genomic), 396 bp, Streptococcus pneumoniae; double-stranded, circular
  misc_feature (B) LOCATION 1...396
  hypothetical: NO
  anti-sense: NO
aaaggaggacccgccatgcaggattcgggaatccaagtactctttcaaggaaataatctcctgagaatcttacaggggttgggcgttacgattgggatatccatcctgtctgtcctcttatccatgatgttcggaacagtcatgggaatcatcatgacctcccattctagaatcatacgatttttaacacgattgtatctggaatttatccgtatcatgccccagctggtgctactcttcatcgtttactttggcttggctcgaaactttaatatcaatatctcaggtgagacttcagctattatcatttttaccctctggggaacagctgaaatgggagacttggtacgtggagctatcacttctctccctaaacatcagtttgaaagtggatag

SEQ ID NO: 213 - DNA (genomic), 222 bp, Streptococcus pneumoniae; double-stranded, circular
  misc_feature (B) LOCATION 1...222
  hypothetical: NO
  anti-sense: NO
cggccgggaccatgtatgcttttatccagtacatcaaccgccctctttgaccctttgattgaggtgacgcaaaacttttcaacactgcaaacgtctatggtttctgcaggccgtgtctttgccttaatcgatgagagcacctatgagccccttcaagaaaatgggcaagccaaagtcaaggagggcaatatcagttttggaacatgtgtgtatctcgtatga

SEQ ID NO: 214 - DNA (genomic), 288 bp, Streptococcus pneumoniae; double-stranded, circular
  misc_feature (B) LOCATION 1...288
  hypothetical: NO
  anti-sense: NO
ccaatcgctttgttacctcatatgagaaaacacgtgaaacgattcgtttttaataaaagaaaaagattttattgtgtgaggagcagaatcaaatctttttctatagttgtggggagatttacttcattttctcctgagattgagtttttacccagccgatttatccaccacctcaaaacagtgttttatactcttcgaaaatctcttcaaatcacgtcagcgtcgccttaccgtactcaagtacagcctgaggctagcttcttagtttgctttttgattttcatttag

SEQ ID NO: 215 - DNA (genomic), 198 bp, Streptococcus pneumoniae; double-stranded, circular
  misc_feature (B) LOCATION 1...198
  hypothetical: NO
  anti-sense: NO
atacctttgcctctaaaggaaatcaaaccatctttttaccaaatacgccaaatggtgtggatgatatccgaacacaaatcttgtcagcccttcgcgctgagaagaaataatagactaatactcttcgaaaatctcttcaaaccacgtcagcgtcgccttgccgtatatctgcaacctcaaaacagtgttttgagctga

SEQ ID NO: 216 - DNA (genomic), 2166 bp, Streptococcus pneumoniae; double-stranded, circular
  misc_feature (B) LOCATION 1...2166
  hypothetical: NO
  anti-sense: NO
aaggaattgccaatgacttcttataaacgtacatttgttcctcaaatagatgcgagagactgtggtgtcgctgccttagcctcgattgctaaattctatggttcagatttttctctagctcacttgagagaacttgcaaagaccaataaagaagggacgactgctcttggcattgtaaaagccgctgatgaaatgggctttgaaacaaggcctgttcaagcagataaaactctctttgacatgagtgatgtcccctatccatttatcgttcacgttaacaaagaaggaaaactccaacattactatgttgtctatcaaacaaagaaagactatctgattattggtgatcctgacccttctgtaaaaatcactaaaatgtcaaaagaacgctttttctctgaatggactggagtagctatttttctagctcccaaacccagctatcaaccccataaagataaaaagaatggtctactaagcttccttcctctgattttcaaacaaaaatctctcattgcttacattgttctctcaagcttattggtcactattatcaatatcggtggttcttattatctccaaggaatcttggatgaatacatcccaaatcagatgaaatcaactttaggaatcatctcagttggtctggttatcacctatatcctccaacaagtcatgagcttttccagagattatctcctaaccgttctgagccagagattaagcattgatgtgattttatcctatattcgccatatttttgaacttcccatgtctttctttgcgacacgtcgtacaggagaaatcatttcacggttcacagatgctaactctattatagatgccttggcttctaccattctttctctttttctggatgtttctattctgattcttgtagggggcgtcttactggcacaaaaccctaatctcttcctcctttctcttctttccattcctatatacatgttcatcatcttttcttttatgaaacctttcgaaaaaatgaaccatgatgtcatgcaaagtaattctatggttagctctgccattatcgaagatatcaacgggattgaaactataaagtcgctcacgagtgaagaaaatcgctatcaaaatatagacagcgaatttgtagattatttggaaaaatcctttaagctcagtaaatattctattttacaaacgagtttaaagcagggaacaaaattagttctgaatatccttatcctatggtttggcgctcaattagtcatgtcgagtaaaatttctatcggtcagctgattacctttaacacacttttttcttactttacaactcctatggaaaatattatcaacctccaaaccaaactccaatctgcgaaggtcgctaataaccgtttgaacgaagtctatctagtcgaatctgaatttcaagttcaagaaaaccctgttcattcacattttttgatgggcgatattgaatttgatgacctttcttataagtatggttttggacgagataccttaacagatattaatctcacgattaaacaaggagataaggttagcctagttggagttagtggttctggtaaaacaactttagccaaaatgattgtcaatttctttgaaccctacaaagggcatatttccatcaattatcaggatattaaaaacattgataaaaaagtcttgcgccgtcatattaattacctaccccaacaagcctatatctttaatggctctatcttggaaaatttaaccttgggcggtaatcatatgattagccaagaagatattctaagagcttgtgaattagctgaaatccgtcaagacattgaaagaatgcctatgggctatcaaactcagctctctgatggagctggtctatcaggaggacaaaagcaacgaatcgctctcgctcgtgctcttttaactaaagctcctgttttaatactagatgaagctactagcggtcttgatgtcttgactgagaaaaaggttatagataatcttatatccctaactgataaaaccattctctttgtagcccatcgtctcagtatagccgaacgaactaaccgtgtcattgttcttgaccaggggaaaatcattgaagttggtagtcaccaagagttaatgcaggcgcaaggcttctaccatcatctattcaataaataa

SEQ ID NO: 217 - DNA (genomic), 747 bp, Streptococcus pneumoniae; double-stranded, circular
  misc_feature (B) LOCATION 1...747
  hypothetical: NO
  anti-sense: NO
gattcgatgccaatgagagacagaatttcagcctttttagaggaaaagcagggcttgtctgtcaattccaagcagtcctataagtatgatttggagcaatttttagacatggtaggtgagcggatttctgagaccagtctcaagatttaccaagcccagctagccaatctaaaaatcagcgcccagaagcgaaagatttcggcctgtaaccaatttctatactttctctatcaaaaaggagaggtggacagcttttaccgcttggaattagccaaacaagctgaaaagaagacggaaaagccagagattctatacctagactctttttggcaggaaagcgaccatccagagggccgcttgctagcgctcttaatcctagaaatggggctcttgcccagtgagattttagccatcaaggttgcggacatcaatctggattttcaggtgctgcgaatcagcaaggcttcccaacagaggattgtcaccattcccacggccttgctttcagaattggaacccttgatggggcagacctatctttttgaaagaggagggaaaccctattctcgtcagtgggcctttcgtcagttagaatcttttgtcaaggagaaaggttttccatccttatcagctcaagtcttacgtgaacagtttattctaagacaaatagaaaacaaggtcgatttgtacgaaattgcaaaaaaattaggattaaaaacagtcctgaccttagaaaaatatagataa

SEQ ID NO: 218 - DNA (genomic), 666 bp, Streptococcus pneumoniae; double-stranded, circular
  misc_feature (B) LOCATION 1...666
  hypothetical: NO
  anti-sense: NO
gcggtttcgccaaaaatggggcttggagcgtatcattgttttaacttatcaagccagtattcaggagctggtatgggagcaattcttgagacacaacgtgaacttcgtgaagtcttgaatgatggtgtgaaaccatgtgatttgcatgcggaaattttgccttcaggtggtgacaagaaacattatcctatcgcctttaacgctcttccacaaattgatgttttcactgataatgattacacgtacgaagagatgaagatgaccaaggaaactaagaaaattatggaagatgatagcattgcagtatctgcaacatgtgtgcgtattccagtcttgtcagctcactctgagtctgtttatatcgaaacaaaagaagtggctccaatcgaagaagtaaaagcagctatcgcagccttcccaggtgctgttcttgaagatgatgtagctcatcaaatctatcctcaagctatcaatgcagttggttcgcgtgatacctttgttggtcgtatccgtaaagacttggatgcagaaaaaggaattcacatgtgggttgtttcagataaccttctcaaaggtgctgcttggaactcagttcagattgctgaaactcttcatgaacgtggattggttcgtccaacagctgaattgaaatttgaattaaaatag

SEQ ID NO: 219 - DNA (genomic), 207 bp, Streptococcus pneumoniae; double-stranded, circular
  misc_feature (B) LOCATION 1...207
  hypothetical: NO
  anti-sense: NO
gctttctcgccaaacgtaattccttgtaaaattcccccagttccattttttcaatcatcctaccacctcctagcttttgcatattatatcattatttgtgttcatttgtcaaaacattctgacactttggtgattgaaaaagccagccttaagctgactctaaaaggaccgagccttgtacaatacagaactcaatcctcgttctaa

SEQ ID NO: 220 - DNA (genomic), 936 bp, Streptococcus pneumoniae; double-stranded, circular
  misc_feature (B) LOCATION 1...936
  hypothetical: NO
  anti-sense: NO
ttggtggcgccaatggaaccagcaacgtgcgtgcgggtaagctctttgacattcctgttttgggaacccatgcccatgccttggtacaggtttatggcaatgactatgaggctttcaaggcttacgctgcgacccacaaaaattgtgtctttcttgtggatacctatgatacccttcgcatcggtgtaccagctgccattcaggtggcgcgtgagctgggtgatcagattaactttatgggtgtgcggattgactctggggatattgcctacatttctaagaaagtccgtcagcaactggacgaggctggatttacagaggctaagatttatgcttctaatgatttggacgaaaatactatcctcaatctcaagatgcaaaaggccaagattgatgtctggggtgtgggtaccacagctgattacagcctatgaccagccggctcttggggcggtttacaagattgttgcaatcgaagatgaaactggtcagatgcgcaatacgattaagctgtctaataatgcggaaaaagtgtcgacgccaggtaagaagcaggtgtggcgcattaccagtcgtgaaaaaggtaagtcagaaggtgattacatcacttatgatggtgtggatattagcgacatgacagaaatcaagatgttccatccgacctatacatacatcaagaagacggttcgtaattttgatgccgttcctctcttggtggatatcttcaaagaaggaatattagtttacaacttgcctagtttgactgacattcaggattatgcccgtaaagaatttgacaagttgtgggatgagtataagcgtgtgctcaatccgcagcactatccagtggatttggcgcgtgatgtatggcaagataagatggacttgattgataagatgcgcaaggaagcccttggtgaaggagaagaagaatga

SEQ ID NO: 221 - DNA (genomic), 432 bp, Streptococcus pneumoniae; double-stranded, circular
  misc_feature (B) LOCATION 1...432
  hypothetical: NO
  anti-sense: NO
tcaccccagccaaggtattggatatccaatttggcaccaactttttcttcaatgattttgttggcatttgctaacaattcatccaagttgtctggtttgtcaccgatttggtacattttgataacaggtttgtcacctgaatcagcagcttttttgctgttacctgtcaaatttccacaagcagcaagacctgcagccagagcgactacactagcagatgcaaaagcatattttttccagtttttcatgataaaaactcctttttttatttttaaacttataaacaatgtaatgatcttatactcaatgaaaatcaaagagcaaactagaaaactagccgcaggctgctcaaagcactgctttgaggttgtagataagactgacgaagtcagttacatatatctacggcaaggcgacgttgacacggtttga

SEQ ID NO: 222 - DNA (genomic), 594 bp, Streptococcus pneumoniae; double-stranded, circular
  misc_feature (B) LOCATION 1...594
  hypothetical: NO
  anti-sense: NO
ccaaggcagccaacaaactgggcgtcaaggttattacggtctatgctttttcatacggaaaactggacccgtccagatcaggaagtcaagtttatcatgaacttgccagtagagttttatgataattatgtcccggaactacatgcgaataatgttaagattcaaatgattggggagacagaccgcctgcctaagcaaacctttgaagctttaaccaaggctgaggaattgactaagaacaacacaggattgattcttaattttgctcttaactatggtggacgtgctgagattacacaggcgcttaagttgatttcccaggatgttttagatgccaaaatcaatccaggtgacatcacagaggaattgattggtaactatctctttacccagcatttgcctaaggacttacgagacccagacttgattatccgtactagtggagaattgcgtttgagcaatttccttccatggcagggagcctatagtgagctttattttacggataccttatggcctgattttgacgaagcggccttgcaggaagctattcttgcctataatcgtcgtcatcgccgatttggaggagtttag

SEQ ID NO: 223 - DNA (genomic), 507 bp, Streptococcus pneumoniae; double-stranded, circular
  misc_feature (B) LOCATION 1...507
  hypothetical: NO
  anti-sense: NO
tcttgtaagccgtggtcgtttccctacagaaagccttttaagagtcttggaaaagatgaccttgaaataataaacagatcaatggttaaggccaatgttgaagatctagcaaataacctagttgaagaactttctgggggtcaaaggcaaagagtatggatagctctagccctagcccaagatacaagtatcctacttttagatgagccaactacttacttggatatctcatatcaaatagaactattagacctcttgactgatctaaaccaaaaatataagacaaccatttgcatgattttgcacgatataaatctaacagcaagatacgctgattacctatttgcaattaaagaaggtaaacttgttgcagagggaaagcctgaagatatactaaatgataaactagttaaagatatctttaatcttgaagcaaaaattatacgtgaccctatttccaattcgcctctaatgattcctattggcaagcaccatgttagctcttaa

SEQ ID NO: 224 - DNA (genomic), 348 bp, Streptococcus pneumoniae; double-stranded, circular
  misc_feature (B) LOCATION 1...348
  hypothetical: NO
  anti-sense: NO
atcagtaagcctacacagacacctagcgtatttaaagtcaaatccgttatatctgttatacctattgctaaaatatactgtaagcactcaaacaataaactaatcaagaaacctgtcccgactattcttaaactagataaattagtttttatcaaagggaaacaaacacctaatggaataaagaaaatcagattaaataacatttcagcaaaaacaatttttccatcgactattagtggttctgaaaatggaatccaattgatataccttggagctaagaaaaatgctataaattcaggatttgtttcaaacttaaataagattccccaagttaataacatcagatag

SEQ ID NO: 225 - DNA (genomic), 246 bp, Streptococcus pneumoniae; double-stranded, circular
  misc_feature (B) LOCATION 1...246
  hypothetical: NO
  anti-sense: NO
agaagggcgttgaaccagtcattccagaaaccaagagctgttaagagcgtgatggttgcgatacctggtagtgacaatggcaaacagatttggaagaaaatccgggcttcactggcaccatcgatacgagccgattctagaatggcttctggaatggtcttcttgaagaaggaacgcatcaagatgatgttaaatggtgagagaagcattggaacaatcaaggcccaaacagtatccccaagctga

SEQ ID NO: 226 - DNA (genomic), 690 bp, Streptococcus pneumoniae; double-stranded, circular
  misc_feature (B) LOCATION 1...690
  hypothetical: NO
  anti-sense: NO
cacgcggagcctgctccaacttctcttcccccaccccccatacacccacgctccccctccagcagatcccatcgcaacttctccctttgttcccaaaccccgtggcctcaccacggcacacatccgtgcagcccatatctccctgccgacacggccctcctcacaccaactgccccccactcaccccactccacccgtccccggaccgcccccgcctcaaccccggccaccccacttccctccaccccccgttcccccgcatgccgcccccctccacgcggccaatcccccaccgcgcgcgagcaactccccccccccacccccaccaccgcccgccgcacgccaacccccccacgcccccccccgcaggaatccgccgccccaccccgggcccacaccgcaccggcctcaccgccccaccccgcccccgcacaccccccccactccgccaccagcccacaccggcccccctaccacacccccaacgaacgagccgccccgccccacgccagccccaaaacccccccgccacccaccccgccccgccgccnacctaccgcccatgctcgcgaccccccgcaccgagcnagccacnncnngnccnnnnnnnnnnttttcnnnnnnnnnnnnnnnnnnnnnnnnnnnnnnnnnnnnnnactacacaaactggcaagcagttggcgaccttga

SEQ ID NO: 227 - DNA (genomic), 1218 bp, Streptococcus pneumoniae; double-stranded, circular
  misc_feature (B) LOCATION 1...1218
  hypothetical: NO
  anti-sense: NO
caatattttttaaggggggacatttttatgtcagagcgtaaattattcacgtctgaatctgtatctgaggggcatccggataagattgcagaccaaatttcagatgcgattttggatgctattttagcaaaggatccagaggcgcacgttgctgctgaaacagctgtatatactggttctgtccacgtttttggtgaaatttctacaaatgcctatgtggatattaaccgtgtggttcgtgataccattgcagagattggttataccaatacagaatatggattttctgctgagacggtgggagtacacccatctttggtggaacaatctcctgacatcgctcaaggtgttaacgaagccttggaggttcgtggaaatgctgatcaagatccactggacttgattggagcaggtgaccaagggctcatgtttggatttgcagtagatgaaacagaagagcttatgccattgccaattgcactcagtcataaattggttcgtcgtctggcagaacttcgtaagtctggagaaattagctatctccgtccagatgcaaaatcacaagttacagttgagtacgatgaaaatgaccgtccggtacgtgtagatacagtcgttatttctactcagcatgatccagaggccactaatgaacaaatccatcaagatgtgattgacaaggtcatcaaagaagttattccatcttcttatcttgatgataagacaaaattctttatcaatccgacaggtcgttttgtaatcggtggtcctcaaggggactcaggtttgactggtcgtaagattattgtagatacttatggtggctactctcgtcatggtggtggtgccttctctggtaaagatgcgactaaggtggatcgttcagcctcttatgcggctcgctatattgccaagaatatcgttgcagcaggccttgctaagaaggcagaagtgcagttggcctatgctatcggtgttgcgcaacctgtttctgttcgtatcgatactttcggtacaggaacagtagctgaaagtcaacttgaaaaagcggctcgtcaaatctttgaccttcgccctgcagggattatccaaatgctggacctcaagcgtccaatttaccgtcaaacatcggcttacggtcacatgggacgtacagatattgatcttccatgggaacgtttggataaggtagatgctttgaaagaagcagtaaaataa

SEQ ID NO: 228 - DNA (genomic), 762 bp, Streptococcus pneumoniae; double-stranded, circular
  misc_feature (B) LOCATION 1...762
  hypothetical: NO
  anti-sense: NO
tcatcatggccaagcaaggtgtcgctttttgccaaggaagctggtgttttagcgggactaaccgtttttcaaagggtttttaccctatttgatgccgaggtgaccttccagaatcctcatcaatttaaggatggggatcgtttgactagtggcgatttagttttagaaatcataggctcggtgagaagtctcttaacatgtgaacgcgttgccttgaattttttacaacatttatcagggattgcttcgatgacagctgcttatgtagaagccttaggcgatgattgcattaaggtatttgatactcgaaaaactactcctaatttacgtctttttgagaaatatgccgtgagagttggcggtggctataatcatcgctttaatttatcagatgctatcatgctaaaagacaatcacattgcggcagtaggtagtgttcagaaggcaattgctcaagcgcgtgcctatgccccttttgtgaaaatggtcgaggtggaagtggaaagccttgctgctgccgaagaagctgcggcggcgggtgctgatattatcatgttggataatatgtcattggaacagattgaacaggccattaccctaattgcaggacgttctcggattgaatgttctggaaatattgatatgaccactattagccgttttcgtggtttagcgattgattacgtctccagtggtagtttaacccatagtgctaagagtcttgatttttccatgaagggtttaacctaccttgatgtctaa

SEQ ID NO: 229 - DNA (genomic), 207 bp, Streptococcus pneumoniae; double-stranded, circular
  misc_feature (B) LOCATION 1...207
  hypothetical: NO
  anti-sense: NO
gatctagctttcgtgatggaaagcgattctcgttcgttttttctttgtcatactcttcgaaaatctcttcaaaccacgtcagttttatctgaaacttcaaagctgtgctttgagcaacctgcgactagcttcctagtttgctttttgattttcattgagtatcaatttgaatggaaaatggaaagttatcatcttgtaatgagttaa

SEQ ID NO: 230 - DNA (genomic), 384 bp, Streptococcus pneumoniae; double-stranded, circular
  misc_feature (B) LOCATION 1...384
  hypothetical: NO
  anti-sense: NO
ctgctcaggcctggaagtcaaggggttgtatttggagctttaactgctgataaaaagttggataagcctaatctggaaaagttaattgctgcatcaaaaggaatggaaattgtctttcacatggcctttgatgaactaagtgatgaagatcaaccggaagctattgactggctcagtcaagccggtgtcactcgtatcctaactcgtgctggtgtgtctggcgactccttagaaaaacgttttgttcactatcacagaattttggagtacgctaaaggtaaaattgaaattctaccaggtggggggattgaccttgacaaccgtcaaacctttattgaccaggtgggggtaacacaattgcatggtactaaggttgttttttaa

SEQ ID NO: 231 - DNA (genomic), 951 bp, Streptococcus pneumoniae; double-stranded, circular
  misc_feature (B) LOCATION 1...951
  hypothetical: NO
  anti-sense: NO
tattgcgggccccaaaaaacgtcgcaagaattgaatgtattaaaaaacacttacaataccttccataagatggaagagttgcaggatgaagtcgaaattttattggattttttggctgaagacgagtcagtgcatgatgaactggtagcgcagttagccgaacttgataagataatgaccagctacgagatgactttactcttgtcagaaccttatgaccacaacaatgccatcttggaaatccatccaggttctggtggtactgaggcgcaggactggggtgatatgttgcttcgtatgtatactcgttatggtaatgctaaaggctttaaagtggaagtgttggattaccaagcaggtgatgaggctggtattaagtcggtaactttatcatttgaagggcctaatgcctatggtctcctcaagtcagaaatgggtgttcaccgcttagtgcgaatctcaccatttgactctgccaaacgtcgccatacctctttcacatctgtagaagtgatgccagaattggatgatactattgaagtggaaatccgtgaagatgatatcaagatggataccttccgttcaggtggtgccggtggacaaaacgtcaataaagtttcaacaggtgtacgtttaacccacattccaactggaattgttgtccaatcaacagtggatcgtacccagtatggaaatagagatcgtgccatgaagatgttgcaggctaagctctatcaaatggagcaagagaagaaggctgcggaggtagattctctcaaaggtgagaaaaaggagattacttggggaagccaaatccgttcttatgtcttcacgccttatactatggtaaaagatcaccgaactagctttgaggttgctcaggtagataaggttatggatggggacctagatggttttatcgatgcttatctcaagtggcgaattagctaa

SEQ ID NO: 232 - DNA (genomic), 2073 bp, Streptococcus pneumoniae; double-stranded, circular
  misc_feature (B) LOCATION 1...2073
  hypothetical: NO
  anti-sense: NO
gattttaagttagaaatgagactgatttgtatgataaaatttaacagccattcgattccgattcggcttaatttattgttttcaatcgtcattttactctttatgaccattattggtcgtttgttgtatatgcaggttttgaacaaggatttttacgaaaaaaagctagcctcagctagtcagaccaagattacaagcagttcagcccgtggggaaatttatgatgctagtggaaaacctttggtagaaaatacgttaaagcaggttgtttcctttacgcgtagcaataaaatgacggctacagacttaaaagaaacagctaaaaagttactgacttatgtgagcatcagttctccaaatttgacagaacgccagctggcggattactatttggctgatcctgaaatctataaaaaaacagtggaagctctcccaagtgagaaacgcttggattcagatggcaatcgtctatccgaatcagaactgtataacaatgcggtcgatagtgtccaaacaagtcaactaaactatacagaggatgaaaagaaagaaatctatctttttagtcagttaaatgctgttggaaactttgcgacaggaaccattgctacagatcctctaaatgattctcaggtggctgttattgcctctatttcaaaggagatgcctggcattagtatttctacttcttgggatagaaaggttttggaaacttccctttcttctatagttgggagtgtatccagtgaaaaagctggtctcccagcggaagaagcagaagcctatcttaaaaaaggctattctctaaatgatcgtgtaggaacctcctatttggaaaagcaatatgaagagaccttacaaggaaaacgctcggtaaaagaaatccatctggataaatatggcaatatggaaagcgtggatacaattgaggaaggtagtaagggaaacaatatcaaactgaccattgatttggctttccaagatagcgtggatgctttactgaaaagttatttcaattccgagctagaaaatggtggagccaagtattctgaaggtgtctatgcagtcgcccttaacccaaaaacaggtgcggttttgtctatgtcagggattaaacatgacttgaaaacgggagagttgacgcctgattccttgggaacggtaaccaatgtctttgttccaggttcggttgtcaaggcggcgaccatcagctcaggttgggaaaatggagtcttgtcaggaaaccagaccttgacagaccagtccattgtcttccaaggttcagctcccatcaattcttggtatactcaggcttacggttcattccctatcacagcggtccaagctctggagtattcatcaaatacctatatggtccaaacagccttaggtcttatggggcaaacctatcaacccaatatgtttgtcggcaccagcaatctagagtctgctatggagaaactgcgttcaacctttggcgaatatggcttgggtactgcgacaggaattgacctaccagatgaatctactggatttgttcccaaagagtatagctttgctaattacattactaatgcctttgggcagtttgataactatacgccgatgcagttggctcagtatgtagcaactattgcaaataatggtgttcgtgtggctcctcgtattgttgaaggcatttatggtaataatgataagggaggactgggtgacttgattcagcaactgcaaccgacagagatgaataaggtcaatatatccgactccgatatgagcatcttgcaccaaggtttttatcaggttgcccatggtactagtggattgacaactggacgtgccttttcaaatggcgccttggtatccattagcggaaaaacaggtacagccgaaagctatgtggcagatggtcagcaagcaaccaataccaatgcggtggcctatgccccatctgataatccccaaatcgctgttgcagtggtctttcctcataataccaatctaacaaatggtgtaggaccttccattgcgcgtgacattatcaatctgtatcaaaaataccatccaatgaactag

SEQ ID NO: 233 - DNA (genomic), 207 bp, Streptococcus pneumoniae; double-stranded, circular
  misc_feature (B) LOCATION 1...207
  hypothetical: NO
  anti-sense: NO
tacaataagtttatgaataaacaacaatttattattatggcgctatttacagctgctgagacctattttttcaatgaagcctggatgactggccgctatattatggcagccttttgggcaattttactctttagaaatttccgagtcagttatgtgatgggcaaaatcgttgatgtcatcgatcagcattttaataggaaagactag

SEQ ID NO: 234 - DNA (genomic), 243 bp, Streptococcus pneumoniae; double-stranded, circular
  misc_feature (B) LOCATION 1...243
  hypothetical: NO
  anti-sense: NO
gtcctcaagttgaagaaggagcctctgctcatccagttgcccccaatgtatgaagcactagaagtagctccaatgcatccgactggtccaacaccagctacagaaactgttgattcataccgggatatgaagcaccgcaagaatctgttacaattttataagaaatattctgagaacaatatcttatccttatatattccagcgagcaggagatggtgtgagtcctgcattccctatcgataa

SEQ ID NO: 235 - DNA (genomic), 300 bp, Streptococcus pneumoniae; double-stranded, circular
  misc_feature (B) LOCATION 1...300
  hypothetical: NO
  anti-sense: NO
caaatctttacggttcaaatgcaccgaaggtctttgcacttgctcacagcttggaacaagcgccaggactcagcttggcagatactttgtcccttcactatgcaatgcgcaacgagttggctcttagcccagttgacttccttcttcgtcgtaccaaccatatgctctttatgcgtgatagcttggatagcatcgttgagccagttttggatgaaatgggacgattctatgactggacagaagaagaaaaagcaacttaccgtgctgatgtcgaagcagctctcgctaacaacgatttag

SEQ ID NO: 236 - DNA (genomic), 1725 bp, Streptococcus pneumoniae; double-stranded, circular
  misc_feature (B) LOCATION 1...1725
  hypothetical: NO
  anti-sense: NO
ttgaactttacaagagaggagttaaataaaatggataagttaataatttttattgagaaaggaaagcctttctttgaaaaattatcgagaaatatatacttaagagcgataaaagatggttttatttccagtatgccagcagtattattctcaagtatttttatactaatagctgctgtgcccaatatttttgggtttaaatggtctgatgaacagttagcttttattttgaaaccttacaactactcaatgggaattttagctctcttagtagctgggacaactgcaaaatcgttaacagattcagttaatacacgtagtatggagaaaaccaaccaaatcaactacatgtcaacttttttagcagctgttgttggattgttaatactggcagctgatccaattgaaggtggatttgctaatggtcttttaggtactagaggattacttactgcatttttggcagcttttattacagtaaatatctataaagtatgtattaaaaataatgtaaccattagacttcctgaagaggttccaccaaatattgcacaagtttttaaagatgttattccgtttgccttatctgttctttcaatatatggattggatttaattgttagaaatatttttggtacaaatgtagcagaatctgttggtaaaatattagcccctctattttcagctactgatggttatatcggtttagctattgtatttggtgcttatgctttcttttggtttgttggaattcatgggccatctgttgtagaacctttaattgtagctatcagttatgcaaatatagaagctaatgttcagcttgtgcaagctggtatgcacgcagataaaattttaaatccagttactcaaacttttgttgtaacaatgggtggtactggtgcaacactagtagttccatttatgtttatgtggttatgtaaatcaaaaagaaatagaattgtcggacgtgcgtctgtagttcctactttctttggcgtaaatgaaccaatcctatttggtgctccaattgttttaaatcctatcttctttattccgtttgttactgctcctattatcaatgtttggattatgaaattttttgtagatgttctacaaatgaatagtttcagtattattttaccttggacaacacctgctccaattggtattgttatgggaacggcgctggctccattgtcattcgtcttggctataactttaatcattatcgacactttaatctattatccatttgttaaagtttatgaccatcaaattttagaagaagaacggaaaggaaactcttcatctgaattgaaagaaaaagttgctgcaaacttcaacactgtaaaagcggatgctattcttgaaaaagcgggtgtcgatgcagcacaaaataccatcactgaagaaacaaatgtcctcgttctctgtgctggtggaggtacaagtggactccttgcaaatgctttgaataaggcagcagcagaatacaatgtccctgtgaaagcaacagcaggcggctatggtgctcaccgtgaaatgttgccagagtttgatttggttatccttgctcctcaagttgcttcaaactttgaagatatgaaggcagaaacagataagctcggtattaaacttgctaagacagaaggcgctcaatacatcaaattaactcgtgatggaaaaggtgccctagcattcgtacaagagcaattcgattaa

SEQ ID NO: 237 - DNA (genomic), 222 bp, Streptococcus pneumoniae; double-stranded, circular
  misc_feature (B) LOCATION 1...222
  hypothetical: NO
  anti-sense: NO
atgatatttactatggctcatgaccaaagaggaggatctatgaaagacttgtttttaaagagaaagcaggcctttcgtagggagtgtcttggttatctgcgctatgtgctcaatgaccactttgtcttgttcctgcttgtcctgttgggctttctagctaccagtacagtcaactcttacaacattttcctgaaaatcattggcctatccttttgtttgtag

SEQ ID NO: 238 - DNA (genomic), 573 bp, Streptococcus pneumoniae; double-stranded, circular
  misc_feature (B) LOCATION 1...573
  hypothetical: NO
  anti-sense: NO
tcgtcgtttacaggaggaaatttaacagggcaattgactgaaaagattcaagaacatgaattaattaagactaaccaagcagagaaaagtgtacaggatgttttggataattgtattgaaagggtacaaaacaattcactgaaatcagatagggttacttcttttgagaccccgtttgctctcttatttatctttgcgactatagctgtgatgctaacctatgggggttatcgggtcagcgcaggatatatatctgtgggaaccttggtttcgtttttgatttacctctttcaattacttaatcctattagtaatatagctaattttgtaactgtttattctaggagcaagggatcttcagttgcactggataacttgcttgcagttcctaaagaaaaatttgagggaggaaaatcggtatcaggacaagggttgaattttaaccatgtctattttggttatgatgaaaatcgacctgtcttaaaggatattacttgttcaattttcaaggggcaaaaattgcttttgttggaccatctggatcaggaaaatcaacgattgtgcgtttgttag

SEQ ID NO: 239 - DNA (genomic), 792 bp, Streptococcus pneumoniae; double-stranded, circular
  misc_feature (B) LOCATION 1...792
  hypothetical: NO
  anti-sense: NO
aaaaggtttacaagatgctgtaaaacatactcatggtcaacaatgatacatttaactatagaatattgtgataatattatagatccatatacaaatttgggagagcaacaaagaattgcaagtgagctggatttgttaagcaagctgattttaaggagacaagaacaacttgaagagcttaatctacttgtaaaatcccgatttaacgagatgtttggggaaaataaaatatttgaaagcattgataacttatttgatattatagatggtgataggggcaaaaattatcctaaatcagatgagttgtttagtgaggagtactgtttatttttaaatacaaagaatgttactaaaaacggattttcattcgatacaaagcaatttatcactaaaacaaaggataaattacttcgaaaaggcaaacttgagcgttatgatatagtcttgacaacaagaggtactgttggaaatgtagcgtactacgatgaattaataaaatataaacatttacgtataaattcaggtatggtaatattacgtcccaagacaccaaatctaaatcagaaatttattatccatgttttaagaaataataattatagtcgagtgatatcaggaagtgctcagcctcagttaccaattacaaaattaaaaaaaatacttctccccctccccccactagccctccaaaatgagttcgcagactttgtagttcaggtcgacaaatcacaatttgcttgtgagatagctataaaagtgtggagaaatagcttgaaatttagtataatatag

SEQ ID NO: 240 - DNA (genomic), 471 bp, Streptococcus pneumoniae; double-stranded, circular
  misc_feature (B) LOCATION 1...471
  hypothetical: NO
  anti-sense: NO
attactcttactacaatctatactgtagatgaacgtgatggaacaattgaagaaactacttctcgtcaaattactaaagagatggtaaaaagacgtataaggagagggacgagagaacctgaaaaagttgttgttcctgagcaatcatctattccttcgtatcctgtatctgttacatctaaccaaggaacagatgtagcagtagaaccagctaaagcagttgctccaacaacaggctggaaacaagaaaatggtatgtggtatttttataatactgatggttccatggcaacaggttgggtacaagttaatggttcatggtactatctcaacagcaacggttctatgaaagtcaatcaatggttccaagttggtggtaaatggtattatgtaaatgcatcgggtgagttagcggtcaatacaagtatagatggctatagagttaatgataatggtgaatgggtgcgttaa

SEQ ID NO: 241 - DNA (genomic), 543 bp, Streptococcus pneumoniae; double-stranded, circular
  misc_feature (B) LOCATION 1...543
  hypothetical: NO
  anti-sense: NO
attatgaagttattgtctatcgccattcccagctataatgcagcagcctatcttcattactgtgtggagtcgctagtgattggtggtgagcaagttgggattttgattatcaatgacgggtctcaggatcagactcaggaaatcgctgagtgtttagctagcaagtatcctaatatcgttagagccatctatcaggaaaataaatgccatggcggtgcggtcaatcgtggcttggcagaggcttctgggcgctattttaaagtagttgacagtgatgactgggtggatcctcgtgcctacttgaaaattcttgaaaccttgcaggaacttgagagcaaaggtcaagaggtggatgtctttgtgaccaattttgtctatgaaaaggaagggcagtctcgtaagaagagtatgagttacgattcagtcttgcctgttcggcagatttttggctgggaccaggtcggaaatttctccaaaggccagtataccatgatgcactcgctgatttatcggacagatttgttgcgtgctagccagttctaa

SEQ ID NO: 242 - DNA (genomic), 1956 bp, Streptococcus pneumoniae; double-stranded, circular
  misc_feature (B) LOCATION 1...1956
  hypothetical: NO
  anti-sense: NO
aaaacgcttacaggagaaagggagtatatggataatagagaagcattaaaaacctttatgacgggtgaaaatttttatctccaacattatctaggagcacatagggaagaactaaatggagagtatggctataccttccgtgtttgggcacctaatgctcaggctgttcacttggttggtgattttaccaattggattgaaaatcagattccaatggtaagaaatgactttggggtctgggaagtctttaccaatatggctcaagaagggcatatttacaaatatcatgtcacacgtcaaaatggtcatcaactgatgaagattgacccttttgctgtcaggtatgaggctcgtccaggaacaggggcaatcgtaacagagcttcctgataagaaatggagggatggactttggctggcacgaagaaaacgttggggctttgctgaacgtcctgtcaatatttacgaggttcatgctggctcttggaagagaaatcctgatggcagtccttatagttttgcccaattgaaagatgaactcattccttacctagttgagatgaactatactcatattgagtttatgcccttgatgtcccacccactaggtttgagttgggggtaccagcttatgggttacttcgctttagagcatgcctatggtagaccagaggagtttcaagattttgtcgaggagtgtcatacccataatattggggttattgtggactgggtaccaggtcactttaccatcaatgatgatgccttagcctattatgatgggacaccgacttttgaataccaagaccataataaggctcataaccatggttggggtgcccttaattttgaccttggaaaaaatgaagtccagtccttcttaatttcttgcattaagcattggattgatatctatcatttggatggtattcgtgtggatgctgttagcaacatgctctatttggactatgatgatgctccatggacacctaataaagatggcggaaatctcaactatgaaggttattatttccttcaacgcttgaatgaagttattaagttagaatatccagatgtgatgatgattgcagaagaaagttcgtctgcaaccaagattacgggaatgaaagagattggtggtctaggatttgactacaaatggaacatgggctggatgaatgatatcctccgtttctacgaagaagatccgatttatcgtaaatatgactttaacctggtgactttcagctttatgtatgttttcaaggagaattatctcttgccattctcgcacgatgaagtggttcatggcaagaagagtatgatgcataagatgtggggagatcgttacaatcaattcgcaggcttgcgcaatctctatacgtaccaaatttgtcaccctggtaagaaattgctcttcatgggtagcgaatacggtcaattcctagaatggaaatctgaagaacagttggaatggtctaacctagaagacccaatgaatgctaagatgaagtatttcacttctcagctaaaccagttttacaaagatcatcgctgtctgtgggaaatcgataccagctatgatggtattgaaatcattgatgcggataatcgagaccagagtgttctttcctttattcgtaagggtaaaaagggagaaatgttagtctgtatctttaacatggtacctgttgagcggaaagattttacaatcggactacccgttgcaggaatttacgaagaagtatggaatactgagttggaagagtggggaggcgtttggaaagaacataatcaaactgttcaaacgcaagaaggactatggaaagattatgagcagaccttaacctttaccctaccggctatgggagcaagtgtatggaaaatcaaacgtcgcttgaaatctactaaaaccgtcacaaataaaaaccaaaaaggagtagaaaatgaaaaatga

SEQ ID NO: 243 - DNA (genomic), 183 bp, Streptococcus pneumoniae; double-stranded, circular
  misc_feature (B) LOCATION 1...183
  hypothetical: NO
  anti-sense: NO
agatctattaccaagcgaaggaaagataaaaaagccgagggatttcctcgactctttacatattatttgtggctctataatattgtagtgggtaacccccctatggatattatggagcctattttgtgtagaaaaaaagtcccatatgtacctataatgaaaagcgacaaaacaactcattag

SEQ ID NO: 244 - DNA (genomic), 1385 bp, Streptococcus pneumoniae; double-stranded, circular
  misc_feature (B) LOCATION 1...1385
  hypothetical: NO
  anti-sense: NO
gtttaattacttgtatgcgcgccatcatggtggaacatttctcatccgtatcgaagatactgaccgtaaacgccatgtcgaggatggtgaacgttccacaacttgaaaaccttcgctggttaggcatggattgggatgaaagtccagaatcacatgagaattatcgccagtctgagcgtttggacttgtatcaaaaatacattgaccaactattagctgaaggaaaagcctataaatcttacgttacagaagaagagttggcagctgaacgcgaacgccaagaagtagctggcgaaacaccacgctacatcaatgaataccttggtatgagtgaagaagaaaaagcagcttacattgcagaacgtgaagcagcagggatcatcccaactgttcgtttggctgtcaatgagtcaggtatctacaagtggcatgatatggtcaaaggcgatatcgaatttgaaggtggcaatatcggtggtgactggattatccaaaagaaagacggttacccaacttacaactttgccgttgccatcgatgaccatgatatgcaaatctctcatgttatccgtggagacgaccatattgctaacacaccaaaacagctcatggtttatgaagcacttggttgggaagctccagagtttggtcacatgaccttgattatcaactctgagactggtaagaagttatctaaacgtgatactaatacacttcaatttatcgaagattaccgaaagaaaggttaccttgcagaagcagtctttaactttattgctcttcttggttggaacccaggtagtgaagatgagattttctctcgtgaagaactcattaaactttttgatgaaaaccgcctcagcaagtcaccagcagcctttgatcagaaaaaactagactggatgagcaatgattatatcaagaatgcagaccttgaaaccatcttggaaatggcaaaaccattcttagaggaagcaggccgtttgactgacaaggctgaaaaattagttgagctctataaaccacaaatgaaatcagtagatgagattatcccattgacagatcttttcttctcagatttcccagaattgacagaagcagagcgcgaagtcatgacgggtganacagttccaacagttcttgaagcattcaaagcaaaacttgaagcgatgacagatgataaatttgtgacagaaaatatcttcccacaaattaaagcagttcaaaaagaaacaggtattaaagggaaaaatcttttcatgcctattcgtatcgcagtttcaggcgaaatgcatgggccagaattaccagatacaattttcttgcttggacgtgaaaaatcaattcagcatatcgaaaacatgctaaaagaaatctctaaataa

SEQ ID NO: 245 - DNA (genomic), 438 bp, Streptococcus pneumoniae; double-stranded, circular
  misc_feature (B) LOCATION 1...438
  hypothetical: NO
  anti-sense: NO
gaaataattactatccacgatagcaatgacgtaaacaggagcgatgtgtttgtagatctagtgagtatcaccttctcgctgatgaattttttcaagattttgattaacctgactgcacaggtaagcccacaagtgattgatgaaaaaattctgatgatggacttgaatctcaataattacttgagtaccgttatccaactccgccaagacgtctatactggtataaaaatcctgcaccgagtagggcatggaaggcaagacatgaatgttacttccctccaaaatagtcacatttttggctggcaagtccagcatatcgcggataaattgacaagtgatttctgggttgctgaaaattttcttagcaaccaagtcattggtcgggctaattcccagatgtctgagaatcatccttttcctccttctatagtgaattga

SEQ ID NO: 246 - DNA (genomic), 1707 bp, Streptococcus pneumoniae; double-stranded, circular
  misc_feature (B) LOCATION 1...1707
  hypothetical: NO
  anti-sense: NO
gaaaagattacccagaccagtctttggaaagtatctaccttagtcttgctggtagaaaagaggaggttgcggatgcgtctcaaggtcattaataaattagttgatatcaatatcctttattcatctcaagaagctaatctggctaatctacgaaagaagcaggctaagaatcctgggaaaaaagtaaatgtttccgctagagtcctaagttcttacattttttccagtctcttgatgctcatctgttttagtaatatagcctttcgttttccttttgaggaaatgccaagtttttttagtacgatggttgctattttactggtgctggccttttcaacttctttcactgcattttacaatgtcttttatgagagtaaggacctggcctcctataggccctatgcctttaaagaatcagagattataatggccaaaggtctgtctgtcctcttgccagctctaactggaattgtaccaatcctagcttattttctggtcctctacattaggctagcaccttctctgtggttgggtttgcctttgatgctactgtccttgaccttattatttgtctctgttactttagtgacggtagtggcagtacatttcttggctcagactagggtcttcagaaagtatcagtctattttttcgaatgtgatgattgggataggagttctcatacctttaatatttatcttctttcttcagtcgacttttggaagtattgttgacaaagttagagacattccatttctcctttatcctcttcatatcttttacaaaatagcagtggagcctttttcgacagaagccttagtgggtctgctcgcttggataggactaactctcttcctgctttatctgaccaaaaagaaggtccttcctcgtttttatgacgtgatcctgcttaacagtgaggagaaggtcaaaaaagaacgtcgcagcaaggagaggatttcaactactaaaaagggctttttccgtatggttttacgctaccacctcaccctcttgggacaggggactggcgtgattacagtgctttttacaagtgctttccttccttatctcatgatgatcagtctgatttccaaaatccgagattctcagatagttccagacattcatcctccatactggttacccttgttttttgtaggagtgtttatagcagttgtcaataacaatatcaccagcctgcattcaattgccttgtccttggagagggaaaatgttgattttcttaagagtttaccctttgactttgctcgttatgtgaaagtgaaattttggattatctttgctgttcagtcctttttaccagttctgactttgcttggtctttctctatatctaggcttgcccatcatttcgatgatttaccttcttgtagtctggatcattgccagtgtcatcctttcttgccaccattactttaaggacgttaaaaatctgtcaacaaattggagtagcattacggacctggtgaatcgttcaaatggcatagtcgccatagttttattgtttatttatagtgcaatcctgatggcccttgtaattgggagcatattcttggttcagtctctctccactatccttgccatcagcttgggagtaggagctcttatcctcctgcttgctcttgctatttttggctatcattattacctgtcacgcatattggcagaaatagaaaaaagatga

SEQ ID NO: 247 - DNA (genomic), 237 bp, Streptococcus pneumoniae; double-stranded, circular
  misc_feature (B) LOCATION 1...237
  hypothetical: NO
  anti-sense: NO
agactttctaccaggttttttaaaagcataattgttagttgtagtcatttattattcttcaaagaaaaatggtggggcgaattttttcagttcttcaaagcacttttgagcagtatctgcatcttcacagatgataagacagacatcattaccacaaagggtagcgatagcgtcagggaagctcaaagtatcaatgatagaaccaaaggattgagccagtccaggaagggtttttag

SEQ ID NO: 248 - DNA (genomic), 243 bp, Streptococcus pneumoniae; double-stranded, circular
  misc_feature (B) LOCATION 1...243
  hypothetical: NO
  anti-sense: NO
cggtttgagtttgctggctttacgtggagtttgtgcttgaggatatatcttcatgggcccttgataatcactgtcagtcaagattttaccagcttgtccgatatttctgcgactcattttgaacaacttcatatcatgacaatagttcacagtgatatccaaagaaacaattctcccttgacttgtgacaatcgcttgagccttcatagcgtggcatttctttttaccagaataattcgctaa

SEQ ID NO: 249 - DNA (genomic), 243 bp, Streptococcus pneumoniae; double-stranded, circular
  misc_feature (B) LOCATION 1...243
  hypothetical: NO
  anti-sense: NO
cgacttgagtttgctggatttacgtggagtttgtacttgaggatatatcttcatgagtccttgataaccactgtcagccaagattttaccagcttgtccgatatttctgcaactcattttgaacaacttcatatcatgacaatagttcacagtgatatccaaagaaacaattctcccttgacttgtgacaatcgcttgagccttcatagcgtggcatttctttttaccagaatcattcgctaa

SEQ ID NO: 250 - DNA (genomic), 243 bp, Streptococcus pneumoniae; double-stranded, circular
  misc_feature (B) LOCATION 1...243
  hypothetical: NO
  anti-sense: NO
cggcttgagtttgctggatttacgtggagtttgtgcttgaggatatatcttcatgagcccttgataaccactgtcagccaagattttaccagcttgtccgatatttctgcaactcattttgaacaacttcatatcatgacaatagttcacagtgatatccaaagaaacaattctcccttgacttgtgacaatcgcttgagccttcatagcgtgaaatttctttttaccagaatgattcgctaa

SEQ ID NO: 251 - DNA (genomic), 252 bp, Streptococcus pneumoniae; double-stranded, circular
  misc_feature (B) LOCATION 1...252
  hypothetical: NO
  anti-sense: NO
cggcttgagtttgctggatttacgtggagtttgtgcttgaggatatatcttcatgagcccttgataaccactgtcagccaagattttaccagcttgtccgatatttctgcaactcattttgaacaacttcatatcatgacaatagttcacagtgatatccaaagaaacaattctcccttgacttgtgacaatcgcttgagccttcatagcgtggcatttttttacaagaataattcgctaattcttttttag

SEQ ID NO: 252 - DNA (genomic), 243 bp, Streptococcus pneumoniae; double-stranded, circular
  misc_feature (B) LOCATION 1...243
  hypothetical: NO
  anti-sense: NO
cggcttgagtttgctggatttacgtggagtttgtgcttgaggatatatcttcatgggcccttgataaccactgtcagccaagattttaccagcttgtccgatatttctgcgactcattttgaacaacttcatatcatgacaatagttcacagcgatatccaaagaaacaattctcccttgacttgtgacaatcgcttgagccttcatagcgtgaaatttctttttaccaaaatcattcgctaa

SEQ ID NO: 253 - DNA (genomic), 318 bp, Streptococcus pneumoniae; double-stranded, circular
  misc_feature (B) LOCATION 1...318
  hypothetical: NO
  anti-sense: NO
gttggttctacctgcaaaagattaccaggcaagccgacattcactgatttaatcgaaatgcctgccttttcttccgcttgggaaatggctgacttgatagcagttgctgctgtatcaatatcaacaataattccatcctttacacctttacttttggcattactcacgccaattacatttaattcaccatttctctgctcggccacaagcaccttgacagagcttgttccaatatctagacctgtaaaaaagccttctctagccattacatcgcttcctctctatcttccaagtttcgcacttcgtattattccatag

SEQ ID NO: 254 - DNA (genomic), 228 bp, Streptococcus pneumoniae; double-stranded, circular
  misc_feature (B) LOCATION 1...228
  hypothetical: NO
  anti-sense: NO
tacacctctacttctaaaacattgttagaaatcgatttgactgtcctgattgatttgtcctattattatttcattttactatactctgttaatttatatgagtttaaaccgatttcatctttaacctcgagtaaagcagtttcaaatatttgtttaagagtttttgattctttacaattaaccgacaaactttctgataaaatatgtacaacttctgagactgaataa

SEQ ID NO: 255 - DNA (genomic), 261 bp, Streptococcus pneumoniae; double-stranded, circular
  misc_feature (B) LOCATION 1...261
  hypothetical: NO
  anti-sense: NO
tacacctctacttctaaaacatttttagaaatcgatttgactgtcctgatcgatttgtcctgttcttgtttcattttactatatagatcgcattcgaaagaattcgttccaaaattgcttggttcgttcttctcttggacgactaaagaattgatgggcattatttttttcaacaattttcccactgtctataaaaataacatgatgggctacatctctagcaaaacctatctcataaagctgatcaaaaactcaatctga

SEQ ID NO: 256 - DNA (genomic), 192 bp, Streptococcus pneumoniae; double-stranded, circular
  misc_feature (B) LOCATION 1...192
  hypothetical: NO
  anti-sense: NO
tacacatctacttctaaaatattgttagaaatcgatttgactatcctgatctatttgtcctgttcttatttcatttcactatatctcaaattgagtatgacgaagtgcgctcccatgtcctgggaacgcactttcttcatatttttcatattcttgaatccatcgataaagactattgggatgaatttttaa

SEQ ID NO: 257 - DNA (genomic), 2586 bp, Streptococcus pneumoniae; double-stranded, circular
  misc_feature (B) LOCATION 1...2586
  hypothetical: NO
  anti-sense: NO
ccaactgagttttctatcattctacgaggtaacatgaaatcatttttaaaaacatatcgaacctattttatttctttcatcattcctgtagtgattatgtctggagtatatctatctcaaggtatctactggaatagcgacaactctcctctattaggagatggctttcatcaatacgttatttttgatatagccttacgaaatatcctacatggaaatagtagtctgttttacacctttacaagtggtctagggctaaacttctatgccctatctagttattacttgggtagttttctcgcgcctctggtttacttttttgatctaacgaatatgccagatgctatctatctgacaactctcttaaaatttggattgattggtctgtcaaccttttttagtttgaataaattgtttcaatctatccctcagactttaaaactagccttatctacttcctatgctctgatgagtttcactgtcagtcaattagagataaaaacctggctagatgtttttatcttgattcctttaattataactggtttacatctactgataactgaaaagaaactcctattgtactttacaagtctgtcaatcttatttattcaaaattattattttggatatatgacagtattgtttcttattttctggtatctctgtcaaatttcgtgggactttaagactcgaaaatcatctgttcttgatttcatagttatctcctttttagctggtatggctagtttgattatgactcttcccactctatttgatttacagacacatggggaaaaattgactgaagttacaaagtttcaaactgaaagtagctggtatcttgatctctttgctaagcaattcattggttcctttgacacaacaaagtatggggccatcccaatgatttttgttggactacttccctttattttgaccattttattttttacgctgaaatctattaagtttcacgtgaaactcatatatgtaatattctttgcatttctaattgcaagcttttacatagaagctcttgacttattttggcaaggcatgcatactccaaacatgtttttacatcgctatgcttggattttctctaccttgttaatttacacagcagcagaagtcttaaagcgtctgaaagaacttaaagtctggaattttttagtttcgctttttcttgtagtagcaggatttttagctaccatctatctaaaatcgcattattcttttttaacagatttgaatattctgcttactcttgaatttttggttgtctattctcttttactccttgcagttatcaaaaagtttatatctgtgaatctatttgccattctaatctctttatttatactggttgaaatgagtttaaatgcttcatctcaaatggacggaattgctaaggaatggggatttgcttctcgaagtgcttatagtcgagatatcccagctatggaatctttctcaacatatattggaaatcaatttactcgtactgaaaaactacaaactcagacaggaaatgacagtatgaaattcaactacaatggaatctctcaattttcatctgttcgaaatcgttcatcaagctctactttagataaacttggttttaaatcctctgggactaatctcaatctccgatatgcaaataatagtattttggctgatagtttatttggtatccagtacaatatctcagacagtcctattgataagtatggctttaaagatatctatcaaaaagataatcttaccctatatgaaaatcaatactctcttccgattgcagttgctagtcaatctgtttacaatgatgtcaagttcaatgaacataccttggataatcaggcctcatttttaaatcaacttgctaacgtcaattttgattatttttctccaataccttatgaaaaaacagaaaaaatagaaaatactaatgatttgattagtgtcacaagttcttcaaatgaagatgcagcaatccagtatcaaattgaagttccagaaaacagccaagtttatctctctttcataaaccttcacttttctaacgataaacaaaagaaggttgacatccttgtaaatggtgaaaaaaagacttttacaactgataatgtcttctccttctttaatctaggatatactaaagagaaaaaaactttcaatatcaatgttagtttccctggaaattcacaagtatcatttgaatctcctaccttctatcgtttagataccaaaactttcaccgaggcaattcaaaaaattaaagaacaacctgtcacagtatcaacttctaaaaacaaggtttttgctacatatgatgtccaacaagatacatctattttcttcaccattccttatgacaaaggttggtctgcctaccaagatggtaagaaaatagaaattaaacaagctcaaactggatttatgaaagttgacattcccaaggggaaaggaactattacactttccttcattccctatggttttattactggagcaatctgttcctttacttctctcttactatttggaatctataatcacagacgaaagtcatctaaggcataa

SEQ ID NO: 258 - DNA (genomic), 192 bp, Streptococcus pneumoniae; double-stranded, circular
  misc_feature (B) LOCATION 1...192
  hypothetical: NO
  anti-sense: NO
aggattcctaccttatttcacaacgatattaacgagtttagttggctcaaacagtttgggaaactgtttgaggttggaaatcagcaaataaattggttattttacaacaatattaaccaatttatttggtacactaatcactttcacgatttccttaccgtcaatttctgctttgactttttcatccgctag

SEQ ID NO: 259 - DNA (genomic), 936 bp, Streptococcus pneumoniae; double-stranded, circular
  misc_feature (B) LOCATION 1...936
  hypothetical: NO
  anti-sense: NO
atgatcgagtttgaaaaaccaaatataacaaaaattgatgaaaataaagattatggcaagtttgtaatcgaaccacttgaacgtggctacggtacaactcttggtaactctcttcgtcgtgtacttctagcttctctaccaggagcagctgtgacatctatcaacattgatggtgtgttacatgagtttgacacagttccaggtgttcgtgaagacgtgatgcaaatcattctgaacattaaaggaattgcagtgaaatcgtacgttgaagacgaaaaaatcatcgaactggatgttgaaggtcctgctgaagtaacagctggtgacattttgacagatagcgatattgaaattgtaaatccagatcattatctctttacaattggtgaaggttcttctctaaaagcgactatgactgttaacagtggtcgtggatatgtacctgctgatgaaaataaaaaggataatgcaccagttggaacacttgctgtagattctatttatacaccagttacaaaagtcaactatcaagtggaacctgctcgtgtaggtagcaatgatggtttcgacaaattaacccttgaaatcttgacaaatggaacaattattccagaagatgctttagggctttcagcacgtattttgacagaacatcttgatttgtttacaaatcttactgagattgctaagtcaactgaagtgatgaaagaagctgatactgaatctgacgaccgtattttagatcgtacgattgaggaactggacttgtctgtgcgttcatacaactgtttaaaacgtgccggtatcaatactgtgcatgatttgacagaaaaatctgaagcagagatgatgaaagtacgaaatcttggacgcaagagtttggaagaagtgaaactcaaactcattgatttgggtcttggattaaaagataaataa

SEQ ID NO: 260 - DNA (genomic), 1323 bp, Streptococcus pneumoniae; double-stranded, circular
  misc_feature (B) LOCATION 1...1323
  hypothetical: NO
  anti-sense: NO
tgtgaaactacaagcgatttactttatggaaggaatagaatgacaaaggttgtttttgaagaaaaatactatccagctgtaaaagaaatggtttatcgaactcgtttggccaacggattgacagttgctcttttgcctaaaaaggaatttaaagaggtttacgggagtgtcactgtacagtttggttcggtagatacgtttgtcacagaagttgacggagatgtaaaacaatatcctggaggaattgctcattttcttgaacataaattatttgagagagaagattctagtgatttgatgtcggcttttacgagtctaggtgcagatagtaatgcctttacaagctttacaaaaacaaactatcttttttcagcaacggattattttttagaaaatttagatttacttgatgaattggtaacatcagcacactttactgaagcttccattctgacagagcaggatattattcagcaagaacgagaaatgtaccaagatgatccagattcgtgtttattcttttcaactttagcgaatttgtatcctggtacacctttagcaactgatatagttggaagtgaggagtccatttcccaaatcaatctaactaatttgcaagaaaattttacaaagttttacaaacctgtaaacatgtctctgtttttagttggtaattttgatgtggagcgagtacaggactattttgaaagcaaagaactgaaagattcagattttcaggaagtagcaagagaaaagttgtttttacagcctgtaaagctaacagatagtatgagaatggaagtatcttctcccaaactagcgattggagttagaggtaagcgagaagtttctgaagcggattgctatcgacatcatattttattaaaattattgtttgcaatgatgtttggttggacttcggatcgttttcaaaaatgttatgaatcaggtaaaattgatgcgtccttatctctggaagttgaaataacaagtcgctttcattttgtcatgttgacaatggatacgaaagagccagttgctttgtctcatcaatttaggaaggctattcgtaattttacaaaggatttagatattacagaggaacatttagatattatcaaaagagagatgtttggcgaatttttcagtagcatgaactctcttgaatttattgcaacgcaatatgatgcttttgaaaatggtgagacaatttttgatttgccgaaaattttacaggaaattactttagaggatgtccttgatgctggacatcatttaatagatgatggtgacatagttgattttacaatattcccatcgtag

SEQ ID NO: 261 - DNA (genomic), 942 bp, Streptococcus pneumoniae; double-stranded, circular
  misc_feature (B) LOCATION 1...942
  hypothetical: NO
  anti-sense: NO
aaacagactacgtacaggcttgcacaggttggggtgcagccttatcgacaagtacatgctcactcaacaggtaaccgcaactcaaccgtacagaatgaagcggattatcactggcggaaagacccagaattaggttttttctcgcacgttgtcggaaacggtcgcatcatgcaggtaggacctgtgaacaacggaagttgggatgttgggggcggttggaatgctgagacctatgcagcggttgaactgattgaaagccattcaactaaggaagagtttatggctgactatcgcctctatatcgaattgctacgcaatctagcggacgaagcaggcttgccgaagactcttgatacagacgacttggcaggtatcaagacgcatgaatactgtaccaataaccaaccaaacaaccactcagaccacgttgacccttatccatatcttgcaagttggggcattagccgtgaacagtttaagcaagacatcgaaaacggcttgagcgctgcaacaggctggcagaaaaatggcactggctactggtacgtacactcagacggcttttatccaaaagataagtttgagaaaatcaacggtacctggtattatttcgatggctcaggctatatgctttcagaccgctggaagaagcacacagacggtaattggtactggttcgacaactcaggcgaaatggccacaggctggaagaaaatcgctgagaagtggtactattttgatgtagaaggtgccatgaagacaggctgggtcaagtacaaggacacctggtactacttagacgctaaagaaggcgccatggtatcaaatgcctttatccagtcagcggacggaacaggctggtactacctcaaaccagacggtagcatggcagacaagccagagttcacagtagagccagatggcttgattacagttaaataa

SEQ ID NO: 262 - DNA (genomic), 1254 bp, Streptococcus pneumoniae; double-stranded, circular
  misc_feature (B) LOCATION 1...1254
  hypothetical: NO
  anti-sense: NO
aataagactactatgaaaaaaatatttttaactttgttaactgtctctcttttagggggtgcttctactgctgttgctcaagattttaccattgccgctaaacatgcgattgctgttgaggcaaatactggtaaaattctctatgagaaggatgcaacgcaacctgtcgaaattgcttccataacaaaattgattactgtttatctggtctatgaagctttggaaaacggaagtattaccctctccactcctgtagatatttctgattatccttatcaattgacgacaaattctgaagccagtaatattcctatggaggcccgtaattatactgtcgaagagttgcttgaagcaactctggtatctagtgccaacagcgccgctattgccctagctgagaaaattgctggctcagaaaaagatttcgtcgatatgatgcgggcaaaactcttggaatggggaattcaggatgccactgttgtcaatacgacaggtcttaacaatgaaactctaggggataacatttacccaggttctaaaaaagatgaggaaaataagcttagtgcttatgatgtcgctatcgttgctcgcaacctcatcaaaaaatacccacaagtcttagaaatcaccaaaaaaccttcttctacttttgctgggatgacaatcacttcaaccaactacatgttagaaggtatgcctgcttaccgtggtggttttgatgggctaaaaacaggaacaacagataaggctggagagtcttttgttggtactactgtcgaaaaaggcatgagagtcatcacagttgttttaaatgcagatcatcaagacaataatccttacgctcgatttacagctacatcttccctaatggattatatttcttctacatttacacttcgcaaaatcgttcaacaaggcgatgcctatcaagatagcaaagcccctgtacaagatggaaaagaagatacagtaactgcagtggctccagaggatatctatctaatcgaacagattgggaatcaatcttcccaatctgttcaattcacacctgattccaaagcaatcccagcaccacttgaagctggaacagtggttggccatttgacttataaagacaaggacttgattggtcaaggttacatcaccacagagcgccctagtttcgaaatggtagcagacaagaaaattgaaaaagccttcttcttaaaagtttggtggaatcagtttgtccgctttgttaacgagaaattataa

SEQ ID NO: 263 - DNA (genomic), 405 bp, Streptococcus pneumoniae; double-stranded, circular
  misc_feature (B) LOCATION 1...405
  hypothetical: NO
  anti-sense: NO
ctacattataccagatttggagaaaatatgttagaaattaaaaacctgacaggtggctatgttcatgttcctgttttgaaagatgtgtcctttactgttgaaagtgggcagttggtcggtttgattggtctcaatggtgctgggaaatcaacgacgatcaatgagattatcggtctgttggcaccttatagtggctccatcaatatcaatggcctgactctgcaaggagatgcgactagctaccgcaagcagattggctacattcctgagacgcctagtctgtatgaggaattgaccctcagagagcatatcgaaacggttgctatggcttacggtattgagcaaaaagtggctttcgaacgagtagagcccttgttaaaaatgttccgtttggacagaaattag

SEQ ID NO: 264 - DNA (genomic), 339 bp, Streptococcus pneumoniae; double-stranded, circular
  misc_feature (B) LOCATION 1...339
  hypothetical: NO
  anti-sense: NO
aaaaactatacaccagagcaacaaaaactccatgatcaatttgaagcagaagcaacggaagatgctaaaaaacaaggcgatattgtgttgaatgttgaccaggatttcatgagcatatctaagtctaataaaagtggttcagactggaagaaaactttcacagtgaggacaaccaataggctagcaaatgacttgaataatgtcttgaaacaggctgataaagatactcctaataccccaacttggctaaactcagctgcttctaaagctaaagatgatgacagagcatataaactactgaagactcttataccaggagaaaattacctatcatgttaa

SEQ ID NO: 265 - DNA (genomic), 330 bp, Streptococcus pneumoniae; double-stranded, circular
  misc_feature (B) LOCATION 1...330
  hypothetical: NO
  anti-sense: NO
tcactatatacgagaatttcgctattgttatggacccatacaggcgaatcatttttcttaatagctggtggatgtaatactgagtggatgaacgtctttttagaagagctttcacaagcttatccagatgattaccttttattcgttatggacaatgctatatggcataaatcaagtaccttaaagattccgactaatattggctttgcatttattcctccgtacacaccagagatgaaccccattgaacaagtgtggaaagagattcgtaaacgtggatttaaaaataaagcctttcaaactttggaagatgtcatgaatcaactttaa

SEQ ID NO: 266 - DNA (genomic), 348 bp, Streptococcus pneumoniae; double-stranded, circular
  misc_feature (B) LOCATION 1...348
  hypothetical: NO
  anti-sense: NO
cttggagagttgtcgataccgctaaggcagtcttcaacgttgataactacaaagaatatctttcattgcaatgtgatagcgccctccgtaatattgtccgcatctatccttacgatgtgtctcctaatgtggatactacgggtgaacggcaagcaaatgaaagtagtctccgtggctctagcgaaattgttgctaaccgtattcgtgaaaaaatccaaagtcgtgttgaagatgctggcttggaaatccttgaagcacgtatcacttacctacctaatgctccaaaaattgctgccgttatgcttcaacgccaacaaacatctgccattattgatgcacgaaaaataa

SEQ ID NO: 267 - DNA (genomic), 282 bp, Streptococcus pneumoniae; double-stranded, circular
  misc_feature (B) LOCATION 1...282
  hypothetical: NO
  anti-sense: NO
tttcaatataccataactgttcctagtcaacctgcaagccctgtcccagctccaagctcagctccgactcaagatcctagagtggtagcaagcgcttcggctagctcaacgagcacacaagctcaagagcaagttgacaagtctgaacttcgtgccttgagtcaagagttagaccaacgcttgaaagctttggcaacaatatctgatccgaaaatcgatgcaaccaaggctgtcctcctagatgctcaaaaagctccggaagatagtgccttgacagagtaa

SEQ ID NO: 268 - DNA (genomic), 822 bp, Streptococcus pneumoniae; double-stranded, circular
  misc_feature (B) LOCATION 1...822
  hypothetical: NO
  anti-sense: NO
gcaagatatacaagattttattataaaagcttttcttttagtgaactgataggtattttcttagcaaacgataaagttttagggccgatacaatcaattgcctattcattaaataagataaatacaaccaaagatttaaggaaaccgtttttaaaatacttaagtggagagaagaattttatagacgctgaacatgataataacggactgtatacttcatcaatagatgtgatacacatgaaagatgttgtatattctattacaccagaaaataaattaagtattgacttctcatttaagtcaccatttagggtattattaacaggaacttctggtagtgggaaaacaacgattttaaatttaattaatggttctttaaagccacaaaaaggttatgtaaatttgttatcacatgggaaaaagagttcagattcaataccaacagttgatcagacaccatatatttttgacactactattcgtgagaacgtaactttatttcaaaatgaatatttttcagatgatcagataattgaggtgttaaaaaaggtaaatctatatgaagaattagaaaagatagatatactaaattatcaatgtggtgaaaatggtagtaatttgtctggaggtcaaaaacaaaaaatagctttagctagagctctgattagaaataataaagtgtacttatttgacgaaatatcagctaatttagataatgataattcaaattccatacatgatattctgttcaatttaggtatttcatttattgaagtttcacatcattatgacttaaatgacaagagatacactgatatataa

SEQ ID NO: 269 - DNA (genomic), 1506 bp, Streptococcus pneumoniae; double-stranded, circular
  misc_feature (B) LOCATION 1...1506
  hypothetical: NO
  anti-sense: NO
acaaagtatactagtaatcctttctgtggagttctggttggtattgggatgactgctctaattcagtctagttctggtgtaacagttatcacagtcggcctggtcagtgccggtctcttaaccttacgtcaggctatcgggattgtcatgggtgctaatattgggacaactgtcacatcctttctcatcggttttaaattaggtaactatgccctacctatgctctttatcggtgccgtctgtctcttttttacaaaaaatcggacagtcaataatatcggacgcatcctctttggtgtcggtggtatcttttttgccctcaatctcatgagcggcgcaatggctccactcaaggatttacaggtctttaaggactatatgattgagctaagtaaaaatcctgttttgggtgtctttgtcggtactggcttgaccttgctaattcacgcttcttcggctaccattgggattttacaaaacctctacgccggcaatctaattgacctacagggagctttgccggttctatttggtgacaatatcgggacaaccattacagccatcattgcctctttaggggctaatattgcagctaaacgggtagcaggagctcatgttgccttcaacgttatcggaacagtcgtctgcgttatttttctagttccttttactgtcctgattcattggtttgaagctacgctaaatctagcaccggaaatgaccatcgcctttgctcacggaacctttaatattaccaacaccattgtccaatttccatttatcggagctctggcttactttgtaaccaagattattcctggagaggacgaggttgtcaaatacgaacccttatatcttgatgaacatttcatcaaacaggccccatctatcgctctaggaaatgctaagaaagagctcttgcacttaggaaactacgctgctaaagcctttgacctttcctataagtacatcattgacttggatgaaaaagttgctgaaaaagggcataaaaccgaagaagcaattaacaccatcgatgagcaattaacacgttatctcattgccctttcaagcgaagctctcagccaaaaagaaagtgaagtgcttaccaatatccttgattcctcccgtgatttggaacggattggagaccacacggaggctctactcaatctgactgactatcttcaacggaaaaatgttgaattttctgatgccgccttgaaagaattagaggaagtttaccgccaaactagtgactttatcaaagatgctctggatagtgtggaaaacaatgatattgaaaaagcacgcagtcttgtagaacgtcatgaagcaatcaataagatagaacgtgttctcagaaaaacccacatcaaacgcctcaacaaaggcgaatgttcaacacaagctggggtcaactttatcgacatcatctcacactacactcgtgtatcagaccacgctatgaaccttgctgaaaaggtttttgcagaacaaatctaa

SEQ ID NO: 270 - DNA (genomic), 201 bp, Streptococcus pneumoniae; double-stranded, circular
  misc_feature (B) LOCATION 1...201
  hypothetical: NO
  anti-sense: NO
ttctttcataccaacgtctttctaactgataatagtcctttttattatatcaaaaaaagccccctgagtcactctaaaacgngactggaaagcatttgggaattctttagacagagattctcagttttagcggcaaatttgggtcaggataaagaaaaaagccctattaaaggctttttaggatgtttacatccaccctga

SEQ ID NO: 271 - DNA (genomic), 1254 bp, Streptococcus pneumoniae; double-stranded, circular
  misc_feature (B) LOCATION 1...1254
  hypothetical: NO
  anti-sense: NO
atcatggagttagtgcatggaatttcaacacattttatccaatcaaaaaagtttaaaacaaacaaaattaccgtgcgttttaccgctccattatcccttgatacgattgcaggtcacatgttgagtgcaagtatgctagagactgctaatcagatgtaccccacttctcaagatttgaggagacacttggccagtctatacggtacagatatgtcaaccaattgtttcagaagagggcaaagccacattatagaattgacatttacctatgttcgtgatgagtttttaagtaggaaaaacgtgctaacctctcagattttggaacttgtaaaagaaactcttttttcacccgtagtagttgataatgggtttgatccggccttatttgaaattgagaaaaaacaattgctagcaagtttagcagctgatatggatgattctttttattttgcacataaagaattggataaattgttttttcatgatgaacgtcttcaattggaatatagtgatttacgaaatcgtattttagctgaaactccacaaagttcttactcttgtttccaagaatttttagccaatgatcgaatagatttctttttcctaggtgattttaatgaggttgaaattcaaaatgtattagaatcatttggctttaaaggtcgaaaaggagatgtgaaggttcagtattgtcaaccttattctaatatccttcaggaaggtatggttcggaaaaatgtgggacaatccattttggaattaggttatcattaccgttctaaatatggtgatgaacaacatttacccatgattgtaatgaatggtttacttggtggatttgctcactctaagctctttacaaatgtccgtgaaaatgctggattagcttataccatttcaagtgagcttgatttatttagtggattcttgaggatgtatgctggtatcaatcgagaaaatcgtaaccaggctcgtaaaatgatgaataatcaactgcttgatttaaaaaaaggttattttacagagtttgagttaaatcagaccaaggaaatgattcgttggtcgttgttactttctcaagataatcaatcttcattgattgaacgtgcttatcaaaatgccttatttggaaaatcttcagcagactttaaaagttggattgcaaagcttgaacaaattgacaaagatgctatttgtagagtagctaataatgtgaaactacaagcgatttactttatggaaggaatagaatga

SEQ ID NO: 272 - DNA (genomic), 336 bp, Streptococcus pneumoniae; double-stranded, circular
  misc_feature (B) LOCATION 1...336
  hypothetical: NO
  anti-sense: NO
caatcggagttccaagtcaacggaagtagatggtttttagaaatgagaaatatcggacaagctggtaaaatcttggctgacagtggttatcaagggctcatgaagatatatcctcaagcacaaactccgaggaaatcaagtaaacttaagccattaactcttgaagataaagcctgtaatcatgcgctatctaaggagagaagcaaggttgagaatatctttgccaaagtaaaaacgtttaaaatgttttcaacaacctatcgaaatcatcgtaaacgcttcggattacgaatgaatttgattgctggtattatcaatcatgaactaggattctag

SEQ ID NO: 273 - DNA (genomic), 192 bp, Streptococcus pneumoniae; double-stranded, circular
  misc_feature (B) LOCATION 1...192
  hypothetical: NO
  anti-sense: NO
tttcaacatactataaaatcaggcaatacaacggctaaaaagtttgagtttatcgaaataccagtgcaaaaactgaaaaaagcgatttataaagctcatctcaaagattcagatgactttagaccagaaacatccacaccaaatctttttgaaagctgtttgaagctttgtccttgctttcttagttcatag

SEQ ID NO: 274 - DNA (genomic), 561 bp, Streptococcus pneumoniae; double-stranded, circular
  misc_feature (B) LOCATION 1...561
  hypothetical: NO
  anti-sense: NO
cattggcatacatgtttgttagaagacggattacaaacggaggtatttgtaatgttagaatctaaaaaaacaactcgatatgtattttatgtctatctgatgttattaacttggggaatcttatttaagtttgaaacaaatcctgaatttatagcatttttcttagctccaaggtatatcaattggattccattttcagaaccactaatagtcgatggaaaaattgtttttgctgaaatgttatttaatctgattttctttattccattaggtgtttgtttccctttgataaaaactaatttatctagtttaagaatagtcgggacaggtttcttgattagtttattgtttgagtgcttacagtatattttagcaataggtataacagatataacggatttgactttaaatacgctaggtgtctgtgtaggcttactgatttatcaaatttttataagagtgttcaaatcacagactagaaaatggatcaatatcttaggtatgcttagccttggttttgcttatcttgttttactgttactgcatttaattggtgtttaa

SEQ ID NO: 275 - DNA (genomic), 624 bp, Streptococcus pneumoniae; double-stranded, circular
  misc_feature (B) LOCATION 1...624
  hypothetical: NO
  anti-sense: NO
ttaaaggagtttcatatgtcaaacgaaaaaaacacaaacactaacgtagaaaagaaagatgctactgttgtagctcacgaaatcaaaggggaacttacttacgaagataaagttatccaaaaaatcattggtctttcactagaaaacgtttcaggtcttttgggaatcgatggtggtttcttctcaaatcttaaagaaaaaatcgttaacagcgatgacgtaacaagtggtgttaacgtagaagttggtaaaacacaagttgcagttgacttaaacgttattgttgagtaccaaaaaaatgttccagctttatattcagaaatcagagaaatcgtatcttcagaagttgctaaaatgactgacttggaaattgttgaaatcaacgtaaacgttgtcgacatcaaaactaaagaacagcatgaagcagactcagtaagccttcaagatcgcgtatctgacgttgctgaatcaacaggagaattcacttcagaacaattcgaaaaagctaaatctggtcttggatctggtttctcaactgttcaagaaaaagttagcgaaggtgtagaagctgttaaaggtgcagcaaatggtgtagtatctcacgaaaacactcgtgtaaactaa

SEQ ID NO: 276 - DNA (genomic), 237 bp, Streptococcus pneumoniae; double-stranded, circular
  misc_feature (B) LOCATION 1...237
  hypothetical: NO
  anti-sense: NO
ataaaggagttaatcatgaaggtagtaaacttgtatgatttgaaacaaatgggaaataaaggtggttgtaccatccaattgattcatcactttccttttggtatgggcttaggacatctcaaaaaagactacattgaatttaaacgtgttggtatctttgatgggaaagcagtagaagttactcttcgagaaccttattcgagagatctactgcaggttgtcaagtcaataaagtaa

SEQ ID NO: 277 - DNA (genomic), 753 bp, Streptococcus pneumoniae; double-stranded, circular
  misc_feature (B) LOCATION 1...753
  hypothetical: NO
  anti-sense: NO
tataataataccacctttttttacgttttttataaatgtagaaaatattcacatttacctaggaggaacaatatgagatgggattatggacagatttttaaagaaattcgaaagtcaaaaggattgacccaacaagatgtatgtggacaagtcatacatcggacaactctaacaaatattgaacacggtaaagttattcccagttttgaaaacatggtatttcttcttgaacaaattgatatgagcttggcagaattcaagtatatatgcaacgaataccatcctagtaaaaggcgagatattattgtagagagccaaaatccgtctacttttcaagatactagaaaaatggttgaactcactgagaaatgtcaaaaatatcttaagacacatcacgatgttcctattcaaaatatctatcgtcatacaaaaattgtcacagagttacgaactaaaggattcaaaaacaaccacgtcttgaaagatttgtctgaagaaatttgggactatcttgaacctatggatacatggtacattagtgatttgaaattgcttggaaccattctctttttctttccttctgaaaatcttccccttcttattgatagaattatgaaaaccatcgagaaatataaatacttccgagaaacaaaagtatttttatcatcttttttagccaatctctccactgtatatttcaacatcatttattcaaagaatgtgaaacaatcaccctacaacttttggtattag

SEQ ID NO: 278 - DNA (genomic), 255 bp, Streptococcus pneumoniae; double-stranded, circular
  misc_feature (B) LOCATION 1...255
  hypothetical: NO
  anti-sense: NO
ccgaataatactggttcattgatattgaagataccaggtccaaaagataatttagccacgtttttagagacagcattgcgactcactaagaatgttgctattaataaacataatgtagatccactaccacccattaaagcgaatgtttgtatttgtgataggttgatgatgtgtggaatggcttgtccattatttgctgcagtgatgttttcagtaatgttaattaatagtaatggttctaggatggcactgtaa

SEQ ID NO: 279 - DNA (genomic), 438 bp, Streptococcus pneumoniae; double-stranded, circular
  misc_feature (B) LOCATION 1...438
  hypothetical: NO
  anti-sense: NO
tactcaaataccaagactggaaaagccaaatccgcaaagtttcgtcctagtttttttaatctaaaaagtttggttaggataatgcagacgactaaggtcagtatcaataataaaatagatgctaatttcattaaaatcatacccatattgtatcataaaaaaaggctaatggaaacgagaaacagaggaatttataggaaagtcaggcttttgagattgtgggtgatttttgttataatgaaagttataaaatcttataataccttgaatgattattatcgaaaactctttggagaaaagacttttaaagtccctattgatgcgggatttgactgtcccaatcgtgatggaactgtggctcatggaggctgtactttttgtacggtttccggttctggagatgccattgtggcaccagatgcgcctatccgtgagtaa

SEQ ID NO: 280 - DNA (genomic), 354 bp, Streptococcus pneumoniae; double-stranded, circular
  misc_feature (B) LOCATION 1...354
  hypothetical: NO
  anti-sense: NO
tatccaaatactccagtgaggcataaaccgccatggacaaggtatcctcctcataaaggcgccaaggactctctgcaggaactaccttacaggtcacctccacctccaaaagaggcagggaaatggcaggataaccgtaaacgaccgcatgttcccctattaaaattatcttactatgtgcctgaccgacaccaactttttttgtcattttttccttttactagacgaaaaaacgtcttatttttcatacaagtattaattctttcctatctattttattatattttcacaaaaaaagcgattgtttccattcacaatcgcttctttcattaccgaacccattcaccattatag

SEQ ID NO: 281 - DNA (genomic), 279 bp, Streptococcus pneumoniae; double-stranded, circular
  misc_feature (B) LOCATION 1...279
  hypothetical: NO
  anti-sense: NO
acggaaaatactatgtttaccttaaagatgcggcccatgcggacaatattcggacaaaagaagagattaaacgtcagaagcaggaacacagtcataatcataactcaagagcagataatgctgttgctgcagccagagcccaaggacgttatacaacggatgatgggtatatcttcaatgcatctgatatcattgaggacacgggtgatgcttatatcgttcctcacggcgaccattaccattacattcctaagaatgagttatcagctagcgagttag

SEQ ID NO: 282 - DNA (genomic), 576 bp, Streptococcus pneumoniae; double-stranded, circular
  misc_feature (B) LOCATION 1...576
  hypothetical: NO
  anti-sense: NO
gttatgaatacagtgaaaaataagcaagaaatcttagaggcttttagagaaaatccagatatgatggccattctgacgatcatccgagaccttggtctgaaagactcgtggttggcagcaggttctgtcagaaatttcatttggaatcttttgtcagacaaatccccttttgatcatgaaacagatatagatgtgattttctttgatccagatttttcttatgaggaaaccttattactgaagaaaaagctgagagaggattttcctcagtaccagtgggaattgaaaaatcaggtctatatgcatcagcacagtcctcacactgcttcctataccagttctcgtgatgctatgagtaagtatccagaacggtgtacggcagttggactgcgcttgaatgaagaatcagattttgaactctatgtaccttatggtttggaggatattttgaattttcaagttcgtccaactcctcatttcttagaaaatgaagaccgaatggaactctatcaaacacgtttatccaagaaaaattggcaggagaaatggaaaaatttgatttttaaaaatacttaa

SEQ ID NO: 283 - DNA (genomic), 267 bp, Streptococcus pneumoniae; double-stranded, circular
  misc_feature (B) LOCATION 1...267
  hypothetical: NO
  anti-sense: NO
actatgaatacaaatctcaagcccaaacttcagcgttttgcttctgcgactgcctttgcctgtcctatctgtcaagaaaatctgactctgttagagactaatttcaagtgctgcaaccgtcattcttttgacttggcgaaatttggctatgtcaatctagcacctcaaatcaagcaatctgctaactatgacaaggaaaattttcaaaaccgtcaacaaatccgtagaagccggcttttaccaagctatcttagatgctgtatctga

SEQ ID NO: 284 - DNA (genomic), 1242 bp, Streptococcus pneumoniae; double-stranded, circular
  misc_feature (B) LOCATION 1...1242
  hypothetical: NO
  anti-sense: NO
agtggtgatactatgaagattagtaagaggcacttattaaattattccatcttgattccctacttacttttatctattttgggcttgattgtggtctattcgaccaccagtgctattttaattgaagaaggcaagagcgccttgcagttggttcgaaaccaaggaatcttttggattgttagtttgatactgattgccttaatttataaattgagactagattttttgagaaatgagcgactaatcattttagttatattaatagaaatgcttttattgttcttggctcgttttattggtatttcagtaaacggggcatacggttggatttcggttgcaggagtaactattcagccagctgagtacttaaaaatcattattatttggtatttagctcaccgattctccaaacagcaagaagaaatagctacttatgattttcaagttttgactcaaaatcaatggcttccccgtgcttttaatgattggcgattcgttctcctagttctgattggaagtttgggaattttccctgatttaggaaatgcgactattttagtcttggtttccttgattatgtatacagttagtggaatcgcttatcgctggttttcaaccattctggcgctcgtatctgccacttctgtctttgtcttgaccactatcagcctaatcggtgttgagaccttttcaaaaattccagtatttggctatgtagccaagcgctttagtgccttttttaatccttttgccgatcgtgctgatgcaggtcaccagttagctaattcttattttgccatggtcaatggtggttggtttggtctaggtcttggaaactcgattgaaaaacgaggttatttgccagaagctcatacagactttgtcttttctatcgtgattgaagaatttggctttgttggtgccagtcttattttagctctcttgtttttcatgattttgcggattatcttggtcggtatccgagcggagaatcctttcaatgccatggttgcactcggtgtcggagggatgatgttggttcaggtatttgtcaatatcggagggatttcgggcttgattccatctacaggagtgactttccctttcttatcccagggtggaaatagtcttctagtcttatcagtggcagtagcctttgtcttaaatattgatgccagtgaaaaacgcgctaagttgtaccgagaattggaaaatcaaccaatgaaccttctgttgaagtag

SEQ ID NO: 285 - DNA (genomic), 1512 bp, Streptococcus pneumoniae; double-stranded, circular
  misc_feature (B) LOCATION 1...1512
  hypothetical: NO
  anti-sense: NO
ttgatagatacgaaaaacaacttagttatgcagagccaattttatgatggagaattaagggaattaacagaacaaattcttaattcggttacaggagatgagaaaaagattatagaattttttagagattcaatctttaacttcaattttttatatagaaaattagaaactattaatgaattatttgatgaaattcgtgaagagcatgaaagctatagaagaggaggatggtctgctaataatcatctatttaatgcggagtttacagtaaaaaatctttataactttttaaaattaaattgtttatgtgttgaacattataagatttataaatcaatcattaatagatatttagaaatattattactcagttatgataattcatatgtaaaccctgactcaagtattttcgatagaacatcttcttggcttaaaaatcttgatttggatgatgttaaattaattcttccgaatatagattttaaggttgtaaatttatattttagaaactattcatttggtaaaataaaaattactgaggaagcgaaagactacttgttgaatcgaattacttatcttcaagaaagacttgaaattactgaagatgaaaatcttcgagagcttaaaaatatgctaatttttcttccccttgttgatgatattgacatagaaaaagtaatagaaattttaaataatcaaacactgtattataattggagcgaggaatttaggagaattattaaaattgtcctcgataatatggatgttattgataaagattcattgaaatctaagataattgggattgtaaataaacatttaaatgaaattttggagaaaaatttttctttatataattcagtgtatccgctctattcacagttactagaatactgctcaactgatcaggaaactgcaataatagtactcgaaaaatttaatacagatattttaagaataaaatataaaaatgatgatataaaaaatatcatagaatattctgacttgatatgtcacttatttaagtattttgaaaaggatattaaagatgacattttagatactctaaaagtttatgaagaatcagaaaatattatttaccataaagtaattgatttgatgagttataatgtctatgattttcctcagatacaaaataaaatctaccattatttgattaaaagaattaatgataaaagagttgagggggttaaaactttcccagacccaagagaaaagtctgtatcagatttatacaacttaagtagaaaaggatatttttctgattttgagattttaaaagatattgaagaagatattcgaggactttatcctgaagtagattggacctggttccatgatagaagtgatgatgttatccatcgtctactagaacatagaactcccaataatattaaaacttatttttcaaaaaatgaagaagataataaattgattaatgagtatattttaaaagctttcgatgaggataaattaatacttaagaaataa

SEQ ID NO: 286 - DNA (genomic), 222 bp, Streptococcus pneumoniae; double-stranded, circular
  misc_feature (B) LOCATION 1...222
  hypothetical: NO
  anti-sense: NO
actggagatacagccttgcactcacaaagacagcagatctttcttttgcaaaaaacaaatgacctgtttgatgaattagccattcaagctgaatctagacatagctttttaaaaaaggaaaatcctacttacttagaatccaaggatagatatctattgttcactcatttcccgaacagttttttctatattttttgcatacgatattgccgaaatgattga

SEQ ID NO: 287 - DNA (genomic), 258 bp, Streptococcus pneumoniae; double-stranded, circular
  misc_feature (B) LOCATION 1...258
  hypothetical: NO
  anti-sense: NO
gaattggatactaagataggtataagtaaaaacaccattagaaattatgaaaaaagggttaggtctactaagaaaaatactatatttgacttagttaaagtattcagtagcttgattgatgccctcttttctccagttcaaaaggattctcctagcgatatccaatctatctacgaccaacgggcaccacccagacaaggtaaagttctgacctatgccgagaggcaactgtatgatcagaaaaacgaagtatcgtaa

SEQ ID NO: 288 - DNA (genomic), 243 bp, Streptococcus pneumoniae; double-stranded, circular
  misc_feature (B) LOCATION 1...243
  hypothetical: NO
  anti-sense: NO
cagatggatacgattgaaaatctcattattgcgattgtgaaacccttaatttcacaaccagatgccttaactatcaagattgaggatacaccagaatttttggaatatcatttgaatcttgatcaaagcgatgtgggtcgtgtaatcggtcgtaagggtcgcactatttctgcgataagaacgattgtctactctgtcccaactgaatacaaaaaagtaagaatcgttattgacgaaaaataa

SEQ ID NO: 289 - DNA (genomic), 441 bp, Streptococcus pneumoniae; double-stranded, circular
  misc_feature (B) LOCATION 1...441
  hypothetical: NO
  anti-sense: NO
aggattggtacgtatcaaatgatcgatattcaaggaatcaaagaagcccttccccaccgttatcctatgcttctagtggaccgtgtcttggaggtgagcgaggataccattgttgctatcaaaaatgtgaccatcaacgagcctttctttaacggccactttcctcaatacccagttatgccaggtgttctgattatggaagccttggcgcaaactgccggtgtgttggagttatcaaaacctgaaaataaaggaaaactggtcttttacgctggtatggataaggttaagttcaagaagcaagttgtaccaggcgaccaattggttatgacagcgacttttgtaaaacgtcgtggcaccatagctgtggttgaagcaaaggctgaagtggatggcaagcttgcagccagtggtacccttacttttgcaattgggaactaa

SEQ ID NO: 290 - DNA (genomic), 564 bp, Streptococcus pneumoniae; double-stranded, circular
  misc_feature (B) LOCATION 1...564
  hypothetical: NO
  anti-sense: NO
aaagaaggtactcatatgattaaatatagtatccgtggtgaaaacctagaagtaacagaagcaattcgtgattatgtagtttctaaactcgaaaagatcgaaaagtacttccaaccagaacaagagttggatgcccgaattaacttaaaagtttatcgtgaaaaaacggctaaagtggaagtaacgattccgcttggatctattactctccgcgcagaagatgtatctcaagatatgtatggttcaattgaccttgtaactgataaaattgaacgtcagattcgtaaaaataaaacaaaaatcgagcgtaaaaataaaaataaggtagcaactggtcaattatttacagatgctttggtggaagattcaaatgttgtccagtctaaagttgttcgttcaaaacaaattgatttaaaaccaatggatttggaagaagcaattctacaaatggatttattggggcatgatttctttatctatgtagatgttgaagatcagacaaccaatgtgatttatcgtcgtgaggatggtgaaattggtttgttagaggttaaagaatcttaa

SEQ ID NO: 291 - DNA (genomic), 837 bp, Streptococcus pneumoniae; double-stranded, circular
  misc_feature (B) LOCATION 1...837
  hypothetical: NO
  anti-sense: NO
tggctattcactttaccgagcagttcaggctgccaaagaaaaaggggaaggaaagatttctcttggaaagataaatttgaatttgctaaagagcttgttaagaaagcaggtcagtacattcttgaccatatgcaggaagacttgcgtgttgaaaccaagtcctctccaacagatttggtgaccagactggacaaagaagttcaggaactcttggttggtgagattttgtcccgttatcctgaggataagatttgtgctgaagaaggttgtctgcgagcctcggttcaagagggcaaggtttgggtcattgatcccattgatggtaccaataattttgtagcccagcaggaagattttgctgttatgatggcttattttgaaaatggtcagggacagtttggtctgatttatgatgtggtcaaaggggattgttaccacggtggtggggaatttccagtttgtctaaatgataggtccctagctccttttaaaactaaaccacttggagattttctcattgcagggaatagtggtatgctggaaaccaatgaatgggggctggctgatttgagccgatcggttcttggtgttcgtgtctatggaagtgcggccattagttttgccaagattttgtcagggcgtttgttgacctatctcacttatctgcaaccatgggattatgccgcagctagtattttaggggaaagtctgggctatcgggttgtgaccctttttggtgaagctcctgattttcaaaccagacagccggtcatgatggtgcctcttgagatgcaggaggaaattcagtcctatatttacgaaaggaaaagaacttaa

SEQ ID NO: 292 - DNA (genomic), 966 bp, Streptococcus pneumoniae; double-stranded, circular
  misc_feature (B) LOCATION 1...966
  hypothetical: NO
  anti-sense: NO
aagaggttcactatgagtgagatcgaaattattaacgccaaaaaaatctaccacgatgtctctgttattgagaatttgaacattacaattccaaaaggaagtctctttacccttcttggagcttcaggatgtgggaaaacgacccttcttcgtatgattgcaggtttcaacagtatcaaagatggagaattttacttcgatgatacaaaaatcaataatatggaacccagcaaacgcaatatcgggatggttttccaaaactacgctattttcccacatttgactgtccgagacaacgttgcttttggtcttatgcaaaagaaggttccaaaagaagaattgattcaacagaccaacaagtatcttgaactcatgcaaattgctcaatatgcggatcgaaagcccgataaactcagtggtggacaacaacaacgtgtcaccttggcatgcgccttagcggttaatccaagtgttctcctcatggacgagccacttagtaatctggaggccaaacttcgcttggatatgcgtcaagccatccgagaaatccaacacgaagtgggaattacaactgtttatgtaacccacgaccaagaagaagccatggctatttcagaccaaattgctgttatgaaagatggggtgatccaacaaatcggccgaccaaaagaactctatcataaaccagctaatgagtttgtggcaacctttatcggacgcacaaatattatccctgccaatcttgaaaaacggagcgacggcgcttatatcgtcttttcagatggctatgcccttcgaatgccagctcttgatcaggttgaggagcaagctattcatgtaagcattcgtcccgaagagtttatcaaagatgaatctggagatattgaaggaactattagtgatagcgtctatcttggactaaatacgaagtatttcattgagacaggttttgcctcaaaaatttaa

SEQ ID NO: 293 - DNA (genomic), 315 bp, Streptococcus pneumoniae; double-stranded, circular
  misc_feature (B) LOCATION 1...315
  hypothetical: NO
  anti-sense: NO
aaattctggtttcatcctctcctctttctagctattgaccaaatgggcgtaaaagccaccctgtgcaagcaaatcagcatgctttccttcttcgacaatcttgccctgatccaagacaactaccttctctgtccgctcagcaatagtcaagcggtgagcaatgaaaatcaaggtcttgtccaaagccatgagattatcgacaatccgcttctctgtcaaaatatccaaactgctagtcgcctcatccaaaatcaagaccggcgcatctgtcaagagagcacgcgccaaagcgattctctgacgttgaccacctga

SEQ ID NO: 294 - DNA (genomic), 1194 bp, Streptococcus pneumoniae; double-stranded, circular
  misc_feature (B) LOCATION 1...1194
  hypothetical: NO
  anti-sense: NO
gtgagtatcacaataacgctaagaaagtggcaagctgaagcgattaaaagaagtgaacatttatctaatggaatctttttagaggctcttgggggcagaggcaaaactatctgtgcacttgctattgcaaaacataaaaaagctaaaaaaatcatcatcacaaacaatcgactagctattctgaatggttggatagatgcagtcaagtttatgaattttgataaaggtgttgagattatcattcagacagatagatatcttcaaaatcaagtcaaaaaggggcataaattagattgtgatgtgctgatagtagacgaatggcagaatatgtcttctgacaaacaagtggccttatatcgcaaaataaagcgaaaatacacgataggtctttcagcgacaccaattcggaaaaaaggacaaaatttctatccgcttgaaaaaacggtatttggttgggcaaccccaaataataaatttgactggcaaaagactcatggaaaaatggtctatgatccatttagctattcaaaagagaagtgggaagattttcaaaattatgaaagttatatctcgagcttgcctaatttcttccgctgggaagagattgaaggaattgagaatgcagttgagaataacggttttgagattaagttttaccaaaagagagtcgcctctggcaatccagaaaaacttgcagaatttagaaaactaaatcttgtaacagtggacggcaaaactgcaatggccaagcaatcgtttggaagaaagacctttgaacgctaccttaatcaaacaggcgtagcagtcgattttccaaaattaaagccagtaaatgcggatacgccattgatgttacaacttgacggtttaatcgaacgagcaccacacgatatgttgattgtcagtaaatctaagcagattgtcaacgtcattagcgagcgccatcctgaaattggaatctggacgggcgatattcaagaaggactttataagaaattcgtggttgctactagtcaagtgttaggtgtcggagtagacggcttgcaacacaaataccaaactattgtcgtattggatccagtagaagaaggttctggagaatatgatgattatcgacaattgctctggcgcataacaggaagtcgtcagcagcatgatgtaaatgtaattgaattttattataaagaaagttaa

SEQ ID NO: 295 - DNA (genomic), 1095 bp, Streptococcus pneumoniae; double-stranded, circular
  misc_feature (B) LOCATION 1...1095
  hypothetical: NO
  anti-sense: NO
cgccgctggttgaagacaaaaacagaggagtgctttatgaaagcctatacttatgttaaaccaggacttgcttcttttgttgatgtagacaaaccagttattcgcaagccaacagacgctattgtgcgtattgtaaaaaccactatttgtggaacagacctccatattatcaaaggggatgttcctacttgccaaagtggtaccattcttggccacgaagggattgggattgttgaagaagttggggaaggagtttccaacttcaaaaaaggtgacaaggtcttgatttcttgcgtctgtgcctgtggtaaatgctactactgtaaaaaaggaatttatgctcactgtgaagacgaagggggctggattttcggtcacttgattgatggtatgcaggctgaatatctacgtgtccctcatgcagataatactctttaccatactccagaagacttgtcagatgaagctttggttatgctgtcagacattctgcctactggatatgaaattggtgtcttaaaagggaaagtagaacctggttgcagcgtagccattattggttcaggtccagttggattggctgctcttttaacagcccaattctattcaccagctaaattgattatggtagacctagacgataaccgcttggaaactgccctatcattcggtgcgactcataaggttaattcttcagaccctgaaaaagccattaaagaaatttatgatttgacagatggtcgtggtgtggatgtcgctatcgaagctgttggtattcctgcaacatttgatttctgtcaaaagattatcggtgtagacggaacggttgccaactgtggtgtgcatggtaaaccagttgaattcgatttagataaactttggattcgcaacatcaatgtaacaactggtttggtatctacaaatacgactccacaattgttgaaagcacttgaaagtcataagattgaaccggaaaaattggtaactcactatttcaaactcagtgaaattgaaaaagcctacgaagtcttcagtaaggcagcagaccaccatgccattaaggtcattatcgaaaacgatatctcagaagcctaa

SEQ ID NO: 296 - DNA (genomic), 252 bp, Streptococcus pneumoniae; double-stranded, circular
  misc_feature (B) LOCATION 1...252
  hypothetical: NO
  anti-sense: NO
gcgttatggttttgttctaacgagttgggtggggggatgattttggcaggtttgtttagcaatgtcctctcgccggtttatgagctttcctttactcttgatatttggagtatcttgatttgcctcattatcgctttctttggaacggcttttgcttttttcatttccatgaaggctgtgtccttggtttctcctttggtgggttttccgcttactcagtgcgcagtgaacctctctcttctgctctcttga

SEQ ID NO: 297 - DNA (genomic), 801 bp, Streptococcus pneumoniae; double-stranded, circular
  misc_feature (B) LOCATION 1...801
  hypothetical: NO
  anti-sense: NO
gggccttccacngaactacgttttgagttggcgcgccttgttgaaatttgccaaccaangaaaatatcccttgggatggttcttggcaatgcaagcaatatcatcgttcgtgatggtgggattcgtggatttgtcatcttgtgtgacaagctcaataacgtttctgttgatggctataccattgaagcagaagctggggctaacttgattgaaacaactcgcattgccctccgtcatagtttaactggctttgagtttgcttgtggtattccaggaagcgttggcggtgctgtctttatgaatgcgggtgcctatggtggcgagattgctcacatcttgcagtcttgtaaggtcttgaccaaggatggagaaatcgaaaccctgtctgctaaagacttggcttttggttaccgccattcagctattcaggagtctggtgcagttgtcttgtcagttaaatttgccctagctccaggaacccatcaggttatcaagcaggaaatggaccgcttgacgcacctacgtgaactcaagcaacctttggaatacccatcttgtggttcggtctttaagcgtccagtcgggcattttgcaggtcagttaatttcagaagctggcttgaaaggctatcgtatcggtggcgtagaagtgtcagaaaagcatgcaggatttatgatcaatgtcgcagatggaacggccaaagactacgaggacttgatccaatcggttatcgaaaaagtcaaggaacactcaggtattacgcttgaaagagaagtccggatcttgggtgaaagcaagtag

SEQ ID NO: 298 - DNA (genomic), 210 bp, Streptococcus pneumoniae; double-stranded, circular
  misc_feature (B) LOCATION 1...210
  hypothetical: NO
  anti-sense: NO
agcaattccacttctgctttttctttaccgacagcagcaacgatttcttcttggaaggcaatcaattctttgacagcttcgtgccctttaaggagcgcttccaacatgatttcttctgacaattctttggcaccagactctaccatgttgacagcgtgcttggttccagctactgtcaattcaagaagagattgctctgcttgttcttga

SEQ ID NO: 299 - DNA (genomic), 219 bp, Streptococcus pneumoniae; double-stranded, circular
  misc_feature (B) LOCATION 1...219
  hypothetical: NO
  anti-sense: NO
ttaaattccacatcatcaaaaaaattcaccttattcttaataatgaatatttcgttaaataaacatatatataaatatttcaatatcctttcaatatcatcctctaaattctcctcaatattttgtatcagcccatttacaatcttacttaaaaaagataagctctttatctctaaaattaaatattttcatacaactgttgtatcgagaaatatataa

SEQ ID NO: 300 - DNA (genomic), 1377 bp, Streptococcus pneumoniae; double-stranded, circular
  misc_feature (B) LOCATION 1...1377
  hypothetical: NO
  anti-sense: NO
aaatgctccacacctagctcatctggggatcagtcacgtctggatgccaccagccttcaaggaaccaacgaaaaagatgtcggctatggggtctatgacttatttgacttaggagagttcaaccaaaaagggactgtccgcaccaagtatggtttcaaagaagactatcttcaagccattcaagcccttaaagcgcagggaattcaacctatggccgatgtagttctcaaccacaaggctgctgctgatcacagggaagcctttcaggttattgaagtggatcctgtagaccgtacagttgaacttggagaacccttcaccatcaatggctggactagttttaccttcgatggtcgccaagatacctacaatgacttccactggcactggtaccacttcacaggtacagactatgatgccaaacgccgtaaatccgggatttacctaatccaaggagacaacaagggctgggctaacgaggaattggtcgataacgaaaacggaaactacgactacctcatgtatgccgacctagactttaaacatcctgaagtcatccaaaacatctatgactgggctgattggttcatggaaacgactggtgtagctggtttccgtttggatgccgttaagcatattgactctttctttatgcgcaacttcatccgcgatatgaaggaaaaatacggtgacgatttctatgtttttggtgaattttggaacccagacaaggaagccaatctggactatctcgaaaaaacggaagaacactttgaccttgtcgatgttcgtctccaccagaatctctttgaagccagtcaagctggcgcaaactatgaccttcgtggcattttcacagatagcctggttgaactcaagcctgacaaggctgtgacttttgtcgacaaccacgatacccaacgaggacaagcccttgagtctaccgttgaagaatggttcaagccagcagcctatgccctcattttgttacgccaagacggccttccatgtgtcttttacggagactactatgggatttcaggccagtatgctcaagaagatttcaaagaaatccttgaccgcctcctagccatccgaaaagacttggcctatggagaacaaaatgactactttgaccatgctaactgtatcggttgggtacgttcaggtgctgaaaatcaatccccaatcgcagtccttatctcaaatgaccaagaaaacagcaagtcaatgtttgtcggtcaagaatggactaatcaaacctttgtagatttacttggtaaccaccaaggtcaagttacaattgatgaggaaggttatggacaattccctgtctcagctagatccgtaagtgtctgggcagtcaataccatctaa

SEQ ID NO: 301 - DNA (genomic), 1536 bp, Streptococcus pneumoniae; double-stranded, circular
  misc_feature (B) LOCATION 1...1536
  hypothetical: NO
  anti-sense: NO
cggactaccactctacgccgctctaacacgcggagcctgctccaacttctcttcccccaccccccatacacccacgctccccctccagcagatcccatcgcaacttctccctttgttcccaaaccccgtggcctcaccacggcacacatccgtgcagcccatatctccctgccgacacggccctcctcacaccaactgccccccactcaccccactccacccgtccccggaccgcccccgcctcaaccccggccaccccacttccctccaccccccgttcccccgcatgccgcccccctccacgcggccaatcccccaccgcgcgcgagcaactccccccccccacccccaccaccgcccgccgcacgccaacccccccacgcccccccccgcaggaatccgccgccccaccccgggcccacaccgcaccggcctcaccgccccaccccgcccccgcacaccccccccactccgccaccagcccacaccggcccccctaccacacccccaacgaacgagccgccccgccccacgccagccccaaaacccccccgccacccaccccgccccgccgccnacctaccgcccatgctcgcgaccccccgcaccgagcnagccacnncnngnccnnnnnnnnnnttttcnnnnnnnnnnnnnnnnnnnnnnnnnnnnnnnnnnnnnnactacacaaactggcaagcagttggcgaccttgactttgctaacgaccgtactgcctacatgatggaatgtcctaatctggtctttgtagaggaacagcctgtccttctctactgtccacaaggattggataagaaagttctagactacgataatatctttccaaatatgtataagattggggcttcctttgaccctaaaaatgccaaaatggtagatgtgtctcaacttcaaaacatggattacggtttcgaagcctatgcaactcaagccttcaacgctcctgatgggcgtgctctagcagttagctggcttggtttgccagatgtttcttacccatctgaccgttttgaccaccaaggaaccttctctttggtcaaggaactcactatcaaagacgacaagctctaccagtatccagtcgctgctattaaggaccttcgtgcttctgaagaagccttctcaaaccgtttccaaaccaagaacacttacgaacttgaactcaacttggaagctaatagccagagcgagattgtcttacttgctgataaagaaggtaagggactttcaatcaactttgaccttgtaaacggtcaagtgacagtggatcgtagccaggctggagaacagtatgcccaagaatttgggacaactcgttcttgccctatcgagaatcaggctactactgctacaatcttcatcgataactctgtctttgaaattttcatcaataaaggagaaaaagtattttctggtcgtgtcttcccacatgcggaccaaaatggtatcctgatcaaatctggaaacccaactggaacttactatgaattagattatggtcgcaaaactaactga

SEQ ID NO: 302 - DNA (genomic), 1650 bp, Streptococcus pneumoniae; double-stranded, circular
  misc_feature (B) LOCATION 1...1650
  hypothetical: NO
  anti-sense: NO
atatattacacatataggagaaaaatattgcttacagtatctgatgtttcactacgttttagtgatcgcaaactttttgatgatgtcaatatcaaatttacagaaggaaatacttacggattaatcggtgctaatggtgccggaaaatcaacctttttaaaaattttagctggagatatcgaacctactactggtcacatctctcttggtccagatgaacgtctctctgttcttcgtcaaaatcactttgactacgaagatgaacgtgccattgatgtcgttatcatgggaaatgaaaaactttatagcatcatgaaagagaaagatgctatctacatgaaggaagatttctcagacgaggacggggttcgtgctgccgaactcgaaggagagtttgccgaacttggaggttgggaagcagagagtgaagcctctcaactacttcaaaacctaaacattccagaagaattacactaccaaaacatgagcgaattggccaacggtgaaaaagtaaaggttctcctcgccaaagcactttttggtaaaccagatgttcttctcttggacgagcctactaacggtttggatatccaatcgattacttggttagaagacttcttaattgactttgataacacagttatcgtagtatcccacgaccgtcacttcttaaacaaagtttgtactcacatggccgaccttgactttggaaaaatcaaactctatgtcggaaactacgacttctggaaggaatcttctgagcttgctgctaaattgctagcagaccgtaatgctaaagcagaagaaaaaattaaacaattgcaagaattcgttgctcgtttctctgccaatgcttctaagtcaaggcaggcaacatcacgtaagaaaatgcttgataagattgagctagaagagattgtaccatctagtcgtaaatatccatttatcaactttaaagcggaacgtgagattggtaatgatctcttgacagtagaaaatctaactgtaaagattgatggtgaaactatcttggataatattagtttcatcttgcgtccagatgataagacagcacttattggacaaaatgatattcaaacgactgcattaattcgtgcaatcatgggagatattgactatgaaggaactgtcaagtggggagttacaactagtcaatcttacctaccaaaagataactcagctgattttgcaggaggagaatcaattcttgactggttgcgtcaattcgcaagtaaagaagatgatgacaatactttcctacgtggtttcctcggccgtatgctcttctctggagatgaagttaacaaacctgtaaatgtcttgtcagggggagaaaaagttcgtgtcatgctttcaaaactcatgctcttaaaatcaaatgtccttgtacttgatgatccaacaaatcacttggacttggaatctatctcaagcttgaatgatggattgaaaaactttaaagaatcaatcatctttgccagccatgaccacgaatttattcaaactttggctaaccatatcattgtcttatctaaaaatggcgtcattgaccgtatcgatgaaacctacgatgaattcctagaaaatgcagaagtacaagcaaaagttaaagaactttggaaagactaa

SEQ ID NO: 303 - DNA (genomic), 270 bp, Streptococcus pneumoniae; double-stranded, circular
  misc_feature (B) LOCATION 1...270
  hypothetical: NO
  anti-sense: NO
ctgaactacaccccaaaagttagacagaaaaaatctaacttttggggtgtttttattatgaaattaagttatgatgataaagttcagatttatgaacttagaaaacaaggatatagcttagagaagctttcaaataaatttgggataaacaattctaattttaggtacatgattaaattgattgatcgttacggaatagagttcggcaaaaaaggaaaaaatcgttactattttcctgatttaaaacaagaaatgatttataaagtttga

SEQ ID NO: 304 - DNA (genomic), 219 bp, Streptococcus pneumoniae; double-stranded, circular
  misc_feature (B) LOCATION 1...219
  hypothetical: NO
  anti-sense: NO
tttcaatacactgtaacatgtgatgaaaatgccagtaatgataccgagaaaaaagctgagaaacttttcccagctttatttgttatagtcaaagcgaatgacttgttcctgtgcatctacatgagcatggaccccaaagggtacaattgctcttggagttgcgtggccgacattcagattatagacaatcgggatattgttgtcaatgatatccaatag

SEQ ID NO: 305 - DNA (genomic), 384 bp, Streptococcus pneumoniae; double-stranded, circular
  misc_feature (B) LOCATION 1...384
  hypothetical: NO
  anti-sense: NO
attcaatacactatagactgtaatcaaacaacgatttggcgaaatgtaaaaaaatatgaggagttcggactcgactctctccttcaagaaacacgtggtggtcgtaaccatgcatatatgacggttggggaagagaaagcctttcttgcccgccatttgaaggctacagaggcaggagaatttgttacaattgatgccttatttcaggcttataaaaaggagttaggtcgttcctacacacgtgatgccttctatcaactgttgaagcgccatggttggcgaaatattatgccacgtccagaacatcctaggaaaacagacgctcaaaccattgtcgcgtctaaaaataaaatctcaattcaagaagaaaagaaagcgctttaa

SEQ ID NO: 306 - DNA (genomic), 885 bp, Streptococcus pneumoniae; double-stranded, circular
  misc_feature (B) LOCATION 1...885
  hypothetical: NO
  anti-sense: NO
gaaaggtacactattatgaaaggtattattcttgcaggcggctcaggtacccgcctgtacccacttactcgggctgcgtcaaaacagctgatgccggtttatgataaacctatgatttattatccgttgtcgacattaatgttggctggaattaaagatattttgattatctcaactcctcaagatttgccccggtttaaggacttgctcttggatggttccgaatttgggatcaagctttcctatgcggaacaacctagtcccgatggacttgctcaggcttttcttatcggtgaagaatttatcggtgacgatagtgttgccttgattttgggcgacaatatctatcatggacctggtttgagcaaaatgcttcaaaaggcagcccagaaagagaaaggtgcgactgtttttggctaccaagtgaaggatccagagcgttttggtgtggtcgagtttgatacagacatgaatgccatttccatagaagaaaaaccagagaatcctcgctccaactatgccgtgaccggtctgtatttctatgataatgatgttgtagaaattgctaaaggtattaaaccaagtgcacgtggcgagttagaaattacagatatcaacaaggcttacctaaatcgtggtgacctttctgttgagctgatggggcgtggttttgcctggttggatacgggaacccatgaaagcctgctagaagcttctcagtatatcgaaacagttcaacggatgcagaatgttcaagttgcaaacttggaagaaattgcctatcgcatgggctatatcagttgtgaagatgtgctcgagttggcgcaacctctgaagaagaatgaatacggacaatatttgctccgtttgattggagaagcatag

SEQ ID NO: 307 - DNA (genomic), 822 bp, Streptococcus pneumoniae; double-stranded, circular
  misc_feature (B) LOCATION 1...822
  hypothetical: NO
  anti-sense: NO
aggagacacacaatgacatttttaaacaaaatccatgaaactgctactttcctgaaagaaaagggaattgcagcccctgagttcggtctaatccttggagcaggacttggagaattggcagaagaaatcgaaaatccagttgtagtagactatgctgagattccaaactggggccgttcaacagtagtcggtcatgctggtaaattggtatatggtgaactggcaggtcgcaaggtcttggctcttcaaggtcgtttccatttctatgaagggaatcctctggaagtggtgactttcccagttcgtgtgatgaaagttcttggatgtgaaggtgttattgtaaccaatgcagctggcggtatcagatttggtcctggtaccttgatggctatctcagaccatatcaacatgacggggcaaaatccattgatgggtgaaaacttggatgactttggcccacgtttcccagatatgtctagggcctacacaccagaataccgtgccactgcccatgaagtggctaaaaaacttaatatcaagcttgatgaaggtgtctatatcggagttactggtccgacttatgaaacaccagcagaaattcgttcctataagacactgggagcagatgcagttggtatgtctacggttcctgaagttatcgtggcagcccactctggcttgaaagttctgggaatttcatgtatcactaactttgcggctggtttccaagaagaactcaatcacgaagaaattgtagaagtgactgaacgtgttaaaggtgatttcaaaggcttgcttaaagcgattcttgctgaattgtaa

SEQ ID NO: 308 - DNA (genomic), 201 bp, Streptococcus pneumoniae; double-stranded, circular
  misc_feature (B) LOCATION 1...201
  hypothetical: NO
  anti-sense: NO
gaggaaaacacaatggctaaagtatgttactttacaggtcgtaagactgtatcaggaaacaaccgttcacacgcgatgaaccaaacaaaacgtgccgtaaaaccaaaccttcaaaaagttactgttcttatcgatggtaaacctaaaaaagtttgggcttcagctcgtgctttgaaatcaggtaaagttgaacgcgtttaa

SEQ ID NO: 309 - DNA (genomic), 1548 bp, Streptococcus pneumoniae; double-stranded, circular
  misc_feature (B) LOCATION 1...1548
  hypothetical: NO
  anti-sense: NO
agaggaaacacctcaagatctttatcaggaggacagtacatgtcacaagaaaaatacatcatggccattgaccagggaactacaagttctcgtgccatcattttcaacaaaaaaggggaaaaggttagctcgagtcaaaaagagtttactcagattttccctcaagcaggttgggttgagcacaatgccaatgaaatttggaactctgttcagtcagttattgcgggtgctttcatcgaaagtggtgtcaagccaaatcaaatcgaggcaatcgggattaccaaccaacgtgaaacaacggttgtctgggataagaaaacaggacttcctatctacaatgctatcgtttggcagtcacgccagacagcacctttggctgagcaactaaaaagccaaggttatgtggaaaaattccatgaaaagactggtttgattattgatgcttacttctctgctaccaaggttcgttggattttggatcatgtagaaggtgctcaagagcgagcagaaaaaggggaattgctctttggtactatcgatacttggttggtttggaaattgactgacggtgcggctcacgtgactgactactcaaatgcagctcgtaccatgctttataacattaaagaactcaaatgggatgatgagattttggaaatccttaacattccgaaggctatacttccagaagttcgttctaactccgaaatctacggcaagacagctccattccatttctacggtggagaggtgccaatctcaggtatggctggggaccaacaagcagccctctttggacagttggcttttgagccaggtatggttaagaatacttatggaacaggctctttcatcatcatgaatactggggaagagatgcagttgtctgaaaacaacctcttgacaaccattggttacggaatcaacggtaaggtttattatgccttggaaggttctatcttcatcgcaggaagtgctattcagtggcttcgtgacggtcttcgcatggttgaaaattcaccagaatctgaaaaatacgctcgtgattctcacaacaacgatgaagtttatgtcgttccagcctttacaggtctaggcgctccatactggaaccaaaatgctcgtggttccgtctttggtttgactcgtggaacaagcaaagaagactttatcaaggcgactttgcaatctattgcttatcaagtgcgtgacatcatcgacaccatgcaagtggatactcagactgccattcaagtattgaaggtggatggtggtgcagccatgaacaacttcctcatgcagttccaggcggatattttaggcattgatattgcacgtgctaaaaacttggaaacaacagctctaggagcggccttcctagcaggtttatcagtagggtactggaaaaacttggacgagttgaaactcttgaacgagacaggagaactctttgagccatctatgaatgaatctcgcaaggaacaactctacaagggctggaagaaggctgtgaaagcaactcaagtctttgcggaagtagacgactaa

SEQ ID NO: 310 - DNA (genomic), 207 bp, Streptococcus pneumoniae; double-stranded, circular
  misc_feature (B) LOCATION 1...207
  hypothetical: NO
  anti-sense: NO
aaaatgaacacagaacagcttaaccaagccttacaaatgacaattagtgaaatgtcaacaacttcaacaaattcgatgattacaagtaatatcttgagtattcagttgaatgagcaaagggaagagaatcaaagacttcaagcacgagtggatgagctggaagctctgcttgatgaacaaactaaaccagcagacaaaggagaatag

SEQ ID NO: 311 - DNA (genomic), 270 bp, Streptococcus pneumoniae; double-stranded, circular
  misc_feature (B) LOCATION 1...270
  hypothetical: NO
  anti-sense: NO
ctgaactgcaccccaaaagttagacagaaaaaatctaacttttggggtgtttttattatgaaattaacttatgatgataaagttcagatctatgaacttagaaaacaaggatatagcttagagaagctttcaaataaatttgggataaacaattctaatattaggtacatgattaaattgattgatcgttacggaatagagttcgtcaaaaaaggaaaaaatcgttactattctcctgatttaaaacaagaaatgattaataaagtctga

SEQ ID NO: 312 - DNA (genomic), 573 bp, Streptococcus pneumoniae; double-stranded, circular
  misc_feature (B) LOCATION 1...573
  hypothetical: NO
  anti-sense: NO
atgaactgcaccccaaaagttagacagaaaaaatctaacttttggggtgtttttattatgaaattaacttatgatgataaagttcagatctatgaacttagaaaacaaggatatagcttagagaagctttcaaataaatttgggataaataattctaatattaggtacatgattaaattgattgatcgttacggaatagagttcgtcaaaaaaggaaaaaatcgttactattctcctgatttaaaacaagaaatgattcataaagtcttacatgaaggctggactaaagatagagtttctcttgaatacggtctcccaagtcgtacgatacttcttaactggctagcacaatacagaaaaaacgggtatactattgttgagaaaacaagagggagagtacctaaaatgggacgtaagccaaaaacgagacctgaagagagaacagaattagaacgtcttcaagcagaaaatgagtacctgagagcggagaaggccatcctaaaaaagttaagagaactccgattgaaggaggaaaaagagaaagaagaaagacagaaattgttcaagaattaa

SEQ ID NO: 313 - DNA (genomic), 192 bp, Streptococcus pneumoniae; double-stranded, circular
  misc_feature (B) LOCATION 1...192
  hypothetical: NO
  anti-sense: NO
atgaactgcaccccaaaagttagacagaaaaaatctaacttttggagtgtttttattatgaaattaacttatgatgataaagttcagatctatgaacttagaaaacaaggatatagcttagagaagctttcaaataaatttgagataaacaattctaatcttaggtacatgattaaattgattgatcgttaa

SEQ ID NO: 314 - DNA (genomic), 2787 bp, Streptococcus pneumoniae; double-stranded, circular
  misc_feature (B) LOCATION 1...2787
  hypothetical: NO
  anti-sense: NO
ttcatatgcacgatgccagtgtcaaggatgtggtgctcaaccagcatcctcaggatattgacagtttggagtactagcatgatcaagcgaaaaacttattggaaggacttaattcagtccttcacaggctccaaggggcgttttttatccatcttgatcctgatgatgttgggatctctagccttagtaggcctcaaagtaaccagtcccaacatggaggcgacagctaatgcttatttaacaactgctcaaaccttggatttggcagtcatgtctaactatggcttggatcaagcagaccaagaagaactaaaacagacggagggcgcagaggtcgagtttggctatttgacagatgtgactatggataatgggcaggatgccattcggctgtactccaaaccagagcgaatttcaacctttcagctaagaaagggacgacttcctcagtcagacaaggaaatcgctttggccactcatttgcaagaccaatacagcgtgggacaggagattagttttaaagaaaaagaagagggtcattcctctttaaaagaccatacttataccattactggttttgtggattcggctgaaatcctctcccagcgagatatgggctacgcaggaagtggaagtgggactctggcagcctatggggtgattttacctagtcaatttgatcagaaagtctacaatatagctcgtttgaaatatcaagatttagcaggtttaaatgccttttcatcagcttatgaagaaaaatccaagcaacatcaggaagagcttgaacaaattttatcagataatggcaaggtacgtctgcaacttttgaaaaaagaaggacaagagtctctagacaaggggcaagagacccttgacaaggctcagactaatttgcaggaaggcaagcgtcgtttagcagctgctcaagctcgtatacaggctcaagaaagtcaactagccttgtttcctcaagttcagagagagcaggctagtgctcaacttacccaagccaagcaggaattgggcaaggaagaggccaaactaaagcaagctgaacaaaatctagcccaagaaaaggaaaaattagaaaaacatcagcaagtcttggacgatttggcggagccaaggtatcaggtctataatcgtcagaccatgccaggtggtcagggctatcttatgtatagcaatgcttcatccagtattcgagcagtgggcaatatctttcctgtggtactttatgccgtagcagccatggtgacatttacgaccatgactcgctttgtagacgaagagcgaactcatgcagggatttttaaggccttgggttatcgtagtaaggatattatcgccaagtttctcctttatggactagtagctgggactgtcggaacggctctaggtagtatacttggtcattatttgctagccagtgtaatttcaagtgtcattacaaaaggcatggtggtgggagaaactcagattcagttctattggacctatagcttactagcttttgtcttgagcttgttggcgagtgtgttatcagcctatctggtggcttggagggaacttcatgacgaagcagcccagcttctacttcctaaacctcctgtcaaaggagctaaaatcttattggagcgtatcggttttatctggcgtcgtctcagttttactcataaggtaacagcccgcaacatctttcgttataagcagagaatgttgatgacaatctttggtgtggcaggttctgtagctctgctctttgcaggtttgggaatccaatcttctgtagcaggagttccgtctaaacagtttcaacaaatccaacagtatcagatgcttgtctctgaaaatcctagtgcgaccaatcaggacaaggtagagctagcagaagtgttgaaagggcaggagatactagcctaccagaaaatctattctaaaacgctagacaaggatttcaaaggcaaggctggtcttcaaaacattactcttatgatgatagagaaggaagatttgactccctttatccatcttcaacatcatcagcaggagctgacattaaaagatggcatcgttattacagctaaactcgcccagctggcaggtgtcaaggttgggcagactttagaaattgaaggtaaggaactaaaggtcgctgctattactgagaactacgttggtcactttatttatatgagtcaggctagctatgagcaactttacggacagctaccccaagccaacacttatctggtctcattaagggataccagtgcaactagtatcgaaagtcaggcgggcttgcttatgaatcaatctgcggtgtccagcgttgtccaaaatgcttcagccattcgactcttcgactctatcgctagctcactcaatcagaccatgaccatcttggtcatcgtatcggttctattagctattgtcatcctttacaatctgaccaatatcaacgtagctgagagaatccgtgaactctccactatcaaggttcttggttttcataataatgaagtcaccctctacatttaccgtgagacgattgtgctgtcccttgtgggaatcgtacttggtctgatagctggtttctatttacaccaatttttgattcaaatgatttcgcctgcgactattctcttttatccgcaggtaggctgggaagtctatgtaatcccagtggcagcagtaagcttcattttgaccttgcttggtttcttcgtcaattattatctgagaaaggttgatatgttagaagccctgaaatctgtagagtaa

SEQ ID NO: 315 - DNA (genomic), 798 bp, Streptococcus pneumoniae; double-stranded, circular
  misc_feature (B) LOCATION 1...798
  hypothetical: NO
  anti-sense: NO
aaaactagcacccttcttttactgtctactgtagccctagctgggtgtagcagcgtccaacgcagtctgcgtggtgatgattatgttgattccagtcttgctgctgaagaaagttccaaagtagctgcccaatctgccaaggagttaaacgatgctttaacaaacgaaaacgccaatttcccacaactatctaaggaagttgctgaagatgaagccgaagtgattctccacacaagccaaggtgatattcgcattaaactcttccctaaactcgctcctctagcggttgaaaatttcctcactcacgccaaagaaggctactataacggtattaccttccaccgtgtcatcgatggctttatggtccaaactggagatccaaaaggggacggtacaggtggtcagtccatctggcatgacaaggataagactaaagacaaaggaactggtttcaagaacgagattactccttatttgtataacatccgcggtgctcttgctatggctaatactggtcaaccaaacaccaatggcagccagttcttcatcaaccaaaactctacagatacctcttctaaactccctacaagcaagtatccacagaaaattatcgaagcctacaaagaaggtggaaaccctagtctagatggcaaacacccagtctttggtcaagtgattggcggtatggatgttgtggataagattgctaaagccgaaaaagatgaaaaagacaagccaactactgctatcacaatcgacagcatcgaagtggtgaaagactacgattttaaatcttaa

SEQ ID NO: 316 - DNA (genomic), 504 bp, Streptococcus pneumoniae; double-stranded, circular
  misc_feature (B) LOCATION 1...504
  hypothetical: NO
  anti-sense: NO
aaaaatagcaccacgctcacaatttcttctaatcgcctcagcttcaatatttcttactttccaatagacttcctgcgaaacaaaatatggtatagtagttctatgaatgatgaagcaagtaaacaactaactgatgcacgatttaagcgtcttgttggtgttcagcgcacgacttttgaagagatattagctgtattaaaaacagcttatcaacttaaacacgcaaaaggtggacgaaaacctaaattaagcctagaagaccttcttatggccactcttcaatatgtgcgagaatatcgaacttatgaacaaattgcggctgattttggtattcacgaaagcaacttaatccgtcggagccaatgggttgaagtaactcttgttcaaagtggtgttacgatttcaagaactcctctcagttctgaggacacggtaatgattattgatgcgacggaagtaaaaatcaatcgccctaaaaaaagaattagcgaattattctggtaa

SEQ ID NO: 317 - DNA (genomic), 468 bp, Streptococcus pneumoniae; double-stranded, circular
  misc_feature (B) LOCATION 1...468
  hypothetical: NO
  anti-sense: NO
gagcaaggcacgctaagcttggtaaactgcgagccgctagaagcttatcgtcaactggaagaagctgcacttgttggatgttgggcgcatgtgagaaggaagttttttgaagcgacccccaagcaagcagataaatcatctttaggagctaaaggattagcctattgtgatcagttattttccttggaaagagactgggaggctttgccagctgatgaacgactacagaaacgtcaagaagagctccaacccctaatagaagacttctttgcttggtgccgccgtcagtcagttttagcaggttcaaaactaggaagggcaattgaatacagcctcaagtatgaagaaacctttaagaccattttgaaagacggacatctggtcctttccaataatctagctgaatgcgccattaaatcattggttatgggacggagtaaaagagtccagtggactcttttagcctaa

SEQ ID NO: 318 - DNA (genomic), 336 bp, Streptococcus pneumoniae; double-stranded, circular
  misc_feature (B) LOCATION 1...336
  hypothetical: NO
  anti-sense: NO
atactgggcacaagccaagatatttttattagtttggctagtgacaatcttgtgctgttcttcgttgatttccttgatatccaaaagaaccaagtcagtgacagccatgagtttgtcaaacttctcaaggtaacgtggtttattacggaaaggaagagcacaggtatccaaggtacagtggattccttgttccttagccttggtgaagagagcaatcaggaaatcaatctgcaagagagcttctcctccactgactgtaatcccacccttatttccccagaaaccacggtagcgcaaggcctctgtcaagacatcatctaccgtccgttcacgtga

SEQ ID NO: 319 - DNA (genomic), 309 bp, Streptococcus pneumoniae; double-stranded, circular
  misc_feature (B) LOCATION 1...309
  hypothetical: NO
  anti-sense: NO
aagaacaggttgaagatcaagaccatgatttctatggtagccaatttgataaccaaatcgagaattccaaagcctttagcttttcagctacgggtaaactcgctggagattatgatatccaactcattggcaacttcaaccaagaaaatgcagttgctgctggacttgcttgtctccgtctcggagcaagtcttgaggacatcaaaaaaggcatcgctgcaacccgcgttcctggtcgtatggaagtcctcactcagaaaaatggagccaaggtcttcatcgactatgcccacaatggggatagtctga

SEQ ID NO: 320 - DNA (genomic), 1212 bp, Streptococcus pneumoniae; double-stranded, circular
  misc_feature (B) LOCATION 1...1212
  hypothetical: NO
  anti-sense: NO
ggtggcttaacggacagtcaaaggagaaatcatatgacacaacatcttactgctgaaactcttcgcaaagactttcttgctgtttttggtcaagaagcagaccaaattttcttttcaccaggtcgtatcaatttgattggtgaacacacagactacaacggtgggcacgtttttcctgctgctatttccttgggaacttacggtgcagctcgtaagcgtgacgaccaagtcttgcgtttctactcagctaactttgaggacaagggcattatcgaagtgcctctcgctgacctcaagtttgaaaaagagcacaactggaccaattatccaaaaggtgtccttcatttcttgcaagaagctgggcacgtgattgacaaaggttttgatttttatgtttatgggaatatcccaaatggtgctggtttgtcttcttcagcatcccttgaactcttgacaggggtagtggcagagcatctctttgatttaaaattagagcgtctcgatttggttaaaatcggaaaacaaacagaaaataactttatcggagtaaattctggcattatggaccaatttgctattggtatgggggctgaccaacgtgctatttacttagataccaatactttagaatacgacttggtgccacttgatttgaaggacaatgtcgttgttatcatgaacaccaacaaacgccgtgaattggcggactctaaatacaatgaacgtcgtgctgagtgtgaaaaagcagtggaagaattgcaagttgccttggatattcagaccctgggtgaattggacgagtgggccgttgaccaatatagctatctgattaaagatgaaaatcgtttgaaacgtgctcgccatgctgtgcttgaaaaccaacgtacccttaaagctcaagcagcccttcaagcaggtgatttggaaacatttggtcgtttgatgaatgcgtcacacgtttctctggagcatgattatgaagtaactggtttggaattggatactcttgttcacacagcttgggcacaagaaggagttctcggtgctcgtatgacaggggctggttttggtggctgtgccattgccttggttcaaaaagatactgttgaggcctttaaggaagctgtaggcaaacactacgaggaagtagttggatacgctccaagcttctatatcgctgaagttgcaggtggcactcgcgtccttgactag

SEQ ID NO: 321 - DNA (genomic), 234 bp, Streptococcus pneumoniae; double-stranded, circular
  misc_feature (B) LOCATION 1...234
  hypothetical: NO
  anti-sense: NO
aaaacattaacaaatatagttggtaaatcattaggacctaaatcagctgttagattcggagaagctttatcctatattgaaggtcctcttcgcagaataaatgagacgatagatggcggtttatatcaaatagagcaaatgattgcatctggattgaaagaatcgggtttaaatgactggactgcgaaaactttagcttcagctattcgtgggatattagatgtacttatttag

SEQ ID NO: 322 - DNA (genomic), 801 bp, Streptococcus pneumoniae; double-stranded, circular
  misc_feature (B) LOCATION 1...801
  hypothetical: NO
  anti-sense: NO
tggaaattaacgacagtagccttgcatctgtcaaaacggctattcaggacgtgttggagggcagatgaaatgattgatattcattcgcacattgtctttgatgtagatgatggtcccaagtcaagagaggaaagtaaggctctcttgacagaagcctacaggcagggggtgcgaaccattgtctctacctctcaccgtcgcaagggcatgtttgaaactccagaagagaagatagcagaaaactttcttcaggttcgggaaatagctaaggaagtcgcgagtgacttggtcattgcttatggggctgaaatttactacacgccagatgttttggataagctggaaaacaatcggattccgaccctcaataatagtcgttatgccttgatagagtttagtatgaacactccttatcgcgatattcatagtgccttgaataaaatattgatgttgggaattactcccgtcattgcccacatagagcgctatgatgttcttgaaaataatgaaaaacgcgttcgagagctgatcgatatgggctgttacacgcaaataaatagttcacatgtcctcaaatccaaactttttggagaaccttataaattcatgaaaaaaagagcgcagtatttcttggagcgtgatttggttcatatcattgcaagtgatatgcataatgtggacggcagacccccccatatggcagaagcatatgaccttgtttcccaaaaatacggagaagcgaaggctcaggaactttttatagacaatcctcgaaaaattgtaatggatcaactaatttag

SEQ ID NO: 323 - DNA (genomic), 948 bp, Streptococcus pneumoniae; double-stranded, circular
  misc_feature (B) LOCATION 1...948
  hypothetical: NO
  anti-sense: NO
acatccctaacactaaaattcctttcccagctcttgctgaacgcgataacgacgatatccgtttcggtcttgaacaaggtatcaacttcatcgcaatttcattcgtacgtactgcaaaagaatgtgaacgaagttcgtgcaatctgtgaagaaactggaaacggacatgttcaattgttcgctaaaatcgaaaaccaacaaggtatcgataacttagacgaaattatcgaagcagctgatggtattatgattgctcgtggtgatatgggtatcgaagtaccgttcgaaatggttccagtttatcaaaaaatgattatcaagaaagtcaatgctgcaggtaaagttgttatcactgcaacaaacatgcttgaaacaatgactgaaaaaccacgtgcaactcgttcagaagtatcagacgtattcaacgctgttatcgacggaactgacgctacaatgctgtcaggcgagtctgcaaacggtaaatacccactcgagtcagtaactacaatggctacaatcgacaagaacgctcaagctcttcttaatgaatacggacgtcttgattcagattcatttgagcgtaactctaagacagaagtaatggcttctgctgttaaagatgctactagctcaatggatatcaaattggttgtaactcttactaagacaggtcatactgcacgtttgatttctaaataccgtccaaatgctgacatcttagcattgacatttgacgaattgacagaacgtggcttgatgttgaactggggtgttatcccaatgttgacagatgctccatcttcaactgacgatatgttcgaaatcgctgaacgtaaagcggtagaagcaggtctcgttgagtcaggcgatgatatcgttatcgttgctggtgtgccagtaggagaagctgttcgcacaaacacaatgcgtatccgcacagtacgttaa

SEQ ID NO: 324 - DNA (genomic), 243 bp, Streptococcus pneumoniae; double-stranded, circular
  misc_feature (B) LOCATION 1...243
  hypothetical: NO
  anti-sense: NO
aaaacgaggttagaagagatgatttttgatacacatacacacttgaatgtagaagaatttgcaggtcgtgaggcagaagaaattgccttggctgatgagatgggtgtgacacagatgaatattgttggttttgatataccgacgattgagcgtgccttggagttggtagatgagtatgagcagctctatgcgactattggttggcatcctacagaagctggtatttatacagtaggaagttga

SEQ ID NO: 325 - DNA (genomic), 1266 bp, Streptococcus pneumoniae; double-stranded, circular
  misc_feature (B) LOCATION 1...1266
  hypothetical: NO
  anti-sense: NO
aaaaagaggttttatatgttaagttcaaaagatataatcaaggctcacaaggtcttgaacggtgtggttgtgaatactccactggattacgatcattatttatcggagaagtatggtgctaagatttatttgaaaaaagaaaatgcccagcgtgttcgctcctttaaaattcgtggtgcctattatgccatttcccagctcagcaaggaagaacgtgaacgtggggtagtctgcgcttctgcgggaaatcatgcgcagggagtagcctatacttgtaatgaaatgaaaattcctgctactatctttatgcccattactacgccacaacaaaagattggtcaggttcgcttttttggtggggattttgtaactattaaactagttggagatacctttgatgcctcagccaaagcagctcaagaatttacagtctctgaaaatcgtacctttattgatccttttgatgatgctcatgttcaagcaggtcaaggaacagttgcttatgagattttagaagaagctcgaaaagaatcgattgattttgatgctgtcttggttcctgttggtggtggcggtctcattgccggggtttctacctatatcaaggaaacaagtccagagattgaggttatcggagtagaggcgaatggagcgcgttccatgaaagctgcctttgaggctggaggtccagtaaaactcaaggaaattgataaatttgctgatgggattgctgtgcaaaaggtaggtcagttgacctatgaagcaactcgtcaacatattaaaactttggtaggtgtcgatgagggattgatttctgaaaccttgattgacctttactctaagcaagggatagtcgcagaacctgctggagcggctagtatcgcctctttagaggttttagctgaatatattaaggggaaaaccatttgttgtatcatttctggaggaaataatgatatcaaccgtatgccagaaatggaagagcgtgccttgatttatgatggtatcaaacattactttgtggtcaatttcccacaacgtccaggagctttgcgtgagtttgtaaatgatatcctggggccaaatgatgatatcacacgttttgagtatatcaaacgagctagcaagggaacaggcccagtattaattgggatcgctttagcagataagcatgattatgcaggtttgattcgtagaatggaaggttttgatccagcttatattaacttaaatggtaatgaaacgctttataatatgcttgtctga

SEQ ID NO: 326 - DNA (genomic), 201 bp, Streptococcus pneumoniae; double-stranded, circular
  misc_feature (B) LOCATION 1...201
  hypothetical: NO
  anti-sense: NO
cactctataactatttattatcttatcaaaaaggagaatcataacatggataagaaacaaaacctaacttcatttcaagaactaacaactaccgaactcaaccaaattataggtggaggatggtgggaagatttcttatatagatttaatataattgaacaaaaaaatacaaaaggattttatcagccaatacaactataa

SEQ ID NO: 327 - DNA (genomic), 345 bp, Streptococcus pneumoniae; double-stranded, circular
  misc_feature (B) LOCATION 1...345
  hypothetical: NO
  anti-sense: NO
gccaatataactaaaaaaaggagaaatacaatggcaaaagcaattacagatgcaacattcgaacaagaaacaaaagacggtttggtcttagtagacttctgggcaacttggtgtggtccatgtcgtatgcaaggtccaatcttggacaaattgtctgaagaactttcagaagatgtcttgaaaatcgttaaaatggacgttgatgaaaatccaaacacagctcgtgcttttggaatcatgtctattccaactcttctcttcaaaaaagacggccaagttgtcaaacaagttgcaggtgttcacacagcagaacaaatcaaggccatcattgctgaattgagctaa

SEQ ID NO: 328 - DNA (genomic), 537 bp, Streptococcus pneumoniae; double-stranded, circular
  misc_feature (B) LOCATION 1...537
  hypothetical: NO
  anti-sense: NO
aaacgtataacatctcctaaagatgtgtcagcacaaattacgattaaccataaaaaagcgcgctatgttcggattgagctagaaggctataatgccctcagtcttgcagaagttgaagttttccgctttatagctacgaatggtgaaacggcgatacaagtttctaagccagttcaaccaatcagtcagactcctgtgaaggataaaacattgacaattcaacacagtggagcttacattgcccgctactccataacttgggaagaagttccagtagataaagatggaaaccaagttgttcgtagtcattcttgggaaggaaacggtcgcaaccagactgcaggttttgtcctcaacctcccaatcaaagaaaatatgagaaatctgcgagttaagattgagaaaaagacaggtctactatggaatagatggcaaacaatctatgaaaacagaccaattttagctcaacctcaccgtaaaattacccattggggtacgatattgaattccaaggtgagtgacgatgatgtcttgtaa

SEQ ID NO: 329 - DNA (genomic), 471 bp, Streptococcus pneumoniae; double-stranded, circular
  misc_feature (B) LOCATION 1...471
  hypothetical: NO
  anti-sense: NO
gaaaggaggttagaagagatgattattacaaaaattagccgtttaggaacttatgtgggagtaaatccacattttgcaacattaatagattttctagaaaaaacaggactagaaaatttaacagaaggttcgattgctatcgatggtaatcgattgtttgggaattgctttacttatctagcagatggtcaagcaggggctttctttgaaacacaccaaaaatatttggatattcatttagttttggaaaacgaagaagccatggctgttacatcgccggaaaatgtaagcgttacccaagaatatgatgaagagaaagatattgaattatacacagggaaagtggaacagttggttcatttgagagctggcgaatgcctcatcacttttccagaagatttacatcaacccaaggttcgtataaatgatgaacctgtgaaaaaagttgtctttaaagttgcgatttcttaa

SEQ ID NO: 330 - DNA (genomic), 240 bp, Streptococcus pneumoniae; double-stranded, circular
  misc_feature (B) LOCATION 1...240
  hypothetical: NO
  anti-sense: NO
tctcattcaactacttgcaaatgcccttgtttggggtgtcttggcaccacttggagatgttgtgatttatcaagaagcggcagaaaaagtatttgcacaagggattgttgcgggaattgccaatggtgtatctgtagctattgcaggaactcttctcttacttgcctatgcaggaacccaaactcgtgcaggaagtttgaaaaaggactaatactcaatgaaaatcaaagagcaaactag

SEQ ID NO: 331 - DNA (genomic), 669 bp, Streptococcus pneumoniae; double-stranded, circular
  misc_feature (B) LOCATION 1...669
  hypothetical: NO
  anti-sense: NO
gaaaattcaactaggcggacgtggaacccacttttgtccaaactgtcaaaggggggactgatgggaaaaatcatcggaatcactgggggaattgcctcaggtaagtcaactgtgacaaattttctaaaacaccaagggctttcaagcagtggattgccgacgcagtgttccaccaactacagaaaacctggtggtcgtctgtttgaggctttagtacagcactttgggcaagaaatcattcttgaaaacggagaactcaatcgccctctcatagctagtctcatcttttcaaatcctgaagagcaaaaatggtctaatcaaattcaaggggagattatccgtgaggaactggctactttgagagaacagttggctcagacagaagagattttcttcatggatattcccctactttttgaacaggactacagcgattggtttgctgagacttggttggtctatgtggaccgagatgcccaagtagaacgcttaatgaaaagggaccagttgtccaaagatgaagctgagtctcgtatggcagcccagtggcctttagaaaaaaagaaagatttggccagccaggttcttgataataatggcaatcagaaccagcttcttaatcaagtgcatatccttcttgagggaggtaggcaagatgacagagattaa

SEQ ID NO: 332 - DNA (genomic), 414 bp, Streptococcus pneumoniae; double-stranded, circular
  misc_feature (B) LOCATION 1...414
  hypothetical: NO
  anti-sense: NO
acattatcaactgacagtagaagaagaaaaaatgctggcagaaatcaaagaaaacaaagaataaaggagaaacctatgcaagtaatcaaacgtaatggcgaaattgctgaatttaatccagataagatttaccaagccatcttgaaggcagcccaaactgtttatgttttgacagatgatttgcgtcaaaatcttgctcaagtcactaagaaggtagttttggatttacaagaagccaaggtggaacgtgcgactatcagtatgattcaatctatggttgaacatcgtttattgggcgcaggttacattaccattgcagaacactatatttcctatcgtttacaacgtgacttggaaagaagtggttatggagatcatatcgcagttcatttacattttgaacaaattcgctaa

SEQ ID NO: 333 - DNA (genomic), 639 bp, Streptococcus pneumoniae; double-stranded, circular
  misc_feature (B) LOCATION 1...639
  hypothetical: NO
  anti-sense: NO
aaggagtcaaccatggaatgtaaaaaactaaatatttggacagcttcctctttcttcatctttcttacctatcttgtctttctcgtttatcctatcgttaccgtgctaaagcaagcacttatacatgaaggacaattctcactagctaattttgtcactttctttagtaaagtctactactctgagacactagtcaacagtttcaaggtttccattaccgctactgtcacttccttagttgtaggaaccctattagcttatctcttctctatgtatgacttcaaggggaagaaatttctacaaatattgattatcattgcttccatgtcagctcctttcgtaggagcctactcctgggttctcttgctgggacgaaatggggtcatcactaaatttttgacaaatgcccttcatcttccagctatcgatatttatggattcaaaggaattgtacttgtctttacactgcaactattcccactggtatttctatatgttgctgaaacaatgaacagtattgacaattctctacttgaagctgctgaaagcatggggtccttcggatttaaacctatcgtaacggttgttttacctctcctagttccaaccttactagcagctccttgcttgtatttatga

SEQ ID NO: 334 - DNA (genomic), 792 bp, Streptococcus pneumoniae; double-stranded, circular
  misc_feature (B) LOCATION 1...792
  hypothetical: NO
  anti-sense: NO
aaaaaaccaacctttattattgtcatgatcgggatttctcttattccagatctgtacaatatcatatttttgtcatcaatgtgggatccatatgggcaattgtctgacttacctgtggcagttgtaaataatgataaagaggcttcctataatggtaatactatggcaataggaaaagacatggtgtccaatttaaaagaaaataaaaccttggattttcattttgtagatgaagaggaaggaaagaagggattggaagatggcgattactatatggtagtgactttaccaagtgatttatctgacaaaacaactacattatccaatattcaatcgacagcagcttatcaatcattgacaagtgagcaacaaactgagataagtgattctgtatctcaaaattcaactgatagtattcaatcggctcagtcaattgtagctttagtacaagatttacagggaagtttagaaaacttacaaaatcaatcttctaatctttcgactttaaaaaatcaagctaatcaagtatcacctattacttctacttctttgataggattgtcaagtggattaacagagatacaaggagatgttactagcaaattagttcctgccagtcagtcgattgcatcaggtgtaaacgcatatactacaggtgttgataaagtttctcagggcgcaagtcaactaagtgaaaaaaatgccaccttgacaggtagtttggataaactagtttcaggctcaaacaccttgacacaaaaatcttctagattgacagcaggagttggttaa

SEQ ID NO: 335 - DNA (genomic), 219 bp, Streptococcus pneumoniae; double-stranded, circular
  misc_feature (B) LOCATION 1...219
  hypothetical: NO
  anti-sense: NO
agtatcgggttttactccacgaggaagcaaggacaagaaaacttccaagaagaaaatgacagtagacaagtaatcttaacggtaactcagattattgagaggctttatcctatgtttttggacatcgagggcaagcctcttgatttttgggatttgacggtacttgaaatcagagaaatgattgaaagctataaccgtgtcaaaatccaagagcggtaa

SEQ ID NO: 336 - DNA (genomic), 1377 bp, Streptococcus pneumoniae; double-stranded, circular
  misc_feature (B) LOCATION 1...1377
  hypothetical: NO
  anti-sense: NO
agaggagcaactagttacggggattctccttaccaatctttctcagccttcgcaggaaacactcattttatcgatttagatatcttggtggagcaaggtttgttggaagcaagtgaccttgaaggagttgactttggtagcgatgcgtctgaagttgactatgctaaaatctactatgcacgtcgtcctcttttagaaaaagcggtgaaacgtttctttgaagtcggagatgttaaagattttgagaaatttgctcaagacaaccaatcatggcttgagctctttgctgagtatatggctatcaaagagcattttgacaatcttgcttggactgaatggccagatgcagatgctcgtgctcgtaaagcttcagcacttgaaagctatcgtgagcaattggcagacaagttggtttaccaccgtgtgactcaatacttcttcttccaacaatggttgaaattgaaagcttacgctaacgacaaccacatcgaaatcgttggggacatgccaatctacgtagcggaagattcaagtgatatgtgggcaaatccacatctcttcaaaacagatgtcaatggtaaggctacttgtatcgcaggatgcccaccagatgagttttctgtaactggtcagctttggggtaatccaatctatgactgggaagcaatggacaaagacggctacaaatggtggattgaacgcttgcgtgaaagcttcaaaatctacgatatcgttcgtatcgaccacttccgtggcttcgaatcttactgggaaatccctgctggttccgatacagcagcacctggtgagtgggtgaaaggtccaggctacaagctttttgcagccgttaaggaagaacttggtgagctaaacatcatcgcagaagaccttggcttcatgacagatgaagtgatcgaattgcgtgaacgtactggcttcccaggaatgaagattcttcaatttgccttcaacccagaagacgaaagcattgatagcccacacttggcacctgctaactcagttatgtacacaggaacacacgataacaatacggttcttggttggtaccgtaatgagattgatgatgcgactcgtgagtacatggctcgttacacgaaccgtaaagaatacgaaacagtggtacacgctatgcttcgtacagtattttcatcagttagctttatggcaattgcaactatgcaagatttactagaattggatgaggcagctcgtatgaacttcccatctacccttggtggaaactggtcttggcgtatgactgaagatcaattgacaccagctgtcgaggaaggtttgcttgacttgacaacaatttatcgccgaattaatgaaaatttggtagatttaaagaaataa

SEQ ID NO: 337 - DNA (genomic), 198 bp, Streptococcus pneumoniae; double-stranded, circular
  misc_feature (B) LOCATION 1...198
  hypothetical: NO
  anti-sense: NO
aaattagggttgggttatcgaaccaatctttttctaaataatactttttctcatgctcagacatataagcaatcaatgactgaaaatgctttatgcgttcatgaagatgttctatattttctttcatccatcctcctactccttaaatttttccaaatatatttttcgcttgtatatttccaacatcaatcttattga

SEQ ID NO: 338 - DNA (genomic), 480 bp, Streptococcus pneumoniae; double-stranded, circular
  misc_feature (B) LOCATION 1...480
  hypothetical: NO
  anti-sense: NO
gttgttcaaacaagaggaacaggccttaaattcgtaaaggaggttatcaattggaactatgagtcgtacaattctgggcatgggaggaaattcatattcaanagaataatagaagccagactgacaatttcaaattcaccttttgttcanagacgntatcagataaaacctgaagctttttatgttttatttaaagnattancagcacctattccacttaatactgattttccaatattcgctgcagatgggagtgatatcngtattcctcgaaatcccatggatacagaaacctntatccaaacccaaacggatgttaaatcctataatctcatacacataaatgccctatacgacttgacgactggagtgtatagagatgtctctattcaagacaaacatgcacaacatgagcgcttagctctgattcagatgatggaggcttctccctttcgagaaagctcttgttatcatggatag

SEQ ID NO: 339 - DNA (genomic), 357 bp, Streptococcus pneumoniae; double-stranded, circular
  misc_feature (B) LOCATION 1...357
  hypothetical: NO
  anti-sense: NO
gatggtcaaacaaatgcgtccaggctctgtatcgttgaccttgctgttgaccaaggtggccttatcgaaacagctgaccgtgtgacaacgcacgatgaacccgtctatgaaaaacacggtgttctccactataccgttgccaatatccctggtgcggttgctcgcacttcaaccatcgccctaaccaatgtcactcttccttatatcgaagctttggctggcaaaggattcgcacaagcaatctctgaagatgaaggcttgcgtcaaggtgtgaccacttatcaaggttacttgactagcctaccagttgctcaaggacttaatcgtgactacactgatatcaatgatttagtataa

SEQ ID NO: 340 - DNA (genomic), 375 bp, Streptococcus pneumoniae; double-stranded, circular
  misc_feature (B) LOCATION 1...375
  hypothetical: NO
  anti-sense: NO
gtatggcaaacttatcggagaactcttctgagttcgtccaaaccagagttatcacagaaaactaacacggaggaaaacattatgttaaaaatgactcttaacaacttgcaacttttcgcccacaaaaaaggtggaggttctacatcaaacggacgtgattcacaagcaaaacgtcttggagctaaagcagctgacggacaaactgtaacaggtggatcaatcctttaccgtcaacgtggtacacacatctatccaggtgtaaacgttggtcgtggtggagacgatactttgttcgctaaagttgaaggcgtagtacgctttgaacgtaaaggacgcgataaaaaacaagtttctgtatacccaatcgcaaaataa

SEQ ID NO: 341 - DNA (genomic), 2421 bp, Streptococcus pneumoniae; double-stranded, circular
  misc_feature (B) LOCATION 1...2421
  hypothetical: NO
  anti-sense: NO
agctataaaacaagctatacaaaggatttgagacgtttgcttcaagtctttttcttttgtccgaaacagatatatagtttcaaactatatcaaaccctaattttttacaattatacagacgctttcttttctgttaagatagtttcaacaacaaattttggaggacacatcatgtcaactacaatcgtcggtttccctcgtttgggcgaattccgtgaattaaaatttacaactgaaaaatactttagaaaagaaatctcagaagaagaacttttagcagcagcaaaagacttgcgtgctaaacactggaacattgtcaaagaaaaaggcatcactgaaattccatcaaatgacttttctcactatgataacttcctagatgcggctttccttttcaacgtggtgcctgcatccgttcaaaacttggacttgtctgaccttgagcgctacttcgctttgggacgtggttaccagggagaaaaaggggacgttcgcgccctcccaatgaagaaatggtttaacactaactaccactacatcgttcctaaatttgaaaaagacactcaagtaaaattggctggtcacaagatttttgatgagttccaagaagccaaagaaattggattgaacactcgtcctgttcttgtaggtcccttcactttccttcaattgtcagactttgaagaaggcgtgaaagcagacgacttcgtagatagcttagtggctgcttaccaagaagtttttgctaaattggctgaacttggtgcgacttgcatccaattggatgaagcggctcttgtaaaagacttgacagctgaagaaaaagctctcttcttgaatctttacaacaaactcttggctgacaaaaaaggtcttgaagtcttgcttcaaacttatttcggtgatgttcgtgacgtatacgctgaccttgtaaacttgccagtagatgctatcggttttgactttgttgaaggtaagaaaactcttgaactcgttaaaggtggcttcccagctgacaagactctctatgcaggtattgtcaatggtaaaaacatctggcgcaacaactatgaaaagagcttggctgttcttgagcaaatcccagctgaaaacatcgttttgacaagctcttgctcacttcttcatgtgccatttacaactgctaatgaagaatttgaaccagcactcttgaaccactttgcctttgcagttgaaaaattggatgaaatccgtgacttggatgctatccgcaatggtcaaggttcagaagctcttgcagccaacaaagaactctttgcgactgagcgtgttggtgaaaatgctgaacttcgtgcgcgtatcgctggcttgacagacacagactacactcgtttgccagcctttgcagaacgtgaagctatccaagaagaagctttcaaacttccagctcttccaacaacaacgattggttcattccctcaaacaaaagaagttcgtgccaaacgtttggcttaccgtaaaggtgaattgtctcaaaaagagtacgatgctttccttgctgaaacgattgacgaatggatcaagtggcaagaagatattgactttgatgtccttgttcacggtgaatttgagcgtaatgacatggttgagtacttcggtcaaaacttgtcaggatacctcttctctaaaaatggatgggtacaatcatacggtatgcgtggggtaaaaccaccaatcatctggggtgatgtcactcgtcttaaccctatcactgttaaatggtctagctatgcacaaagtcgtacaaacaaacctgttaaaggtatgttgactggacctgttaccatccttaactggtcattcccacgtgaagacatctctatcaaggattcaactctccaaatcgcccttgctatcaaggatgaagtacttgaccttgaagctgctggtgtgaaaatcatccaaatcgacgaggctgctcttcgtgaaaaattgccactccgccgtagcgactggtacgaagactaccttgactgggctattcctgccttccgcttggtacactcaacagtagcgccagacacacaaatccacactcacatgtgttactcagaatttacagatatcatcccagctatcgataacatggatgcagacgttatttcctttgaagctagccgttcaaaccttgaaatcttggacgaactcaaagcgaaaaacttccaaacagaagtgggacctggggtttacgatatccactcacctcgtgtaccaaatgaaggcgaaatcgacaacacaatcgaagccatccttgctaaagtgccaagcaagaaagtttggatcaaccctgactgtggtttgaaaacacgtggtatcccagaaacaaaagaaagcttgatccgccttgttgaagcagctaaagctgcgcgtgagaaattgtaa

SEQ ID NO: 342 - DNA (genomic), 1611 bp, Streptococcus pneumoniae; double-stranded, circular
  misc_feature (B) LOCATION 1...1611
  hypothetical: NO
  anti-sense: NO
tatggtaaaacaaatataaatagaaagcgttttcttgaatgtttatttaagaaagtagttggttttttacactttgttagacatcaggaggaaaaacaaatgagtgaaaaagctaaaaaagggtttaagatgccttcatcttacaccgtattattgataatcattgctattatggcagtgctaacttggtttatccctgcgggggcctttatagaaggtatttacgagactcagcctcaaaatccacaagggatttgggatgtcctcatggcaccgattcgggctatgctaggtactcatccagaggaaggttcgctcattaaagaaacgagcgcagcgattgatgtagccttcttcatccttatggttgggggtttccttggcattgtcaacaaaactggtgctcttgacgtagggattgcctctatcgtgaagaagtataagggccgcgaaaaaatgttaattttggtactgatgcctttgtttgccctcggtggtacaacttatggtatgggggaagaaacaatggccttctatccactccttgtgccagttatgatggccgttggttttgatagcctgactggtgttgcaattattttgctcggttctcaaatcggctgtttggcatctactctgaatccatttgcgacaggtattgcttcagcgactgcgggagttggtacaggggacggtatcgtacttcgtctgatcttctgggttaccttgactgctcttagtacttggtttgtttaccgttatgcggataagattcaaaaagatccgactaagtcactggtttatagtactcgcaaagaagatttgaaacactttaacgtagaagaatcttcatctgtagaatctacacttagcagcaaacaaaaatcagttctcttcttatttgtgttgacattcatcttgatggtattgagcttcattccatggacagaccttggcgttaccatttttgatgactttaatgcttggttgactggtcttccagttattggtaatattgtcggttcatctacttctgcactaggtacttggtacttcccagaaggcgcaatgctctttgcctttatgggtatcctgattggtgttatttatggtcttaaagaagataagattatctcttccttcatgaatggtgctgctgacttgctcagtgttgccttgatcgtagcgattgctcgtggtattcaagttatcatgaacgacggtatgattaccgatacaatcctcaactggggtaaagaaggcttgagcggtctatcttcacaagtctttatcgttgtaacttatatcttctatctacctatgtcattcttgatcccatcttcatctggtcttgccagcgcaactatgggtatcatggctccacttggagaatttgtaaatgtccgtcctagcttgattatcactgcttaccaatctgcttcaggtgtcttgaacttgattgcaccaacatctggtattgtgatgggagctcttgcacttggacgtatcaacattggtacttggtggaaattcatgggcaaactcgtagtcgctattattgtagtgaccatcgcccttcttctccttggaaccttccttccattcctataa

SEQ ID NO: 343 - DNA (genomic), 225 bp, Streptococcus pneumoniae; double-stranded, circular
  misc_feature (B) LOCATION 1...225
  hypothetical: NO
  anti-sense: NO
aaatccaaaacacaaggcatgaaatttatcaaaaaactccataaaattatcctcctcaacaaacagacttcctacacgtcattctttagttctagcctttccaaaacaaaccattttatactcttcgaaaatcaaattcaaaccacgtcaacgtcgccttgccgtactcaagtacagcctgcggctagtttcctagtttgctctttgattttcattgagtattag

SEQ ID NO: 344 - DNA (genomic), 363 bp, Streptococcus pneumoniae; double-stranded, circular
  misc_feature (B) LOCATION 1...363
  hypothetical: NO
  anti-sense: NO
attccaaaaacaaaaacgttagcggaactagcagatgtgattttatggagtttcgattttgtaaatgctcatgctcacgcatttttcatggataatgttgagtggagtcatgcagattcttactttcttagctttgttagtgacgatgttgaagaacgttacacagaaaatgtctatctggatagcctaagtgtcaaacaaaaatttaagtttcttttcgacttcggtgatgaatggcgttttgaatgccaagtactgagagaaatcgagacagaggacgaagaagcttatctcgtacgttcggttggaacgtcgccagaacaatatccagattatgatggttttgactatgaagaatggtaa

SEQ ID NO: 345 - DNA (genomic), 1926 bp, Streptococcus pneumoniae; double-stranded, circular
  misc_feature (B) LOCATION 1...1926
  hypothetical: NO
  anti-sense: NO
atgaaaaaaactacaatattatcattaactacagctgcggttattttagcagcatatgtccctaatgaaccaatcctagcagatactcctagttcggaagtaatcaaagagactaaagttggaagtattattcaacaaaataatatcaaatataaggttctaactgtagaaggtaacataagaactgttcaagtgggtaatggagttactcctgtagagtttgaagctggtcaagatggaaaaccattcacgattcctacaaaaatcacagtaggtgataaagtatttaccgttactgaagtagctagtcaagcttttagttattatccagatgaaacaggtagaattgtctactatcctagctctattactatcccatcaagcataaaaaaaatacaaaaaaaaggcttccatggaagtaaagctaaaactattatttttgacaaaggcagtcagctggagaaaattgaagatagagcttttgatttttctgaattagaagagattgaattgcctgcatctctagaatatattggaacaagtgcattttcttttagtcaaaaattgaaaaagctaaccttttcctcaagttcaaaattagaattaatatcacatgaggcttttgctaatttatcaaatttagagaaactaacattaccaaaatcggttaaaacattaggaagtaatctatttagactcactactagcttaaaacatgttgatgttgaagaaggaaatgaatcgtttgcctcagttgatggtgttttgttttcaaaagataaaactcaattaatttattatccaagtcaaaaaaatgacgaaagttataaaacgcctaaggagacaaaagaacttgcatcatattcgtttaataaaaattcttacttgaaaaaactcgaattgaatgaaggtttagaaaaaatcggtacttttgcatttgcggatgcgattaaacttgaagaaattagcttaccaaatagtttagaaactattgaacgtttagccttttacggtaatttagaattaaaagaacttatattaccagataatgttaaaaattttggtaaacacgttatgaacggtttaccaaaattaaaaagtttaacaattggtaataatatcaactcattgccgtccttcttcctaagtggcgtcttagattcattaaaggaaattcatattaagaataaaagtacagagttttctgtgaaaaaagatacatttgcaattcctgaaactgttaagttctatgtaacatcagaacatataaaagatgttcttaaatcaaatttatctactagtaatgatatcattgttgaaaaagtagataatataaaacaagaaactgatgtagctaaacctaaaaagaattctaatcagggagtagttggttgggttaaagacaaaggtttatggtattacttaaacgaatcaggttcaatggctactggttgggttaaagacaaaggtttatggtattacttaaacgaatcaggttcaatggctactggttgggttaaagacaaaggcttatggtattacttaaacgaatcaggttcaatggctactggttgggttaaagacaaaggcttatggtattacttaaatgaatcaggttcaatggctactggttgggttaaagacaaaggcttatggtattacttaaacgaatcaggttcaatggctactggttgggttaaagacaaaggcttatggtattacttaaacgaatcaggttcaatggctactggttgggttaaagacaaaggcttatggtattacttaaatgaatcaggttcaatggctactggttggtttacagtttctggtaaatggtactatacctataattcaggagatttattagtaaacacgactacacccgatggctatcgagtcaatgctaacggtgagtgggtaggatag

SEQ ID NO: 346 - DNA (genomic), 483 bp, Streptococcus pneumoniae; double-stranded, circular
  misc_feature (B) LOCATION 1...483
  hypothetical: NO
  anti-sense: NO
tgtagaaaaacagctaaaggaaagactatgaaaccactacttgaaaccatcgatacccgctttggaactaccaacaagcatgccttttctcggggaaataccctgccatacacaggcgtgccttttgggatgaattattttgtgccccagaccagtgaccaggacggagcttggttcttcgatccgcatctgcctatctttcaggggattcgattaactcaccagcccagtccttggattggggactactcttggctccttctgacacctgtcaccagtcaactgggtgaagacagtctctttcaccgccagtcttcctataatagggataaggcctctttccaacctcattatctaaagattttctccctgcgctatcagattgaaacccagctcacaccgacttgctacggtgcttctattcgtttgaagcaaaagcaaggcaaagcctctccctctatcttcacgcaacagatgaactga

SEQ ID NO: 347 - DNA (genomic), 1965 bp, Streptococcus pneumoniae; double-stranded, circular
  misc_feature (B) LOCATION 1...1965
  hypothetical: NO
  anti-sense: NO
ggtagaaaaacgatgaaaattcaagatttattgagaaaagatgtcatgttgctggatttgcaggcaactgaaaagactgctgtcattgaagagatgattaaaagcctaacaggccacggttatgtgacagattttgaaacctttaaagaaggcattttggcgcgtgaagctttaacttctactggtttgggtgatggaatcgctatgcctcacagcaaaaacgctgctgtcaaagaagcgacagttctctttgctaagtcaaacaagggtgttgactatgagagtttggatgggcaggcaactgacctcttcttcatgattgcagctccagaaggtgccaatgatactcacttggcagcattgacagaattgtctcaatacttgatgaaagacggttttgcagacaaacttcgtcaagcaacatctgcagaccaagttatcgaactttttgaccaagcttcagaaaaaactgaggaacttgttcaagcacctgctaatgactctggtgactttatcgtagctgttacagcttgtacaacaggtattgcccacacttacatggcccaagaagcccttcaaaaagtagctgctgaaatgggggttggtatcaaggtcgaaaccaacggtgctagcggtgttggaaatcaactaactgcagaagatatccgtaaggctaaagctattatcattgcagcagacaaggccgttgaaatggatcgtttcgatggcaaacctttgatcaatcgtccagttgctgacggtatccgtaagacagaagaattgatcaacttggctatttcaggagatgcggaagtctaccgtgccgctaatggtgccaaagtcgcaacagcctctaacgaaaaacaaagccttggtggtgccttctacaaacacttgatgagtggtgtatctcaaatgttaccattcgttatcggtggtggtatcatgattgcccttgccttcttgattgacggtgctttgagtgttccaaatgaaaaccttggcaatcttggttcttaccatgagttagcttctatgttcatgaaaattggtggagctgcctttggtttgatgcttccagtctttgcgggttatgttgcctactctattgctgaaaaaccaggtttggtagcaggtttcgtggctggtgctattgccaaagaaggttttgcctttggtaatattccttatgccgcaggtggtgaagcaacttcaactcttgcaggtgtctcatctggtttcctaggtgcccttgttggtggatttatcgcaggtgccttggttcttgccatcaagaaatacgttaaagttcctcgttcactcgaaggtgctaaatcaatccttctattgccacttcttggaacaatcttgacaggatttgttatgctagctgtgaatatcccaatggcagcaatcaacactgctatgaatgacttcctaggcggtcttggaggaggttcagctgtcttacttggtatcgtccttggtggaatgatggctgttgacatgggtggaccagttaataaagcagcttatgtctttggtacaggtacgcttgcagcaactgtttcttcaggtggttctgtagccatggcagcagttatggctggaggaatggtgccaccacttgcaatctttgtcgcaactcttcttttcaaagataaatttactaaggaagaacgtaactctggtttgacaaacatcatcatgggcttgtcatttatcactgagggagcgattccatttggtgccgctgacccagctcgtgcgattccaagcttcatccttggttcagcagtagcaggtggactcgttggtcttactggtatcaaactcatggcgccacacggaggaatcttcgttatcgcccttacttcaaatgctctcctttacctcgtttctgtcttggtaggagcaatcgtaagtggtgtggtttatggttacctacgcaaaccacaagcataa

SEQ ID NO: 348 - DNA (genomic), 249 bp, Streptococcus pneumoniae; double-stranded, circular
  misc_feature (B) LOCATION 1...249
  hypothetical: NO
  anti-sense: NO
aaaagaaaaacctggggtcttgtactcttcgaaaatctcttcaaaccgcgtcaacgtcgccttgccgtatgtaggttactgacttcgtcagttctatctacaacctcaaagcagtgctttgagcagcctgcggctagtttcctagtttgctctttgattttcattgagtattggcctcaggtttccatttgcaatcagaaagggattttatgtccattattcaaaaactttggtggtttttcaagttag

SEQ ID NO: 349 - DNA (genomic), 396 bp, Streptococcus pneumoniae; double-stranded, circular
  misc_feature (B) LOCATION 1...396
  hypothetical: NO
  anti-sense: NO
aaaatgaaaactaagaaattattgaaaatggttattcctgttttaatgataagtgctgttggaactactttcgtagaagcaaatcagataggtgcttttagtaattttgttattactaccagttataagagaacaggttatttgactaaagaaaatgaaggtgcggaatatatcatgaacttaaatccttgtagaaatttacatcccatgactgttaagcatcgtatagtaaattctaatggagaagctcgtagtggagaatcgttaacaacctgtggtactcgttcaactcatggtaattgggcaacggttggctatgtttatgcagcagatatggcaagacaaaattggtgggatttatcagctgccatttcaggtagttggtcaccaaattaa

SEQ ID NO: 350 - DNA (genomic), 384 bp, Streptococcus pneumoniae; double-stranded, circular
  misc_feature (B) LOCATION 1...384
  hypothetical: NO
  anti-sense: NO
aaggagaaaactgaaatgattcaaacagaaactcgtttgaaagtcgcagacaacagcggtgctcgcgaaatcttgactatcaaagttcttggtggttcaggacgtaaatttgcaaacatcggtgatgttatcgtggcatctgtaaaacaagctactcctggtggtgcggttaaaaaaggtgacgttgttaaagcagttatcgttcgtactaaatcaggtgctcgtcgtgctgatggttcatacatcaaatttgacgaaaacgcagcagttatcatccgtgaagacaaaactcctcgcggaacacgtatctttggcccagttgcacgtgaattgcgtgaaggtggcttcatgaagatcgtgtcacttgctccagaagtactttaa

SEQ ID NO: 351 - DNA (genomic), 213 bp, Streptococcus pneumoniae; double-stranded, circular
  misc_feature (B) LOCATION 1...213
  hypothetical: NO
  anti-sense: NO
atgtctgaaactatcttagaaatcaaggaactaaaaaaatccttcggagacaatcccatcctccaaggactttctctagaaatcaaaaaagggggaagttgttgtcatcctaggggcatctggttgtgggaaaagtaccctccttcgttgcctcaacggcttagaaagtattcaaggtggagatattcttctggatggtcagtctatcgttga

SEQ ID NO: 352 - DNA (genomic), 447 bp, Streptococcus pneumoniae; double-stranded, circular
  misc_feature (B) LOCATION 1...447
  hypothetical: NO
  anti-sense: NO
attgatgaaacaggattcgatacttatttttatcgagaatatggtcgctcattaaaaggtcagttaagaagaggtaaagtatctggaagaagatatcagaggatttctttggttgcaggtctaacaaatggtgagttaatcgctccaatgacttacgaagagatgatgacgagcgacttttttgaagcttggtttcagaagtttctcttaccaacattaaccacaccatcggttattattatggataatgcaagattccatagaatgggtaagttagaacttttatgcgaggagtttgggcataaacttttatctcttcctccctactcacctgagtacaatcctattgagaaaacatgggctcatatcaaaaagcacctcaaaaaggtattaccaagttgcaataccttttatgaggctcttttgtcctgctcttgtttcaattga

SEQ ID NO: 353 - DNA (genomic), 249 bp, Streptococcus pneumoniae; double-stranded, circular
  misc_feature (B) LOCATION 1...249
  hypothetical: NO
  anti-sense: NO
attgatgaaacaggattcgatacttatttttatcgagaatatggtcgctcattaaaaggtcagttaagaagaggtaaagtatctggaagaagatatcagaggatttctttggttgcaggtctaacaaatggtgaattaatcgctccaatgacttacgaagagatgatgacgagcgacttttttgaagtatggtttcagaagtttttcttaccaacattaaccacaccatcggttattatagtaaaatga

SEQ ID NO: 354 - DNA (genomic), 447 bp, Streptococcus pneumoniae; double-stranded, circular
  misc_feature (B) LOCATION 1...447
  hypothetical: NO
  anti-sense: NO
attgacgaaacaggattcgatacttatttttatcgagaatatggtcgctcattaaaagatcagttaataagaggcaaagtatctggaagaagatatcagaggatttctttggttgcaggtctaacaaatggtgagttaatcgctccaatgacttacgaagagacgatgacgagcgacttttttgaagcttggtttcagaaatttctcttaccaacattaaacacaccatcggttattattatggataatgcaagattccatagaatggggaagctagaactcttgtgtgaagagtttgggtataaacttttacctcttcctccctactcacctgagtacaatcctattgagaaaacatgggctcatatcaaaaagcacctcaaaagggtattaccaagttgcaataccttttatgaggctcttttgtcttgttcttgtttcaattga

SEQ ID NO: 355 - DNA (genomic), 450 bp, Streptococcus pneumoniae; double-stranded, circular
  misc_feature (B) LOCATION 1...450
  hypothetical: NO
  anti-sense: NO
attgacgaaacaggattcgatacttatttttatcgagaatatggtcgctcattaaaaggtcagttaagaagaggcaaagtatctggaagaagatatcagaggatttctttggttgcaggtctaacaaatggtgagttaatcgctccaataacttacgaagagatgatgacgagcgacttttttgaagcttggtttcagaagtttctcttaccaacattaaccacaccatcggttattattatggataatgcaagattccatagaatggggaagctagaacttttatgcgaagagtttgggcataaacttttacctcttcctccctactcacctgagtacaatcctattgagaaaacatgggcccatatcaaaaagcacctcaaaaaggtattaccaagttgttgcaataccttttacgaggctcttttgtcctgctcttgtttcaattga

SEQ ID NO: 356 - DNA (genomic), 708 bp, Streptococcus pneumoniae; double-stranded, circular
  misc_feature (B) LOCATION 1...708
  hypothetical: NO
  anti-sense: NO
tatgaagaaacaagtggagaaagcagagaatttaatatgaaaaaacgggctattcaaattttactagcattgtccttaattttttacaaatcaacttggttttggagagttttcaatcacctcgcaaagccctatctaccagcaagtcgtgaattttttcagattctgcttttgatggagagcggagttcttttcttagcggtcatctatctactggtttttgcaggaaagaaaatttttcatttcaagtggcagctgaggtacttcatctaccttttactgggctacatcatttcatatatgtctgacttcctcttttcgtatttcatatccctgtcttcaaatcagatttctctgaatgaaacggtagaaatgatggggagacaggagttcccttatttcttgctcatcgtttgcttcatcgcccctattgctgaggaattgatttatcgaggtgtgcttatgacaacctttttcaaaaactcaccttggtacggagatgttttgctttctgctattattttcggttatattcatatcaattttgctttaactcctcttgcttttttcatttatgctagtggaggtcttattttagctctattgtatcgcatgactaaaaatctctactatccaatactagttcatattctcatcaatatcactgccttctgggatgtttggttactcctattttcaggaagttag

SEQ ID NO: 357 - DNA (genomic), 1077 bp, Streptococcus pneumoniae; double-stranded, circular
  misc_feature (B) LOCATION 1...1077
  hypothetical: NO
  anti-sense: NO
gatagagaaaccgagaggacaaacatgaaactaaaaagttatattttggttggatatattatttcaaccctcttaaccattttggttgttttttgggctgttcaaaaaatgctgattgcgaaaggcgagatttactttttgcttgggatgaccatcgttgccagccttgtcggtgctgggattagtctctttctcctattgccagtctttacgtcgttgggcaaactcaaggagcatgccaagcgggtatcggccaaggattttccttcaaatttggaggttcaaggtcctgtaaaatttcagcaattagggcaaacttttaatgagatgtcccatgatttgcaggtaagctttgattccttggaagaaagcgaacgagaaaagggcttgatgattgcccagttgtcgcatgatattaagacccctatcacttcgatccaagcgacggtagaagggattttggatgggattatcaaggagtcggagcaagctcattatctagcaaccattggacgccagacggagaggctcaataaactggttgaggagttgaattttttgaccctaaacacagctagaaatcaggtggaaactaccagtaaagacagtatttttctggacaagctcttaattgagtgcatgagtgaatttcagtttttgattgagcaggagagaagagatgtccacttgcaggtaatcccagagtctgcccggattgagggagattatgctaagctttctcgtatcttggtgaatctggtcgataacgcttttaaatattctgctccaggaaccaagctggaagtggtgactaagctggagaagggccagctttcaatcagtgtgaccgatgaagggcagggcattgccccagaggatttggaaaatattttcaaacgcctttatcgtgtcgaaacttcgcgtaacatgaagacaggtggtcatggattaggacttgcgattgcgcgtgaattggcccatcaattgggtggggaaatcacagtcagcagccagtacggtctaggaagtacctttaccctcgttctcaatctctctggtagtgaaaataaagcctaa

SEQ ID NO: 358 - DNA (genomic), 300 bp, Streptococcus pneumoniae; double-stranded, circular
  misc_feature (B) LOCATION 1...300
  hypothetical: NO
  anti-sense: NO
aatatggaaactagtatcagcatggctgacttttatggaaaataccaaaatgaaaatctagaacttatcgatgtccgtgaagcacatgaattccaagcaggacatgcactaggtgccaaaaatcttccattaagtaccttagaagcaagctacaaagaactcaaacctgaccatgaatactatgtcatttgtcaaggaggagtccgctctgcatctacctgccagtttctcagctcccaaggcctcaccgttaccaacgtagaaggtggtatgaatgcttggcccggtcaagtaaaataa

SEQ ID NO: 359 - DNA (genomic), 1020 bp, Streptococcus pneumoniae; double-stranded, circular
  misc_feature (B) LOCATION 1...1020
  hypothetical: NO
  anti-sense: NO
agtgaggaaactaggatgaaagagattattgaaaaactagcaaaatttgaaaatttatcaggtgtggaaatgacggatgtcattgagcgtatcgtaactgggcgtgtaactgaagcgcagattgcttctctcctcttagctcttaagatgaagggggaaacacctgaagaacgcacagccattgcccaagtcatgagaggacatgcccagcatattccaactgagattcatgatgccatggacaactgtggtacaggtggggacaagtctttcagttttaatatttccacaactgcagcctttgtcttggctggtggcggtattcacatggccaagcatggtaatcgctcgatttcttctaaatctggttccgcagatgtcctcgaagccttgggaatcaatcttgacctcaaaccagctgaactaggtaaggtctttgataaaactggaatcgtctttctcttcgctaaaaatatgcacccagctatgaaatacatcatgccagctcgtttggaattgggaattccaacgattatgaacttgactggtccactgattcatccaatggctttagaaacacagcttcttggaattagtcgtccagaactcctagaaagtacagctcaggttttgaaaaatatgggtcgcaaacgtgccatcgtggttgctggaccagaagggttggatgaagctggcttgaacggaacaaccaagattgcacttcttgaaaatggcgaaatcagcttgtcaagctttactccagaggatttgggaatggaaggctatgctatggaagatattcgtggtgggaatgctcaggaaaatgcagaaattttgcttagcgttctgaaaaacgaagcaagtccattcttggaaacgacagtcttgaatgctggtcttggtttctatgctaatggtaagattgatagcatcaaggaaggagttgccttggcccgtcaagtgattgctagaggcaaggcccttgaaaaactcagactgttacaggagtaccaaaaatga

SEQ ID NO: 360 - DNA (genomic), 585 bp, Streptococcus pneumoniae; double-stranded, circular
  misc_feature (B) LOCATION 1...585
  hypothetical: NO
  anti-sense: NO
aattggagaactaagaccatgattttattgattgacaactatgattcttttacctataacttggcccaatacattgggaattttgcagaagttcaggttctgagaaatgatgattccaagctgtatgaagaagctgaaaaagcagatggtctggtcttttctcctggtcctggttggccagttgatgctggaaagatggaagacatgattcgtgattttgcaggcaagaagccgattctagggatttgtttgggtcaccaagccattgcagaagtctttggtggtaagctaggtttggctccaaaagtcatgcatgggaaacagagcaatattaactttgaagcgccatctgttttgtatcaaggtattgaggatggccgtgcggtcatgcgttatcacagtattttgattgaggaaatgccagaagactttgaagtgacagctcgttcgactgatgaccaagccatcatggggattcaacataaaaacctaccgatttatggcttccagtaccatccagagagcattggaacgccagacggcttgtcttctattcggaattttatcgagaaggttgtaaagtga

SEQ ID NO: 361 - DNA (genomic), 2667 bp, Streptococcus pneumoniae; double-stranded, circular
  misc_feature (B) LOCATION 1...2667
  hypothetical: NO
  anti-sense: NO
ttaaggagaacacacatgtctaaagaactttcatctaaatacaatccagccgaggttgaggctggtcgttaccaaaaatggcttgatgctgatgttttcaagccttcaggcgatcaaaaggctaagccttattcaatcgttattccaccaccaaacgttacaggtaaacttcaccttggtcacgcttgggatacaactttgcaagatattatcatccgtcaaaaacgcatgcaaggttttgataccctttggcttcctgggatggaccacgcagggattgccactcaggctaaggtagaggagcgcttgcgtggtgagggcatttcccgctatgaccttggtcgtgagtctttcttgacgaaagtctgggaatggaaagacgaatatgccactactatcaaggaacaatggggcaagatggggctctctgtagactactctcgtgagcgtttcactcttgacgaaggtttgtcaaaagctgttcgtaaggtctttgtggacctttacaagaaaggctggatctaccgtggtgagtttatcatcaactgggacccagcagctcgcacagccctttctgatattgaggtgattcacaaggatgtcgaaggtgccttctaccacatgaactacatgctggaagatggttcacgcgcccttgaagttgctacaactcgtcctgagactatgtttggggacgttgcggttgcggttaatccagaagacccgcgctacaaggacttgattggtaaaaacgtcatccttccaatcgctaataaactcatcccaatcgttggagatgagcacgcagatcctgagtttggtactggtgtcgtgaaaatcacacctgcccacgatccaaatgacttcttggttggccaacgtcataacttgccacaagtcaacgtcatgaacgacgacggaactatgaatgagcttgcctttgaattttcaggcatggatcgttttgaagctcgtaaggcagtcgttgctaagttggaagaaatcggtgcccttgtcaaaatcgaaaaacgtgtccattcagtcggtcactcagaacggacaggtgtcgtagttgagccacgcttgtctactcaatggttcgtcaagatggaccaattggctaagaacgccattgccaaccaagacacagaggacaaggtcgaattctacccacctcgtttcaacgataccttccttcaatggatggaaaatgtccacgactgggttatctctcgtcagctttggtggggtcaccaaatccctgcctggtacaatgctgatggtgaaatgtatgtcggcgaagaagctccagaaggtgacggatggactcaggacgaagacgtcttggatacttggttcagttctgccctctggccattttcaaccatgggctggcctgaagtcgactcagaagactttaaacgttatttcccaacttcaaccttggtaacaggttacgacatcatcttcttctgggtgtctcgtatgatcttccagtcattggaattcacaggccgtcaaccattccaaaacgtccttatccatggtctaattcgtgatgaagaaggacgtaagatgtctaaatctcttggaaatggcattgacccaatggatgttattgataaatatggtacagatagtcttcgttggttcttgtcaaacggctcagctcctggtcaagacgttcgtttctcttacgagaaaatggatgcttcatggaactttattaacaagatttggaacatttctcgctatatcctcatgaacaatggaggtttgacgctggatgtggcgcatgacaatgtcacaaaagttgcaacaggtgaggctggtaatgtgacggaccgctggattctccacaatctcaacgaaaccattgcaaaagttactgaaaactttgataagtttgagtttggtgtggctggtcatatcctttacaacttcatttgggaagaatttgccaactggtatgttgagttgaccaaggaagttctttacagcgacaatgaagacgataaggtaattactcgatctgttctcctctatacgctggataaaatccttcgtctccttcacccaatcatgccgttcgtgacagaagaaatctttggtcagtacgctgaaggctctatcgtgacagcagcatacccaactgtcaacccagcctttgaagaccttgctgcccacactggtgtggaaagtctcaaaaacttgattcgtgctgttcggaatgcgcgtgcggaagtaaatgtagcaccaagcaaacctatcacaatccttgttaagactagcgatagtgacttggaagccttctttaacagcaatgtcaactacatcaagcgctttacaaatccagaacatttggaaatcgcatcaaccatccctgcacctgaactggctatgtcaagcgtcatcacaggagcagaaatctacttgccactggcagaccttctcaatgtcgaagaagaactggctcgtctcgacaaggaactcgctaaatggcaaaaagaactggatatggtcggtaagaaactctctaacgaacgcttcgtagccaacgccaaaccagaagtcgtccaaaaagaacgcgacaaacaagctgactaccaagccaagtatgatgcgaccgtagcacgtattgatgagatgaagaagttggtgaaataa

SEQ ID NO: 362 - DNA (genomic), 939 bp, Streptococcus pneumoniae; double-stranded, circular
  misc_feature (B) LOCATION 1...939
  hypothetical: NO
  anti-sense: NO
gggaggagaacaaaaatgacagagttggcaaagcaactattagagttgacctatattgtgattggttgtcaatttctccatacagcctattgtagttataaagataaaacaaacccagttcgacttgggacatctgcattttggactctattgtctattacgtttataggtggttcctatatgccaaatatgagtattggtattattgtaatcctattatcgctgttaacattgtttaagcaagtccgtatcggaaccttgccatccttagatgaaatgaaagccaatattgaatctaacaggttgaaaaataaaatttttattccagttatgctgatggcaatacttgcgttggtcttagcgcaaatgattccagaatttagcaagatttcgattagccttgccgccttgtttgctacaatttctgttcttgtgattaccaatagtcaccctaagagtctgttatcagaaaataatcgaatgactcagcaagtatcaacaagtggtattgttcctcaattattaggggctttgggggctatttttactgtagcaggtgttggtgatgttatctctcatctgattagcggtattgttccttcagatagtcgctttataggagttttggcctatgttcttggaatggttctattcacaatgattatgggaaatgcttttgcagcattcaccgttattacagcaggtgttggagttccctttgtatttgctctgggagctaatccaattgtggctggtgctcttgccatgacagcaggttattgtgggaccttattgaccccaatggctgctaattttaacgctctaccagcagcattgatggatatgaaagatcagaatggcgttataaaggctcaagcaggtgttgctctagtaatgattgttattcacatattcttaatgtactttctcgcattttag

SEQ ID NO: 363 - DNA (genomic), 1047 bp, Streptococcus pneumoniae; double-stranded, circular
  misc_feature (B) LOCATION 1...1047
  hypothetical: NO
  anti-sense: NO
atcttaggaacacaagagggcaaagatatgaatattacttatatagttggaaatggtttggatttgcaatatggtttgaaaacaagatatagggatttctacgaattccaaaataaggtttatataagtaggacagagaacgaggaaaaatattcaaatttcatttatgagtctctattttctgataaagtaaatgattatgaaaattggtcagattttgaattgtcaattggtaaattaacaaaagataacgacctcatctcctcaagtatagaaataaaggagaaatttatagatgattttagtgaagtagttgatgatttaagagaatatctacgcatacaacaagaaaaaaatcttgagaaaggtaatgcaattgactttataagcactctagataatatgaggacctctctccctgtaattaatcaacctgctatcgataaaaaatataatgaaaatctatatcaacacgatatcgtgaatatattaactcttaattacacaaatgtaatcgataaattatataatgagtcagcaaaatcatttagcaatcaattacgaactaataattataaatttcacattgcgcctccaattcatgcacatggaacggtagatatttgcacagttttaggagttagtgacgagacacagatttcaaatagttttgatgaagaacaaaaagaatccttaataaaaaatttagttttgaagaactatagagaaaatatggatgttaaaaatagcgatattataaaaaattctgacatcataattctttatggggtttctttgggagagactgatgggtatatctggaatcagattgctgaacaatcaatcagaagttctgttcctgtcataatttaccattatgtacctcattttgatgcaggaaaccccactagagtaaaacgcttatatagaaatgtagaagacaaattcatacaaaatagtggaattgatttagagttagagaagaaattaagagataaccttattgttgttattggaaagactatttttaatctgatggaaaggtaa

SEQ ID NO: 364 - DNA (genomic), 783 bp, Streptococcus pneumoniae; double-stranded, circular
  misc_feature (B) LOCATION 1...783
  hypothetical: NO
  anti-sense: NO
gaaggaggaacaaaactaatggcattacttgaagtaaaacagttaaccaaacattttggtggtctaacagctgttggagatgtgactcttgaattgaacgaaggggaactggttggattaatcggtccaaacggagctgggaaaaccacccttttcaaccttttgaccggtgtttatgaaccaagtgagggaacagtaactctagatggtcaccttttgaatgggaaatcaccttataagattgcctctttgggacttggacgtactttccaaaatatccgtctctttaaagatttaacagttttagacaatgttttgattgcttttggaaaccatcacaaacagcatgtttttactagtttcttacgcttaccagctttttacaagagtgaaaaagaattaaaggctaaagctttggaattgttgaaaatctttgatttagatggtgatgcagagactcttgctaaaaatctttcctacggacaacaacgtcgtttggaaattgttcgtgcccttgctacggaacctaaaattctcttcttagatgaaccagcagcaggtatgaacccacaggaaacagccgaattgactgagttaattcgtcgtatcaaagatgaatttaagattacaatcatgttgattgaacacgatatgaatctggtcatggaagtaacagaacgtatctacgtacttgaatatggccgtttaattgctcaaggaactccagacgaaattaagaccaataaacgcgttatcgaagcttatctaggaggtgaagcctaa

SEQ ID NO: 365 - DNA (genomic), 792 bp, Streptococcus pneumoniae; double-stranded, circular
  misc_feature (B) LOCATION 1...792
  hypothetical: NO
  anti-sense: NO
agaggaggaactcttatggaaatatctaaaggaattatttttaatattcaacacttttcaattcatgacggcccgggtattcgtacaactgtttttttaaaaggatgtcctctgcgctgtccatggtgttctaatcctgaatctcaaagaatgaaacctgaaaaaatgaaagatgctcaacgagagaaattcaccttagtcggtgaagaaaagactgtagaagaaattattacagaggtattaaaagacaaagaattttacgaagaatccggtggaggtttaactttatcaggaggtgaaatatttgctcagtttgaatttgctaaagccatcttaaaatcagctaaagaacatcacatacacactgccattgaaactactgcctttgttgatcatgaaaaatttattgatttaattcaatatgtggattttatctacacagacctaaaacattataattctataaaacataaaaaagtgactggggtttttaatcaaatgattattaaaaacattcattatgctttttctcaaaataaaactatcgttttaagaatcccagttattcctaattttaacaatagtttagaggatgcagaaaaattcgctactctatttaactcattaaatatcgaccaagttcaactactcccttttcatcaatttggtgaaaacaaatatcgtttattaaatcggaaatatgaaatggatggaatcaacgcacttcatcctgaagatcttattgattatcaaaaggtatttctgaaccaccatattaattgttatttctag

SEQ ID NO: 366 - DNA (genomic), 828 bp, Streptococcus pneumoniae; double-stranded, circular
  misc_feature (B) LOCATION 1...828
  hypothetical: NO
  anti-sense: NO
gctgttgnaactangctgaaaaggacatatgaagaaaaactgaaaattttgctccttccaaaggatccaaacgatgacaagaatatcatccttgaaatccgtggagcagctggtggagacgaagcggcacttttcgctggagatttgctaactatgtaccaaaagtatgcggaagcccaaggttggcgctttgaagtcatggaagcctctatgaatggtgtcggtggttttaaagaagtggttgctatggtttcaggtcagtctgtatactctaagcttaagtatgaatcaggtgcccaccgtgtgcaacgtgttcctgtgacagaaagccaaggccgtgttcatacttcgacagcgacagttcttgttatgccagaagttgaagaggttgaatacgacattgatccaaaagaccttcgtgtcgacatctatcacgcctctggtgctggtggacagaacgtcaataaggttgcgactgccgttcgtatcgttcacttgccaaccaatatcaaggttgagatgcaggaagaacgtacccagcagaagaaccgcgagaaggctatgaagattatccgtgcacgcgtcgctgaccactttgctcagattgctcaggatgaacaagacgctgagcgtaagtcgacaatcggtactggtgaccgttcagaacggatccgaacttataacttcccacaaaaccgtgtcacagaccaccgtatcggcttgaccctccaaaaactagatacgattttgtctggtaaattggacgaagttgtggatgccttggtgctttatgaccaaacacaaaaactagaagaattaaacaaataa

SEQ ID NO: 367 - DNA (genomic), 453 bp, Streptococcus pneumoniae; double-stranded, circular
  misc_feature (B) LOCATION 1...453
  hypothetical: NO
  anti-sense: NO
cgagttttgaccacgtatctctatgatatcgagtcttggacctggtttgaactctatctcttttgcaataccatgcccttcttgagccatcaagatctgatttttttatcaacctccttactcgaaaaatccaaagaatttaaagagttagtacacaatcgattgtatatgaagcaaggactcttaaatatcttatcagaactcatggagcgaaaacttttctcctacatcccaatcttcgaagccgagttggagaggatgttacgaccgtatgatgtttttgaaaaagtatcgtggcaatttttaaagaagatgagtgtctttcttcaaacaaagggaagcaatcaaaaagagattgaacgctttatccaatctctgcaggtattagaaaatccacaattaacatccctttttgaattgcgttttcagcaatataaagaacttatagattag

SEQ ID NO: 368 - DNA (genomic), 744 bp, Streptococcus pneumoniae; double-stranded, circular
  misc_feature (B) LOCATION 1...744
  hypothetical: NO
  anti-sense: NO
atatctttgactttcttttgggaggaacttggaatccttctagtaaagaatttgggtgcccttcctatgattttgggttcctttatcgttaccattctctcagcccttatcgcaacaccctttgctattggtgcagcagtttttatgaccgaagtatcaccaaaaggggcgaagattttgcaaccagctattgaactcctggttgggattccttcagtagtgtatggatttattggcttgcaagtcgtcgttccctttgttcgcagtgtctttggtgggactggttttgggattttgtcagggatttccgtcctctttgtcatgattttgccgaccgtaacctttatgacaacggatagcttgcgtgcggttcctcgttattatcgtgaagccagtttcgctatgggagccactcgctggcagactatctggcgtgtgatcttgaaggcggcccgttctggtattttcactgcagtggtctttgggatggcgcgtgcctttggtgaggctttagctatccagatggttgtcggaaactcagctgttatcccaacttccttgaccacaccagctgcaactttaacttctatattaactatgggaattgggaacactgtcatgggaactgtaaataataatgttctctggtcactggccttggtactgctcttgatgagtttagtttttaacagtgtgattaaattgattacgaaagaaagaggaaagaaaaattatgcgcgctaa

SEQ ID NO: 369 - DNA (genomic), 462 bp, Streptococcus pneumoniae; double-stranded, circular
  misc_feature (B) LOCATION 1...462
  hypothetical: NO
  anti-sense: NO
attaatttgactttcctgatagagttgttcacatcttatttcaattcactatactttcccttatactcaatgaaaatcaaagcgcaaactaggaagctagccacaggttgctcaaagcactgctttgaggttgtagataagactgacgaagtcagctcaaaatactgttttgaggttgcagataagactgacgaagtcagctcaaaatactgttttgaggttgcagataagactgacgaagtcagctcaaaatactgttttgaggttgcagataagactgacgaagtcagctcaaaatactgttttgaggttgcagataagactgacgaagtcagctcaaaatactgttttgaggttgcagataagactgacgaagtcagctcaaaatactgttttgaagttgcagataagactgacgaagtcagctcaaaatactgttttgaggttgcagatggaagctga

SEQ ID NO: 370 - DNA (genomic), 258 bp, Streptococcus pneumoniae; double-stranded, circular
  misc_feature (B) LOCATION 1...258
  hypothetical: NO
  anti-sense: NO
attaatttgactttcctgatagagttgttcacatcttatttcaaatcactatattttaagaaggtacttgcaatgacaggtacagaaacatttacagttatttcaactgaggacttggagcaaacttcaggtggtcttgctgtttgggaagatggatatagtagatggttatattatagagaatttgctccttatatgaggcaaggggcacttaattcttatatagatgcttggaagtacggcttccgaacagggtaa

SEQ ID NO: 371 - DNA (genomic), 294 bp, Streptococcus pneumoniae; double-stranded, circular
  misc_feature (B) LOCATION 1...294
  hypothetical: NO
  anti-sense: NO
gggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtag

SEQ ID NO: 372 - DNA (genomic), 294 bp, Streptococcus pneumoniae; double-stranded, circular; identical to SEQ ID NO: 371
  misc_feature (B) LOCATION 1...294
  hypothetical: NO
  anti-sense: NO

SEQ ID NO: 373 - DNA (genomic), 294 bp, Streptococcus pneumoniae; double-stranded, circular; identical to SEQ ID NO: 371
  misc_feature (B) LOCATION 1...294
  hypothetical: NO
  anti-sense: NO

SEQ ID NO: 374 - DNA (genomic), 294 bp, Streptococcus pneumoniae; double-stranded, circular; identical to SEQ ID NO: 371
  misc_feature (B) LOCATION 1...294
  hypothetical: NO
  anti-sense: NO

SEQ ID NO: 375 - DNA (genomic), 237 bp, Streptococcus pneumoniae; double-stranded, circular
  misc_feature (B) LOCATION 1...237
  hypothetical: NO
  anti-sense: NO
gcttcattgacatgtagcccctcacttgacagcatatacatatgcagggctagagaacgacctgaagacatgagactacttggcgtattggtagaggtacctaatgtatacatgagggcagctgtttcaccaacgatacggccaatagctagtatcactccagctaaaatacctggcatggcaactggtagaacaattctaaaaacagtccgtaacttacctgccccaagtccataa

SEQ ID NO: 376 - DNA (genomic), 738 bp, Streptococcus pneumoniae; double-stranded, circular
  misc_feature (B) LOCATION 1...738
  hypothetical: NO
  anti-sense: NO
aaaatgttgacaaatagtataataaaaacaaaggagaacagcatgctgaaatgggaagacttgcctgtggaaatgaaatcaagcgaggttgagtcttactaccagcttgtctctaaaaggaagggttcgctgattttcaagcgttgcttggactgggttttggccttggtgcttacatgggttctaacttctcccatctttctcatcttgagcatttggatcaagttggatagcaaggggccagtgatttacaagcaagagcgtgtgacccagtacaaccgtcggttcaagatttggaagttccgtaccatggtgacggatgcggataaaaaaggaagtctggtgacttctgctaacgatagccgtattaccaaggttggaaatttcatccgacgtgtccgtttggacgaactgcctcagttggtcaatgtccttaaaggtgagatgtcctttgtcggtacacgacctgaagtgccacgttatacagagcagtatagccctgaaatgatggcaaccttgctcttgcaagcaggaattacctctccagccagcatcaactacaaggatgaggacaccatcatcagtcaaatgacggagaaaggtctgtcagttgatcaggcctatgtggagcatgttcttcctgaaaagatgcgctataacctcgcctatctccgagagtttagtttctttggggacatcaaaatcatgtttcaaaccgtgtttgaggtactaaaataa

SEQ ID NO: 377 - DNA (genomic), 186 bp, Streptococcus pneumoniae; double-stranded, circular
  misc_feature (B) LOCATION 1...186
  hypothetical: NO
  anti-sense: NO
atgttactgacttcgtcagttctatctgcaacctcaaaacagtgttttgagctgacttcgtcagttctatccacaacctcaaaacagtgttttgagcaacctgtgactagctttctaagcgatgccttggttctcattgcctataatcaaaaagagaaattttctcctgaaaagcatatagagtag

SEQ ID NO: 378 - DNA (genomic), 1002 bp, Streptococcus pneumoniae; double-stranded, circular
  misc_feature (B) LOCATION 1...1002
  hypothetical: NO
  anti-sense: NO
aataaactgactagaaaaaacaaaggagaaactatgtctcaactctatgatattaccattgtgggtggtggtcctgtcgggctttttgcagccttttatgcccacctacgccaagccaaggttcaaatcatcgactctcttccccagctaggtggacaacctgctattctctaccctgaaaaggaaatcctagacgtaccaggcttcccaaacctgactggagaagagttgactaaccgcttgattgaacagctaaatggatttgatacccctattcatctcaatgaaacggttcttgagattgacaaacaagaagaagaatttgccatcacaacttctaaaggaagtcacctgactaaaacagtcatcatcgctatgggtggcggtgccttcaaaccacgtccgctggaacttgaaggtgttgagggctatgaaaatatccactaccacgtttctaacattcagcaatacgctggtaagaaagtgacgattcttggtgggggagactcggctgtggattgggctttggcttttgaaaaaatcgcaccaactacccttgttcaccgcagagataatttccgtgccttggaacacagtgttcaagccttgcaagaatcatctgtaaccatcaagacaccattcgcccctagccaactccttggaaatggaaaaacacttgataaacttgaaatcacaaaagtcaaatctgatgaaactgaaaccattgacctagaccacctctttgtcaactatggtttcaaatcttctgtcggtaaccttaaaaactgggggctcgacctcaaccgtcacaagattatcgtcaacagcaaacaggaatccagccaagcaggtatctatgctatcggtgactgctgctactatgacggaaaaattgatctgattgcgacaggcctcggagaagctccaactgctgtcaacaacgctatcaactacattgaccctgaacaaaaagtacaaccaaaacactctactagtttataa

SEQ ID NO: 379 - DNA (genomic), 270 bp, Streptococcus pneumoniae; double-stranded, circular
  misc_feature (B) LOCATION 1...270
  hypothetical: NO
  anti-sense: NO
aatgaactgaccccaaaagttagacagaaaaaatctaacttttggggtgtttttattatgaaactaacttatgatgataaagttcagatctatgaacttagaaaacaaggatatagcttagagaagctttcaaataaatttgggataaacaattctaatcttaggtacatgattaaattgattgatcgttacggaatagagttcggcaaaaaaggaaaaaatcgttactattctcctgatttaaaacaagaaatgatttataaagtctga

SEQ ID NO: 380 - DNA (genomic), 294 bp, Streptococcus pneumoniae; double-stranded, circular
  misc_feature (B) LOCATION 1...294
  hypothetical: NO
  anti-sense: NO
atagaactgacgaagtcagctcaaagcactgctttgaggttgcagatgaaactgacgaagtcagctcaaaacatgtttttgaggttgtggatgaaactgacgaagtcagctcaaaacatgtttttgaggttgtggatgaaactgacgaagtcagctcaaaacatgtttttgaggttgtggatgaaactgacgaagtcagtaaccatacatacggtaaggcgacgtgacgtggtttgcagagattttcgaagagtattagccttccatatagtctttcaaagcctgtcctgttag

SEQ ID NO: 381 - DNA (genomic), 384 bp, Streptococcus pneumoniae; double-stranded, circular
  misc_feature (B) LOCATION 1...384
  hypothetical: NO
  anti-sense: NO
ataagactgacgaagtcagctcaaaatactgttttgaggttgcagataagactgacgaagtcagctcaaaatactgttttgaggttgcagataagactgacgaagtcagctcaaaatactgttttgaggttgcagataagactgacgaagtcagctcaaaatactgttttgaggttgcagataagactgacgaagtcagctcaaaatactgttttgaggttgcagataagactgacgaagtcagctcaaaatactgttttgaagttgcagataagactgacgaagtcagctcaaaatactgttttgaggttgcagatggaagctgacgtagtttgcagagattttcgaagagtattatatgagaaaaatcctctactctactaa

SEQ ID NO: 382 - DNA (genomic), 411 bp, Streptococcus pneumoniae; double-stranded, circular
  misc_feature (B) LOCATION 1...411
  hypothetical: NO
  anti-sense: NO
ttccttatgactaaatcattaattttggtgagccatggtcgcttctgtgaggagcttagaggtagcacagaaatgattatgggcctacaagacaacatttacacagtagctcttcttccagaagatggcccagaagaatttactgctaaatttgaagctgttattgaaggattggatgatttcctagtttttgcggatcttctcggtgggacaccttgtaatgtggtgagtcgcttgatcatggaaggtcgtgatattgacctttacgcagggatgaatcttccaatggtgattgaatttatcaatgcgagccttacaggcgcagatgcggactacaagagccgtgctgcagaaagcattgtgaaagttaatgacctgttagcgggcttcgatgatgacgaagatgaataa

SEQ ID NO: 383 - DNA (genomic), 456 bp, Streptococcus pneumoniae; double-stranded, circular
  misc_feature (B) LOCATION 1...456
  hypothetical: NO
  anti-sense: NO
actaatatgacactaacaacctttttattacaagcagtagcaagttttcttgccattatcacttttttaatcgtactcaatgtgcaacggtctatgctcttacctggagggattttgggcatgactgtctggctaatctatctcttgctcaaggaaccgaccaatgtcattgtagctaccttcattgcagccattattggttcttgtgtcagccagattttaagtattctttataagacacctgctgtggtctttatcttggccattttggcaccgctggttccaggttatctctcctaccgaacaactgccttttttgtgacaggggactataataaagcactggcaagtgggctcttggttgtcatgttggctctggtaatctctattggaatggctagcggatcagtgattctcagactctatcattatataaaaacacatcgagtatcgtag

SEQ ID NO: 384 - DNA (genomic), 2751 bp, Streptococcus pneumoniae; double-stranded, circular
  misc_feature (B) LOCATION 1...2751
  hypothetical: NO
  anti-sense: NO
aaagatatgacagaaagagagtctgttttgcacacaatgtcaaggaggagacacatgtcaaaagaacaaaaacgccaagcgttttatactcagagccctgaagaggtcttgcaggctgtggatgcgaccgagcaaggtttgtcatcaagtgaggcggaaaagcgccttgccgaatttgggcacaatgaactcgaagaaggcgagaaacgatcaatcttggtcaaattcatcgagcaatttaaggatttgatgattatcatcctagttgcggcagcaatcttgtcagtcgtgacttctggtggggaagatatcgcagatgccattatcatcctagctgtggttatcatcaacgctgcctttggtgtttaccaagaaggaaaagctgaagaagctattgaagccctcaaatccatgtctagtccagttgcccgcgttcttcgtgatggacacatggcagagattgactctaaagaattggtaccaggcgatatcgttgcccttgaagcaggtgacgtggtaccagcggacctacgtttgctagaagccaactctcttaaaattgaagaagcagccttgacgggtgaatctgtaccagtcgaaaaagacttgtcagtcgagcttgcgacagatgctggtattggtgaccgtgtcaacatggccttccaaaactcaaacgtaacctatggtcgtgggatgggtgttgttgtcaatacaggtatgtacactgaagttggtcatattgctggtatgcttcaagatgcggatgagactgatacaccactcaaacaaaacttgaacaacctttctaaggtcttgacctatgctatcttggtcattgcccttgttacttttgtagtgggtgtcttcattcaagggaaaaatccacttggtgagttgttgacttctgttgcccttgctgttgcagccattccagaaggacttcctgctatcgttaccatcgttctttctcttggtactcaagttttggccaaacgacattccatcgttcgtaagttgccagcagttgaaacacttggttcaactgaaatcatcgcttctgataagactggtacgctgactatgaacaagatgacagtcgaaaaagtcttctacgatgcggttctacatgactcagctgatgatattgaactaggtcttgaaatgccactacttcgttcagttgtcttggccaatgatacgaaaatcgatgtggaaggtaacttgattggtgacccaaccgaaacagcctttatccaatatgccttggacaagggctatgatgtcaaaggtttcttagagaaatatcctcgtgtagctgaattgccatttgactctgaccgtaagctcatgtcaacagttcacccattgccagatggtcgtttccttgtagcagtcaagggtgcgccagaccaactcttaaaacgttgtcttcttcgtgataaggctggggatattgctccgattgatgagaaggttacaaatctcattcatacaaacaattctgaaatggctcatcaagccttgcgtgtccttgcaggtgcttataagattatcgatagtattccagaaaatctcacttctgaagagcttgaaaatgatttaatttttactggtttgattgggatgattgatcctgaacgtcctgaagctgctgaggctgttcgtgtggctaaggaagctggaattcgtccaattatgattacaggtgaccaccaagacaccgcagaagctattgccaaacgtttgggaatcattgacgcaaacgatacagaagaccacgttttaactggtgctgagctcaacgaattatctgatgaagactttgaaaaagttgttggtcaatactctgtttatgcccgtgtgtctccagagcacaaggttcgtatcgtcaaggcttggcaaaaacaaggtaaggtcgttgccatgacaggtgacggtgtcaatgatgccccagctctgaaaacagcagacatcggtatcggtatgggaatcactggtacagaggtttctaagggggcttctgatatgattcttgcagatgataactttgcgactattatcgtcgcagtggaagaaggacgtaaggtcttctcaaatattcaaaagactattcagtacctactttctgccaatactgctgaagtattaaccatcttcctatcaaccttgtttggttgggacgtcttgcagccagttcatcttttgtggattaacttggtaacggataccttcccagcaattgcactaggtgttgaacctgcggaacctggtgtcatgaatcataaaccacgtggacgcaaggcaagcttcttctcaggtggtgttttgagttctatcatttatcaaggtgtactccaagcagctcttgttatgagtgtttatggccttgcgattgcttacccagttcatgtgggtgacaatcatgctattcatgcagatgccctaacgatggcctttgcaacccttggtttgattcagctcttccatgcctacaatgtcaagtctgtctaccaatccatcttgacagttggcccattcaagtctaagacctttaactggtccatcttggtatcctttatccttctcatggcaacaatcgttgtagaaccgcttgaaggaatcttccacgtaaccaaactagacttgtcacaatggggaattgttatggctggaagcttctcaatgattatcatcgtcgaaatcgttaagtttattcaacgcaaactcggttttgacaagaatgcgatttaa

SEQ ID NO: 385 - DNA (genomic), 705 bp, Streptococcus pneumoniae; double-stranded, circular
  misc_feature (B) LOCATION 1...705
  hypothetical: NO
  anti-sense: NO
aagtgcatgactaaacgtgtactcattacaggagtgagttcaggtattggattggctcaggctcgcctctttttagagaagggctatcaagtttatggagttgaccaaggtgaaaagccactcttagagggtgattttcactttttacagagagatttgaccttggacttggaacctatttttgactggtgccctcaggtggatgttttgtgtaatactgccggagttttggatgattacaaaccactgttggaacaaacggcgcaggacattcaagagatttttgaaatcaactacattattccagtagagttgactcggtattatttgacacaaatgctggaaaataaaaagggaatcatcatcaatatgtgttccattgcttctagcctagcaggtggaggtggtcacgcctatacttcatccaagcatgccttggctggcttcaccaagcagttggctctagactatgctgaagctgggattcaggtctttggtatcgctccaggagcagtcaagacagctatgaccgctgcggattttgaaccaggtggtttagctgactgggtggctagtgaaacaccaatcaagcgctggattgaaccagaggaaatagcagagcttagtctttttttagcaagtggaaaagcgagcgccatgcaaggacaaatcttgacaatagatggtggctggtctttgaagtag

SEQ ID NO: 386 - DNA (genomic), 534 bp, Streptococcus pneumoniae; double-stranded, circular
  misc_feature (B) LOCATION 1...534
  hypothetical: NO
  anti-sense: NO
gaaataatgacagaaaccttgataaaaattgaaaatttacataaatcttttggaaagaatgaagtattgaagggcatcaacctcgagattaaaagaggagaagttgtcgttatcatcggtccttcagggagtgggaaatctaccttgcttcgctctatgaatttgttggaggaagcaaccaaggggaagcttatctttgagggagtcgatattacggacaagaagaatgacctgtttgccatgcgtgagaagatgggcatggttttccaacaatttaacctctttcctaatatgactgtgatggaaaatattaccttgtcacctatcaagactaaaggtgaaagcagggaagttgctgagaagagagcccaagagcttttggaaaaagttggtttgccagataaggcagacgcttatccacagagtctgtcgggtgggcaacaacaacggattgcatcgcgcgtgggttggctatggtaccagatgttttgctctttgacgaaccaacttcagccttggatcctgaaatggtag

SEQ ID NO: 387 - DNA (genomic), 1491 bp, Streptococcus pneumoniae; double-stranded, circular
  misc_feature (B) LOCATION 1...1491
  hypothetical: NO
  anti-sense: NO
agagtaatgacattagtttatcaatcaacgcgtgatgccaacaatacagtaactgccagccaagcaattttgcaaggtttggcgacggacggcggtttgtttacaccggatacttatccaaaggtagatttgaactttgacaaattgaaagatgcttcttaccaggaagttgctaagctagttttgtcagcatttttagatgactttacagttgaggagttggactactgtatcaacaatgcctacgatagcaaatttgatactccagctattgcaccattagtgaaattagatgggcaatacaatttggaacttttccatggttcaacgattgcctttaaggatatggccttgtctattttgccatactttatgacgactgctgctaagaaacatggtttggagaacaagattgttatcttgacagcgacatctggtgacacggggaaagctgctatggcggggtttgcgaatgtgcctggtactgagattatcgtcttttatccaaaggatggtgtcagcaagattcaagagttacaaatgaccactcagactggcgacaatactcatgttattgctattgatggtaactttgacgatgcgcaaacaaatgtgaagcacatgtttaacgacgtggctcttcgtgaaaaattgactaccaacaagttgcaattttcatcagctaactctatgaacattggtcgtctggtgccacaaattgtttattatgtttatgcttacgctcaattggttaagactggtgaaattgtagctggtgaaaaggttaacttcacagtaccaacaggaaactttggaaatatcttggctgccttttatgccaaacaaattggtttgccagttggtaaattaatctgtgcttcaaatgacaacaatgttttgacagacttctttaaaacacgtgtctatgacaaaaaacgtgagtttaaggtaacaaccagcccatctatggatatcttggtatcttcaaacttggagcgcttgattttccatcttttgggaaataatgctgaaaagacaactgaacttatgaatgccttgaacacgcaaggacaatataagttgacagactttgatgcagagattttggacctctttgcagctgaatatgcgactgaggaagaaacggcagcagagatcaagcgtgtttgtgagttagattcttatatcgaggaccctcatacagctgttgcttcagcagtttataaaaaataccaatcggccactggagatgtaactaagacagtgattgcttcaacagctagtccatacaagttcccagtagttgcagtagaagctgtaactggaaaagcaggtttaacagactttgaagccttggctcaattacatgaaatctcaggcgttgcagtgccaccagcagttgatgggcttgaaatagctccaattcgtcacaagacaacagtggcagctgctgacatgcaagcagcggttgaggcttatttaggactttaa

SEQ ID NO: 388 - DNA (genomic), 303 bp, Streptococcus pneumoniae; double-stranded, circular
  misc_feature (B) LOCATION 1...303
  hypothetical: NO
  anti-sense: NO
ttggaaatgacaaccatccgatcacttcttcttaatttcatttctatttcctattccatttttattcaaaaaatcaaaaagcaaactagaaagctggtcgctggtggttcaaaacactgttttgagattgtcgatagaactgacaaaccctgtaatatacctgcatatatacatacgacaaggcgatactaccctagtttgaagagattttcgaagagtattcatttttgtcttttacttattataccatattcacataaaaaaacgaacattcttatcctaaaaaatgctcatttttcttaa

SEQ ID NO: 389 - DNA (genomic), 822 bp, Streptococcus pneumoniae; double-stranded, circular
  misc_feature (B) LOCATION 1...822
  hypothetical: NO
  anti-sense: NO
aaatttgtgaccagtttttatcctatctacgctatggttaaggaagtatctggtgacttgaatgatgttcggatgattcagtcaagtagtggtattcactcctttgaaccttcggcaaatgatatcgcagccatctatgatgcagatgtctttgtttaccattctcatacactcgaatcttgggcaggaagtctggatccaaatctaaaaaaatccaaagtgaaggtcttagaggcttctgagggaatgaccttggaacgtgtccctggactagaggatgtggaagcaggggatggagttgatgaaaaaacgctctatgaccctcacacatggctagatcctgaaaaagctggagaagatacccaaattatcgctgataaactttcagaggtggatagtgagcataaagagacttatcaaaaaaatgcgcaagcctttatcaaaaaagctcaggaattgactaagaaattccaaccaaaatttgaaaaagcgactcagaaaacatntgtaacacaacatacagccttttcttatctagcgaagagatttgggcttaatcaacttggtattgcaggcatctctcctgaacaagaaccaagtccacgacaattaacagaaattcaggaatttgttaaaacctataaggttaaaacgatttttacagaaagtaatgcttcttcaaaagtagctgaaactcttgtcaaatcaacaggtgtgggtcttaaaactctgaatcctttagaggcagacccacaaaatgacaagacctatttagaaaatctggaagaaaatatgagtgttctagcagaagaattaaagtga

SEQ ID NO: 390 - DNA (genomic), 963 bp, Streptococcus pneumoniae; double-stranded, circular
  misc_feature (B) LOCATION 1...963
  hypothetical: NO
  anti-sense: NO
ctcgaatcgactaataaagaaaaattggtagatgatttattggcattcctagcaccaattacccatccagagcgacttggcaagccaaattctcaaattgagtatactgaagacgaagttcgtattgctcaattagctgataagtatacaacgtcagatggttacatttttgatgaacatgatataatcagtgatgaaggagatgcatatgtaacgcctcatatgggccatagtcactggattggaaaagacagcctttctgataaggaaaaagttgcagctcaagcctatactaaagaaaaaggtatcctacctccatctccagacgcagatgttaaagcaaatccaactggagatagtgcagcagctatttacaatcgtgtgaaaggggaaaaacgaattccactcgttcgacttccatatatggttgagcatacagttgaggttaaaaacggtaatttgattattcctcataaggatcattaccataatattaaatttgcttggtttgatgatcacacatacaaagctccaaatggctataccttggaagatttgtttgcgacgattaagtactacgtagaacaccctgacgaacgtccacattctaatgatggatggggcaatgccagtgagcatgtgttaggcaagaaagaccacagtgaagatccaaataagaacttcagagcggatgaagagccagtagaggaaacacctgctgagccagaagtccctcaagtagagactgaaaaagtagaagcccaactcaaagaagcagaagttttgcttgcgaaagtaacggattctagtctgaaagccaatgcaacagaaactctagctggtttacgaaataatttgactcttcaaattatggataacaatagtatcatggcagaagcagaaaaattacttgcgttgttaaaaggaagtaatccttcatctgtaagtaaggaaaaaataaac

SEQ ID NO: 391 - DNA (genomic), 747 bp, Streptococcus pneumoniae; double-stranded, circular
  misc_feature (B) LOCATION 1...747
  hypothetical: NO
  anti-sense: NO
ctgcagtcgactcaagtcgatgcccatggttatatgggacgtggctgggactgggccgacatgctgggcttcaccgtagctggttacggtgttgtttccatggatgtgcggggccagtcaggttactcacaagacggcttgcgttctcctttaggaaataccgtgaaggggcatattatccgtggtgctatggaaggtcgggaccacctcttttataaggatgtttatctggatatttaccagttggtcgaaattgttgctagtctgtctcaggttgatgagaagcgtctttctagctatggtgcctcacaaggaggggctctagctctagttgcagcagcgctcaatcctcgaattcagaaaacagttgccatttatcccttcttgtcagacttcagacgggtgattgagattggtaatactagcgaggcttacgacgaacttttccgttatttcaagtttcacgaccccttccatgaaacagaggaggaaatcatggcgacccttgcctatatcgatgtcaaaaatcttgcccatcgtatccaaggtgaggttaagatgattacgggcttggacgacgatgtttgctatcccattacccagtttgcgatttataatcgtctgacctgcgataaaacctatcgcatcatgcctgagtatgctcacgaagccatgaatgtatttgtcaatgaccaagtctacaactggctctgtggaagtgagattccttttaaatatctaaaataa

SEQ ID NO: 392 - DNA (genomic), 210 bp, Streptococcus pneumoniae; double-stranded, circular
  misc_feature (B) LOCATION 1...210
  hypothetical: NO
  anti-sense: NO
aaaaacacgacttcaccctttttggtaaataccgtatcgtgcttggtagtgttttgctactttacagttttgtccgtttatttgtataagaaaaaccttgaaggggtaactcttcaaggttttatactcttagaaaatctcttcaaaccgcgtcagctttatctgcaacctcaaaacagtgttttgagcagcctgcggctagcttcctag

SEQ ID NO: 393 - DNA (genomic), 1566 bp, Streptococcus pneumoniae; double-stranded, circular
  misc_feature (B) LOCATION 1...1566
  hypothetical: NO
  anti-sense: NO
atcgcaacgacctggtatatctatttaccgccccttaacctgaccagctgggaatttctcttcttcctctgtgggcatttgttagttgtggcaatcttatttggctttggcaaggggataaaccttgtcaaaacggttcatgtgcgccacggtaaggcggaagctgccttaaatcttgagggtttcaaaatcaatcggttagggaaaattctgttagcttcgattggaggaattcttctcttggcagctttggtttccttggtaacttccagcatgtttcaggctaaaaattatgccaatgtagtcacggttacggaaaaagactttactgaatttcctaggagtgacaccagtaaggttcctatcctagatagaagtactgctgaaaaaattggagaccgctacttgggttccctaaccgataaggtgtcgcaatacgtagcggcagatacctatacccaattgacaattgatgggaaaccttatcgggtcacaccactagaatatgcagaccctatcaaatggtttaacaatcaagccaagggaatcggtgaatatatcaaggtggacatggtaactggaaatgcggatttggtggacttgaagacaccaatcaagtattcagactcggagtattttaaccgtgatgtcaaacgtcacctgcgcttgaagtacccgaccaaaatctttaaaactccatcttttgaggtggacgatgagggcaatcctttctatgtagcaacggtttaccaaaagcaatttggacttgctgttcctcgtcctgcttcagtcattatcttggatgctacaaatggagaaaccaaggaatacagcttatcagatgttccagaatgggtggacaggatctatccagcagaggaaaccattgagcaaatcaactacaacggcaagtacaaggacggtttcttgaatgccatgatttccaagaaaaacgtgacccagactaccaagggctataattacttgtctatcggtaatgacatctatctctacacaggtgtgacgtcggctaatgcggatgagagtaatcttggtttcatccttgaaaatatgcgaacaggagaaatcactaagtatagcttggcttctgcgacagaagaatcagcccgtgaatcagcagaaggtgctgttcaggagaaatcctacaaagcaaccttcccaatcctcatcaacctcaatgacaagcctctctacatcatgggcttgaaggacaatgctggcttggtcaaagagtacgccctggtagacgcagtcgagtaccaaaatgttatcgttgctactacagtggaagagatgctcagcaagtatgccaataaaaacgaccttgaaattgacaatgcaacgacagaaagcatcaatggagtagtagcagacctcaaatcagctgttatcaagggagacactgtctacttctttaaagttgatggcaagatatacaaggtcaaggcttcagtatccgatgactatccttaccttgaaaatggtaaaaccttcgaaggtcaagtaggaaaagacaattatctcaagacctttaagctacggtaa

SEQ ID NO: 394 - DNA (genomic), 1014 bp, Streptococcus pneumoniae; double-stranded, circular
  misc_feature (B) LOCATION 1...1014
  hypothetical: NO
  anti-sense: NO
gacatgacgacaaatcgtaaggacgagcatatcctctatgcccttgagcagaaaagttcctataatagctttgatgaggtggagctgattcattcttccttgcctctttacaatctggatgaaatcgatctttcgacagagtttgctggtcgaaagtgggactttcctttttatattaatgccatgactggtggaagtaataagggaagagaaatcaatcaaaagctggctcaggtggcggaatcctgtggtattttatttgtaacgggttcttatagcgcagccctcaaaaatccaacggatgattctttttctgtcaagtctagtcatcccaatctcctccttggaaccaatattggattggacaagcctgtcgagttaggacttcagactgtagaagagatgaatcctgttctattgcaagtgcatgtcaatgtcatgcaggaattactcatgcccgagggagaaaggaagtttagaagctggcaatcgcatttagcagattatatcaagcaaattcccgttcctattgtcctcaaggaagtgggctttggaatggatgccaagacaatcgaaagagcctatgaattcggtgttcgtacagtggacctatcgggtcgtggtggcaccagctttgcctatatcgaaaaccgtcgtagtggccagcgtgattacctcaatcaatggggtcagtctaccatgcaggcccttctcaatgcccaagaatggaaagataaggtcgaactcttggttagtggaggggttcggaatccgctggatatgattaagtgcttggtttttggtgctaaggctgtgggattgtcacgaaccgttctggaattggttgaaacctacacagttgaagaagtgattggcattgtccaaggctggaaagcagatctacgcttgattatgtgttcccttaactgtgccaccatagcagatctacaaaaagtagactatcttctttatggaaaattaaaagaagcaaaggatcagatgaaaaaggcgtaa

SEQ ID NO: 395 - DNA (genomic), 606 bp, Streptococcus pneumoniae; double-stranded, circular
  misc_feature (B) LOCATION 1...606
  hypothetical: NO
  anti-sense: NO
gcctttgcgaccaagccaaaacagttcatctttatggcaaaaaaagaactctttaccaaccgtatctttggttggtggattcgtatgtgtggcgcctttcccatcgaccgtgaaaatcccagcgcctcagccatcaaatatcctatcaacgttctcaaaaaaagtgaccgctctctcatcatgtttccaagtggtagccgccactcaaacgatgtcaaggggggcgcagcactgattgccaaaatggccaaggtccgtatcatgccggttacctacaccggtcccatgactttgaagggcttgattagccgtgaacgtgtcgatatgaactttggaaatccaatcgatatctcagatatcaagaaaatgaatgatgaaggcattgaaacagtcgccaatcgtattcaaacagaattccaacgtctggacgaagaaacgaaacaatggcacaatgataaaaaaccaaatccactctggtggtttatccgcatccctgccctcatccttgctattatcctcgctatcctaaccatcatctttagctttatcgcaagcttcatctggaacccagataagaaaagggagaaattgcatagaagagaatga

SEQ ID NO: 396 - DNA (genomic), 798 bp, Streptococcus pneumoniae; double-stranded, circular
  misc_feature (B) LOCATION 1...798
  hypothetical: NO
  anti-sense: NO
aaaactcagactgttacaggagtaccaaaaatgagtcaggaatttttagcacgaatcttagagcagaaggcgcgtgaggtggagcagatgaagctggagcaaatccagcctctgcgccagacctatcgcttggcagaatttttgaagaatcatcaggactgcttgcaggtaatcgctgaggtcaagaaagctagccctagtttgggagatatcaatctcgatgtggatattgtgcaacaggcccagacttatgaagaaaacggagcagtgatgatttcggtgttgacagatgaggttttctttaaagggcatttggattatctacgggaaatttccagtcaggtagagattccgacgctcaacaaagactttatcatagatgaaaagcaaatcatccgcgctcgcaatgcaggtgcgacagttatcttgcttattgtggcagccttgtccgaagaacgcctcaaggaactgtatgactacgcgacagagcttggtctggaagtcttagtggagactcacaatctagctgaactagaggtagcccacagacttggtgctgagattatcggggtcaacaaccgcaacttgactacctttgaggtcgacttgcagaccagtgtagatttagccccttactttgaggaaggtcgctattacatttctgaatctgccattttcacagggcaggatgcggaacgactagccccatactttaacggaattttggtagggacagctcttatgcaggcagaaaatgtggcccagagaatcaaggagttgcagattgacaaaggttaa

SEQ ID NO: 397 - DNA (genomic), 2292 bp, Streptococcus pneumoniae; double-stranded, circular
  misc_feature (B) LOCATION 1...2292
  hypothetical: NO
  anti-sense: NO
agaaataagacaataatcaggagacaactaaacatgttatcactacaagaatttgtacaaaatcgttacaataaaaccattgcagaatgtagcaatgaagagctttaccttgctcttcttaactacagcaagcttgcaagcagccaaaaaccagtcaacactggtaagaaaaaagtttactacatctcagctgagttcttgattggtaaactcttgtcaaacaacttgattaaccttggtctttacgacgatgttaaaaaagaacttgcagctgcaggtaaagacttgatcgaagttgaagaagttgaattggaaccatctcttggtaatggtggtttgggacgtttggctgcctgctttatcgactcaattgctactcttggtttgaatggtgacggtgttggtcttaactaccactttggtcttttccaacaagttcttaaaaacaaccaacaagaaacaattccaaatgcatggttgacagagcaaaactggttggttcgctcaagccgtagctaccaagtaccatttgcagactttactttgacatcaactctttacgatattgatgttactggttatgaaacagcgactaaaaaccgcttgcgtttgtttgacttggattcagttgattcttctattattaaagatggtatcaactttgacaagacagatatcgctcgcaacttaactctcttcctttacccagatgatagtgaccgtcaaggtgaattgctccgtatcttccaacaatacttcatggtttcaaacggtgcgcaattgatcatcgacgaagcaatcgaaaaaggaagcaacttgcatgaccttgctgactacgcagttgtccaaatcaacgatactcacccatcaatggtgattcctgaattgattcgtcttttgactgcacgtggtatcgatcttgacgaagcaatctcaattgttcgtagcatgactgcctacactaaccacacaatccttgctgaagcgcttgaaaaatggcctcttgaattcttgcaagaagtggttcctcacttggtaccaatcatcgaagaattggaccgtcgtgtgaaggcagagtacaaagatccagctgttcaaatcatcgatgagagcggacgtgttcacatggctcacatggatatccactacggatacagtgttaacggggttgcagcactccatactgaaatcttgaaaaattctgagttgaaagccttctacgacctttacccagaaaagttcaacaacaaaacaaacggtatcactttccgtcgttggcttatgcatgctaacccaagattgtctcactacttggatgagattcttggagatggttggcaccatgaagcagatgagcttgaaaaactgttgtcttatgaagacaaagcagctgtcaaagaaaaattggaaagcatcaaggctcacaacaaacgtaaattggctcgtcacttgaaagaacaccaaggtgtggaaatcaatccaaattctatctttgatatccaaatcaaacgtcttcacgagtacaaacgccaacaaatgaacgctttgtacgtgatccacaaataccttgacatcaaagctggtaacatccctgctcgtccaatcacaatcttctttggtggtaaagcagctccagcctacacaatcgctcaagatatcattcacttgatcctttgcatgtcagaagttattgctaacgatccagcagtagctccacacttgcaagtagttatggttgaaaactacaacgttactgcagcaagcttccttatcccagcatgtgatatctcagaacaaatctcacttgcttctaaagaagcttcaggtactggtaacatgaaattcatgttgaacggagctttgacacttggtactatggacggagctaacgtggaaatcgctgagttggttggtgacgaaaacatctacatctttggtgaagattcagaaactgttatcgacctttacgcaaaagcagcatataaatcaagcgaattctacgctcgtgaagctatcaaaccattggttgacttcattgttagcgatgcagttcttgcagctggaaacaaagagcgcttggaacgtctttacaatgaattgatcaacaaagactggttcatgactcttcttgacttggaagactacatcaaagtcaaagagcaaatgcttgctgactacgaagaccgtgacgcatggttggataaagtcatcgttaacatttctaaagcaggattcttctcatctgaccgtacaatcgctcagtataacgaagacatctggcacttgaactaa

SEQ ID NO: 398 - DNA (genomic), 1182 bp, Streptococcus pneumoniae; double-stranded, circular
  misc_feature (B) LOCATION 1...1182
  hypothetical: NO
  anti-sense: NO
aaggataagacaaagatgggaaaatatgattttacaagcctgcccaaccgtttagggcaccatacctataaatggaaagaaacagaaacggatagtgaagttctaccagcttggatagcggatatggactttgtggtcttgcctgaaatccgccaagccgtgcaaacttacgcagaccaactggtttatggttatacctatgccagtgaagacttaattaaggaagttcaaaagtgggaagctacacaatacggttacaactttgacaaagaggctcttgtctttatcgagggtgtggtaccagccatctcaacagctattcaaacctttacaaaagaaggcgaggcggttttaattaacacgcctgtctacccaccctttgctcgcagtgtcaagttgaataatcgtagattgattactaattccttagtggaaaaggatggtctgtttgagattgactttgaccaacttgaaaaggatttggtggaagaggaggttaaactctatattctttgcaaccctcacaatcctggtggacgtgtttgggaaaaagaagtgttggagaagattggccaactctgccaaaaacacggtgttttgttagtttcggatgagattcaccaagatttgaccctctttggtcacaaacaccagtctttcaataccatcaatcctgccttcaaaaattttgctatcgtcttgagcagtgccactaaaacatttaatattgctggaacaaaaaattcctatgcagtcattgaaaatcctaagttgagactagctttccagaaacgcctgttggccaataatcagcatgaaatttcaggcttgggttatttggcgacagaagctgcctatcgatacggtaaagattggctagaggaactcaagcaagtctttgaagaccacatcaattatgtggtggatctatttggaaaagagactaaaatcaaggtcatgaaaccgcaaggtacctacttgatttggcttgacttttcagcttatgacctgactgatgaaacattgcaagagttgttgagaaatgaagccaaggttatcctcaaccgtggtttggattttggagaggaaggaagtctccatgcccgcatcaatatagctatgcccaaatctctgttgcaagaagtctgtcagcggattgtggctacttttgccaaacgttaa

SEQ ID NO: 399 - DNA (genomic), 288 bp, Streptococcus pneumoniae; double-stranded, circular
  misc_feature (B) LOCATION 1...288
  hypothetical: NO
  anti-sense: NO
aatttaaagacagacctttatttggtttgggttcaccttttccgggaggccagaaaggaagctagagtaattcaattggccttggattaccatctggaaaaaatctttgtccaagccatgcaggaatttctaggaaaataccatgggaaatcaaaaggtgtcagctcttatcttcattccttctggagctcagccattgtctctgtccttctaaaatggatcaaggatggcatgaaggtaccagctgaaaagattgcagatttaggtttaccattttttaaaaaatag

SEQ ID NO: 400 - DNA (genomic), 1041 bp, Streptococcus pneumoniae; double-stranded, circular
  misc_feature (B) LOCATION 1...1041
  hypothetical: NO
  anti-sense: NO
ttgagaaagactagtaaaatgattaatcaaatttatcaactaactaaacctaagtttatcaatgtcaaatatcaggaagaggctattgaccaagagaatcatatccttatccgtcccaactacatggctgtctgtcatgcggatcagcgttactaccagggaaaacgtgatcccaagattttgaataaaaagcttccaatggcaatgattcacgagtcatgtggaatcgtcatttctgacccgagcggaacctacgaggttggtcaaaaagttgtcatgattcccaatcagtctcctatgcagagtgatgaagaattctatgaaaactacatgacagggacccatttcttgtctagtggatttgatggctttatgagagagtttgtttctctccctaaagatcgtgtggtggcttatgatgctattgaagatacggttgcagccattacagagtttgtcagtgtgggcatgcacgctatgaatcgtctattgactcttgctcatagcaagcgggagcggatccccgttattggagatggaagtttagcttttgtggttgccaatattatcaactatactttgccagaagcagagattgtggttattggtcgtcattgggaaaagttggaactcttctcatttgccaaagaatgctatattacggataatattcctgaagagttggcctttgaccatgcttttgaatgttgtggtggtgatggtactggaccagctattaatgacttgattcgctacattcgtcctcagggaacaattctcatgatgggagttagcgaatataaagtcaatctcaatactcgcgatgccttagaaaagggcttgctcttggttgggtcatctcgttctggtcgcattgattttgaaaatgctatccaaatgatgaaagtcaagaaatttgccaatcgtcttaaaaatatcctttatctagaagaacctgtaagagaaattaaagatattcaccgtgtctttgcaaccgatttaaacacagcctttaaaacagtgtttaagtgggaagtataa

SEQ ID NO: 401 - DNA (genomic), 1116 bp, Streptococcus pneumoniae; double-stranded, circular
  misc_feature (B) LOCATION 1...1116
  hypothetical: NO
  anti-sense: NO
aaagtgaagacaatgaaaaaagttgccattattggagcaggaattgtgggagcaacagctgcctactacctctcgagagaaagtgacctagaggtgaccgtttttgaccatgagcaaggtcaagccaccaaggccgcagcaggaattatcagtccttggttttccaaacgccgtaataaagcctggtacaagatggcgcgcttgggggctgatttttatgtggatttattagctgatttagagaaatcaggacaaaaaatcgacttttaccagcgttcgggagtctttctcttgaaaaaggatgaatccaagttggaagaactttatcaactggccctccagcgcagagaagaatctcccttgatagggcaattagccattctggaccaagcttcagctaatgaattattccctggtttgcagggatttgaccgcctgctctatgcttctggtggagcgagagtagatggccaactcttggtaactcgtctgctagaagccagtcatgtcaagctggtcaaagaaaaagtgactctgacactcttatcatcaggctaccagattggcgaagaggtgtttgatcaggttattttggcaacgggagcttggttgggggacatgttagagcctttaggttatgaagtggatgtccgtcctcaaaaaggacaactacgagattatcagcttgcccaagacatggaagcttaccctgttgtcatgccagaaggggagtgggatttgattccctttgcaggtgggaaattatccttgggcgctacccatgaaaatgacatgggatttgatttgacggtagatgaacccttgctccaacaaatggaggaggcggccttgcctcattacccagttttagctagagcgacttcaagggctgagcgtgtgggaatccgtgcctataccagtgatttctctcccttctttgggcaggtgccagaattggcaggtgtctatgcaggcagtggactaggttcatcaggcctcacaactggtcctatcattggttaccatctagcccaactgatccaagacaaggagttgaccttggaccctctaaattacccaattgaaaactatgtcaaacgagtaaaaagcgaataa

SEQ ID NO: 402 - DNA (genomic), 636 bp, Streptococcus pneumoniae; double-stranded, circular
  misc_feature (B) LOCATION 1...636
  hypothetical: NO
  anti-sense: NO
aggacgaagacctcttggttccgcttgattattcaaaaattgaaggaatcgaaaatatcggaccagagtttctcaaccagtcctttgacccaggtaataaattctccatcccttacttctggggcgactcactttgtggagaaactttcagacacggaacaactcaataaaaaggttaagattattcctttggaagtcgtgctccgcaactatactgctggttccttttcaaaacgttttggtgtggatgagggaatcgccttggagactccgattgtcgaattttactacaaaaatgatgatttggatgatccatttatcaatgatgagcatgtgaaattcctacagattgcgggtgaccagcagattgcctacttgaaggaagaaacgcgtcgtatcaatgaactattgaaagtctggtttactgagattgggcttaaattgattgactttaagctagagttcggttttgacaaggatggcaagattatcttggcagacgaattttcaccagataactgccgcttgtgggacgctgatggcaaccacatggataaggatgttttccgtagaggattgggagaactaaccgacgtttatgagattgtttgggaaaagttgcaggaattgaaataa

SEQ ID NO: 403 - DNA (genomic), 1671 bp, Streptococcus pneumoniae; double-stranded, circular
  misc_feature (B) LOCATION 1...1671
  hypothetical: NO
  anti-sense: NO
ggacggaagactgcttcctcccttttatcagaaaaggagaaacagatgacacttgataaaggaaaagtagtctatcaaatctatccaaaatcttacaaagacaccactgaaaacggtattggggatttccgtgggattatcgaaaaaattccctatttagccaaactaggtgtggatatggtctggctcaatccattctatccaagccctcaacgggataatggttacgatatttcagattatatggcagtggatcctctttttggtgatatggctgattttgaggaaatggtgtgtgtcggtaaagagcacaagattgactttatgctggacatggtacttaatcattgttcgacagagcatgaatggtttcagaaagccctagctggtgataagtattatcaagactttttcttcatccaagaccaaccaacagattggcagtctaagtttggtggttctgcatgggcgcctttcggggatactgggaaatactatcttcacctatttgatgagacccaggctgaccttaactggcgcaatcccaatgtccgtaaggagcttttcaaggttgttaatttctggcgcgacaagggtgtcaaaggttttcgatttgatgtgatcaatttgatcggtaaggacgaggtttcagtggactgtcctgaaaatgaagggaagccagcttatacagacaaacccatcgttcataactatttgcgtatgatgaaccaagccacttttggatctgacgatagctttatgacagttggggaaatgtcttctaccaccatggaaaactgtgtcctctattcgtcgcctgatcgtcaggaattatccatgacctttaattttcatcacctcaaggtggactataaggatggacaaaagtggaccttggctccctttgattttgaagagttgaagagtctttaccatagttggggtaaggaaatgagtgataaagacggttggagtgccctcttttggaacaatcacgatcaaccacgtgccttgaaccgttttgtcgatattcaaaacttccgcaaggaaggagccactatgctagcagccagcattcacctgtcacgtgggacaccttatatctacatgggtgaggaaatcgggatgattgacccagactatgattctatggctgattatgtggatgtcgaatcgcttaatgcctatcagatgctcttagaagaaggaaagagtcagcaagaagccttccagattattcaagctaagtcgcgtgataattcacgcattcccatgcagtgggatgcttcggaaaatgcaggattttcaacaggcactccttggttgaaagctggtaaatcctataaatacatcaatgtagaaaatgaaatccagggtccgatttttaccttctatcaagacttgattcgactgcgtaaggaaatgccaatcatttcagaaggaagttacaaaccagcctttgaagatagcaaacaagtctacgcttttgaacgccagtttgaggatcaaaagttactagtgctcaataacttttatgctaaagaagtggaaatcgacttgccagcagtctaccaaaatggacagattttgatatcaaactatgaagatgcagaagtgtctgagaaaattctactcaaaccctatcaaacactggctatttatgtaaattaa

SEQ ID NO: 404 - DNA (genomic), 291 bp, Streptococcus pneumoniae; double-stranded, circular
  misc_feature (B) LOCATION 1...291
  hypothetical: NO
  anti-sense: NO
agaaatgagactttaaaaatggcagttaaaatccgtttgactcgtatgggttctaagaaaaaacctttctaccgtatcaacgtagcagattcacgttcaccacgtgacggacgtttcatcgaaacagttggaacttacaacccacttgttgctgaaaaccaagtaactttgaaagaagaccgcgttcttgcatggttggctaatggagctcaaccttcagacacagtacgtaacatcctttcaaaagaaggcgtattgaaaaaattccacgattctaaattttcaaaataa

SEQ ID NO: 405 - DNA (genomic), 219 bp, Streptococcus pneumoniae; double-stranded, circular
  misc_feature (B) LOCATION 1...219
  hypothetical: NO
  anti-sense: NO
caaaaggagacttgtatgaatacttattgtaatataaatgaaacaatgctgagtgaggtttatggaggtaattccggaggagcagctgtagttgctgctttaggttgtgcagcgggtggagtgaaatatgggagacttctaggaccatggggcgctgcaataggaggaattggaggagcagtggtttgtggatatttagcctataccgctacatcataa

SEQ ID NO: 406 - DNA (genomic), 855 bp, Streptococcus pneumoniae; double-stranded, circular
  misc_feature (B) LOCATION 1...855
  hypothetical: NO
  anti-sense: NO
agaaaggagacagctatgcaatctacagaaaaaaaaccattaacagcctttactgttatttcaacaatcattttgctcttgttgactgtgctgttcatctttccattctactggattttgacaggggcattcaaatcacaacctgatacaattgttattcctcctcagtggttccctaaaatgccaaccatggaaaacttccaacaactcatggtgcagaaccctgccttgcaatggatgtggaactcagtatttatctcattggtaaccatgttcttagtttgtgcaacctcatctctagcaggttatgtattggctaaaaaacgtttctatggtcaacgcattctatttgctatctttatcgctgctatggcgcttccaaaacaagttgtccttgtaccattggtacgtatcgtcaacttcatgggaatccacgatactctctgggcagttatcttgcctttgattggatggccattcggtgtcttcctcatgaaacaatttagtgaaaatattcctacagagttgcttgaatcagctaaaatcgacggttgtggtgagattcgtaccttctggagtgtagccttcccgattgtgaaaccagggtttgcagcccttgcaatctttaccttcatcaatacttggaatgactacttcatgcaattggtaatgttgacttcacgtaacaatttgaccatctcacttggggttgcgaccatgcaggctgaaatggcaaccaactatggtttgattatggcaggagctgcccttgctgctgttccaatcgtcacagtcttccttgtcttccaaaaatccttcacacagggtattactatgggagcggtcaaaggataa

SEQ ID NO: 407 - DNA (genomic), 231 bp, Streptococcus pneumoniae; double-stranded, circular
  misc_feature (B) LOCATION 1...231
  hypothetical: NO
  anti-sense: NO
tctccttggactacaagactttcaaaacctttgccatcaagacctactgtatccataccgatgtggatgagcaattcaactccctcgtcagagacaatgccgatggcatgcttggtagggaaaagaaccgtcactgttccattaactggagaggtcaactcaccttggcttggttcaatgaccagaccttgccccatgacacctgatgcaaaaacaggatccgtcgcttga

SEQ ID NO: 408 - DNA (genomic), 402 bp, Streptococcus pneumoniae; double-stranded, circular
  misc_feature (B) LOCATION 1...402
  hypothetical: NO
  anti-sense: NO
caaaaatggacaaaagagctaatggttacttggattttgtgggcacttatactagcaatgttggcgtggatgggctttaactatcttcgtattcgccgtgcggctaaaattgtggacaatgaggagtttgaagccttgattcgtacgggtcaattgattgatttgcgcgacccagcagaattccacagaaaacatatccttggtgcacgcaatattccttcaagtcagttgaaaactagtcttgcagcccttcgtaaagataaacctgtccttctctacgaaaaccaacgtgcgcaacgagttacaaatgcagctctttacttgaaaaaacaaggtttttctgagatttatatcctttcttatggcttggattcttggaaagggaaagtgaagactagctaa

SEQ ID NO: 409 - DNA (genomic), 402 bp, Streptococcus pneumoniae; double-stranded, circular
  misc_feature (B) LOCATION 1...402
  hypothetical: NO
  anti-sense: NO
atggaatggacaactgagcgtcgttacagactttatcaagaatggacgcaagaagaaattcaacatataaatgaaaatatggcacaatctccatggcatactcattancatgttgaagcaaaaacaggacttctcaacgacccaaatggcttttcttacttcgatggcaattggatcctctttaaccagatttttccttttggtgcancccacggtttanattcttgggcccacctaaaaattaatgattgggttcacttanaaaaacctgaaatcaagttttggcaaaatcctcattnaatnttcagggtcccaacctcggttcgtccatccaatttgggcaaaaattattccttttttttccggagatttttcccaataaaaaatggatcgtccccctaa

SEQ ID NO: 410 - DNA (genomic), 1410 bp, Streptococcus pneumoniae; double-stranded, circular
  misc_feature (B) LOCATION 1...1410
  hypothetical: NO
  anti-sense: NO
agttctcggacttcagccctttttaaaggagtagaaatgaaattaacaatccatgaaattgcccaagttgttggagccaaaaatgatatcagtatctttgaggacacccagttagaaaaagctgagtttgatagtcgtttgattggaactggagatttatttgtgccacttaaaggtgcgcgtgatggccatgactttattaaaacagcctttgaaaatggtgcagcagtaaccttgtctgagaaagaggtctcaaatcatccttacattctagtagatgatgttttgacagcctttcaatccctagcatcctactatcttgaaaaaacgactgttgatgtctttgctgttacaggttcaaatggcaagacaacgactaaggatatgttggcgcatttactgtcaacaagatacaagacctacaaaacacaaggcaattacaataatgagattggccttccttacacagttctccacatgcctgaaggaacagaaaagttggtcttggagatggggcaggaccacttgggagatattcatctcttgtctgaattggctcgtccaaaaacagccatcgtgaccttggttggagaagctcatttggcctttttcaaagatcgttctgagattgctaaaggaaaaatgcaaattgcagacggaatggcttcaggttccttgcttttagcgccggctgaccctatcgtagaggactatttgccaactgataaaaaggtggtccgttttgggcaaggggcagagttggaaatcacagacttggttgagcgcaaagatagtctaaccttcaaggccaatttcttagagcaagcccttgatttgccagtaactggtaagtacaatgctaccaatgctatgattgcatcctatgttgccctacaagaaggagtttcagaggagcaaattcatcaggccttccaaggtcttgaattgacgcgtaatcgtactgagtggaagaaagcagccaatggagcagatatcctgtcagacgtatataatgccaatccaactgctatgaagctgattttagagactttctctgccattccagccaatgaaggtggcaagaaaattgcagtgttggcggatatgaaggagcttggtgaccagtctattcaactccataaccagatgattttgagcctttctccagatgtgcttgataccgttattttctatggagaagacattgctgaattagcccaattggccagtcaaatgttcccaataggccacgtttactacttcaagaaaacagaagaccaagaccaatttgaagacctagtcaagcaggtcaaggaaagcctcagtgccaatgatcaaatcttgctcaagggctctaactctatgaacctagccatgttggtagaaagtttagaaaatgaaaccaagtga

SEQ ID NO: 411 - DNA (genomic), 306 bp, Streptococcus pneumoniae; double-stranded, circular
  misc_feature (B) LOCATION 1...306
  hypothetical: NO
  anti-sense: NO
atacgacggacactttcgcgaacatgcttggccttgacgggagcgtctgcttccacctcacccaagcgttctcgcaacttactattttccaagcgaagagctgtattttcttctaccaagctcttgagatttttcttgatggcttccacatcggctaaggttaccaataattgttgggaaaaatcatccagcgcgtcaaataattcttttgtgtccataaaacaagcccctttcctgtctttatcattcatttttgagtttatatttctttcaagaccagatattccatggcattttgaaagctga

SEQ ID NO: 412 - DNA (genomic), 1104 bp, Streptococcus pneumoniae; double-stranded, circular
  misc_feature (B) LOCATION 1...1104
  hypothetical: NO
  anti-sense: NO
cacactgggacacatttcaaaaacagttggtttttgaatgtcccaaacatggctaaaataggtcttggaaatattcctcgtgaaactcctcttaagactgtagcagctgaaagcaatccaactggatatgcaacaaaattagaggaagtatctcttggtaaggatactatgactggacactgggaaatcatgggactcaacattactgagcctttcgatactttctggaacggattcccagaagaaatcctgacaaaaatcgaagaattctcaggacgcaaggttattcgtgaagccaacaaaccttattcaggaacggctgttatcgatgattttggaccacgtcagatggaaactggagagttgattatctatacttcagctgaccctgttttgcagattgctgcccacgaagacattattcctttggatgaattgtaccgtatctgtgaatacgctcgttcgattacccttgagcgtcctgcccttcttggtcgcatcattgctcgcccttatgtaggtgaaccaggtaacttcactcgtacggcaaaccgtcgtgacttggctgtatctccattttccccaactgttttggataaattgaatgaggctggtatcgatacttatgctgtgggtaaaatcaacgatatctttaacggtgctggtatcaaccatgacatgggtcacaacaagtcaaatagtcatggaattgatacactattgaagactatgggacttgctgagtttgaaaaaggattctcattcacaaacctagttgactttgatgccctttacggccatcgtcgtaatgctcacggttaccgtgattgcttgcatgagtttgatgaacgcttacctgaaattatcgcagctatgagagagaatgaccttctcttgattactgcggaccatggaaatgacccaacgtatgcaggaacggatcacactcgggaatatattccattgttggcctatagccctgcctttaaaggaaatggtctcattccagtaggacattttgcggatatttcagcgactgttgccgataactttggtgtggaaactgctatgattggggaaagtttcttagataaattggtataa

SEQ ID NO: 413 - DNA (genomic), 867 bp, Streptococcus pneumoniae; double-stranded, circular
  misc_feature (B) LOCATION 1...867
  hypothetical: NO
  anti-sense: NO
gaattttattttccaagactggctcgtcgtttgcttgtaaatgatgattatgatgttgaagtttcttttaccattatgaatccaccactgttgttctctaaaagaagagaagtcaagaagatatcttggattcatggaagtattgaagaacttcttaaggatagctctaaaagagaatcacatagaagccagttggatgctgcgaatacaattgtagggatttcaaaaaagaccagcaattctatcaaggaagtttatccagattatgcttctaaattacagacaatctacaatggatatgattttcagactattctagaaaaatctcaagagaagatcgatatcgagattgctcctcaaagtatctgtactatcggacggattgaggaaaataagggttctgaccgtgtagtggaagtgatacgattattacaccaagagggaaaaaactatcatctctattttatcggggctggtgatatggaagaggaactgaaaaaacgagtcaaagagtatgggattgaggactatgtacatttccttggttatcaaaaaaatccttatcagtatttatctcagacgaaagttctcttgtctatgtctaaacaagaaggttttcctggagtgtatgtggaggccttgagtctgggactcccttttatctctacggacgttggaggggctgaggaattatcccaagaaggacgatttggacaaatcattgagagcaatcaagaggcagctcaggcgattactaattacatgacttctgcctcaaactttgatgtcgatgaggctagccaattcattcaacaatttacaattacaaaacaaatcgaacaagtagaaaaactattagaggagtag

SEQ ID NO: 414 - DNA (genomic), 309 bp, Streptococcus pneumoniae; double-stranded, circular
  misc_feature (B) LOCATION 1...309
  hypothetical: NO
  anti-sense: NO
gataaatttgctaagttgtatgccccttttatgaaaaaagataaagaggtttatgataaagtttgtgaatatcttagtcctcatttgaataaagatatggaggtgcttgaacttgcttgttggtttcgtgtcataacagttatagaggcaaatagttatgtaaatataaggagttcaagacttctaccaaagtttaaaactcaaaaaataaatagttggtgtgctgcttacaatatccattttaataatggatattgtaagcagcataccaatgaatttaaagattctttaaagagtcttattttgtga

SEQ ID NO: 415 - DNA (genomic), 1113 bp, Streptococcus pneumoniae; double-stranded, circular
  misc_feature (B) LOCATION 1...1113
  hypothetical: NO
  anti-sense: NO
gggaaatttgctaagataaataaaaagaaaggagctcttatggccaatatttttgactatctgaaagatgtcgcatatgattcttattacgaccttcccttgaatgagttagacattctaaccttaatagaaatcacctacctctcctttgataatctggtctccacacttcctcaacgtcttttagatctagcacctcaggttccaagagatcccaccatgcttactagcaaaaatcgccttcaattattagatgaattggctcaacacaagcgcttcaaaaattgcaaactctcccattttatcaacgacatcgaccctgaactgcaaaagcaatttgcggctatgacttatcgtgtcagcctcgatacctatctgattgtctttcgtgggacagatgacagtatcattggctggaaggaagatttccacctgacctatatgaaggaaattcctgctcaaaagcacgcccttcgctatttaaagaacttttttgcccatcatcctaagcaaaaggttattctagctgggcattccaagggaggaaatctcgctatctatgctgctagccaaattgagcaaagtttgcaaaatcagatcacagcagtttatacatttgatgcacctggtctccatcaagaattgacacagactgcgggttatcaaaggataatggatagaagcaagatattcattccacaaggttccattatcggtatgatgctggaaattcctgctcaccaaatcatcgttcagagtactgccctgggtggcatcgcccagcacgatacctttagttggcagattgaggataagcacttcgtccaactggataagaccaacagtgatagccagcaagtagacacaacctttaaagaatgggtggccacagtccctgacgaagaacttcagctctacttcgacctcttctttggcactattcttgaggctggtattagctctatcaatgacttggcttccttaaaggcgcttgaatacattcatcatctctttgtccaagctcaatccctcactccagaagaaagagaaaccttgggtcgccttacccagttattgattgatactcgttaccaggcatggaaaaatagataa

SEQ ID NO: 416 - DNA (genomic), 768 bp, Streptococcus pneumoniae; double-stranded, circular
  misc_feature (B) LOCATION 1...768
  hypothetical: NO
  anti-sense: NO
atgaatattgcaaaaatagtcagagaagcgcgtgagcagagtcgcttgacaaccttggactttgcgacaggcatttttgatgaatttatccaattacatggtgaccgttcttttcgtgatgatggtgcagttgttggtggtattggttggcttggagaccaagctgtaacagtggttggtatccaaaaaggcaagagtttgcaagacaacctcaaacggaattttggccaaccacatccagaaggctaccgaaaggcactgcggttgatgaaacaggctgagaaatttggccgtccagttgtgacctttatcaatacagcaggtgcttatcctggtgtcggagcggaagaacgtggtcaaggggaagctattgctcgcaatctcatggaaatgagtgacctgaaagttcctattatcgccattattatcggtgaaggtggttcaggcggggctctggctctagctgtcgcggaccgtgtctggatgctggaaaattctatctatgccattctcagtccagaaggctttgcttccattttatggaaggacggtactcgcgccatggaagcagcagaactgatgaaaatcacttcgcatgaactgttagaaatggacgtggtggataaggtgatttctgaagtaggactttctagtaaagaactgattaagagtgtcaaaaaagaactccaaacggagctggctagactttcacaaaaaccgctagaagagttgctggaagaacgctatcaacgatttagaaaatactaa

SEQ ID NO: 417 - DNA (genomic), 612 bp, Streptococcus pneumoniae; double-stranded, circular
  misc_feature (B) LOCATION 1...612
  hypothetical: NO
  anti-sense: NO
tacgatattgcagaaagtcatttctatgcttcagctaataatgtaatccgtgatgacgcttcgtccttccacaccttctattttgatcctgagacaggtcaaccctttaaaggtgtaacgagacaagggtatagtgatgattcatgctgggcacgtggtcaatcatggggagtctatggtattcctttgacttatcgtcacttaaaagacgagtcctgctttgacttgtttaagggtgtgaccaattttttcttgaatcgtctgccaaaagatcatgtgtcctattgggatttgatttttaatgatggtagtgatcaatcacgagattcttcagcaacagctatcgccgtctgtgggattcatgaaatgctaaaacatctcccagaggtggatgctgacaaagatatttataaacatgctatgcatgccatgcttcgttccttgatcgaacattatgcaaatgatcaatttacccctggtgggacaagtctcctccacggtgtgtactcatggcattcaggtaaaggagtggatgaaggcaatatctggggtgactactattacctagaagcccttatccgtttctacaaagactggaacctatattggtag

SEQ ID NO: 418 - DNA (genomic), 186 bp, Streptococcus pneumoniae; double-stranded, circular
  misc_feature (B) LOCATION 1...186
  hypothetical: NO
  anti-sense: NO
cctgccattgcatctactacacttccatccttcgagtattgctcccgatatctagctaagttcccatctactccatctagtaagttccataaaaaaaatagaaaccatgccagcaataatagaatgaaattagttgtaaatgtcattgtcagaaatccaagaatcaaaggggctatagataaataa

SEQ ID NO: 419 - DNA (genomic), 1074 bp, Streptococcus pneumoniae; double-stranded, circular
  misc_feature (B) LOCATION 1...1074
  hypothetical: NO
  anti-sense: NO
aagctaattgccgcattctacaatatgtacaagaagaggtcggttgcaaggtcttgcttgcccagaagggcatattccctctacaaaacttatcccttgattagccagtatctatcaggtacgacagctagtggactctatgaggccaaattggcaagggaagaatttcctggtgaagtccatgtatttgcgcctgctttcaaggatgcagacttggaggaattgctagagataatggaccatatcgtctttaactcagagagacagttgcgtaaacacggtccgcgttgtcgagaggctggtgtcagtgttggtttgcgcctcaaccctcagtgttcaactcaaggagatcacgcgctctatgacccttgtgcaccaggttctcgctttggagttactatagacaagattccgagtgatttgctagatttggttgacggacttcattttcataccctttgcgagcagggagcagatgatttacaaacaactttgaaagcagtagaagaacagtttggtccctacttacatgaggtaaaatggctcaatatgggtggtggtcatcatattacaagagaaggttacgatgtggatttgctgatttcagaaatcaagcgtatccgaaaaacttacaatcttgaaatctatatcgagcctggtgaagccattgcgcttaatgcgggttatttagcaactgaggtattagatattgtagaaaacggtatggaaatcttggttttagacgcctctgcgacctgccatatgcctgatgtacttgagatgccctatcgtccatctttgagaaatggctttgaggcacaggaaaaagcccatacctacagactttcttctaatacctgtctgacgggcgatgtgattggtgattatagttttgaaaatccagtccaaatcggagacagactttattttcaagacatggccatttattcttttgtcaaaaataatacctttaatggtattggattgccaagcctctatctcatggacgaacagggagactgtagcttactcaaagcttttggctatcaagactttaaagggagattatcatga

SEQ ID NO: 420 - DNA (genomic), 873 bp, Streptococcus pneumoniae; double-stranded, circular
  misc_feature (B) LOCATION 1...873
  hypothetical: NO
  anti-sense: NO
atgagaattgcagattatagcgtgaccaaggcagtgttggagcgtcacggttttacctttaaaaagtcctttgggcaaaatttcttgacggataccaatatccttcaaaaaattgtggatacggctgaaattgatgatcaggtcaatgtcatcgaaatcgggccaggtattggtgccttgacagaatttttggctgagcgtgcagcccaagtcatggcttttgagattgaccaccgtttggtgccaattttggcagataccctgcgtgattttgataatgtgactgtagttaacgaagatattctcaaggttgatttggcgcaacatatccaaaattttaaaaatcctaacctgccaatcaaggtagtggctaatttgccttactacatcacgacgcctattctcatgcacttgattgagagtggcattccttttagtgagtttgtggtcatgatgcagaaagaagtagcggaccgcatttcagcccagcctaacaccaaggcttacggtagcttgtctatcgccgtgcagtattacatgacagccaaggttgcctttatcgtgcctcgtacggtctttgtgccagcgccaaatgtggattcagccatcttgaaaatggtgcgccgtccagagccagctgtagcagtggaagatgagaacttcttctttaaggtttccaaggctagttttacccatcgccgtaagaccttgtggaataacttgacaggttactttggcaagactgaggaagtcaaggacaagctgaccaaggctttggaccaggcagacttgtcgccaagtgtgcgtggggaagctctcagcttggcagaatttgccggtctagcagacgcacttaaagggcaaggactctaa

SEQ ID NO: 421 - DNA (genomic), 852 bp, Streptococcus pneumoniae; double-stranded, circular
  misc_feature (B) LOCATION 1...852
  hypothetical: NO
  anti-sense: NO
cctatgattgcagaatttatcgatggattgcaaaaattccatttcctacaaaatgccttgataacagctattgtcgtcgggattgtagctggagccgtgggatgtttcattattctacgcgggatgtcactcatgggagatgccatttcacatgctgtcttaccaggtgtagccctctccttcatcttgggccttgacttctttatcggagccattgtctttggattgctagctgccatcatcattacctacatcaaaggaaactcgattatcaaaagcgataccgccatcggcattaccttttcttctttcttagccctcggtatcatcttgaatggtgtctctaaaagttcaactgaacttttccatatcctttttgggtatatcctggccgtccaagatacggatatgtttattactatgggtgtgggggcagccatcctcttgttaatctggattttcttcaagcaactcttgataacttcctttgatgaactcttggctaaagccatgggaatgcctgtcaatttctatcactaccttctcatggtactcctgactctcgtgtctgtgacagccatgcaaagtgtcggaactatcctgattgtagccatgctgattaccccagctgcaactgcttatctgtatgctaatagtctgaaaagcatgattttcctttcctcaaccttcggagctactgcttcagttttgggactctttattggctatagttttaatgttgcggcaggttctagtatcgtgcttacagctgctagtttctttctcattagcttctttatcgctcccaaacaacgatatttgaaactgaaaaataaacatttgttaaaataa

SEQ ID NO: 422 - DNA (genomic), 465 bp, Streptococcus pneumoniae; double-stranded, circular
  misc_feature (B) LOCATION 1...465
  hypothetical: NO
  anti-sense: NO
ccgatgattgccaaggagtttgagactttcttgttggggcaggaggaaacttttttgacccctgctaaaaatctagctgtgttgattgatacccacaatgcggatcatgcgaccctcttgcttagtcagatgacctatacccgtgttcccgttgtgacagatgaaaaacagtttgttgggacgattggactcagagatattatggcttatcagatggagcatgacttgagccaagaaatcatggcggatacggatatcgttcatatgacaaaaacggacgtagcggttgtttcgcctgatttcaccattacggaggtcttgcacaagctagtagatgagtccttcttaccggttgtggatacagagggtattttccaagggattattacgcgcaagtccatcctcaaggccgttaatgccctcttgcatgattttagtaaggaatatgagattcgatgccaatga

SEQ ID NO: 423 - DNA (genomic), 393 bp, Streptococcus pneumoniae; double-stranded, circular
  misc_feature (B) LOCATION 1...393
  hypothetical: NO
  anti-sense: NO
aataatgttgcaatcggcgtgaccttctctggtgaagccagccaaatgttagaaaaaaatgaaaatctacgttatgtggtaccgacagaggccagcaatctttggtgtgacaatatggtcattcccaaaacagttaaaaaccaaaactcagcctatgcctttatcaactttatgttgaaacctgaaaatgctctccaaaatgcggagtatgtcggctactcaacaccaaacctaccagcgaaggaattgctcccagaggaaacaaaggaagataaggccttctatcccgatgttgaaaccatgaaacacctagaagtttatgagaaatttgaccataaatggacagggaaatatagcgacctcttcctacagtttaaaatgtatcggaagtag

SEQ ID NO: 424 - DNA (genomic), 222 bp, Streptococcus pneumoniae; double-stranded, circular
  misc_feature (B) LOCATION 1...222
  hypothetical: NO
  anti-sense: NO
tcacaggttgctcaaaacactgttttgaggttgtggatagaactgacgaagtcagctcaaaacactgttttgaggttgcagatagaactgacgaagtcagtaacatctatacggcaaggtgaagctgaccatggtttgaaaagattttcgaagagtatcatttcatctcactctaaatcttaccaacataaaacgcatagtatcaaagttttcatcacctga

SEQ ID NO: 425 - DNA (genomic), 201 bp, Streptococcus pneumoniae; double-stranded, circular
  misc_feature (B) LOCATION 1...201
  hypothetical: NO
  anti-sense: NO
ccgcaggttgctcaaagcactgctttgaggttgcagatagaactgacgaagtcagctcaaaacactgttttgaggttgcagatagaactgacgaagtcagtaacatatatagcggccaaggcgacgttgacgcggtttgaagagatttttgaagagtatgaaacgaaaaggaggttggtcattgtaccagcctccttttga

SEQ ID NO: 426 - DNA (genomic), 201 bp, Streptococcus pneumoniae; double-stranded, circular
  misc_feature (B) LOCATION 1...201
  hypothetical: NO
  anti-sense: NO
ttgggggttgccccctgtgagatagggaagtcgcttagctctagggagtttagctcagctgggagagcatctgccttacaagcagagggtcagcggttcgatcccgttaactcccaaaggtcccgtagtgtagcggttatcacgtcgccctgtcacggcgaagatcgcgggttcgattcccgtcgggaccgtttaaggtaa

SEQ ID NO: 427 - DNA (genomic), 201 bp, Streptococcus pneumoniae; double-stranded, circular; identical to SEQ ID NO: 426
  misc_feature (B) LOCATION 1...201
  hypothetical: NO
  anti-sense: NO

SEQ ID NO: 428 - DNA (genomic), 249 bp, Streptococcus pneumoniae; double-stranded, circular
  misc_feature (B) LOCATION 1...249
  hypothetical: NO
  anti-sense: NO
ttgggggttgccccctgtgagatagggaagtcgcttagctctagggagtttagctcagctgggagagcatctgccttacaagcagagggtcagcggttcgatcccgttaactcccattttagcgggtgtagtttagtggtaaaactacagccttccaagctgttgtcgcgagttcgattctcgtcacccgctttgaactttgttctttgtaccaagtttttgacttgggcgcgtagctcaggtggttag

SEQ ID NO: 429 - DNA (genomic), 2928 bp, Streptococcus pneumoniae; double-stranded, circular
  misc_feature (B) LOCATION 1...2928
  hypothetical: NO
  anti-sense: NO
atgtcttatttcagaaatcgggatatagatatagagaggatcagtatgaatcggagtgttcaagaacgtaagtgtcgttatagcattaggaaactatcggtaggagcggtttctatgattgtaggagcagtggtatttggaacgtctcctgttttagctcaagaaggggcaagtgagcaacctctggcaaatgaaactcaactttcgggggagagctcaaccctaactgatacagaaaagagccagccttcttcagagactgaactttctggcaataagcaagaacaagaaaggaaagataagcaagaagaaaaaatttcaagagattactatgcacgagatttggaaaatgtcgaaacagtgatagaaaaagaagatgttgaaaccaatgcttcaaatggtcagagagttgatttatcaagtgaactagataaactaaagaaacttgaaaacgcaacagttcacatggagtttaagccagatgccaaggccccagcattctataatctcttttctgtgtcaagtgctactaaaaaagatgagtacttcactatggcagtttacaataatactgctactctagaggggcgtggttcggatgggaaacagttttacggtaattacaacgatgcacccttaaaagttaaaccaggtcagtggaattctgtgactttcacagttgaaaaaccgacaccagaactacctaaaggccgagtgcgcctctacgtaaacggggtattatctcgaacaagtctgaaatctggcaatttcattaaagatatgccagatgtaacgcatgtacaaatcggagcaaccaagcgtgccaacaatacggtttgggggtcaaatctacagattcggaatctcactgtgtataatcgtgctttaacaccagaagaggtacaaaaacgtagtcaactttttaaacgctcagatttagaaaaaaaactacctgaaggagcggttttaacagagaaaacggacatattcgaaagcgggcgtaacggtaaaccaaataaagatggaatcaagagttatcgtattccagcacttctcaagacagataaaggaactttgatcgcaggtgcagatgaacgccgtctccattcgagtgactggggtgatatcggtatggtcatcagacgtagtgaagataatggtaaaacttggggtgaccgagtaaccattaccaacttacgtgacaatccaaaagcttctgacccatcgatcggttcaccagtgaatatcgatatggtgttggttcaagatcctgaaaccaaacgaatcttttctatctatgacatgttcccagaagggaagggaatctttggaatgtcttcacaaaaagaagaagcctacaaaaaaatcgatggaaaaacctatcaaatcctctatcgtgaaggagaaaagggagcttataccattcgagaaaatggtactgtctatacaccagatggtaaggcgacagactatcgcgttgttgtagatcctgttaaaccagcctatagcgacaagggtgatctatacaagggtgaccaattactaggcaatatctacttcacaacaaacaaaacttctccatttagaattgccaaggatagctatctatggatgtcctacagtgatgacgacgggaagacatggtcagcgcctcaagatattactccgatggtcaaagccgattggatgaaattcttgggtgtaggtcctggaacaggaattgtacttcggaatgggcctcacaagggacggattttgataccggtttatacgactaataatgtatctcacttagatggctcgcaatcttctcgtgtcatctattcagatgatcatggaaaaacttggcatgctggagaagcggtcaacgataaccgtcaggtagacggtcaaaagatccactcttctacgatgaacaataaacgtgcgcaaaatacagaatcaacggtggtacaactaaacaatggagatgttaaactctttatgcgtggtttgactggagatcttcaggttgctacaagtaaagacggaggagtgacttgggagaaggatatcaaacgttatccacaggttaaagatgtctatgttcaaatgtctgctatccatacgatgcacgaaggaaaagaatacatcatcctcagtaatgcaggtggaccgaaacgtgaaaatgggatggtccacttggcacgtgtcgaagaaaatggtgagttgacttggctcaaacacaatccaattcaaaaaggagagtttgcctataattcgctccaagaattaggaaatggggagtatggcatcttgtatgaacatactgaaaaaggacaaaatgcctataccctatcatttagaaaatttaattgggaatttttgagcaaaaatctgatttctcctaccgaagcgaaagtgaagcgaactagagagatgggcaaaggagttattggcttggagttcgactcagaagtattggtcaacaaggctccaacccttcaattggcaaatggtaaaacagcgactttcctaacccagtatgatagcaagaccttgttgtttgcagtagataaggaagatatcggacaggaaattattggtatagctaaaggaagcatcgaaagtatgcataatcttcctgtaaatctagcaggtgccagagttcctggcggagtaaatggtagcaaagcagcggtgcatgaagttccagaatttacagggggagttaatggtacagagccagctgttcatgaaatcgcagagtataagggatctgattcgcttgtaactcttactacaaaagaagattatacttacaaagctcctcttgctcagcaggcacttcctgaaacaggaaacaaggagagtgacctcctagcttcactaggactaacagctttcttccttggtctgtttacgctagggaaaaagagagaacaataa

SEQ ID NO: 430 - DNA (genomic), 1968 bp, Streptococcus pneumoniae; double-stranded, circular
  misc_feature (B) LOCATION 1...1968
  hypothetical: NO
  anti-sense: NO
agactatctgctacagcaggtcttgttttattagcagcaggtgtacttgcagcatgcagttcttcaaaatcatctgattcatcagcccctaaagcttatggctatgtttatacagcagacccagaaaccttggactacctgatttcaagtaaaaatagtacaacagtagtgacttcaaatgggattgatggtttattcactaacgataattacggtaatcttgctcctgcagttgcagaggattgggaagtctctaaggatggtttgacctacacttataagattcgtaaaggggttaaatggtttacctctgatggagaagaatatgcagaggtgacggctaaagatttcgtgaacggtttaaaacacgcagcagataaaaaatcagaagctatgtatttagctgaaaattcggttaaaggcttggcagattatctatcaggaacttcaacagatttttcaacagttggtgtcaaggcggttgatgattatacgttacaatacactttgaaccagcctgaaccgttctggaactctaagttgacctattctattttctggcctctgaatgaagaattcgaaacatcaaaaggaagcgattttgctaaaccaacagatccgacatccttgctttataatggtccattcttgttgaaagggttgactgcaaaatcttctgtagagtttgtaaaaaatgagcaatattgggataaagaaaatgtccacctagatactatcaatctagcttactatgatggatcagatcaggagtcgctagagcgtaacttcactagtggagcttatagttatgcccgtctttaccctaccagctccaactattctaaggttgcagaagaatacaaggacaatatctattacacacaatcaggctctgggattgctggtctgggtgtgaatattgatcgccaaagttacaactatacttctaaaactacagattcagagaaagtagctactaagaaggcattgcttaacaaagatttccgtcaagccttgaattttgctcttgatcgctcagcttactcagctcaaatcaatggtaaagatggagcagctttagcagttcgtaatttatttgtaaaaccagactttgtttcagctggtgagaagacctttggtgatttagtcgctgctcaacttcctgcttatggtgatgagtggaaaggtgtgaatttagctgatgggcaggatggtttattcaatgctgacaaggccaaggcagagtttgcgaaagctaagaaagctttagaagcagacggcgttcagtttcctattcatctggacgttccagtagaccaagcatcaaaaaactacatatctcgtattcagtcctttaaacaatctgtagaaacagttcttggtgttgaaaatgtcgttgttgatattcaacaaatgacaagtgatgaattccttaatattacttactatgctgccaatgcttcatctgaggattgggatgtatcaggaggagtttcatggggtccagactatcaagacccatctacttacctggatattttaaaaacaactagcagtgaaactacaaaaacatatttaggatttgataatccaaatagcccttcagtagttcaagttggtttgaaagaatacgataaattagttgatgaagctgccagagagacaagcgacttgaatgtccgttatgaaaaatatgcagcggctcaagcatggttgacagatagttcactctttattcctgctatggcttcttctggtgcagcaccagtgctttcacgaattgttccatttactggagcttctgcgcaaacaggctctaaggggtcagatgtttacttcaaatatttgaaattacaagataaagtggtgactaaggaagagtatgaaaaagctcgtgaaaaatggttgaaagaaaaagctgaatcaaatgagaaagctcaaaaagaattggcaagtcatgtgaagtaa

SEQ ID NO: 431 - DNA (genomic), 807 bp, Streptococcus pneumoniae; double-stranded, circular
  misc_feature (B) LOCATION 1...807
  hypothetical: NO
  anti-sense: NO
atgacttatttacccgttgctttgaccattgcagggactgaccctagtggtggtgctggcattatggcagatttaaagtcattccaagcgagagatgtctatggaatggctgttgtaaccagtcttgtcgctcaaaataccagaggtgttcagctaatcgagcacgtttctcctcaaatgttgaaagcccaattggagagtgtcttttctgatattccacctcaggctgtaaaaactggaatgttggctactactgaaatcatggaaatcatccaaccctatcttaaaaaactggattgtccctatgtccttgatcctgttatggttgctacaagtggagatgccttgattgactcaaatgctagagactatctcaaaacaaacttactacctctagcaactattattacgccaaatcttcctgaagcagaagagattgttggtttttcaatccatgaccccgaagacatgcagcgtgctggtcgcctgattttaaaagaatttggtcctcagtctgtggttatcaaaggcggacatctcaaaggcggacatctcaaaggtggtgctaaagatttcctctttaccaagaatgaacaatttgtctgggaaagcccacgaattcaaacctgtcacacccatggtactggatgtacctttgctgcagtgattactgctgaactagccaagggcaagagtctttaccaggcagttgataaggccaaggcctttatcacaaaagctattcaagatgcccctcaactcggtcatggttctggtccagtcaaccatacaacttttaaagattaa

SEQ ID NO: 432 - DNA (genomic), 927 bp, Streptococcus pneumoniae; double-stranded, circular
  misc_feature (B) LOCATION 1...927
  hypothetical: NO
  anti-sense: NO
agacgacctgcaactggccatggccatgcaggacctgcacctccacggcgccgagctggggcagtcgcacctgcaggcgcgccgcatggctttcggctgcgctggcgacctggatgcgcccctgcacggcatctagcaggcgcgcgagatcggccagcggcagtggccggctcccgctcgatgccagcaggcgtgccagcaggcggtcgccgggggtttgcatggcaggcaatggcacaggcgcttggtcgtcggggggcagtgcggatggatcggtttctccgggttgccgacgctcctctccgcggccttcgccgcccgctgtcggcgcgggcggcgagacctggacactggcctgcgccgtggacgcgacctcggctgcggttttcgccgggaagccggggccgggctgtggccgctcatgcgtccgacctgcgatttgcgggtgggaggacaccggcaccagcggcggttcgtcgaccggaggcgccgaaacgctggccggctcccgggcttgcgtggacgccgcgacgcgcgcggaaaccgccggcgcttgccgtgctaccgatccggacggcaacactgttggcgttggcgttggcgttggcgttggcgttggcgttggcgttggcgttggcgttgcttccgcggcaactggcacgggggcttgccnattggtcggcggccggtcggcggcaggcgccgcgggctggtcggcgagaggcgtcgaggtcggcgcgtcgctgttcgcggcgggctcttcggcctctgtcgtttcgtcgcccttgtcgaacggtggcctgggcgccggcggtcggtgcgcgggcagggcctgttcgaaggcgatctgctgcgcgcgcagcggcggaaggggggcaggggtgtcggacgacacgagcggagccgtatccacggcgttcagcttga

SEQ ID NO: 433 - DNA (genomic), 207 bp, Streptococcus pneumoniae; double-stranded, circular
  misc_feature (B) LOCATION 1...207
  hypothetical: NO
  anti-sense: NO
actattactgcgggccaaatcggtaagtaccaacttgaagaaataaagacaatcgtcaaaagaaattctaatacaatatctttcttaaccgaaacatccagttttttagatagaattagttctgctattacgctacgtaaagctagcaaaacaactatcgatacaacagtcagctctaaactatttaataatagagtagttatttag

SEQ ID NO: 434 - DNA (genomic), 909 bp, Streptococcus pneumoniae; double-stranded, circular
  misc_feature (B) LOCATION 1...909
  hypothetical: NO
  anti-sense: NO
gaactaactgctgattcgcccctttttatggtaaaaacaatgaccattgcaacgattgatatcggagggactgggattaagtttgccagtctgactcctgatgggaaaatactgtataagacaagtatttcaacgcctgaaaacttggaggatttactagcgtggctagatcaacgcttgtcagaacaggattacagtgggattgctatgagcgttccaggtgcggtcaatcaagagacaggtgtgattgatggcttcagtgcggtgccctacatccatggcttttcttggtatgaggcgcttagctcttatcagctacctgtccatttagaaaatgatgccaactgcgttggactcagtgaactactagctcatccagatcttgaaaatgcagcctgtgtcgtgattgggacagggattggcggagccatgattatcaatggtagacttcatcgaggtcgccacggtctgggtggagaatttggctacatgacaacccttgcccctgctgaaaaacttaataactggtcgcaactagcatcaactgggaatatggtacgatacgtgattgaaaaatctggtcatactgattgggacggtcgcaagatttaccaagaggccgcagctggtaatgctctttgtcaagaagccattgagcgcatgaaccgcaatctggcgcaaggcttgctcaatatccagtatctcatcgatccagatgtcatcagtctgggtggctctatcagtcaaaatccagattttatccaagatgtcaagaaggctgttgataactttgtcgatacctacgaagaatacacggtcgcaccagttatccagacctgcacctatcacgcagatgccaatctctacggtgcccttgtcaactggctacaggaggaaaagcaatggtaa

SEQ ID NO: 435 - DNA (genomic), 204 bp, Streptococcus pneumoniae; double-stranded, circular
  misc_feature (B) LOCATION 1...204
  hypothetical: NO
  anti-sense: NO
cgaacaactgcacggatggcagcgttcataccaggtgcgtctccgccactagtcaagacagcaatacgtttcatattggtttatgctcctttttcttttaacattcttcttgattatatcacatttgattttaaaattcttctattttccgtatttttagcgataaatcgttttcataacgatttcattcaatttctcctctaa

SEQ ID NO: 436 - DNA (genomic), 2385 bp, Streptococcus pneumoniae; double-stranded, circular
  misc_feature (B) LOCATION 1...2385
  hypothetical: NO
  anti-sense: NO
ggcaagactgcgcgtcaccataccatgtttgaaatgttggggaacttctctatcggggattacttccgtgacgaagctatcacttgggcttatgagcttttgacaagccctgaatggtttgatttccctgctgaaaaactttacatgacctactatccagacgataaagattcttacaaccgctggattgaagtgggagtggatccaagtcacttgattccaattgaggacaacttctgggaaatcggtgcgggaccttctggaccagatacagaaatcttctttgaccgtggggaagcctttgacccagaaaatatcggtcttcgcctgcttgcagaagatattgaaaacgaccgttatattgaaatctggaacatcgttttgtcacaatttaacgcagaccctgctgttcctcgtagcgaatacaaggaattgccacataagaacattgatacgggcgctggtttggagcgtttggtggccgttatccaaggggctaagaccaactttgaaacggacctcttcatgccgattatccgtgaagtcgagaaattgtctggtaaggtttatgaccaagatggcgacaacatgagcttcaaggttatcgcagaccacattcgttctctttcatttgctatcggtgatggtgcccttccaggaaatgaaggtcgtggttatgttcttcgtcgtcttctccgtcgtgcttctatgcatggtcaaaaattgggtatcaacgagcctttcctttacaaactcgttccaactgttggaaaaatcatggaaagctactacccagaagtgcttgagaaacgtgactttattgagaaaatcgttaagagcgaagaagaatcatttgcccgtacccttcactcaggtcaacactttgcccaaggaattgtggcagacttgaaagaaaaaggtcaatctgtcattgctggtcaagatgtctttaaactctatgatacatacggattcccagttgaattgactgaagaaattgctgaagaagctggtatgactgtagaccgtgaaggttttgaagcagccatgaaagaacagcaagaacgcgcgcgtgcgtcagctgtcaagggtggctcaatgggtatgcaaaatgaaactcttcaaaacatcactgtagaaagtgtcttcaactacaatgctagccaattgtcttctaaattggtagctatcgttgctgacaatgcagaagtaggagctgtttcagaaggaactgcctctcttatctttgcggaaacgtcattttatgctgaaatgggtggacaggtagctgactacggacaaatcttggatgagtcaggtaaggttgtggctactgtgaccaatgttcagaaagccccaaatggtcaagcccttcatacagttgaagtccttgcaccgcttgccttgaaccaagaatataccttggcaattgatagcaatcgccgtcaccgtgtcatgaaaaaccacactgcgactcatttgcttcacgctgcccttcacaatatccttggaaaccacgcaacacaggcaggatctcttaacgaagttgaattccttcgctttgactttacccacttccaagcagtaactgctgaggaacttcgtgcgattgaacagcaagttaacgagaaaatttgggaagcacttgaagtgaagacagttgaaacggatattgacactgctaaagaaatgggagcgatggccctctttggtgagaaatacggcaaggaagttcgtgtcgtgactatcggtgactactctattgaactttgtggtggtactcatgttggcaacacttctgagattggtctcttcaaaattgtcaaagaagaaggaatcggttcaggaactcgccgtatcttggcagtgactggtaaggaagcctttgaagcctatcgtgaacaagaggatgctcttaaagctgtcgcagcaaccttgaaagcacctcaagtcaaggaagtacctcacaaggtagaaggacttcaagaacaacttcgtcaacttcaaaaagaaaatgctgagttgaaagaaaaagccgcagctgcagccgcaggtgatatcttcaaagatgttaaggaagtcaacggtcatcgttacattgctagtcaagtgtctgtatccgatgccggtgcccttcgtacttttgcagataactggaaacaaaaagactactctgatcttcttgtcctagttgccgctatcggtgacaaagtcaatgtccttgtagcaagcaagacaaaagaccttcatgcaggaaaccttgtcaaagaattagcaccaatcatcgatggacgtggtggtggtaaaccagacatggccatggcaggaggaagcaaccaagctaagatccaagaattgttggatgcagtagcaggtaaattgtaa

SEQ ID NO: 437 - DNA (genomic), 930 bp, Streptococcus pneumoniae; double-stranded, circular
  misc_feature (B) LOCATION 1...930
  hypothetical: NO
  anti-sense: NO
tataattattttatgattattactattcctataaaaaaccaaaaagatattggcacaccatctgattcagtcgttgttctcggctattttgatggcatacataaggggcatcaagaattatttcgtgttgccaacaaggctgcgagaaaggatttattacctatcgtcgttatgacctttaatgaatctccaaagatcgctttagagccttatcatccagatttgtttttgcatattttgaaccctgctgaacgtgaaagaaaattaaagcgcgaaggtgtagaagaattatatctccttgattttagtagtcaattcgctagtctcactgcacaagaattctttgcaacttatatcaaggctatgaatgccaaaattattgttgcaggttttgattatacatttggttctgacaaaaaaacagcagaagatttaaaggattactttgatggagaagttatcattgttccacctgtagaagatgagaaaggaaagattagttcaactcgtatccgtcaagctattttagatggaaatgtgaaagaagcaggaaaacttttgggggcaccgcttccatcaagaggtatggtggttcatggtaatgctcgtggtcgtacaattggttatccgacagcgaatttagtgcttttagaccgtacttatatgccagcagatggcgtttatgtcgttgatgttgagattcaaagacagaagtatcgtgctatggctagtgtcgggaaaaatgtgacctttgatggagaagaagcacgttttgaagtcaatatttttgattttaatcaagatatttatggggaaaccgtcatggtttattggcttgatcgcattcgtgatatgaccaaatttgactcagttgaccaattagtggatcagttaaaggctgatgaagaagtaactcggaattggtcttaa

SEQ ID NO: 438 - DNA (genomic), 603 bp, Streptococcus pneumoniae; double-stranded, circular
  misc_feature (B) LOCATION 1...603
  hypothetical: NO
  anti-sense: NO
gtcaattatttgaataaaatggaaaggaatatcaatatgaaaaaatggcaaacatgtgttcttggagcaggttcgctcctttgtttgacggcttgttcaggcaagtccgtgactagtgaacaccaaacgaaagatgaaatgaagacggagcagacagctagtaaaacaagcgcagctaaagggaaagaggtggctgattttgaattgatgggagtagatggcaagacctaccgtttatctgattacaagggcaagaaagtctatctcaaattctgggcttcttggtgttccatctgtctggctagtcttccagatacggatgagattgctaaagaagctggtgatgactatgtggtcttgacagtagtgtcaccaggacataagggagagcaatctgaagcggactttaagaattggtataagggattggattataaaaatctcccagtcctagttgacccatcaggcaaacttttggaaacttatggtgtccgttcttacccaacccaagcctttatagacaaagaaggcaagctggtcaaaacacatccaggattcatggaaaaagatgcaattttgcaaactttgaaggaattagcctag

SEQ ID NO: 439 - DNA (genomic), 192 bp, Streptococcus pneumoniae; double-stranded, circular
  misc_feature (B) LOCATION 1...192
  hypothetical: NO
  anti-sense: NO
aacttttatgcgaagagtttgggcataaacttttacctcttcctccctactcacctgagtacaatcctattgagaaaacatgggcccatatcaaaaagcacctcaaaaaggtattaccaagttgttgcaataccttttacgaggctcttttgtcctgctcttgtttcaattgactatagcagattgaaataa

SEQ ID NO: 440 - DNA (genomic), 234 bp, Streptococcus pneumoniae; double-stranded, circular
  misc_feature (B) LOCATION 1...234
  hypothetical: NO
  anti-sense: NO
aacttttatgcgaggagtttgggcataaacttttatctcttcctccctactcacctgagtacaatcctattgagaaaacatgggctcatatcaaaaagcacctcaaaaaggtattaccaagttgcaataccttttatgaggctcttttgtcctgctcttgtttcaattgactatagttcacggatacagttgggaaagaagctattaaatatttggagagtccttttgggatga

SEQ ID NO: 441 - DNA (genomic), 708 bp, Streptococcus pneumoniae; double-stranded, circular
  misc_feature (B) LOCATION 1...708
  hypothetical: NO
  anti-sense: NO
atgatttatgcaggaattcttgccggtggaactggcacacgcatgggaatcagtaacttgccaaaacaatttttagagctaggtgatcgacctattttgattcatacaattgaaaaatttgtcttggaaccaagtattgaaaaaattgtagttggggttcatggagactgggttttacatgcagaagatcttgtagataaatatcttcctcttcataaggaacgtattatcattacaaagggtggtgctgaccgcaatacaagtattgagaacatcattgaagccattgatgcttatcgcccgcttactccagaggatatcgttgttacccacgattctgttcgtccatttattacgcttcgcatgattcaagacagtatcaaacttgctcaaaatcatgacgcagtggatacagtagtagaagcagtggatactatcgttgaaagtaccaatggtcaattcattacaggtattccaaatcgtgctcacctctatcagggacaaacacctcaaacattccgttgcaaggacttcatggacctttatggatctctttctgatgaagagaaggaaatcttgacagatgcatgtaaaatctttgtgatcaaaggaaaagatgtagccttggccaaaggcgaatactcaaatctgaagattacaaccgtaacagatttgaagattgcaaaaagtatgattgagaaagactag

SEQ ID NO: 442 - DNA (genomic), 1023 bp, Streptococcus pneumoniae; double-stranded, circular
  misc_feature (B) LOCATION 1...1023
  hypothetical: NO
  anti-sense: NO
gaaatgcatgcaaaaatgcgaaataaaacacaaatacacctaggcataatttttgtaatctgcctaggtcttcttattacaatatttttgtcattaaagcttggaacaaaagaaattaatatcagagattttttagcagcttttggaatgggcaatacaaatgatgattttattaaatcaattatatataaaagaatacctagaactatttttgcaattttagcaggttctagtcttgccataagcggtgtattgatgcaatcagttactagaaacccaatagctgatccaggtatactcggtataaacacaggagcaagtcttagtgtagtaattggtctttcttttttaggaatttcatcaagcataagccatataagttttgcaatcattggtggcttagtaagtgtaatttttgtatacgcgattgctgtaagcggaaaagcaggccttacccctataaaactagccttatcaggaacttgtgttagtatggctttaagcagttttgtaagttttttaattttaccgaataataacgtcttagacaaatttagattttggcaaataggtagccttggagcagctacattatcttctatatctacactactaccttttataattttaggtcacttgatagctatatttatttcatcagatttaaacgctttagctatgggtgatgaaatggctgttggtcttggagttaatgttaataggataagatcacttgcaataattgcaagtgtgcttttatgttcaagtattactgcaattggtggacctattggcttcgtaggtcttatagttcctcacttttgtggcttatttataagcaaagatatacgcacaatgaccatttcttcatcttttataggtgcagagctcttgcttatatgtgatataatcggccgtatgttaggtaaaccaggtgaaattgaagtagggataattactgcaataatcgggggtccagtacttatttatgtaactatgaaaaatagaggggttaataactaa

SEQ ID NO: 443 - DNA (genomic), 543 bp, Streptococcus pneumoniae; double-stranded, circular
  misc_feature (B) LOCATION 1...543
  hypothetical: NO
  anti-sense: NO
tcgcatgatgctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagtaacatatatacggcaaggcgaagctgacgtggtttga

SEQ ID NO: 444 - DNA (genomic), 303 bp, Streptococcus pneumoniae; double-stranded, circular
  misc_feature (B) LOCATION 1...303
  hypothetical: NO
  anti-sense: NO
ccgctcgatgcaggacaacgatttagatatggagtttccattatcccagacgactacgacccaatcgcttatgtcgtcagcaagtccatggagccaaagataagaaacagcgactacctatttatcaagaataccccacagattgactataataccatcggcatcttccaagtagacggcgctaactatgtcaagaaactccgccaaggctaccttaaaaaaactcaatcccaaataccccgacatccacctagacgaaagcaaccatattcgtaccatcgggaaagttgtcaggctatatag

SEQ ID NO: 445 - DNA (genomic), 756 bp, Streptococcus pneumoniae; double-stranded, circular
  misc_feature (B) LOCATION 1...756
  hypothetical: NO
  anti-sense: NO
aaatactgtgcgttcgtacctttatggtgtttcgatttgtgcntggagaattacgcactcgaaatggaagatttattcgaatacataggatatttattagacaattttagacgtaatactgtcaatttgcgactacatggagtaaataactatctgccttttattggtcatgatgatttgaaattaaaatttgtcaaagtacatcaaaaaccgtttttagaagatgtcattagccatgctgattacctttttcttaaacgtagtttgaaaaaagatggtattttaaaaaggcattttgtcgtttggtttttaggtgcaactggggctcgtgtaagtgaacttattaaactaaaagtagagcatgtagaaatcggttattttgacatttactcaaaaggtggtaaaattcgtagactgtacattcctaaaaaattaagaaatagttgtcttagttggttagaatcagaaaatcgccgaagtggttatttatttttgaataaatttaacgaaccaattacagcaagaggagttgctcaacagttaaaaaattatgctgataaatacaaaatgaatcctaaagtaatttaccctcattcttttaggcatttatttgctaagaattttttagcgaagtataatgatattgccttgcttgcagatttgatgggacacgaaagtatagaaactactcgaatttatctaaggaaaacagctactgaacaacaaaatattgtagataaaattgttaattggtaa

SEQ ID NO: 446 - DNA (genomic), 450 bp, Streptococcus pneumoniae; double-stranded, circular
  misc_feature (B) LOCATION 1...450
  hypothetical: NO
  anti-sense: NO
aagatctatttgacgaggacttcctcaatgactagtccactattagaatctagacgccaactccgtaaatgcgcttttcaagctctcatgagccttgagttcggtacggatgtcgaaactgcttgtcgtttcgcctatactcatgatcgtgaatatacggatgtacaacttccagcctttttgatagacctcgtttctggtgttcaagctaaaaaggaagaactagataagcaaatcactcagcatttaaaagcaggttggaccattgaacgcttaacgctcgtggagagaaacctccttcgcttgggagtctttgaaatcacttcatttgacactcctcagctggttgctgttaatgaagctatcgagcttgcaaaggacttctccgatcaaaaatctgcccgttttatcaatggactgctcagccagtttgtaacagaagaacaataa

SEQ ID NO: 447 - DNA (genomic), 849 bp, Streptococcus pneumoniae; double-stranded, circular
  misc_feature (B) LOCATION 1...849
  hypothetical: NO
  anti-sense: NO
atgatattcgctacgagtcaggtgaatccattgaccaactcttccgtcaggaatttaaggcctaagcaaaggagattatttatgttttggaatttagttcactacgaatttaaaaatgttaacaagtggtatttagccctctacgcagccgtgctagtcctttctgccctcatcggaatacagacacaaggctttaaaaatctaccttaccaagaaagtcaggctactatgctactttttctagctacagtctttggtggcttgatgcttacacttgcgatttcaaccattttcttgattattaaacgcttcaaaggtagtgtctacgaccgacaaggctatctgactttgaccttgccagtttctgaacaccatatcatcacagccaaactaatcggtgcctttatctggtcattgattagcaccgctgtattggctctaagtgctgttattattctggctttaacagctccagaatggattcctctttcttatgtgattacatttgtagaaacacatctccctcagatctttcttacaggtatatccttcctactaaataccatttcaggaatcctctgcatctacctggctatttccattggacagcttttcaatgaataccgtacagcactcgctgttgcagcctacattggtatccaaatcgtcattggatttattgaacttttcttcaatcttagttctaatttctatgtcaattcactggtaggactcaatgaccatttctatatgggagcaggtatagccattgttaaagaactcatattcatagctatcttttatctcggaacctactacatcttgagaaataaggttaatttgctttaa

SEQ ID NO: 448 - DNA (genomic), 273 bp, Streptococcus pneumoniae; double-stranded, circular
  misc_feature (B) LOCATION 1...273
  hypothetical: NO
  anti-sense: NO
gattgcctcgcaacgacattgctggacaacctctgctattttagaatcaatttcctgaaggtgatagccgatattctccaaggtgaaaatcagctcctcaaacaagttctccatggtaaattgatgattgggattttgaaagagaatgccaaccttctggacacgtgcgatgatagaaagctgactgacctcgctcccatctatcaggacttgaccactatagggaagagaactgacttgggcaatgacttgaaaaaggctggattttcctga

SEQ ID NO: 449 - DNA (genomic), 378 bp, Streptococcus pneumoniae; double-stranded, circular
  misc_feature (B) LOCATION 1...378
  hypothetical: NO
  anti-sense: NO
aaatcaatcgccctaaaaaaacaattagcgaatcattctggtaaaaagaaatttcacgctatgaaggctcaagcgattgtcacaagtcaagggagaattgtttctttggatatcactgtgaactattgtcatgatatgaagttgttcaaaatgagttgcagaaatatcggacaagctggtaaaatcttggctgacagtggttatcaagggctcatgaagatatatcctcaagcacaaactccacgtaaatccagcaaactcaagccgctaacagctgaagataaggcttataaccatgcgctatctaaggagagaagcaaggttgagaacatctttgccaaagtaaaaacgtttaaaatgttttcaacaacctattga

SEQ ID NO: 450 - DNA (genomic), 450 bp, Streptococcus pneumoniae; double-stranded, circular
  misc_feature (B) LOCATION 1...450
  hypothetical: NO
  anti-sense: NO
aaatcaatcgccctaaaaaaacaattagcgaatgattttggtaaaaagaaatttcacgctatgaaggctcaagcgattgtcacaagtcaagggagaattgtttctttggatatcgctgtgaactattgtcatgatatgaagttgttcaaaatgagtcgcagaaatatcggacaagctggtaaaatcttggctgacagtggttatcaagggcccatgaagatatatcctcaagcacaaactccacgtaaatccagcaaactcaagccgctaacagttgaagataaagcctgtaaccatgcgctatctaaggagagaagcaaggttgagaatatttttgccaaagtaaaaacgtttaaaatgttttcaacaacctatcgaaatcatcgtaaacgcttcggattacgaatgaatttgattgctggcattatcaatcatgaactaggattctag

SEQ ID NO: 451 - DNA (genomic), 450 bp, Streptococcus pneumoniae; double-stranded, circular
  misc_feature (B) LOCATION 1...450
  hypothetical: NO
  anti-sense: NO
aaatcaatcgccctaaaaaaagaattagcgaattattctggtaaaaagaaatgctacgctatgaaggctcaagcgattgtcacaagtcaagggagaattgtttctttggatatcactgtgaactattgtcatgatatgaagttgttcaaaatgagtcgcagaaatatcggacaagctggtaaaatcttggctgacagtggttatcaagggctcatgaagatatatcctcaagcacaaactccacgtaaatccagcaaattcaagccgctaacagttgaagataaaacctataaccatgcgctatctaaggagagaagcaaggttgagaacatctttgccaaagtagaaacgtttaaaatgttttcaacaacctatcgaaatcatcgtaaacgattcggattacgaatgaatttgattgctggtattatcaatcatgaactaggattctag

SEQ ID NO: 452 - DNA (genomic), 969 bp, Streptococcus pneumoniae; double-stranded, circular
  misc_feature (B) LOCATION 1...969
  hypothetical: NO
  anti-sense: NO
attatggtcgcaaaactaactgatgtcgccaaacttgcaggcgtcagtcctactaccgtttctcgggttatcaataaaaaagggtatctatctgagaaaaccatccaaaaagtcaatgaagccatgcgagaattgggctataaacccaacaacctggctcgtagtctgcaaggaaaatcagctaagttaatcggcttgattttccccaatatttccaatgttttctatgcagaattgattgataaattggaacaccaactcttcaaaaatggttacaagaccatcatctgcaacagtgaacatgattctgagaaggaacgtgaatacatcgaaatgttggaagccaatcaggtggacggcatcatttctggtagtcacaacctaggaatcgaagactacaatcgtgtgacagcgccgattatttcctttgaccgaaacctatcgccagacatccctgtcgtctcctctgacaactatgctggtggggttcttgctgcccaaaccttggtcaagacaggtgcccagtctatcatcatgattacagggaatgacaattccaattcgccaaccggactgcgccacgctggttttgcatccgtactcccaaaagctcctattatcaatgtttccagtgacttttctcccgtcagaaaagaaatggaaatcaagaatatcttgacccgggaaaaaccagatgccatttttgcttcggatgatttgacagctattctggtcattaaaatcgctcaagaattgggcatttctgtcccaaaagagctcaaggtcatcggctatgatgggacctactttatcgaaaattactaccctcaattggctactatcaagcaacctttggaagagattgcttgtctcactattgatcttctcttgcaaaagattgaaggcaaggaagtcgccacaactggttacttcttaccagttacgctattaccaggaaaaagtatttaa

SEQ ID NO: 453 - DNA (genomic), 993 bp, Streptococcus pneumoniae; double-stranded, circular
  misc_feature (B) LOCATION 1...993
  hypothetical: NO
  anti-sense: NO
gtcgcggtcgccataccactcgagctgttagtttttacaatctcaacgggggtaaaatcgcagatacaccaggattttcatccttggactatgaagtatcaagggctgaagacctcaatcaggctttcccagagattgctactgttagccgagattgtaagttccgtacttgtacccatacccatgagccgtcttgtgccgtcaaaccagctgttgaagagggtgttattgcaaccttccgttttgacaattacctgcaattccttagtgaaattgaaaatcgtagagaaacctataaaaaagtcagcaaaaaaattccaaaataaggagaaacctatgtctcaatacaagattgctccgtcaattctggcagcagattatgccaactttgaacgtgaaatcaaacgtctagaagcaactggggcagaatatgcccatatcgatatcatggacagtcattttgtaccgcaaatcagttttggtgcaggtgtggtcgagagccttcgtcctcatagtaagatggttttcgattgccacttgatggtgtcaaaccctgagcatcatctggaagattttgcgcgtgcaggtgcagacatcatcagtatccatgtagaagcaacacctcatattcatggcgccctccaaaaaattcgttcactcggagttaagccttcagtcgttatcaatcctggcacaccagttgaagccatcaagcacgtccttcatctagttgaccaagttttagtcatgacggttaatccaggttttggtgggcaagcctttctgccagaaaccatggataaggttcgtgagttggttgctcttcgtgaggaaaaaggtttgaactttgaaatcgaagtggatggtgggattgatgaccaaactattgctcaagccaaagaagctggtgcgactgtttttgtagcaggttcctatgtctttaagggagaagtcaatgagcgagtacaaactctcagaaaacaactggactag

SEQ ID NO: 454 - DNA (genomic), 513 bp, Streptococcus pneumoniae; double-stranded, circular
  misc_feature (B) LOCATION 1...513
  hypothetical: NO
  anti-sense: NO
accaactattttgggaggaagaagatgaaaaatagattttattattatcaattactagacgaaagagaagaacaactgttcaataaagcgggctctgaaagtttctatatctgcatcgctttgtcgctcctatcttatatcatttcagtattagcaccaagcctttttaattctaatatgctgctaatcgttatcatcatagggacattttactttttcaatcgtgcccgttatctgggagtgacctactatagtcgttttcattttacgattttgggttgttttttcctaaccttggctattacggctcttttgatgttgcagaattatcaattcaacatagaaatttatcagcacaatcctttgaattttaaatacctgtctgcttgggtcattacttatgtcatttaccttccgtgggtctttattggcaatcttggtcttaagagctatggcgaatgggctcagaaaaaatttgaacaagatatggatgaattggagagtggagaatag

SEQ ID NO: 455 - DNA (genomic), 183 bp, Streptococcus pneumoniae; double-stranded, circular
  misc_feature (B) LOCATION 1...183
  hypothetical: NO
  anti-sense: NO
tttatccccgccaccctttttcattttatactcttcgaaaatctcttcaaaccncacggtcagctgttatcttccacacctacaatagtgtgtgctgttgagacaacctgtggggctagacttccgctgtgtttgacacttgtgatgtttctattgactattagcgattgtcactgtaaataa

SEQ ID NO: 456 - DNA (genomic), 198 bp, Streptococcus pneumoniae; double-stranded, circular
  misc_feature (B) LOCATION 1...198
  hypothetical: NO
  anti-sense: NO
ggtggcaccgcgttaccaacgccctcacacggaagtatattctgtgtgtgggcttttttctatccgtcgtttgctttatcttttattagggccttaagtcgctttgatgaacttgagttctatctacagctcttgcctcctactaaaagtaaacaaaaaggctggactaatacgaaaaaagctagtaatactcaatga

SEQ ID NO: 457 - DNA (genomic), 507 bp, Streptococcus pneumoniae; double-stranded, circular
  misc_feature (B) LOCATION 1...507
  hypothetical: NO
  anti-sense: NO
aaatcttacgccaaggcgcaattaaacgagaagatattcttgctcggttgccagagatttcttttgaggaggcttgaaatgctaagagatttgcaagaaacagatgtgaaagcgatatgtgacatcaaccaagagactttgggttatacttttagtccagaggaaacggctagccaactagctagactgtctcaggattcccatcatttcctacttggctatgaggatgcagctaatcatgtcttacttggatatgtccacgctgaagtttacgaatcactctattccaaagcaggatttaatatcttagctttagcagtttcacctcaagcgcaaggtcaaggtatcggtaaaagtttactacaagggttggaacaagaagccaaaagatgtggttatgggtttatccgcttaaattctgccaatcatcgtctgggtgctcatgcattttatgaaaaagttggctatacttgtgataaaatgcagaaacggtttattcgcatcttt

SEQ ID NO: 458 - DNA (genomic), 399 bp, Streptococcus pneumoniae; double-stranded, circular
  misc_feature (B) LOCATION 1...399
  hypothetical: NO
  anti-sense: NO
gaaaactacgccaaccaagtcgcagcaaaccgcttcgtgattttattgaagactaagagtgaggaaaatatggcttatacagaagagcaaattgaaaacatcaaaacacggattttaacagccttggaagaagtcatcgaccctgagttgggaatcgatattgtcaatcttggtttgatctatgagattcgttttgacggtgacacagggcaaacagagattgacatgactttgacaactatgggttgtcccttagcagaccttttgacagaccagatttatgatgctatgatagaggttccagaagtaacggatactgaggttaaattagtctggtatccagcatggacagttgaaaaaatgagtcggtatgcccgcattgccataggcattaagtaa

SEQ ID NO: 459 - DNA (genomic), 333 bp, Streptococcus pneumoniae; double-stranded, circular
  misc_feature (B) LOCATION 1...333
  hypothetical: NO
  anti-sense: NO
atgaaaaacgctcttgtttttcaccaaaatacttttccattattcctccttgaaataaaatttatatatgttacaaagacctttattatattagtgtattatctattatctatagaaaaggcagtataccttaattatactcttaatttacaaaaaagtcttaaaattgagatgcgctttcatactttgttttatattatttgggggtacaataacacctaccatgaaatttacacggtaggtgttactcatatcactaatcgttctaaaaatggtttgaggcagttgaggagaattccttctatccagcttccttgtgctgatgagcgatag

SEQ ID NO: 460 - DNA (genomic), 1005 bp, Streptococcus pneumoniae; double-stranded, circular
  misc_feature (B) LOCATION 1...1005
  hypothetical: NO
  anti-sense: NO
ataccttgcgccaccgtgtcattgccattgaaaatggccgtgtcgttcgtgacgaatcaaaaggagagtatggatacgatgattagtagattttttcgccatttatttgaagccttaaaaagtttgaaacgaaatggttggatgacagtagctgctgtcagttcagtcatgattactttgaccttggtggcaatatttgcatctgttattttcaatacagcgaaactagctacagatattgaaaataatgtccgtgtagtagtttatatccgaaaggatgtggaagataatagtcagacaattgaaaaagaaggtcaaactgttacaaataatgactaccacaaggtatatgattctttgaagaacatgtctacggttaaaagtgttaccttttcaagtaaagaagaacaatatgaaaaattaaccgagataatgggagataactggaaaatctttgaaggagatgccaatcctctctatgatgcctatattgtagaggcaaacactccaaatgatgtaaaaactatagccgaagatgctaaaaaaattgaaggtgtctctgaggttcaagatggcggtgccaatacagaaagactcttcaagttagcttcatttatccgtgtttggggactagggattgctgctttgttaatttttatcgcagttttcttgatttcaaataccattcgtattaccattatttcccgcagtcgcgaaattcaaatcatgcgcttggtcggagctaaaaacagttatatccgtggaccgttcttgttagaaggagcctttatcggtttattgggagctatcgcaccatctgttttggtctttattgtttatcaaattgtttaccaatctgtcaacaaatcgttggtagggcaaaatctatccatgattagtccagatttatttagtccgttgatgattgccctactatttgtgattggggttttcattggttcattgggatcaggaatatccatgcgccgattcttgaagatttag

SEQ ID NO: 461 - DNA (genomic), 369 bp, Streptococcus pneumoniae; double-stranded, circular
  misc_feature (B) LOCATION 1...369
  hypothetical: NO
  anti-sense: NO
tcccgttgcgccgcctggcgctcggtgtgttcctgcgccgcggcgcgaacccgtagcaattggcggccctgggcgcgctcggcccggtccaggcgcaggcgtcggacgcgcaacagcagcgccaggctcatgcgcagaggctccgcaactgcgcgcaggcctgtgcgtaatcgctggtttcgtgggtaccctggcgcagccactggcggatcgccgcgatcttctcgatggcctggtcggcttcgctgtcctggcctttctggtattcgccgatcttcagcagcaactcgacttcctcgtacttcgccagccattcgcgcaagcgtccggccgcatggcgctgatcgtcgtcgacgatctggttcatga

SEQ ID NO: 462 - DNA (genomic), 477 bp, Streptococcus pneumoniae; double-stranded, circular
  misc_feature (B) LOCATION 1...477
  hypothetical: NO
  anti-sense: NO
tctgggttagcgaagaaccccttactcttgcaactgatttttatctattatgtgctcccaagtattgggattcgtttagaccgccttcctgcagctattattgcctttgttctcaactatgcagcttactttgcagaaattttccgtgggggaattgacactattccaagaggacagtatgaggccgccaaggtcttgaagtttagcccttttgacagagtgcgctatattatcttgccccaagtgaccaagatcgttcttcctagtgtctttaatgaagttatgagtttggtcaaggatacttctttggtctatgctctcggaatttcagaccttatcttggctagtcgaacagctgctaaccgcgatgctagtctagttcctatgttcttggcaggagccatttatttgattttgattgggattgtgacaattatttccaaaaaagttgagaagaagtatagttattatagatag

SEQ ID NO: 463 - DNA (genomic), 1569 bp, Streptococcus pneumoniae; double-stranded, circular
  misc_feature (B) LOCATION 1...1569
  hypothetical: NO
  anti-sense: NO
gtctgtctagctatagatatattaagtttgataaaatttcttggagattttgttatggattataatttcaatttggagcatcctttctttttcactaataatgattatagtacagatactagcataaagtaccaagtaagtctgccttttaattggcacgaagtaatgaataatgatgagtgggtttatcaataccctattggaaaatttgttgaaagacaagggtggaaaatacacattagttcagagtataacagttcacatgaattgttacaagatgtagcaaaaatttgccatgaaatgcgaattccatttaaacatcttagtacagaagacaaatttatcatgcgaaacgggaaattggttagtcgaggattttctggtaaatttattacatgttatccaaatcaaaatgaattagagtcggttttgcaaaggttagaaagtgccttaaagcaatataatggaccatatattttaagcgataaacgttgggatgaagcaccaatatatctgaggtatggtgtgtttaggccgtcaagggatgatgaaaagaaggttgctattgatgaattaattgttggcgatgaagttgttaaagatgaacgtttaccagtatttaaaattccaaaaggtatagtgccccctgactttttgaataaatggcttgacaagaaagataaaaaacagggagactttccctttattatagataatgcaattagattttcaaacagtggtgggatatataatgctaggctaaaagaagatgggaaaaaaataattttaaaagaggctagaccgtatacaggtctaggatttgatggtacttattcttcagagaaattagcttcggagtgcaaagcactaaaaattctaaatgaatggagtgagacgcctaaaatatactggcacggtaagatctgggagcacaccttcttaggaattgaacatatgaagggcgttccactaaatagatgggttaccaataattttcctttatatgaagttgttgataagaccaaagattatctattgagagtttcaaagatagtagaaaaactcatcgatttaacgaataagtttcattctgaaaatgtatatcatcaagatttacatttaggaaatatcttggttaaggatgaagatgagattagtataatagactgggaacaggctgtcttttcaaatgatgaaaaagttgtacataaagttgcagcccctggttttagagcatggcgagaaacacttcccagtgagatagattggtatggtattagacaaatagctcattatttatacatgccactagtaactacatcggatttgacatacaactatgtaagtcaaaccaggatagaaggaaaaaaactatttgagtctttgggttatacaagagaacatatagattatgtagaaagtttattgtcatatctagattctaaatgtccacagattgagaatatttccaggaaaaaagttttaaaacccatgcatgagattagaactatcgagagtgagcaagatatacaagattttattataaaagcttttcttttagtgaactga

SEQ ID NO: 464 - DNA (genomic), 930 bp, Streptococcus pneumoniae; double-stranded, circular
  misc_feature (B) LOCATION 1...930
  hypothetical: NO
  anti-sense: NO
gaaagactagccctcagcttccagacaaaatcaaagccttttaggcttttttttgttatactagaaaagtatatttatagaatttttgctctatttttggggaaatcagacgtttttctagtaagtactgtaaaagttttgaaaaagaaaggaactatcatgtcagtattagagatcaaagatcttcatgttgagattgaaggaaaagaaattttaaaaggggttaacctgaccctgaaaacaggagaaattgccgctatcatgggaccaaatggtacaggtaaatcgactctttctgccgctatcatgggaaatccaaactatgaagtaactaaaggtgaagttttgtttgatggcgtaaacatccttgagttggaagtggatgagcgtgcgcgtatgggacttttccttgctatgcaatacccatcagaaatccctggaattaccaatgctgagtttcttcgtgccgctatgaatgcgggtaaagaagatgatgagaagatttcagttcgtgagtttattactaagctagatgaaaaaatggaattgctcaacatgaaagaagaaatggcagagcgttacctcaacgaaggcttctctggtggtgagaaaaaacgcaatgaaattcttcaacttttgatgttggagccaacatttgctcttttggatgagattgactcaggtcttgatattgacgctcttaaagttgtgtctaaaggtgtcaatgccatgcgtggtgaaggttttggtgctatgatcattactcactaccaacgtcttttgaactatatcacacctgatgtggtacacgtgatgatggaaggtcgtgttgtcctttctggtggtccagaattggctgcgcgtttggaacgtgaaggatacgcaaaactagctgaagaacttggctacgactacaaggaagaattgtaa

SEQ ID NO: 465 - DNA (genomic), 393 bp, Streptococcus pneumoniae; double-stranded, circular
  misc_feature (B) LOCATION 1...393
  hypothetical: NO
  anti-sense: NO
cattttatagcaattgcagttattgatttgctactatttgcattttttatcattagactcgagacatcttttgagtggctcttgctctctgatttaattttcttccttactcaaggactcctgctatttctcttgatcgtccgactcaaacatcaattcgctgagatttatcctcaaatcaataaaaagattcgcttctactatttaggggttctcaccattgattttctattttttgttctcttagccttcattagttctcagcgtttttcatctcttatgccaatcatcactgcttgccattctactttttattatatgacagctgactacctaagagaaaactatccagacttttacgacaaacacatctctttatgggagtgtctctaa

SEQ ID NO: 466 - DNA (genomic), 831 bp, Streptococcus pneumoniae; double-stranded, circular
  misc_feature (B) LOCATION 1...831
  hypothetical: NO
  anti-sense: NO
gcgcgttcagctgggatgcactatgatgcaagctacatttcatttgatgggatattaagaaaggagattctcatgacacttttagatgtaaaacacgttcaaaaaatttataaaacacgttttcagggcaaccaagtagaagccctcaaggatattcactttaccgtcgaaaagggtgactacgttgccatcatgggtgagtctggttctggtaaatcaactcttctcaatattctagctatgctggataaaccaagtcgtggtcaggtttacttgaatggaactgacaccgcaaccattaaaaattcacaggcctctagcttccgtcgtgaaaagttgggctttgtcttccaagactttaacttgctagatactctatctgtaaaggacaatatcttgcttccgcttgtcttgtcaagaagacctattacagagatgatgaagaaattggtggtgacagctgagaatctgggaataaaccaattacaagagaagtacccttacgagatttctggtggccagaaacagcgtgtagcagtagcacgcgccatcatcactgaacctgaaattctccttgcggacgaaccgacaggagctcttgactccaagtcatctgcagccttacttgatgtctttgatgaaatcaatgagcgcggccaaaccattctcatggtaacccactcaacagcagcagctagcagagctaaacgtgtactctttatcaaagacggcattctttacaatcaaatctaccgtggagagaagacagaacgtcagatgttccaagaaatctctgataccttgactgtcatggcaagcgaggtgaattag

SEQ ID NO: 467 - DNA (genomic), 1038 bp, Streptococcus pneumoniae; double-stranded, circular
  misc_feature (B) LOCATION 1...1038
  hypothetical: NO
  anti-sense: NO
atgaaatcagcagtatatacaaaggcaggtcaggttggacttgctagcattgaacgtccgcaaataatagaagcggatgatgtgattattcgtgtggttcgtgcgtgcgtttgtggttcagatttatggaggtaccgtaatccagaaacgaaagctggacataaaaatagtggacacgaagcgattgggattgttgaagaagctggggaagccattacgacggtgaaaccaggtgattttgtgattgtcccttttacacatggatgtggtgagtgtgatgcctgtcttgctggatttgacggttcttgcgacaatcatattggtaataatttggggggtgattttcaggcagaatatattcgcttccactatgcaaactgggcgctggttaaaatccctggtcaaccttctgattatacagaagggatgctcaagtcccttttgactcttgcagatgtcatgccgacaggctatcatgcagcgcgtgttgcaaatgttcaaaaaggggacaaggttgttgttatcggtgatggggctgttggtcaatgtgctgtcatcgcggctaagatgcgtggagcatcacaaattatccttatgagccgtcatgaagaccgtcaaaagatggctatggagtcaggtgcgacagctgttgttgcagaacgtggtcaagaaggaattaccaaggtgcgtgaaatcctcggcggaggagcagacgcagcacttgaatgtgttggtacggaggctgctatagaacaggcgctaggtgttcttcataatggagggcgtatgggctttgtaggagtcccacactataataatcgtgctcttggttcgacatttatgcaaaatatctctgtagcaggtggggcagcttctgctacaacatacgataagcaatttttactaaaagccgtccttgatggtgatatcaatccaggtcgcgtctttacttcaagttataaactggaagatatcgaccaagcctataaagatatggatgaacgtaagacaattaagtctatgattgtaatcgaataa

SEQ ID NO: 468 - DNA (genomic), 441 bp, Streptococcus pneumoniae; double-stranded, circular
  misc_feature (B) LOCATION 1...441
  hypothetical: NO
  anti-sense: NO
gcggccacagcccggccccggcttcccggcgaaaaccgcagccgaggtcgcgtccacggcgcaggccagtgtccaggtctcgccgcccgcgccgacagcgggcggcgaaggccgcggagaggagcgtcggcaacccggagaaaccgatccatccgcactgccccccgacgaccaagcgcctgtgccattgcctgccatgcaaacccccggcgaccgcctgctggcacgcctgctggcatcgagcgggagccggccactgccgctggccgatctcgcgcgcctgctagatgccgtgcaggggcgcatccaggtcgccagcgcagccgaaagccatgcggcgcgcctgcaggtgcgactgccccagctcggcgccgtggaggtgcaggtcctgcatggccatggccagttgcaggtcgtcttcaccacgagccgggaggtccc

SEQ ID NO: 469 - DNA (genomic), 261 bp, Streptococcus pneumoniae; double-stranded, circular
  misc_feature (B) LOCATION 1...261
  hypothetical: NO
  anti-sense: NO
agaataacagcaatattaaaaagatcaggactgataataaacaaaaagaaagtacaacgactagttcaaaagctaaaacttcaagtaaaaagttattcaagaaaatctagaaaatactcatcctacaaaggacaggtaggaaaaatatcagacaacaaaataaaaagaaatatttattaccgaaaaaaaggggaaatcgagtcaagtaccaacaggctcatctattccaaaaagatatttactcgatggaaaaactcctag

SEQ ID NO: 470 - DNA (genomic), 849 bp, Streptococcus pneumoniae; double-stranded, circular
  misc_feature (B) LOCATION 1...849
  hypothetical: NO
  anti-sense: NO
aaaatgacagcaggacaaactaaattagccactatggttaatccagaagtaatggcggatatggtagccgctaaattacctaaattgattaaatttacaccgctagcgtatgtagagacaaagcttgaaggtcaaccaggtagcactttaacagtgccagcatgggagtatgcaggagacgctactgaaattgaagaaggccaagcaattacgccagaccaattgactactaaaaagactactatgaccatcaaaaaagcaggtaaaggttatgaaattaccgatgagtctcttttgtcaggtcttggtgacccactaggtcaagcgacttaccagcttggtttagctattgccaacaagatcgataatgatttggtagcggtagctaaaactgcaacacaacatattacagaaactccaacaactcttgaggcaatcgataaagctctagatatctttgaggacgaagaagatgcacagtatgttgctatcatcaaccctaaagatgctactaagctaaaaactgcagtagcaaaagaatggattaaaggttcagagcttggagcaaatatggttgtttctggaaccttcggtgaagttgatggtgtgcaaatcgtgcgctctaaaaaagttgatgaaggtaaaggcttccttgttaaagtgtcaccaagtcaaactcagacagacgacgctaacaaatatggagcttttgttatcttgcttaaacgtgatgtggctatcgaaacagaccgcgatatcttgaagaagactaccgtaatcacaggtgatgaacactacggcgtttacctttacgaccctacacgagttgtaaaattcggtggcgcgtaa

SEQ ID NO: 471 - DNA (genomic), 465 bp, Streptococcus pneumoniae; double-stranded, circular
  misc_feature (B) LOCATION 1...465
  hypothetical: NO
  anti-sense: NO
aaatggacagcagtacaagagcttgagagaactttaagaggtgttgagatgattactattaaaaagcaagaaattgtcaagctagaggatgttttgcatctctatcaggctgtcggttggacaaattatacccatcaaccagagatgctggagcatgccttatcgcattcattagtaatttatctggcacttgatggtgatgctgtggtgggcttgattcgtttggttggagatggattctcatcagtttttgtacaggatttgattgttttaccaatctatcagcgtcaagggattggtagtgccctaatgaaagaggccttaaaagattacaaagatgcttatcaagtccagctggtgacagaagagacagaaaaaaacgtgggattttatcgttctatgggctttgaaatcttatccacctataattgtatagggatgacttgggcgaatcgagaaaaataa

SEQ ID NO: 472 - DNA (genomic), 216 bp, Streptococcus pneumoniae; double-stranded, circular
  misc_feature (B) LOCATION 1...216
  hypothetical: NO
  anti-sense: NO
aggtaccaagccaagaaaagtattgcagcaataaaaaatagcttctttccaaggttggaaggagctattttactggctattgattacttttatactcttcgcaaatctcttcaaaccacgtcagctttgccttgccgtatatatgtgactgacttcgtcatgtcttatctacaacctcaaaacagtgttttgagcagcctacggctagcttcctag

SEQ ID NO: 473 - DNA (genomic), 576 bp, Streptococcus pneumoniae; double-stranded, circular
  misc_feature (B) LOCATION 1...576
  hypothetical: NO
  anti-sense: NO
aaaaaacaagcttatgatgaaaaaaataaaaaagtcatctatttattgctagatgaaaaaaggaagaactatgtagaagataagagacaaaatttccctagtctccctaactggaaaatggatttattttcagaagaagaaaaaaggaattattttcaaaccacatgtgaaatttcaagtaaagactctgcaataaataaatacaaaatggaaaaaattattaagagatcaaataaaggaaatgtttatcgggcaattagaaaatcggacgggcaaaaagtaatcatcaagcagtcaagaccttttgtgaattatgatgctgaaggagaatggacagctcttgatgatataaaaaatgaagctcacatgctaaaaaaattagccgataaaagttatactactaatttaactgatgaattttatatcgtggatgattattttcttgttcaggaacaagttgacgggttaaactttgaagaatttattcgagaaacagaacactccttaaatattagagaaaaaacactgtataacattgtgaatatagtaagtgacatccataaactgggaatataa

SEQ ID NO: 474 - DNA (genomic), 201 bp, Streptococcus pneumoniae; double-stranded, circular
  misc_feature (B) LOCATION 1...201
  hypothetical: NO
  anti-sense: NO
aaaatgcaagccttttatattaaaaaagagaaaaaactgtcaaacgattatcatgaaataaatacaggaaatcaatcaaatttttacgaaaatgtgaaagataatgaaataaaatactttttaaccaaggtttcaaacttatttttcaaggaattcctgatgaaacagtcaaaaacaatcaatctaaaacttgcccactaa

SEQ ID NO: 475 - DNA (genomic), 1431 bp, Streptococcus pneumoniae; double-stranded, circular
  misc_feature (B) LOCATION 1...1431
  hypothetical: NO
  anti-sense: NO
caaatgtatttaggagatttgatggagaaagccgagtgtggtcaattttcaatcctttcctttctattacaagagtctcagacgaccgtcaaggctgtaatggaagaaacaggattttcaaaagcaaccctaaccaaatatgtcaccctgctcaatgacaaggctttggatagtggcttagagctgactattcactcagaagatgaaaatctgcgtctgtctatcggtgcagctaccaaggggagagatattcggagcttgtttttggatagtgctgttaaataccagattttggtttatcttctctaccaccaacagtttttagcccatcagctggctcaagaattggtgattagcgaggctacgcttggtcgtcacttggctggtttaaatcagattttgtcagaatttgatttatccatccaaaatggacgctggcgaggtccagagcatcagattcgctatttctatttctgtcttttccgaaaggtctggtcgagtcaggaatgggaaggtcacatgcagaaaccagagagaaaacaggagattgccaatttagaggaaatctgcggtgcaagtttgtctgcggggcagaaattggacttggttctctgggctcacatcagtcaacaacgtcttcgggtcaatgcttgtcagtttcaagttatagaagagaaaatgcgagggtattttgacaatatcttctatcttcgtttgctgagaaaggttccgtccttttttgctgggcaacatattccactaggagttgaggatggtgagatgatgatattcttctcttttctcctatctcatcgcattcttcctcttcatactatggagtatattcttggttttggagggcagttggcagatttactgacgcaattgattcaagaaatgaagaaggaggaactattgggggattatacagaggaccatgtcacctatgaactcagtcagctttgtgctcaagtctatctctataagggctatattttacaggatcgctacaagtaccagttagagaatcgtcatccatatttactgatggaacatgattttaaagagacagcagaggagatttttcatgctctacctgcttttcaacaggggacagatttagataagaagattctctgggaatggctccagttaatcgaatatatggctgaaaacggtggccagcatatgcggattggtctggatttgacatctggttttcttgtcttttcaaggatggcagccattttgaaacggtatttggaatacaatcgttttattaccattgaagcttatgaccctagtcggcattatgatttgctggttaccaataacccgattcataagaaggaacagaccccagtctattatttaaaaaatgacttggatatggaagatttggcagggattcgtcagttattattcacttaa

SEQ ID NO: 476 - DNA (genomic), 1536 bp, Streptococcus pneumoniae; double-stranded, circular
  misc_feature (B) LOCATION 1...1536
  hypothetical: NO
  anti-sense: NO
gtagcaaaagctaggtggaacagcattcagatgtctgttacattttttataggagagcaaagattgaaaacaaaaattggattagcaagtatctgtttactaggcttggcaactagtcatgtcgctgcaaatgaaactgaagtagcaaaaacttcgcaggatacaacgacagcttcaagtagttcagagcaaaatcagtcttctaataaaacgcaaacgagcgcagaagtacagactaatgctgctgcccactgggatggggattattatgtaaaggatgatggttctaaagctcaaagtgaatggatttttgacaactactataaggcttggttttatattaattcagatggtcgttactcgcagaatgaatggcatgaaaattactacctgaaatcaggtggatatatggcccaaaacgagtggatctatgacagtaattacaagagttggttttatctcaagtcagatggggcttatgctcatcaagaatggcaattgattggaaataagtggtactacttcaagaagtggggttacatggctaaaagccaatggcaaggaagttatttcttgaatggtcaaggagctatgatgcaaaatgaatggctctatgatccagcctattctgcttatttttatctaaaatccgatggaacttatgctaaccaagagtggcaaaaagtgggcggcaaatggtactatttcaagaagtggggctatatggctcggaatgagtggcaaggcaactactatttgactggaagtggtgctatggcgactgacgaagtgattatggatggtgctcgctatatctttgcggcctctggtgagctcaaagaaaagaaagatttgaatgtcggctgggttcacagagatggtaaacgctatttctttaataatagagaagaacaagtgggaaccgaacatgctaagaaaatcattgatattagtgagcacaatggtcgtatcaatgattggaaaaaggttattgatgagaacgaggtggatggtgtcattgttcgtctaggttatagcggtaaagaagacaaggaattggcgcataacattaaggagttaaaccgtctgggaattccttatggtgtctatctctatacctatgctgaaaatgagaccgatgctgagaatgacgctaaacagaccattgaacttataaagaaatacaatatgaacctgtcttaccctatctattatgatgttgagaactgggaatatgtaaataagagcaagagagctccaagtgatacagacacttgggttaaaatcatcaacaagtacatggacacgatgaagcaggcgggttatcaaaatgtgtatgtctatagctatcgtagtttattacagacgcgtttaaaacacccagatattttaaaacatgtaaactgggtagcggcctatacgaatgctttagaatgggaaaacccttattattcaggagaaaaaggttggcaatatacctcttctgaatacatgaaaggaatccaagggcgcgtagatgtcagcgtttggtattaa

SEQ ID NO: 477 - DNA (genomic), 312 bp, Streptococcus pneumoniae; double-stranded, circular
  misc_feature (B) LOCATION 1...312
  hypothetical: NO
  anti-sense: NO
attgaacgagcttgtaaaagctatcgaagaagaatttggtgtaactgcagatacttctgtagctgttgctgcagctngatgcttgatgctggtgctgctaaagattcattcgacgttgaattgacatctgcaggcgacaaaaaagttggtgttatcaaagttgtacgtgaaatcactggtcttggtcttaaagaagctaaagaacttgttgacggtgcaccagcacttgttaaagatggcgttgcaactgcagaagctgaagaaatcaaagctaaattggaagaagctggagcttcagttactcttaaataa

SEQ ID NO: 478 - DNA (genomic), 660 bp, Streptococcus pneumoniae; double-stranded, circular
  misc_feature (B) LOCATION 1...660
  hypothetical: NO
  anti-sense: NO
aggagacgagctaatgactacaaaaaagctaatattactattgaagagtacattgaaatgtctgaagttgattttaatgaagctgttaattatgaatttacatctgacacttgtcaattagcaaatagtatttatcaatctctttttaagttttttgataagaaaaatttctctggcgatttaatttttacttggaaatctccatcattagtcaaagaaggggattatattgggaaaagggattcacaagtagataatcttagagtaataggaaatatatttccgaattatcttactaatcgaaaatatagcctcaatatgaatcgtaatggctgtatgggagattttcctcatgacttttttgatatatacctagatcatgtagcaaaatatgcctacgaacaaaaagttaataatattaaagagtattatcctttaaaaagagcgattttacaccaagagaatgcattgtattttcgatttttttctaattttgacgactttttagaaaaaaattatttaaagactatatggcaagtttctaaagaaactcctttttctgaaatggattttaatatgtttaaaaatatttcagaaaagataatcttcgaaagaggtagtaaaatgcttaatgatttaaaaagtaattataaaaaatag

SEQ ID NO: 479 - DNA (genomic), 1011 bp, Streptococcus pneumoniae; double-stranded, circular
  misc_feature (B) LOCATION 1...1011
  hypothetical: NO
  anti-sense: NO
tataatagagccatgagtagaattttagataatgagataatgggggatgaggagttagtagaacgcacgctccgtcctcagtatttacgtgaatatatcggacaggataaggtcaaggaccagctacaaatctttattgaagctgccaaaatgcgggatgaagcgctggatcatgtgctcttatttgggcctccaggtctcgggaaaacgaccatggcctttgttattgccaacgaactgggagtcaatcttaagcagacgtcgggtccagtcattgaaaaagccggagatctggtagctattttgaatgagttagagcctggggatgtactttttattgatgagatccatcgtttgccaatgtcagtggaagaggtgctttatagtgctatggaggacttctacatcgatattatgattggggctggtgagggtagtcgtagtgttcatttggagttaccaccttttaccttgattggtgcgacgactcgggctggtatgctctccaatccgctacgggcacgttttgggattacaggccatatggagtattatgcccatgctgacttgacagaaattgtcgagcggacggcagatatttttgagatggaaatcactcatgaggcagcatctgagttggccctacgtagtcgtgggacccctcgtattgccaatcgtctcctcaagcgcgtgcgcgattttgcccagataatggggaatggggtaattgatgatattattaccgataaggctttgactatgctggatgttgaccatgaaggtttggactatgtggatcaaaaaatccttcgtaccatgattgagatgtacagtggaggacctgttggtctaggaactctttctgtgaatatcgccgaagagcgtgagacagttgaagacatgtatgagccttacttgattcaaaaaggttttatcatgcggacacggtctggacgggtggcgactgctaaggcatatgagcacttaggttatgaatacagtgaaaaataa

SEQ ID NO: 480 - DNA (genomic), 285 bp, Streptococcus pneumoniae; double-stranded, circular
  misc_feature (B) LOCATION 1...285
  hypothetical: NO
  anti-sense: NO
ttgaacagagctaatagaggcgaaaaaatttcaggtcctcctttgctagatgataatgaggaaactaagattttaccaacctcttcttcccgttttggttatgccaatcctaaggatcatggttttagccaggaaaccttgaagattcaggtcgaaccatctattcataaaagccgtcgtattgaaaataccaagagaaatgtcttcaattctaagttgaataaaatcttatttgcggtcatctttctcttgattttgcttgttttagcaatgaaacttttgtaa

SEQ ID NO: 481 - DNA (genomic), 795 bp, Streptococcus pneumoniae; double-stranded, circular
  misc_feature (B) LOCATION 1...795
  hypothetical: NO
  anti-sense: NO
tcgatgagagcacctatgagccccttcaagaaaatgggcaagccaaagtcaaggagggcaatatcagttttggaacatgtgtgtatctcgtatgacggtaaacatccgattctggatgacatttctttctctgttaataagggtgaaaccattgcctttgtaggtcatacaggttcagggaaatcgtctattatcaatgtcctcatgcgcttttatgaattccagtcagggagagttctcttggatgatgtggatatcagggatttcagtcaagaagagctgagaaaaaacatcggtttggttttacaggaacccttcctctatcatggaactattaagtccaatatcgccatgtaccaagaaatcagtgatgagcaggttcaggctgcggcagcctttgtggatgcagattcctttattcaagaacttcctcaggggtacgactcccctgtttccgagcgtggttcgagcttctctactgggcagcgccagctttttgcctttgctagaacagtcgccagccagcctaaaatcctgattttggatgaagcgacagccaatattgactctgaaacagaaagtttggttcaagcttctctggcgaagatgagacagggccgaacaactattgctatcgctcaccgcctttctactattcaagacgccaactgcatctatgtcttggataagggacgcattatcgagagtggaacccatgaggaactcttgactctgggaggaacctatcacaagatgtatagtttgcaggcaggggccatggcctatactctttga

SEQ ID NO: 482 - DNA (genomic), 243 bp, Streptococcus pneumoniae; double-stranded, circular
  misc_feature (B) LOCATION 1...243
  hypothetical: NO
  anti-sense: NO
aaccaaggagcgcttcctctaatccataaggaggtatttatgacgcactacgttgccaatccagaggtggtcattctcgagggtggcatcatgggacaagaagctatcctcaaaccaaagattcgtgcagccttgaaagaagtcttggttccaagtttggctgagaacacaagattagaatttgctcatcatcaaaacactgctggtatgcttggagcctactatcattttaaaataaaataa

SEQ ID NO: 483 - DNA (genomic), 693 bp, Streptococcus pneumoniae; double-stranded, circular
  misc_feature (B) LOCATION 1...693
  hypothetical: NO
  anti-sense: NO
gaaggaggagcaagcatgaaaaaaatctattcatttttagcaggaattgcagcgattatccttgtcttgtggggaattgcgactcatttagatagtaaaatcaatagtcgagatagtcaaaaattggttatctataactggggagactatatcgatcctgaactcttgactcagtttacagaagaaacaggaattcaagttcagtacgagacttttgactccaacgaagccatgtacactaagataaagcagggtggaacgacctacgatattgccattccaagtgaatacatgattaacaagatgaaggacgaagacctcttggttccgcttgattattcaaaaattgaaggaatcgaaaatatcggaccagagtttctcaaccagtcctttgacccaggtaataaattctccatcccttacttctggggaaccttaggaattgtctacaacgaaaccatggtagatgaagcgcctgagcattgggatgacctttggaagccggagtataagaattctatcatgctctttgatggggcgcgtgaggtgctgggactaggactcaattccctcggctacagcctcaactccaaggatctgcagcagttggaagagacagtggataagctctataaactgactccaaatatcaaggctatcgttgcggacgagatgaagggctatatgatttag

SEQ ID NO: 484 - DNA (genomic), 222 bp, Streptococcus pneumoniae; double-stranded, circular
  misc_feature (B) LOCATION 1...222
  hypothetical: NO
  anti-sense: NO
gtagctttggcgaaagagcaagatattccatttaagctcgacatctatccattttacggatcggacgcttcagcagcgatgtcagcaggtgcagaggtcaagcatgcacttcttggagctggtattgagtccagtcactcttatgagcggacccacatcgattcagtagtagcgactgagcgtattgttgatgcttatcttaagagcgaggcggtatcatag

SEQ ID NO: 485 - DNA (genomic), 1134 bp, Streptococcus pneumoniae; double-stranded, circular
  misc_feature (B) LOCATION 1...1134
  hypothetical: NO
  anti-sense: NO
atctccttggcttcatcgaagccatcgtcgatttcctatttttcagtcgcttttgacgccctttgtatcataaatagaattggagaggtcatggctgatgacaagctaagagcgactcctgcagctagaaagttagcagatgatttagggataaacctctacgacgtttctggctcaggtgcaaacggtcgtgtccacaaagaagacgtggaaacttataaagacacaaacgtggttcgcatttcgccacttgcaaaacgaattgccctcgaacataacattgcttggcaggaaatccaaggaaccggtcatcgtggtaaaatcatgaagaaggatgttttggccctgcttcctgaaaatatcgaaaacgatagcatcaaatctcctgctcagattgaaaaagtggaagaagtccctgataacgtaacaccatatggtgaaatcgagcgtattccaatgacaccaatgcgtaaggttattgcccaacgcatggttgaatcttacttgactgcgccaaccttcaccctcaactatgaagttgatatgactgaaatgttggctcttcgtaagagggttcttgagccaatcatggaagcaactgggaagaagactactgtaacagaccttctttcacttgcagttgttaagtctcttatgaaacatccatacatcaacgcttcattgacagaagatggcaagactattatcactcacaactatgtcaatcttgccatggcagttgggatggataatggattgatgacacctgttgtttacaatgctgagaagatgagtctttcagaactggttgtagcctttaaggatgttattggccgtaccttggatggtaaattggctccaagtgagttacaaaattcaacattcacaatcagtaatttgggaatgtttggtgttcagtcctttggcccgattattaaccaacccaactcagctatccttggtgtcagttcgacaatcgagaagccagttgtcgtcaatggtgaaattgtgattcgcccaatcatgagtttaggattaaccattgaccaccgtgtcgtagatggtatggctggtgctaagtttatgaaggacttgaaagagttgattgaaaccccaatctcaatgttgatttaa

SEQ ID NO: 486 - DNA (genomic), 834 bp, Streptococcus pneumoniae; double-stranded, circular
  misc_feature (B) LOCATION 1...834
  hypothetical: NO
  anti-sense: NO
anggnattggccattacaggattccttatgaataagatgaacaaggtgatgctgacgatgtttggcttagtgatgctccccctactatttgcttgtagtaacaatcaatcggctggaattgaagccataaagtccaaaggaaaattggttgtagccctcaatccagattttgctccatttgaatatcaaaaagtggttgatgggaaaaatcagattgtgggttcagatatcgaattagccaaggctatcgcaacagaactaggtgtcgaattggaactatctcctatgagttttgacaatgtactggctagcgttcaatcaggaaaagctgaccttgccatatcaggtgtttctaagacagatgaacggagcaaggtgtttgatttttcaactccctactatactgcaaaaaataaactcattgtcaaaaaatctgatttagccacttatcagtctgtcaacgatttggcgcagaaaaaggtcggagcgcagaaaggttcgattcaagagacgatggcgaaagatttgctacaaaattcttccctcgtatctctgcctaaaaatgggaatttaatcacagatttaaaatcagggcaagtggatgccgttatttttgaagaacccgttgccaagggatttgtggaaaataatcctgatttagcaatcgcagacctcaattttgaaaaagagcaagatgattcctatgcggtagccatgaaaaaagatagcaaggaattgaaagaggcagtcgataaaaccattcaaaagttgaaggagtctggggaattagacaaactcattgaggatgcctttaaagcgtccattgaaaaatag

SEQ ID NO: 487 - DNA (genomic), 282 bp, Streptococcus pneumoniae; double-stranded, circular
  misc_feature (B) LOCATION 1...282
  hypothetical: NO
  anti-sense: NO
acttggctggctggattatccccaaccaaaatcactaccaaaccaggcactagacctgtttcttcctttaattttgcagtcttttcagccaactgcccctgcaatttggccgctaaagctttcccatcaataatctgtgtcatatcacttctcttttctttcaaatatcttccattataccaaaaactgcaagtgccctctaacacttctttcctaggttatcctatagtttcaaactataagaaaaagctctggttgaacttttcactaatcttgtcttga

SEQ ID NO: 488 - DNA (genomic), 285 bp, Streptococcus pneumoniae; double-stranded, circular
  misc_feature (B) LOCATION 1...285
  hypothetical: NO
  anti-sense: NO
ccaaggctggcaataccgacacgattcttatcatcggttcctaagagtaagggaattcaagcatctatgtcacgcaagggaaacagccaagacaacggtatgatggagtccttctttgggattctgaaatcggaaatgttttatggctatgagaaaacatttaaatcacttaatcaattggaacaagctattgtagactatattgattactacaacaataaacgaattaaggtaaaactaaaaggacttagccttgtgcaatacagaactaaatccttcggataa

SEQ ID NO: 489 - DNA (genomic), 1317 bp, Streptococcus pneumoniae; double-stranded, circular
  misc_feature (B) LOCATION 1...1317
  hypothetical: NO
  anti-sense: NO
gaaattatggccctaccaactattgccattgtaggacgtcccaatgttgggaaatcaaccctatttaatcggatcgctggtgagcgaatctccattgtagaagatgtcgaaggagtgacacgtgaccgtatctatgcaacgggtgagtggctcaatcgctcttttagtatgattgatacaggaggaatcgacgatgtagatgctcctttcatggaacaaatcaagcaccaggcagaaattgccatggaagaagcagatgttatcgtttttgtcgtgtctggtaaggaaggaattactgatgcagacgaatacgtagctcgtaagctttataagacccacaaaccagttatcctcgcagtcaacaaggtggacaaccctgagatgagaaatgatatctatgatttctatgctctcggtttgggtgaaccactgcctatctcatctgtccatggaatcggtacaggggatgtactagatgctatcgtagaaaatcttccaaatgaatatgaggaagaaaatccagatgtcattaagtttagcctgattggtcgtccaaacgttggaaaatcaagcttgatcaatgctatcttgggcgaagaccgtgttattgccagtcctgttgctggaacaactcgtgacgctattgatacccactttacagatacagatggtcaagagtttaccatgattgatacggctggtatgcgtaagtctggtaaggtttatgaaaatactgagaagtactctgtcatgcgtgccatgcgtgctattgaccgttcagatgtggtcttaatggtcatcaatgcggaagaggggattcgtgaatacgacaagcgtatcgctggatttgctcatgaagctggtaaagggatgattatcgtggtcaacaagtgggatacgcttgaaaaagataaccacactatgaaaaactgggaagaagatatccgtgagcagttccaatacctgccttacgcaccgattatctttgtatcagctttaaccaagcaacgtctccacaaacttcctgggatgattaagcaaatcagcgaaagtcaaaatacacgtattccatcagctgtcttgaacgatgtcatcatggatgccattgccatcaacccaacaccgacagacaaaggaaaacgtctcaagattttctatgcgacccaagtggcaaccaaaccaccaacctttgttatctttgtcaacgaagaagaactcatgcacttttcttacctacgtttcttggaaaatcaaatccgcaaggcctttgtctttgagggaacaccgattcatctcatcgcaagaaagcgtaaataa

SEQ ID NO: 490 - DNA (genomic), 291 bp, Streptococcus pneumoniae; double-stranded, circular
  misc_feature (B) LOCATION 1...291
  hypothetical: NO
  anti-sense: NO
caatctatggctcgcaaagagaccatggcagaaaggaaatattgcaaaatgaaaaaagatatccatccagaatatcgcccagttgtcttcatggacacaactactggttaccaattccttagcggttcaacaaaacgctctaacgaaacagttgagttcgaaggcgaaacttacccattgatccgtgtggaaatttcatcagactcacacccattctacactggacgtcaaaagttcactcaagcagatggacgcgtggatcgtttcaacaaaaaatacggtctcaaataa

SEQ ID NO: 491 - DNA (genomic), 822 bp, Streptococcus pneumoniae; double-stranded, circular
  misc_feature (B) LOCATION 1...822
  hypothetical: NO
  anti-sense: NO
gaatcaatggctaaggaaagagtggatgtactagcttataaacaggggttgtttgaaacgagagagcaggccaagcgaggtgtgatggctggcctagtcgtagcagtccttaatggagaacggtttgacaagccaggagagaaaattccagatgacaccgaattaaaactcaagggggagaaactcaagtatgtcagccgtggtggtttgaaactggaaaaggccttgcaggtctttgatttgtcggtggatggcgcgactacgattgatatcggggcctctactggaggttttaccgatgtcatgctacagaatagtgccaagttggtctttgcagtcgatgttggtaccaatcagttggcttggaaattacgccaagacccacgagttgtcagtatggagcagttcaatttccgctatgctgaaaagactgatttcgagcaggagccgagctttgccagtattgatgtgagtttcatttcccttagtctgattttgccagccttgcaccgtgtcttggctgatcaaggtcaggtggtagcacttgtcaaacctcagtttgaggcaggacgtgagcagattgggaaaaatggaattattcgagatgctaaggttcatcagaatgtccttgaatctgtaacagctatggcagtagaggtaggtttttcagtccttggcttggacttttctcccatccaaggtggacatggaaatattgaatttttagcgtatttgaaaaaagaaaagtcagcaagcaatcagattcttgctgagattaaagaagcagtagagagggcgcatagtcaatttaaaaatgaataa

SEQ ID NO: 492 - DNA (genomic), 489 bp, Streptococcus pneumoniae; double-stranded, circular
  misc_feature (B) LOCATION 1...489
  hypothetical: NO
  anti-sense: NO
aaaaaaatggctagtttatacgaactaacaggtcagttcctgacaatttaccaattggatatcgatgacgaaacaaaagcagacacgcttgaggccatcgattggcaagaacaatttgaacagaaagcagaaggatatgcccatgttatcaagaatctagaagccgacgtggcaatgtacaaggctgaggaagagagcttcaaagccaagaaacaggtggcacagaaaaagctggattatgtcaaggataacattatggcagctatgaatgtcacggggcaaaccgaagttaagagtggtgccctgattataaaaattgctaagaatccagaatcagtcaaggtcaacgaagacgaccttccgaaaaaatattttacaaaaaaagtgacgcttgcgccggacaaaaaaacactcaaagagttgcttaaatctggcaagaaagtcaaaggtgcggagcttgtccggacagaaaagttggtgattaagtaa

SEQ ID NO: 493 - DNA (genomic), 501 bp, Streptococcus pneumoniae; double-stranded, circular
  misc_feature (B) LOCATION 1...501
  hypothetical: NO
  anti-sense: NO
atgaagacggcttttataatcattgatgttcagaatgttttagtagaaactgggttccagacaaaaagtctattggaaaaaatttcttatttacaaaaccaggctagaagcaagaatattgaaattatctatgttcaacatattgagaactctgaagctcaaacatcagaagattggcagttatctgcgcttttaaatcgaaaacctgctgaaaaggtctttcagaagaagtataacagtattttcaaagaaactggcttaaaagaatacttggataaacaggggattgaaaaattagttttatgtggtatgcagacagaatattgtgtggatacctctgtcaaggttgcctttgaatatggctatcagcttattgttccagaaggtgctgtcacaacctttgatggggatgacattccagcagaaacgattaatgaattttatgaggacatttgggaggagcgctttgcagatgtcctagattacaaacatattttctaa

SEQ ID NO: 494 - DNA (genomic), 255 bp, Streptococcus pneumoniae; double-stranded, circular
  misc_feature (B) LOCATION 1...255
  hypothetical: NO
  anti-sense: NO
cagcctgcggctagcttcctagtttgcactttgattttcattgagtattatcttatctcaagcccatttgagcgagcttggtttgatatttgttttgatcaaccagcaagcccaagcctccataaacatcataggcgtctacccagtcacccagttctggaatcgtcaatttttcaataccattttttgctccatccaaaacagataaaccgtttgttaggaggaaagtataaggtacgttggttgaggtcatag

SEQ ID NO: 495 - DNA (genomic), 1848 bp, Streptococcus pneumoniae; double-stranded, circular
  misc_feature (B) LOCATION 1...1848
  hypothetical: NO
  anti-sense: NO
tccacagcggcttattccaagtataccacttgggctttggcagtagctaactgcgctaaatataatataaggaggagtaaaatgaagacagttcaatttttttggcattattttaaggtctacaagttctcatttgtagttgtcatcctgatgattgttctggcgacttttgcccaagccctctttccagtcttttctggacaagcggtgacgcagctagccaatttagttcaagcttatcaaaatggcaatccagaacttgtatggcaaagcctatcaggaatcatggtcaatcttggcctgctggttttggttctatttatctctagtgtaatatacatgtgtctcatgacgcgcgtgattgcagaatcgaccaacgagatgcgcaaaggcctctttggtaagcttgctcagttgacggtttctttctttgaccgtcgacaagatggcgatatcctgtctcattttaccagtgatttggataatatcctacaagcctttaacgaaagcttgattcaggtcatgagcaatattgttttatacattggtctgattcttgtcatgttttcgagaaatgtgacgctggctctcatcaccattgccagcaccccattggctttccttatgctgattttcatcgtgaaaatggcacgcaaatacaccaacctccagcagaaagaggtagggaagctcaacgcctatatggatgagagcatctcaggccaaaaagccgtgattgtgcaaggaattcaagaggatatgatggcaggatttcttgaacaaaatgagcgcgtgcgcaaggcaacctttaaaggaagaatgttctcaggaattcttttccctgtcatgaatgggatgagcctgattaatacagccatcgtcatctttgctggttcggctgtacttttgaatgataagtctattgaaacaagtacagccctaggtttgattgttatgtttgcacaattttcacagcagtactaccagcctattatccaagttgcagcgagttggggaagccttcagttggcctttactggagctgaacgaattcaggaaatgtttgatgcagaggaggaaatccgacctgaaaaggctccaaccttcactaagttgcaagaaagtgttgaaatcagtcatatcgatttttcatacttgcctgataaacctattttgaaagatgtcagcatttctgcccctaaaggccagatgacagcagttgttgggccgacaggttcaggaaaaacgactattatgaacctcatcaatcgcttttatgatgttgatgctggtggtatttattttgatggtaaagacattcgtggctatgacttagatagtcttagaagcaaggtgggaattgtattgcaagattcggtcttgtttagcggaacgattcgagacaatatccgatttggtgtgccagatgctagtcaggaaatggttgaggtagcagcaaaagcaacccacattcacgactatatcgaaagtttgcctgataagtacgatactcttattgatgatgaccagagcatcttttcagcagggcagaagcaattgatttcaatcgctcgaaccctgatgacagatccagaagttctcattctcgatgaagcaacttcaaacgtagatacggtgacagaaagcaagattcaacatgccatggaggtggttgtagcaggtagaactagtttcgtcattgcccaccgcttgaaaaccattctcaatgcagatcagattattgtccttaaagatggagaagtcattgaacgtggtaaccaccatgaacttttgaagctaggtggcttttattcagaactctatcacaatcaatttgttttcgaataa

SEQ ID NO: 496 - DNA (genomic), 210 bp, Streptococcus pneumoniae; double-stranded, circular
  misc_feature (B) LOCATION 1...210
  hypothetical: NO
  anti-sense: NO
aattctcaggcggaggacattcaaacgctcaagattaaattttccatggtgggatttggtgaaggtttgctgaaaggctggcaagccattgataccaagatagcggatatattgctcaaaagcatcaatatcagactgactgaggtcagtatacaaatcagttctaagaagattgatcaaatcctcctgacgaaaacggtaacgttttaa

SEQ ID NO: 497 - DNA (genomic), 615 bp, Streptococcus pneumoniae; double-stranded, circular
  misc_feature (B) LOCATION 1...615
  hypothetical: NO
  anti-sense: NO
gtaatcaaggcattgattgtaggagtagcaataaacggaatcagcataatcggatttaaaactgttggaaacgtaaatagaatagctgtattgatattaaaaatagacggtataatagctagcttacctaatgttttattcgcacgactcttactaaataggaagagacaaatcgcaagaccaatagtcgctccaccgccacctataaatacaaataaatctttaaacggtaatgtaataatgtgttggagtgtttgtcctgcagccacagcttcttggttttctgtagtaaattgtaaccaaactgggtctacaaaagcatttaaaacttgtcccccattaactccacagaaccaaaagaatgagtttacaataacacatagaatcatacctggaagcgttcctgcaattaacttaagcggtgttccaacaattgcacctaggaatccgttgagacctcctgcaactcctgccgcttcaagaccttttaagaccaaagcccacaaaacaaaagtagtaaaaccaggtaaaagagctgaaaatgatttacttactacatctgggacaccacttggcatttttatcgtaattccgcgctggataaacatacgataa

SEQ ID NO: 498 - DNA (genomic), 558 bp, Streptococcus pneumoniae; double-stranded, circular
  misc_feature (B) LOCATION 1...558
  hypothetical: NO
  anti-sense: NO
gaagttgaggcttacttgttggataagttaaaacatcccaaggttgtggctttaggtgaaattggcttagactaccattggatgacagcgcctaaagaggtgcaggagcaggtttttcgccgtcagattcagctatctaaggacttggatttgccttttgttgtccatacccgtgatgcgctggaagatacctatgagattatcaagagtgagggcgttggtcctcgtggtggtatcatgcattcattttcagggacgcttgagtgggcagagaagtttgtggatcttggtatgaccatttccttctcaggagtggtgactttcaagaaggcaactgacctccaagaagcagctaaagagttacctttggacaagatgttggtggaaacagatgcgccttacttagcacctgtacccaagcgtggtcgtgaaaataaaacagcctatactcgctatgtggtcgactttatcgctgacttgcgtggtatgacgacagaagagctggcggtagcaacgactgcaaatgcagaacgaatttttggattggacagcaagtaa

SEQ ID NO: 499 - DNA (genomic), 501 bp, Streptococcus pneumoniae; double-stranded, circular
  misc_feature (B) LOCATION 1...501
  hypothetical: NO
  anti-sense: NO
ataaaggaggcagatatgaatttaaaacaagctttaattgacaatgactcgatccgactaggtttagaggctaacaattggaaagaagcagtcaaggtagcagtagatcccttaattgaaagtggggcaattttgccagagtattacgatgctatcattgaatcgactgaagagtatgggccttactatatcttgatgccaggtatggctatgccccacgctagacctgaagctggtgtgcaaagtgatgccttttcattgattaccttacaaaatcctgttgtattttcagatgggaaagaggtatctgttttgttggcactagcagcaacaagttcaaaaattcacacaagtgtagccattccacaaattattgccctgtttgaattagaagattctattgcacgtttacaggcttgccagactaaagaagatgtcttggctatgattgaagaatctaaggatagcccttatctcgaaggattggatttggaaagttag

SEQ ID NO: 500 - DNA (genomic), 888 bp, Streptococcus pneumoniae; double-stranded, circular
  misc_feature (B) LOCATION 1...888
  hypothetical: NO
  anti-sense: NO
aacatgagggcaaaagaactacaagactggtttcctgaggctcggatttcagaccaaccagtagagaaagagggctatctcacgctccctttagcttctcagcagtggattttgctggaggaagctgggctcagcgagcgtgaaaagcagttggttgcccttttgacccagcaggagcaggctcgttcgctaaacccttggtattcctatctggttgagggcaagggacaggcaccgcaagtttttaaaaagattcagttggtttattgccatctttcttattttcagcaggaaaatctggcttcttggctagatatgatgcggactctttttccgaattgtcagacagtgctacaggtcggagctcaggattatgttttcgtgcttcaacaagacaaatacacttctgtaagagatattttaagtgatacgattgaagcggttgagtatgactttggacttcgtctttctatcatgttgggtcaggtttggtctcagacgggacatcaagccctatcagacttaatcaaagctgagcgggatttgttcaagacatggtggcgtcagggtcaccaaggtgttcatactttttctcagctctatctttggagtatgggagaaagactcgtggacttgaagccaatcaaggaatgtctacaccagatgattttggatcaagatcagattcaggaaatcattctctctctttgggaaaatagtgctgttctcactaaaacagcccagcaactctatctgcaccgcaattctctccaatacaagattgataaatgggaagagttgacagggcttcagttgaaagagttgaccgacctgaccttgtgttatcaattgattttaggttctttgtcaactatagttggtttgtaa

SEQ ID NO: 501 - DNA (genomic), 411 bp, Streptococcus pneumoniae; double-stranded, circular
  misc_feature (B) LOCATION 1...411
  hypothetical: NO
  anti-sense: NO
aaaaagagggcatttatgacctatgaatacaagagtcacatttatttggcagagacagctttaaatgtaaaggatttggccagtcaaacagccttttatcagcaagttattggtttagaaatcttatctcaaactgagacagagtccattctaggccttggtggaaaagtcttggtacagctgattcaagcacaagagagcggagaagtgagggaatattatggtctttaccatttggccattctcttgcccacacgcaaggctttagctgatgtcttgaaacacctgacagatttacaaattcctcttgtcggcggtgcagaccatggttacagtgaagctatttacttggaagatttggagggaaatggcattgaactctatcgagataagccattttccacatggtga

SEQ ID NO: 502 - DNA (genomic), 398 bp, Streptococcus pneumoniae; double-stranded, circular
  misc_feature (B) LOCATION 1...398
  hypothetical: NO
  anti-sense: NO
gggcgggggcgccggacaacataagcacgccatcctctagtcctgtactcctccccacctcccccgtccccactctggcgcgaggggcgcgacccgccgcaccccccagcgcagccggccgcagcctccccagatccgcggcaaccaaacggngcagcnggccaccacacacgcacccccccccgccccggcccncgcccacccgccacaacccagagcgcgccacgcagcccagcacagacagcaaggcgacgagccacccccgccccgcacgggacccccgggcccccgccccgcgacccccngccccccacagggagagaaaaccaagccaccccgacccaccaacgcaccaccgnggtccagcctcaccaanganattccaacnaagtcaataa

SEQ ID NO: 503 - DNA (genomic), 1119 bp, Streptococcus pneumoniae; double-stranded, circular
  misc_feature (B) LOCATION 1...1119
  hypothetical: NO
  anti-sense: NO
tcgttccatttagatagagaggaaatacatatgagaatttttgctagtccttctagatatattcagggggaaaatgccttgtttgaaaatgccaaatcaattttggatttgggaaattaccctattctattatgcgatcagttggtttatgatattgttggaaaacgatttgaagattacctacataggtatggtttccatattgttctggcgctatttaatggtgaagcttctgacaatgaaatcaatcgagttgttgccttggctgagaaagaaaattgtgatagtattatcggtcttggtgggggaaagacgattgatagcgcaaaagctattgcagatttgattgaaaagcctgttattattgctccaacaattgcatcgaccgacgcacctgtatctgctttatctgttatttatacagatgaaggtgcatttgatcattatctattttattctaaaaatccagatttagttttggttgatacaaaagttatttcacaagcccctaagcgtttattagcgtctggtattgcagatggtttagcaacttgggttgaggcgcgtgcggttatgcaggcaaatggaaaaactatgttgggacaacagcaaacattggctggagttgcaattgcgaagaaatgtgaagaaacgctgtttgcagatggtttacaggctatggcagcttgtgaagctaaagtggtgacaccagcattagaaaatattgttgaagctaatactttattgagtggtctaggttttgaaagtggaggattagctgcggcgcatgcaattcataatggttttactgcattgacaggtgacattcatcatttaacacatggtgaaaaagtagcttatggaactttagtacaactattattggaaaatagacctaaagaagaacttgataagtatattgagttttacaaaaaaattggtatgccaacaactctaaaagaaatgcatttggatcaagttggatatgatgatttaataaaagttggtaaacaagcaactatggagggtgagacaattcatcagatgccgtttaagatttcgccttcagatgttgctcaagctattatcgctgtagatgcctatgtaaattcaaaataa

SEQ ID NO: 504 - DNA (genomic), 189 bp, Streptococcus pneumoniae; double-stranded, circular
  misc_feature (B) LOCATION 1...189
  hypothetical: NO
  anti-sense: NO
atcacacatttaggaggaaattttatgaagaaaaaaatacttatcattttcatcttgtatctaatcatgtccatctttctttatccgcttagggaaagtatttggtatcagctattttataccatagcctatgtgattgcagttatgatctattttgctttaactaaaaagaaaggagcaaagaaatga

SEQ ID NO: 505 - DNA (genomic), 368 bp, Streptococcus pneumoniae; double-stranded, circular
  misc_feature (B) LOCATION 1...368
  hypothetical: NO
  anti-sense: NO
ggctggaccncggtggtgcgttggtgggtcggggtggcttggttttctctccctgtggggggcngggggtcgcggggcgggggcccgggggtcccgtgcggggcgggggtggctcgtcgccttgctgtctgtgctgggctgcgtggcgcgctctgggttgtggcgggtgggcgngggccggggcgggggggggtgcgtgtgtggtggccngctgcnccgtttggttgccgcggatctggggaggctgcggccggctgcgctggggggtgcggcgggtcgcgcccctcgcgccagagtggggacgggggaggtggggaggagtacaggactagaggatggcgtgcttatgttgtccggcgcccccgccc

SEQ ID NO: 506 - DNA (genomic), 1092 bp, Streptococcus pneumoniae; double-stranded, circular
  misc_feature (B) LOCATION 1...1092
  hypothetical: NO
  anti-sense: NO
gattgtaattttcttacgggcatgattctctccttaacagtacatacctattttatcattttttcggcagagaattattacagaaaggttacaaaaagaataaagtcccttttcattttcaaagcatggctgattttggagaaatgtggtataatttttcttatggaaaagattgtcattacagcaactgctgaaagtattgaacaagttgaacaactactcgaagctggcgtagaccgtatctatgtcggtgagaaagattttggccttcgtctgccaacgacctttagttatgaccaattacgtgaaatcgctaagttggttcatgatgctggtaaggaattgatcgttgcggtcaatgctctcatgcaccaagatatgatggaccgtatcaagcctttcttagacttcttggaagaaatcaagacagactatattacgattggggatgcaggcgtcttttacgtagttaaccgcgatggttattcatttaagaccatctacgatgcttcaaccatggtaactagcagtcgtcagattaacttctggggacaaaaggctggcgcatctgaggctgttttggcgcgtgaaattccatcagctgaacttttcaaaatgccagaaattttggaaattcctgctgaagttttggtttacggtgctagtgtcatccatcattctaaacgtccgctcttgcaaaactactataactttacacatatcgatgatgaaaagacgcataaacgtgacctcttcttggctgagccaagtgatccagagagccactattccatttttgaagataatcatgggacccatatctttgccaacaatgaccttgatttgatgatcaaattaacagaattggtggagcatggctttactcgctggaaactagaagggctctacactcctggtcagaactttgttgagattgcaaaactctttatccaagcgcgtaacttgattcaagagggcaactttagccatgatcaagtcttcttgctggatgaagaagttcgtaaacttcaccctaaaaaccgtttccttgatacaggattttatgactacgatcctgacatggttagataa

SEQ ID NO: 507 - DNA (genomic), 261 bp, Streptococcus pneumoniae; double-stranded, circular
  misc_feature (B) LOCATION 1...261
  hypothetical: NO
  anti-sense: NO
ttctgttttttttatttatactcaatgaaaatcaaagagcaaactaggaagctagccgcgggttgctcaaagcactgctttgaggttgtagatagaactgacgaagtcagctcaaaacatgtttttgaggttgtagatgaaactgacgaagtcagctcaaagcactgctttgaggttgtagatgaaactgacgaagtcagtaaccatacatacggtagggcgacgctgacgtggtttgaagagattttcgaagagtattaa

SEQ ID NO: 508 - DNA (genomic), 222 bp, Streptococcus pneumoniae; double-stranded, circular
  misc_feature (B) LOCATION 1...222
  hypothetical: NO
  anti-sense: NO
aagctaaattttatgaaggctatattctttattattctcttcgcttttcaaacctatcttatttatctatccataagtatctccgataaaaaacaaaagactattgaattaacatcattgaattgttttgtcatattatttctaatctatgataaattaatttttctctttattgcttatgtttttttgataatttttatattaaacttgttccgtaactga

SEQ ID NO: 509 - DNA (genomic), 1032 bp, Streptococcus pneumoniae; double-stranded, circular
  misc_feature (B) LOCATION 1...1032
  hypothetical: NO
  anti-sense: NO
ataaaaaatttagaaaatttaagaatagaaaagagaacaaatcttatggcaaaagatattcgtgtcttactttactacctttatactccaattgaaaatgcagagcaatttgctgcagaccacttggctttctgtaaatcaatcggccttaaaggccgtatcctagtcgctgacgagggaattaacggaacagtttcaggtgactatgaaacaactcaaaaatacatggactacgttcacagccttccaggaatggaagatctctggttcaagattgacgaagaaagtgaacaagccttcaagaagatgtttgttcgctacaagaaagaaattgtccaccttggtttggaagacaacgactttgacaatgacatcaacccacttgaaacaacaggtgcttacttgtctccaaaagagttcaaagaagcgcttcttgataaagataccgttgtccttgacacacgtaacgattatgagtacgacctagaacatttccgtggggctattcgcccagatattcgcaacttccgtgagttaccacaatgggtccgtgacaacaaagaaaaattcatggacaagcgtgtcgtggtttactgtacaggtggtgttcgctgtgagaaattctcaggctggatggttcgtgaaggttacaaagatgttggccaattgcacggaggaatcgcaacttacggtaaagacccagaagttcaaggtgagctttgggatggaaaaatgtacgtatttgacgagcgtatcgccgttgatgtcaaccatgtcaacccaaccatcgtagggaaagactggtttgatggaacaccatgtgaacgttatgtcaactgtggaaatcccttctgtaaccgtcgtatcttgacatcagaagaaaatgaagacaagtaccttcgtggatgctcacacgagtgccgtgttcacccacgtaaccgctatgtttcaaaaaatgaattgacacaagctgaagtgattgagcgcctagccgctatcggtgaaagcttggatcaagcagctactgtataa

SEQ ID NO: 510 - DNA (genomic), 984 bp, Streptococcus pneumoniae; double-stranded, circular
  misc_feature (B) LOCATION 1...984
  hypothetical: NO
  anti-sense: NO
ttccatttttattacgggggctttctttattatttgacaaaccctattgttactttcttaaataaagtctgtaaactcaatcgtttgcttggtattttaattaccttgtgtactttggtctggggaatggtcataggtgttgtctatctcttacctattttgattaatcagttatctagtttgattatatctagtcaaactatttatagtcgagtacaagacttaatcatagacttatctaattatcctgcgctccagaatttggatgtagaagctacaattcagcagttaaacttatcctatgttgatattcttcaaaatatcctaaatagcgtatcaaatagtgtggggagcgtcttgtcagctcttatcagtactgttttgattttgattatgactccagtttttttggtttatttcttattagatggacataaattcttgcccatgcttgaaagaacgattctaaagagggatcgcttgcatattgcaggcttattaaagaatttaaatgcgacgattgctcgctatattagtggagtttcgattgacgcaatcattataggttgtttagcttatattggctatagtattattggtttaaaatatgctttagtttttgccattttttctggtgtagccaatttaattccttatgtggggccaagtattggtttgattcctatgatcatcgcaaatatattcactgatccccatagactgctgattgcagtgatttatatgcttgttgttcagcaggtagatggcaatatcttatatcctcgaatcgtaggaagtgttatgaaggttcatccaatcacgattttagttttacttttgttgtcaagcaatatctatggtgtagttggaatgattgtcgcagtgccaacctattctatcttgaaagaaatttctaagttcttatcccgtttgtatgaaaatcataaaataatgaaagaacgagaaagagaattagctaagtaa

SEQ ID NO: 511 - DNA (genomic), 348 bp, Streptococcus pneumoniae; double-stranded, circular
  misc_feature (B) LOCATION 1...348
  hypothetical: NO
  anti-sense: NO
aagtcattttatggcttatctacaattgattcagtttattcttatgcaatgcagcacttgactagccaaaattatccggacattatttttgtttcaggagatgaaaaggttcagggcttgattcgtgcgtgctatgagaaaggaattcttattccagatgatatttctatcattggatttaataatattcctatttctcagtattatactccagctttgtctacaattgctcccaattatgttaaattggctaaagaaatgatagagggtgttttagcgattattaaaggggaaagtgtcacatctgttgaagtttctcctaaatttgttaggagacagattttctag

SEQ ID NO: 512 - DNA (genomic), 309 bp, Streptococcus pneumoniae; double-stranded, circular
  misc_feature (B) LOCATION 1...309
  hypothetical: NO
  anti-sense: NO
actaaattttataggaggaagacaatggattggtacgattatatgatacaggcatccaaacaatcacaattcaacgcaagccattggtttcgctatttgcgaaaagttatttttgaagactattcttatttaacaaaccaagatgtagaaaagttgctagactccaaagaactaacccgttttcaaaaaattagcttgaagtatgcctttcaagagcatactccaactcataaatatgtgatttcattaaataaacctgctaagttaaccaatgttcaaaaattgatggagaaatacaaacatggataa

SEQ ID NO: 513 - DNA (genomic), 690 bp, Streptococcus pneumoniae; double-stranded, circular
  misc_feature (B) LOCATION 1...690
  hypothetical: NO
  anti-sense: NO
aagcattttctatttcactcgtcaaaagaggaggtttatagaatgaatgaaataattacattaaaaaatattgagttgaaattaaaaaaaacatgtgtttttcaaaaccttaattttagttgtaaacagggggaaattataggaattactggtgcgaatggctcagggaaaagtgtattgtttaaattaatagctggtttatatagtccgtcttatggagaagtgttaatcaatggggaaaatattgttcctgagagaaaaattccagctaatttgggagctttgattgaagaacctggttttataaattattatagtggctttaagaatttacaatatttggcaagcatacgaggagtagttggtaatcaggaaatcaatgatacactgaaaatagttggtctatatgagcaaaaagaccagaaagttaaaacttattcgctaggtatgaggaaaaagctagggattgctcaagcaattatggagaatccctctattcttttactagatgaacctatgaatgccttggataaatcaagtgtagaaaatatgagaacattgtttagaaagctctctagtgaaaaagggacaacaattttgattgctagtcatagtgaagaggatattcgtatcttatgtgataaagtatatgcaatagaagataaagtatgtacactgtgttcagattga

SEQ ID NO: 514 - DNA (genomic), 468 bp, Streptococcus pneumoniae; double-stranded, circular
  misc_feature (B) LOCATION 1...468
  hypothetical: NO
  anti-sense: NO
attattctttatactcgtaagcaagaagtccatagtgtcctagccagtaagaagtcggtgaagcttttttacagtatgttactcttaattaatgtgttaggagctgttcttgttttgtcagataacttgttcatcaaaaatacgctgcagcaagaattagttgactttttattgccatccttctttttcctatttgggctagatttgctgatttttttacccttgaaaaaatacgtgcgcgattttcttgctatgctggacagaaaaaagacagtgttggtgactattttagcaacacttcttttcttaagaaatccaatgaccattgtctcacttctgatttatattggactgggcttgttttttgcagcctatcttgtcccaaattcggttaagaaggaagtttccttttatggtcatattttccgagatcttgtattggtcattgttacgctcattttcttttag

SEQ ID NO: 515 - DNA (genomic), 618 bp, Streptococcus pneumoniae; double-stranded, circular
  misc_feature (B) LOCATION 1...618
  hypothetical: NO
  anti-sense: NO
gtcattctttactacaaatatctaggcttttctttagagaaaatagcagagctgttaaaggaagaaaggacagatttattgccccatttaactaggcagttggactatctaactcgcgaaaggcaacatctggataccttgatttccaccttgcaaaaaactattcaagaacaaaaaggagaaagaaaaatgaccattgaggaaaaattcacgggatttagctatcaagacaatcaaaaatatcaccaagaagcggtagagaaatatggtcaagaagtcatgggacaagcgctcgaacgccaaaaaggtcacgaagacgaggctacggccgcctttaaccaagtctttcaaactttggcacaaaatcttcaagttggtttacctgcaacagcaaccgaaaaccaagagcaagcagccaagctcttgcaagctattcgcacttatggatttgactgctctattgaggtattcggtcatatcggtaaaggttacgtctacaacccaaattttaaggaaaacattgacaagtttggttctggaacagcccagtacacgtcagatgccattgccggcttacgttcagacaaatgcagaataaatagactaggaatttcctag

SEQ ID NO: 516 - DNA (genomic), 198 bp, Streptococcus pneumoniae; double-stranded, circular
  misc_feature (B) LOCATION 1...198
  hypothetical: NO
  anti-sense: NO
ctttatctttatacctttctaaaactgttcgagcaaatttttcataaaaatgaatcattctcctatcaacccatccatgatattttcttgctaaatataatggagtctcatagtgtgaaagagttacaagtggctctatcccgtgagcatgtagttcatcaaacaattcatcataatatttcaaaccagcttcgttag

SEQ ID NO: 517 - DNA (genomic), 189 bp, Streptococcus pneumoniae; double-stranded, circular
  misc_feature (B) LOCATION 1...189
  hypothetical: NO
  anti-sense: NO
ctgaagctttatcgggttcaaaactcggcaatgaactctatctgggttctaacttccaagaagaagttggtctgcgtggcgctcatacctctacaaccaagtttgacccagaagtcttcctcgcagttgcttgctcaccagcaggtgatgtctacggtggtcaaggcaagattggagatggaaccttga

SEQ ID NO: 518 - DNA (genomic), 948 bp, Streptococcus pneumoniae; double-stranded, circular
  misc_feature (B) LOCATION 1...948
  hypothetical: NO
  anti-sense: NO
gattacatttacttgcatacgacgaaatgtaaacatttctgtttaaaattaaggataaaatcaatgaaaaaagcaatggtaattatcaaccctacttctggtggcgagaaggctttggattacaaagaaaagctggagaataaagcaaaagaatactttgaatatgttgaaaccaaaattaccgaaaaagcgctggatgcaacacattttgctgaagaagcttctcgtgagcagtatgatgcagtggttgtgtttggtggagatggaactgtcaatgaagtcatttcaggtattgatgagagagactacattcctaagttagggattatcccaggcggtacgggtaacctcattacaaaacttttggaaatcaatcaagacatcgatggcgcaattgacgaactggattttgatttaaccaataagattgatatcggtaaagcaaatgacaactattttggttatatctttagtatcggttctctgcctgaggcgattcacaatgttgaaatagaggacaaaacaaaattcggtattttaacctatgctgtaaataccatgaagtctgtcatgacagatcaggtctttaacattaaggttgagacagaaaatggaaattatgttggtgaagctagccatgttttggtccttttgacaaattacttcgctgataagaaaatctttgaagaaaacaaggacggctatgccaacattttgattctgaaagatgcctctatattctccaaattatccgtcattcctgatttattaaaaggggatgttatcgcaaatgataatatcgagtatatcaaagcgcgtaatattaaaatctcttcagatagtgaattggagtcagatgttgacggagataaatcagataacctacctgtagaaatcaaagtcctagctcagcgagtagaagtattttcaaaaccgaaagaggattag

SEQ ID NO: 519 - DNA (genomic), 198 bp, Streptococcus pneumoniae; double-stranded, circular
  misc_feature (B) LOCATION 1...198
  hypothetical: NO
  anti-sense: NO
cctccctttctaaaaaatagcaagttttgggtcattgatgaaactgatgaaagattaggaccattcaatacatttgaagaggcttatcaatcgttgttattttatttaaaaatgactgaagatgaatatcagtcaaactatacggcccaggaacttgtttatatttacaaagaggagaaaaaaccatgccgtcgatga

SEQ ID NO: 520 - DNA (genomic), 1146 bp, Streptococcus pneumoniae; double-stranded, circular
  misc_feature (B) LOCATION 1...1146
  hypothetical: NO
  anti-sense: NO
aacatgatttactttgataattcggcgacgaccaggccctatccagaagcccttgaaacctatatgcaggtggcttcaaaaattttaggaaatccatctagtctccatcgtttgggagaccaggcaacacgaattttagatgcttcccgtcaacagattgcagatttaatcggtaagaaaagtgatgaaatcttctttacatctggtgggacagaaggggataactggatcatcaagggagtagcatttgaaaaagcccagtttggcaagcacatcatcgtatcagccattgaacatccagcagttaaggaatcagccctctggttgaaagctcaaggttttgaagtggattttgctccagttgataacaaaggatttgtggatgttgaggcgctagaagatttgataagacctgatacgaccctcgtttccatcatggcagttaacaatgaaattggctctgttcagcccattgaggctatttcaaaactattggcagacaagccaactatttccttccacgttgatgcggttcaggcgcttgccaagattccgactgaaaagtatctgacagaacgagtggatttcgcgactttctctggtcacaagttccacggaatccgtggtgttggttttatctatatcaagtctggcaagaagattacgcctcttttaacaggtggtggtcaggaacgtgattaccgttcgacaactgaaaatgtggcaggaattgcagcgaccgctaaggctctccgtttatctatggaaaagctagatatctttaggagcaagactgggcagatgaaggcagtgattcgtcaagcacttctggactatccggatatatttgtcttttcagatgaggaagacttcgcccctcatattctgacttttggaatcaagggtgttcgtggtgaggtcattgttcacgcctttgaagactatgatattttcatctcaacgacctcggcttgttcgtccaaggctgggaaaccagccggaaccctgattgctatgggagtggacaaggataaggctcagtcagctgtgcgtcttagtctagaccttgaaaatgatatgagtcaggtcgagcagttcttgaccaagctaaaattaatttacaatcaaactagaaaagtaagatag

SEQ ID NO: 521 - DNA (genomic), 1113 bp, Streptococcus pneumoniae; double-stranded, circular
  misc_feature (B) LOCATION 1...1113
  hypothetical: NO
  anti-sense: NO
aaacgaaattttcacatcttcacttttgtaagtagatatagagcttcaatcagtacctctacttgtaaaagaatgtgtgagatagaaaggacaggaaaaggaatgaatgcagatgatacagtaaccatttatgatgtcgctcgtgaagcaggtgtttccatggcgacggtcagccgtgtggtcaatggcaataaaaatgtaaaagagaatacccgtaaaaaagtgctagaggtaattgatcgtttggattatcgtccaaatgcagttgcgcgtggtcttgcaagtaaaaagacaaccactgtcggtgtcgtgattccaaatattaccaatggttatttttcgagtttggctaaggggattgatgatattgcagaaatgtacaagtacaatattgtcctagctaatagcgatgaagataacgagaaagaagtttctgttgtcaataccctcttttcaaagcaggtagatggcattatctatatgggttatcacttgacagataaaattcgctcagaattttcgcgttcacgtactccgattgttctcgcaggaactgtcgatgttgagcaccagttgccaagtgtcaatattgactataagcaagcaacaattgatgcagtgagttaccttgctaaagaaaatgagcgtattgctttcgttagcggtccgctagtggatgacatcaatggtaaggttcgtttagttggctacaaggaaaccttgaaaaaagcaggaatcacttatagtgagggtttggtatttgaatctaaatatagctatgatgatggttacgccttagcagagcgtttgatttcatcaaatgcaactgcagcagttgtgacaggtgatgagttggcagcaggagtcttgaacggtttggctgataagggtgtttctgtgccagaagattttgaaattattactagtgatgattcacaaatctcacgctttacccgtccaaacttgacaacgattgcccaacctctttatgaccttggtgccattagtatgcgtatgttgaccaagattatgcataaggaagagttggaagaacgtgaagttctcttacctcatggtttgacagaacgtagctcaacacgaaaacgtaaatag

SEQ ID NO: 522 - DNA (genomic), 216 bp, Streptococcus pneumoniae; double-stranded, circular
  misc_feature (B) LOCATION 1...216
  hypothetical: NO
  anti-sense: NO
caacgctttctatatgtgcgagaatatcgaacttatgaagaaattgcggctgattttggtatccacgaaagcaacttactccgtcggagccaatgggttgaagtaactcttgttcaaagtggtgttacgatttcaaaaactcatcttagtgctgagaatacggtgattgtggatgcaacagaggtaaaaataaatcgtcctaaaaaaatcaactag

SEQ ID NO: 523 - DNA (genomic), 399 bp, Streptococcus pneumoniae; double-stranded, circular
  misc_feature (B) LOCATION 1...399
  hypothetical: NO
  anti-sense: NO
cagcgaaatttcgcctataatctttcaacttcaccaaacttagaacaagtgaaagctatgttaaaccaggcctttacagagaaacattatgagaataccattctccatagcgatcaaggctggcaataccaacacgatttttatcacaggtttttagagagtaagggaattcagccatctatgtcacgcaaaggaaacagcccagacaatggcatgatggagtccttctttggcatcttgaaatccgaaatgttttatggttatgagaagaactttagatctttagaaaaccttgaacaagctattgtggactacattgattactacaacaacaaacgaattaaggtaaaactaaaaggacttagtcctgtgcaatacagaactaaatccttcggataa

SEQ ID NO: 524 - DNA (genomic), 390 bp, Streptococcus pneumoniae; double-stranded, circular
  misc_feature (B) LOCATION 1...390
  hypothetical: NO
  anti-sense: NO
gctatatttctgactgtcctaaaaacaatggtgaagcagctagtccagcagccgcggaataatacaggttctaaatacccttatactattgatgtgacaggcgaggttggtgatttgaaacaaggtttttctgtcaacattgaggttaaaagcaaaactaaggctattcttgttcctgttagcagtctagtaatggatgatagtaaaaattatgtctggattgtggatgaacaacaaaaggctaaaaaagttgaggtttcattgggaaatgctgacgcagaaaatcaagaaatcacttctggtttaacgaacggtgctaaggtcatcagtaatccaacatcttccttggaagaaggaaaagaggtgaaggctgatgaagcaactaattag

SEQ ID NO: 525 - DNA (genomic), 672 bp, Streptococcus pneumoniae; double-stranded, circular
  misc_feature (B) LOCATION 1...672
  hypothetical: NO
  anti-sense: NO
tggccatttctgctatctacatgggccacaaggttatcgcgctggatcctgcggcggattgcccggcctctcgcgtggcggaaatcattgtggcaccttataacgatgtggacgccctccgtcagttggcagaccgttgcgatgtcctcacttatgagtttgaaaatgtcgacgctgacggtttggatgccgttatcaaggatgacaactccctcaagaaacagattctgccgcatttcgcaaaatcgtattttagaaaaggactttttgtcaaacaaggctcaagtcactgtggcaccctacaaggtcgtgacttctagcctagacttggcagatatcgacatgtcgaaaaactatgtcctcaagactgcgactggtggctacgatggtcatggacaaaaggttattcgttcagaagcagacttggaagcagcctatgcgctagcagactcagacagctgcgtcttggaagaatttgtcaactttgaccttgagatttctgtcatcgtgtcaggaaatggcaaggaggtgacgtttttcccagttcaggaaaatatccaccgcaacaatatcctgtctaagaccatcgtaccagcccgcatttctgaaagtctagtagacaaccataagactatggcagtcgaatcgcagaacaaaactcaacttgtctga

SEQ ID NO: 526 - DNA (genomic), 852 bp, Streptococcus pneumoniae; double-stranded, circular
  misc_feature (B) LOCATION 1...852
  hypothetical: NO
  anti-sense: NO
aagggaaattttatgatcataaaacgaatactaaaccacaatgccgtaattgcgcaaagtaaaaaagatatcgatattcttctttttggaaggggaatagcttttggaagaaaaactggagataaagtaaatccaattgatattgagaaaagtttttttctcaaaaatagagataatatgacccgttttacagagatgtttattaacgttcctttggagttggtgtacatcaccgaaaaaataattaacctaggtaaaataacattgggtaataattttgatgaaattatctatattaatttaacggatcatatttcttcgagcatagaacgttataaagaagggattattatttcgaatcccctacgctgggaaatatcgaaatattataaagaagaatttgaacttgggaaaagggctttacaaataataaaaaaagagttaggtattgaacttccaattgatgaagctgcattcatagcgctacattttgttaatgctaatttagaaaataattttcaagagtcgtataaaatcactgaaataattatgggaattgagaaaatcattcaagatttctattgtactgagtttaaccaagattctattgattattatagattcataactcatataaaattatttgcccatcgcttggttgaaaatacaacttattgtgacgatgatgatgaagacttgttagcattaatgaaaaataaatatcctagagaatatgaatgtggtgaacaggtggcaatgtttatacaaactgagtacaattatttgctgacttctagtgaattagtttatttgatggctaatattcgtcgcttaacaaaaaatttagattaa

SEQ ID NO: 527 - DNA (genomic), 1359 bp, Streptococcus pneumoniae; double-stranded, circular
  misc_feature (B) LOCATION 1...1359
  hypothetical: NO
  anti-sense: NO
tttttttcttactgttttaatccctttatttgtggtaaaataagactattaagtttaaagaggatccctatgaaattacaaaaaccaaaaggaacgcaggatattttacctgctgaatctgctaagtggcagtatgttgagggctttgcccgtgagattttcaagcgctataactatgcagaagtgcgcacgcctatttttgagcattacgaggttatcagtcgctctgtcggagatacaacggatatcgtaaccaaggaaatgtacgatttttatgacaagggtgaccgtcatattaccctccgtccagaaggaactgcgcccgttgtccgttcctatgtggaaaataaactcttcgccccagaagtgcaaaagccaagcaagttctactatatgggacctatgttccgttatgagcgtccacaggcagggcgcttgcgccaattccaccagattggtgttgagtgttttggctctagcaatccagctaccgatgtggaaacaatctctatggcagcctattttttgaaggaaatcggtattcaaggtgtcaaattgcacctcaacactcttggaaatcctgagagccgtgcagcctaccgccaagccttgattgactatttgacaccgctcaaggagaccttgtctaaggatagccaacgtcgcttggaggaaaatcctcttcgtgtcttggactctaaggaaaaagaagacaaggtggcagtagagaatgcgccgtctatcttggactttcttgatgaagaaagccaaactcattttgatgctgtgcgtcagatgttggaaaatcttggagtagattacatcatcgataccaatatggtgcgtggtctggactactacaaccacaccattttcgagtttatcacagagattgagggcaatgacttgacagtctgtgcgggtggtcgctacgatggtttggttgcttactttggaggccctgaaactgctggatttggttttgggcttggtgtagagcgcctgcttctcatccttgaaaaacaaggcgtggccctccctatcgaaaacgccctagatgtctatatcgcagtcttgggtgatggagcaaatgtcaaagccctagaactagtccaagctcttcgccaacaaggtttcaaagcagagcgtgattacctcaaccgtaagctcaaagctcagttcaagtcagcagatgtctttgcggctaagaccctcatcaccctaggagagagcgaagtcgaaagcggacaagtgacggtcaagaacaaccaaacccgagaagaagtgcaagtgtcacttgagacaatcagccaaaacttctcagaaatctttgaaaaactaggattttatactcaatga

SEQ ID NO: 528 - DNA (genomic), 735 bp, Streptococcus pneumoniae; double-stranded, circular
  misc_feature (B) LOCATION 1...735
  hypothetical: NO
  anti-sense: NO
aataattcttatttgctagaaaggtggagagacatgcgctggctttttcgtttgataggggctttcttttcttttgtgtggcgtttgttttggcgtctggtttggatagttgtgctcttatgtgtgcttgctttcggacttctctggtatctgaacggggattttcaaggagcgctaaagcaagcagaacggtcagtaaaaattggtcaacaaagtattgaccaatgggagaaaacagggcaactgcctaagttaagccagacagatagtcaccagcattctgaaggaaggtggccacaggcctctgctcgtatttacctggatccgcagatggattcacgctttcaagaggcttatttagaagcaatccagaactggaatcaaactggtgcttttaactttgaactcgtgactgagtctagtaaggcggatattaccgctacggagatgaacgacggaggcactcctgtggcaggagaggcggaaagtcaaactaatctcttaacagggcaattcttgtccgtaacggtgcggttgaatcattattatttgtccaatccatactatggctactcctatgaacgccttgtccatacggcagaacatgagttaggtcatgcgattggcttggaccatacagatgagaagtctgtcatgcaaccagcaggttccttttatggtatccaggaagaggatgttgcaaacctccgaaaaatatatgagactagtgagtag

SEQ ID NO: 529 - DNA (genomic), 282 bp, Streptococcus pneumoniae; double-stranded, circular
  misc_feature (B) LOCATION 1...282
  hypothetical: NO
  anti-sense: NO
ctgagatttcttcatagcataaacttcttggaactggtagtagtcaccagagtaacgcgtcagctgttgattttccacatgatagacaatattgataacgtcattgaggaatggaatatcgtgcgaaatgagaacaaaggcattctcatagttttggagatagcgcttgagccaatcaatatgctcagcatccaagtagttggtcggctcgtccaacagcaaaatatcaggcttttcaaggagaagttttgccaaaagcaccttggttctttgcccacctga

SEQ ID NO: 530 - DNA (genomic), 810 bp, Streptococcus pneumoniae; double-stranded, circular
  misc_feature (B) LOCATION 1...810
  hypothetical: NO
  anti-sense: NO
acagaatcttataataaacgagttataaaagcaaacacgatgacaggatttattcattttaaagatttggatggtgccagtgttgggaatagtcatccttcaacttcaccaggcggaactcattattttaagaccaagtctgctattaaaactgaacctctagctagcggaactgtgattgattactattatcctggggagaaggttcattatgatcagatacttgaaaaagacggctataagtggttgagttatactgcctataatggaagctatcgttatgttcaattggaggctgtgaataaaaatcctctaggtaattctgttctttcttcaacaggtggaactcattattttaagaccaagtctgctatcaaaactgaacccctagttagtgcaactgtgattgattactattatcctggagagaaggttcattatgatcaaattctcgaaaaagacggctacaagtggttgagttatacggcttataacggaagtcgtcgctatatacagctagagggagtgacttcttcacaaaattatcagaatcaatcaggaaatatctctagctatggatccaataatagttcaactgtcggttggaagaaaataaatggtagttggtatcatttcaaatcaaatggttctaaatcaacaggatggctgaaagacggttctagctggtattatttgaaattatctggtgaaatgcagacaggatggttaaaggagaatggctcgtggtattatctgggtagttcaggggctatgcaaacagggtctaccagtatcgtcagaagagcataa

SEQ ID NO: 531 - DNA (genomic), 468 bp, Streptococcus pneumoniae; double-stranded, circular
  misc_feature (B) LOCATION 1...468
  hypothetical: NO
  anti-sense: NO
atgaacacttatgaaggtaatttagtagcaaacaatattaaaataggtattgttgtagcgagatttaatgaatttataacttcaaaattattatctggagcactagataatctcaaaagagagaatgtaaacgagaaagatatcgaggtagcctgggttccaggagcttttgaaataccactgattgcatcaaaaatggcaaaaagtaaaaaatatgatgcaattatctgcttgggagctgtcattagagggaatacaagtcattatgattatgtatgtagcgaggtatctaagggaatcgcccaaatcagtttaaatagcgaaattcctgttatgtttggtgtgctaacgacagatacaattgaacaagccatagaacgagctggtaccaaagcaggaaataagggttctgagtgtgcacaaggagctattgaaatggtcaacctaattcgtacattagacgcatag

SEQ ID NO: 532 - DNA (genomic), 297 bp, Streptococcus pneumoniae; double-stranded, circular
  misc_feature (B) LOCATION 1...297
  hypothetical: NO
  anti-sense: NO
gtatcaacttatccttttttaaaagaaaaatccgaagatatttggccttcttcggattttttctattttccacagtttcatgtaattcatctagatgatgaacaaattagttgttctttcctctacggaatagataaaatgccccaagtagcaagaaccctagacttgccaagattgactgaccttctcctgtctgagggagattcttttgatccgaatggttcttttcctcttcagatttttccttttcttttgaattctgtacttgtggctgagctgcttgctctagctttttaa

SEQ ID NO: 533 - DNA (genomic), 963 bp, Streptococcus pneumoniae; double-stranded, circular
  misc_feature (B) LOCATION 1...963
  hypothetical: NO
  anti-sense: NO
atggaaacttactacaaagccattaactggaatgccatcgaagatgtcatcgacaaatcaacttgggaaaaactgacggagcaattttggctcgatacacgtattcccttatcaaacgacttggatgactggagaaagctatctaacaaagagaaagacttggtcggaaaagtttttggtggtttaacccttcttgacactatgcaatctgaaactggggttcaagcccttcgcgcagacatccgtacaccacatgaggaagctgttttcaataacatccaatttatggaatctgtccacgctaaatcttactcatcaatcttttctaccttgaatactaaggctgagattgaagaaattttcgaatggaccaataccaatccttacctacaaaagaaggctgagattgtcaacgaaatctacctaaacggcagcccacttgaaaagaaagttgccagcgtcttcctcgaaaccttcctcttctactctggtttcttcactcccctctactatctcggtaacaacaaactagccaacgttgcagaaatcattaaattgattattcgtgacgagtctgttcacggaacctacattggttacaaattccaacttggtttcaatgaattgcctgaagaagagcaagaaaaactcaaagaatggatgtacgacctactctatactctttatgaaaatgaagaaggctacacagagagtctttatgacggtgttggttggactgaagaggttaaaaccttccttcgctacaatgccaataaagctctcatgaacatgggacaagatccacttttcccagattcagctgaagatgtcaacccaatcgttatgaacggtatttcaacaggaacttccaaccatgacttcttctctcaagtcggaaatggttaccttcttggcgaagttgaagccatgcaagacgatgactataactacggtttagactaa

SEQ ID NO: 534 - DNA (genomic), 291 bp, Streptococcus pneumoniae; double-stranded, circular
  misc_feature (B) LOCATION 1...291
  hypothetical: NO
  anti-sense: NO
tggaggacttacgtgcttaagattcgttatcataaacagtttaaaaaagattttaagttggctatgaagcgtggtttgaaggcagaattattagaagaagttttgaattttctggttcaagaaaaagaacatcctgccagatatcgtgatcattcattgacggcatccaagcattttcaaggagttcgtgaatgccatacccagccagattggcttttggtttataaagtagataagtcggaattgattttaaatttgctgaggacaggcagtcacagtgatttattttaa

SEQ ID NO: 535 - DNA (genomic), 996 bp, Streptococcus pneumoniae; double-stranded, circular
  misc_feature (B) LOCATION 1...996
  hypothetical: NO
  anti-sense: NO
gtttttcttctaacctatcctttctatttcattcggttatttgaacggctcttgtatcgtttgcagacttcctactatgcctactatgcaaattttgaaagtaaactgccttattttacctacattttgtctacctttacggtctatgcaatgtgtatgtatctagcaaccaagccaaagaaattgcaggccacagcagtgcttgtctcctttattgcagctaatactattcatttggcaattgggacacgaaatccctttattttaagtattttatttgcttttgtttattactttatgcgggagcaaactgaaaaaggaaaatggattgggtttaaagaaaagttagcgatttttgtaggttctcctattctcatgttagcgatgggagtactcaattatgtacgggataatgtccaagtttcccatacaggtttctgggatatcttacttgactttatctataaacaagggactagttttggtgttctggctcgaggttttctatttaacagtagcctcccttaccgagatttccgtaattttacttttggtcctgttcttgattattttgcaagggggagtttgggagccattttcggaggaaaagcctttgaacatacaaccaatagtgtggaactagctattgatagtaatagttatgcccacaatatatcctatcttgtcttgaacaaggaatacttgaaagggcatggtatcgaaagtagttatatcatggagttgtataccgactatggtatgattggagtctttctgcttagtttcttactcggcgtattatatatagccatgctgcaagtagcctatcgctcaaggacaatcctatttgctttatccatactcatcttgaataatctattctttatgccaagaagcagcttttcagaaagtttcttcaatttatttacaatgcaattctggggaattgttcttgtgattatatttgtagcaaaaatgcttacaaaggaaaactag

SEQ ID NO: 536 - DNA (genomic), 378 bp, Streptococcus pneumoniae; double-stranded, circular
  misc_feature (B) LOCATION 1...378
  hypothetical: NO
  anti-sense: NO
gagcttcttctggacccactctaccgcctacatgtttcagtaatctttttagaaagagagcaagccatttcaaccgaggantacctcgcccacctctttctccattttcataaaaaccaagaccatatcaccagtctgctattttccaaaaatgactacttcctccgtcaactccataaagagctagaacaccatgtctattccgtgctagctgataatttaaaagaagcccaccctaatatgcctacttcttacctccaacacttggtcgtgtccaactttatcgagacattgacctggtggctcaaaaaaggtcaagatttcacaggccaggaagttgtccaattttatctagaccttctcattcctaaaaattga

SEQ ID NO: 537 - DNA (genomic), 207 bp, Streptococcus pneumoniae; double-stranded, circular
  misc_feature (B) LOCATION 1...207
  hypothetical: NO
  anti-sense: NO
aatggttattataaaaaatggtctgaaatagatgatgatacttttcgaaaatctttttacgtcagctcagctttgccttgctgtgttttgagcaagctacggttagcttccgagtttgattttcatttactagaaatgaaactgatgagagatatcagtagacatttgagtcaggatattatggaaaatgataaaaagagctcgtga

SEQ ID NO: 538 - DNA (genomic), 1371 bp, Streptococcus pneumoniae; double-stranded, circular
  misc_feature (B) LOCATION 1...1371
  hypothetical: NO
  anti-sense: NO
aaaatatattatgaaagagctctcataatgcttttaaatttcttattcatatttatttttctattaattatcattacatttatattatttgagggagatttgtttcaacccgcagtaattttaacacttgcttattttatttcgattgcaagtgctctagttaatagaaatgtttggggaacagaactccatttcaaaacctttggtttgatattgctaggggttgctacatttattatagtttccttgttgacaaaattgtcgtacaaacctaaagtggagggaatttcgtataaagaattaaaagaaataaatccttcaaagataatatatggcattcttctgattctaaatcttgttatgctatttctttatatccatgaaattcagaaagtggtactgttttcaggtagaggtttttctaatattacagatttgataagtaactataggtacctatcttattattcaaatgaagtagaagatcgtgtaagtggaatgattaatcaactagctaaaattattccagcgactacatttgtttctttatatatatttataaataattattttataacgaagcaaataaagaaaaatttcatttatttgattccaatagctatattctttgtctatgcaatcattagtggtggtagactgccccttataaggttagttattggaactctgttgatattgtatatatactctgtgtacgggagtcataaatctcaacttaccagaagttttaaaatgattactcgctctctttttgcatttcttatgttgatagttttattctttcttttaaaatttgtattagggcgttcttctcaggaagattttatcagttacatcactcgttatatgggaggctcaattcaactatttgatttatttgttatagatccgatacgacgtaacaaagaactaggtgcagaaactttttcgggaatttatgagatgcttgcaaaattaggatttgataataatattataaaaggcttagaatggagaatatcgcctaattattattctttagggaatgtgtatactgcaattagacgctattattcagactttggtgtaattggtattgtaatttgtcagagttttacagcatggttgtatactttaggttatgaaaaaattagacatcattctttagttacaaatggtcaaagatttaggttgattctattagcagcttcattttatccattatttttaaatagtatcgaggatgtgttttatatttcaatggttaccattggatatggaatccaaattgttatcttttatctggttttttgggttcttctgaaagttcaggttgactttaacaaaggtaaattaaggataaatagatga

SEQ ID NO: 539 - DNA (genomic), 879 bp, Streptococcus pneumoniae; double-stranded, circular
  misc_feature (B) LOCATION 1...879
  hypothetical: NO
  anti-sense: NO
tcacttcattacgattgtgactctggtcgttttagcctattctctcttgattggagtcatcctatgattcgatttttagttttagctggctattttgaactgactatttacctccatctgtcgggcaaactaaaccagtacatcaacatgcactattcctatctggcctatatctccatggtgctttcttttatcttggctatcgttcaattgtatatctggatgaagcaagtcaaaacccacagtcatctgaacagccgattagccaagatgacgagtatttctcttctggctattccacttgtcatcggcttaactttcccaactgttagcttggattctcagactgtttctgctaaaggttatcatttccccctatcggaaggaacggatctagccattcagacaagcgaagggacgacaagccaatatttgaaaccagataccagttcttatttttcaaaatcagcctatgaaaaggaaatgcgaacggcggcggataaatacttatcccaagatagtattcagatcactaatgaaaactatatggaagtcatggaggctatctacgactatccagatgagtttgagggcaagacaatccagtttacaggctttgtctataacgaccccagtcatgccaatagtcaatttctgttccgattcggcattatccactgtatcgcagattctggtgtctatggattgctgaccaagggcaatacccggcagtatgaaaacaacacttggataacagccaaaggaaaactggtcaatcactaccataaagaactcaaacaaaaccttccaaccttggaaatcgacagctttaccaaagtcgataaaccagaaaatccctatgtatatagagctttttaa

SEQ ID NO: 540 - DNA (genomic), 1377 bp, Streptococcus pneumoniae; double-stranded, circular
  misc_feature (B) LOCATION 1...1377
  hypothetical: NO
  anti-sense: NO
agaactcattatccaagttggatacgcttattacataggagaatacaaatgaaatttagaaaattagcttgtacagtacttgcgggtgctgcggttcttggtcttgctgcttgtggcaattctggcggaagtaaagatgctgccaaatcaggtggtgacggtgccaaaacagaaatcacttggtgggcattcccagtatttacccaagaaaaaactggtgacggtgttggaacttatgaaaaatcaatcatcgaagcgtttgaaaaagcaaacccagatataaaagtgaaattggaaaccatcgacttcaagtcaggtcctgaaaaaatcacaacagccatcgaagcaggaacagctccagacgtactctttgatgcaccaggacgtatcatccaatacggtaaaaacggtaaattggctgagttgaacgacctcttcacagatgaatttgttaaagatgtcaacaatgaaaacatcgtacaagcaagtaaagctggagacaaggcttatatgtatccgattagttctgccccattctacatggcaatgaacaagaaaatgttagaagatgctggagtagcaaaccttgtaaaagaaggttggacaactgatgattttgaaaaagtattgaaagcacttaaagacaagggttacacaccaggttcattgttcagttctggtcaagggggagaccaaggaacacgtgcctttatctctaacctttatagcggttctgtaacagatgaaaaagttagcaaatatacaactgatgatcctaaattcgtcaaaggtcttgaaaaagcaactagctggattaaagacaatttgatcaataatggttcacaatttgacggtggggcagatatccaaaactttgccaacggtcaaacatcttacacaatcctttgggcaccagctcaaaatggtatccaagctaaacttttagaagcaagtaaggtagaagtggtagaagtaccattcccatcagacgaaggtaagccagctcttgaatatcttgtaaacgggtttgcagtattcaacaataaagacgacaagaaagtcgctgcatctaagaaattcatccagtttatcgcagatgacaaggagtggggacctaaagacgtagttcgtacaggtgctttcccagtccgtacttcatttggaaaactttatgaagacaaacgcatggaaacaatcagtggctggactcaatactactcaccatactacaacactattgatggatttgctgaaatgagaacactttggttcccaatgttgcaatctgtatcaaatggtgacgaaaaaccagcggatgctttgaaagccttcactgaaaaagcaaacgaaacaatcaaaaaagctatgaaacaatag

SEQ ID NO: 541 - DNA (genomic), 609 bp, Streptococcus pneumoniae; double-stranded, circular
  misc_feature (B) LOCATION 1...609
  hypothetical: NO
  anti-sense: NO
gtcggtcttcttgagtgccccacttttcttttaaaaaaggagttttttatgttgaaaaaatggcagttaaaagatgttatcttgcttgctttcttgtctatcttttttggtggggttttcgttggttcaggatatgtgtataatattctcagtctactcttaacacctcttggtttgcaggcctttgccaatgaaatcctcttcggtctctggtgtatggctgcgcccattgctgccatctttgttccgagagtcggaagtgcaacgattggagaagtgctagctgcgcttgctgaagtcctttatggtagccaatttggtctaggagctcttttgtctggcttggttcaaggtttgggaagtgaatttggttttatcgtaactaagaatcgctatgaaagttggctctctctaactgctaatagtattggggttacgcttgttagctttgtctatgaatacattaagttaggttactacgccttttcccttccgtttgtcctttccttacttgtggtacgttttatttctgtttatttcttctgtaccatcttggttcgtgccattgtcaaactctatcatcagtttgcaactggaggaaaagcatag

SEQ ID NO: 542 - DNA (genomic), 675 bp, Streptococcus pneumoniae; double-stranded, circular
  misc_feature (B) LOCATION 1...675
  hypothetical: NO
  anti-sense: NO
cgagataattattataatcctgtgattgttcaaccattagttttaattggggcgcctgatgtaaaagaaatgcctaaagattggactgaattaggtagtaagtataaaggtaaatattcaatttatggtcttcaaggtggtacaggacgggcaattctagcaagtatcttagttcgttaccttgatgaaaaaggagatttaggcgtatcagaaaaaggatgggaagttgcaaaagaatactttgcaaatgcctatactcttcaaaaaggtgaaagctcagttgttaaagcgttagataaagaaagcccaattcaatacggtatgatctggggttctggagcgttaattggacaaaaagaacaaaatgttgaattcaaagttatgactcctgagattggtgtaccatttgtaactgaacaaactatggttttaagcactagtaaaaaacaagcgttagctaaagaatttattgattggtttggtcaatcagaaattcaagtagaatatagtaaaaaatttggatctattcctgcaaataaagatgccctaaaagagttacctgaagatacgaaaaaatttgttgatcaagtgaaaccacaaaatattgactgggaagctgttggaaagcatttggatgaatgggtagaaaaagctgaattagaatacgtaaaataa

SEQ ID NO: 543 - DNA (genomic), 264 bp, Streptococcus pneumoniae; double-stranded, circular
  misc_feature (B) LOCATION 1...264
  hypothetical: NO
  anti-sense: NO
aatatgaattattttcgaaaacgtagggagagacaagcgaaatctaatagtggaatttactgtcccgcagctaatcgttccaaaattcaatatgaaactaaagaaaaagctgaccatgcggttcaatatgataacggaggtttagttagaagctattattgtcgtacatgtgcgtgttggcatactacttcaaaatctaataaacctccgctaagtttgaaaaactatggtctgaaactctttggtttagataaatcagaatag

SEQ ID NO: 544 - DNA (genomic), 855 bp, Streptococcus pneumoniae; double-stranded, circular
  misc_feature (B) LOCATION 1...855
  hypothetical: NO
  anti-sense: NO
cagcaccttctacaccatcagaaagtggggaaatcgaagatgacgaattctaattacaaacttacaaaagaagattttaatcaaatcaacaaacgtagcttgtttactttccaattaggttggaactacgaacgtatgcaagcttctggttacctttacatgatcttgcctcagttgcgtaaaatgtatggtgatggaactcctgaattgaaagaaatgatgaaagttcatactcaattcttcaatacttcaccattcttccataccattatcgctggttttgaccttgccatggaagaaaaagatggtgtaggttcaaaagacgccgttaacggtatcaagacaggtttgatgggaccattcgctcctcttggggatacaatctttggttcacttgtacctgctatcatggggtcagtcgcagcaactatggctatcgctggccaaccttgggggatcttcctttggattgcagttgcagtagcgtatgacatcttccgttggaaacagttggaatttgcttacaaagaaggggttaaccttatcaacaacatgcaaagtaccttgacagctttgattgacgctgcatccgtacttggtgtcttcatgatgggtgctcttgtagcaacagtgattaactttgaaatttcttacaagttgccaatcggtgaaaagatgattgatttccaagacatcttgaaccaaatcttcccacgtttgcttccagcaatctttactgcctttatcttctggttgcttggtaagaaaggtatgaactctactaaagctatcggtattattatcgtacttgctttggctctttctgcccttggtcactttgcacttggaatgtaa

SEQ ID NO: 545 - DNA (genomic), 1533 bp, Streptococcus pneumoniae; double-stranded, circular
  misc_feature (B) LOCATION 1...1533
  hypothetical: NO
  anti-sense: NO
aaattacttctttccttaacaataaggaaaaagaatgcgttttcatcttttggtttgaggtttataataagagtatcaaagtcaggaggaaaaaagatgactacttttaaagatggatttttatggggtggtgctgttgctgctcatcaacttgaaggtggatggcaagaaggtggcaagggaattagtgttgctgatgttatgactgctggtcgtcatggagtagctcgtgaaattactttgggagttttagagggtaaatattatccaaatcatgaggcgatagatttttatcatcgttataaagaagatatagcactttttgctgaaatgggattcaagtgcttccgtacctctattgcatggacacgtatctttccaaaaggtgatgagttagagccgaatgaagaaggattacagttttatgataatctttttgatgaatgcttaaagaatggtattgaacctgtcatcactctatctcattttgaaatgccttatcacttagtgaccgaatatggtggttggaaaaataggaaattgattgatttctttgctcgttttgcagaagtcatatttaaacgttacaaagataaggttaaatattggatgactttcaatgaaatcaataatcaagcgaattatcaggaagattttgcaccatttactaactcaggtattgtatatgaggaaggtgataatagagaggcaattatgtatcaagcagcacattacgaattagttgcttctgcacgagctgtaaaaattggtcatgagattaatccagattttcaaataggttgtatgattgcgatgtgtccaatttatccagctacttgcaatcctaaggatatcttaatggcaatgaaagctatgcaaaagcgttattattttgctgatgtgcatgttttaggtaaatatcctgagcatattttcaagtattgggaacgaaaaggtatttcagttgattttactgcccaggataaagaagatttacttggtgggactgtagattacattggtttcagttactatatgtcctttgctatcgactctcatcgtgaaaataatccttattttgattatcttgaaacagaagatttagtgaaaaataattatgttaaggcttctgaatgggagtggcaaattgatccagaaggtttgcgttatgcgttaaattggtttacagaccactatcacttaccactctttattgttgaaaatggttttggagctatagataaagttgcagcagatggtatggtacatgatgattatagaattgaatatctaggtgcccatattcgtgaaatgaaaaaggctgtagttgaagatggtgttgatttaatgggttatactccatggggatgtattgatttagtttcagctggtaccggtgaaatgcggaaacgttatggctttatttatgtagataaagatgacaatgggaagggaagttataatcgttccccgaaaaaatcttttggctggtataaggaagttatttcatctaacggtgaatcagtagaatag

SEQ ID NO: 546 - DNA (genomic), 196 bp, Streptococcus pneumoniae; double-stranded, circular
  misc_feature (B) LOCATION 1...196
  hypothetical: NO
  anti-sense: NO
aacacttctcaagaaaaaacacaacaagatgaaacgccaaaatctagcgtcaaggaagagaaaaaagaagatcagaaaacagcaactcaggactctactacacctgctacaagtaaacctgccactgaaaatgaaaaacagcccaatactccaacttcagaaaataatactcaatgaaaatcaaagaacaaactag

SEQ ID NO: 547 - DNA (genomic), 936 bp, Streptococcus pneumoniae; double-stranded, circular
  misc_feature (B) LOCATION 1...936
  hypothetical: NO
  anti-sense: NO
acacgatgttacagccttgaatgtttcaggaaaactgttcttaaaccactcactttttcaaataataaagctggttttgaactcttagatctgtcttttcgacagctcaaccaagactgtctcatcgctcttaaacttctttctgaccccaatcgtgaacaatttcaacacgataatcggcaagtagaactaaaaatactggctagacatattcatcgtctcaagaaaaaacagtctgattggaaagtacaatacactcgttgtcttgatatcatctttcctgagttggataaaatcgttggaaagcattcagaatatacctaccaactcttgacacgctaccctaatcctcagaaaaggcttgaggcaggatttgataagctgatagaaattaagcgattgaccgcttctaaaattcaggatatcctctcagtcgcacctcgttctatcggaacaacatctcctgctcgtgaattcgaaatcatcgaaatcatcaaacattacaagaggctcattgacaaggcggaaacatgtgtcaatgacttgatggctgagttcaactcggtcatcacgacggttactgggattgggggtcgtttaggggcggtcattttagccgagattcgaaatattcatgcctttgataatcctgctcaattacaagctttcgctggactggattcttctatttatcagtcaggtcagattgatttagctggaagaatgatcaaacggggttcccctcatctgcggtgggcactcatacaagctgccaaagcatgcgctcgcttttcacctgcttttaaggtctatcttaagactaagttagaacaaggaaaacattacaatgtagccatcatccaccttgcaaaaaaacttatccgaaccctgttttatatcctaaaaaagagctgccatttgacgaacaaaaagtga

SEQ ID NO: 548 - DNA (genomic), 210 bp, Streptococcus pneumoniae; double-stranded, circular
  misc_feature (B) LOCATION 1...210
  hypothetical: NO
  anti-sense: NO
tgtaatcgttatcaaaagtctaaaaaagaatttttagatggatatcaaaataaaaagggaggaaattatgaaaaagttttcaaaaacattgagagacaactggatctttctcttgatggttttgccaggggcactctggttgattctattcttttacattccagtatttgggaacgtggttgccttcaaagactaccacatgaccagtaa

SEQ ID NO: 549 - DNA (genomic), 288 bp, Streptococcus pneumoniae; double-stranded, circular
  misc_feature (B) LOCATION 1...288
  hypothetical: NO
  anti-sense: NO
tcccagcttctttttatatataaaattttacccgtgcaaagacagggccttagcagacttcttttttacttcgttcacccttgctttttctttttaggtttgggcgttggcagttggttatacatagctaaaatcaggtcttatagaaacatcttattatcaagttcttccactcaaatcatttctttggcacctttgtatggaaactcaaaagaagattggtcaatcttatctaagactgcttgcacgggtttaactaaaagcgatcgtcataaataccgccaataa

SEQ ID NO: 550 - DNA (genomic), 567 bp, Streptococcus pneumoniae; double-stranded, circular
  misc_feature (B) LOCATION 1...567
  hypothetical: NO
  anti-sense: NO
tggaggcttctccctttcgagaaagctcttgttatcatggatagaggctatgaaagttacaatctcatggctcattttcaagaaaaaggttggctttatatcatccgtattcgagatggaaaacaatccatgccttcctccttcaacttgccaaatacggagtgttttgatcaaaaagtttctctaaaattatcacgaaagcaaactaatcagctcaaaaaactttatcgtgattttcccaatgactatcattttattccacacaattctatttttgattttcttccagaaacaagtcgaaaacaagatcctgtaacactctatgaacttccttttcgtatggtgcgtttagaagtggaagaaggaaaatacgaaactttagtgacgaatacagactattcagtccaagaattaaaaaatctctacgccagtagatggggcatagagactagttttcgtgacctgaaatacagtattggcttggtcaattttcacgccaaaaagaagggagggatctccaagaaatctttgctcgctttacaaattttaacttttgtcgttgggtaa

SEQ ID NO: 551 - DNA (genomic), 684 bp, Streptococcus pneumoniae; double-stranded, circular
  misc_feature (B) LOCATION 1...684
  hypothetical: NO
  anti-sense: NO
tggaggcttctccctttcgagaaagctcttgttatcatggatagaggctatgaaagttacaatctcatggctcattttcaagaaaaaggttggctttatatcatccgtattcgagatggaaaacaatccatgccttcctccttcaacttgccaaatacggagtgttttgatcaaaaagtttctctaaaattatcacgaaagcaaactaatcagctcaaaaaactttatcgtgattttcccaatgactatcattttattccacacaattctatttttgattttcttccagaaacaagtcgaaaacaagatcctgtaacactctatgaacttccttttcgtatggtgcgtttagaagtggaagaaggaaaatacgaaactttagtgacgaatacagactattcagtccaagaattaaaaaatctctacgccagtagatggggcatagagactagttttcgtgacctgaaatacagtattggcttggtcaattttcacgccaaaaagaagggagggattctccaagaaatctttgctcgctttacaaattttaacttttgtcgttgggtaacctcgcaagttgccatcgacagtagtcacaaaaaacaaagatataaagtgtgtttctcagatgcggcttatgcctgccgtttgttttttaacggttccctttcttccctccagtga

SEQ ID NO: 552 - DNA (genomic), 789 bp, Streptococcus pneumoniae; double-stranded, circular
  misc_feature (B) LOCATION 1...789
  hypothetical: NO
  anti-sense: NO
tggaggcttctccctttcgagaaagctcttgttatcatggatagaggctatgaaagttacaatctcatggctcattttcaagaaaaaggttggctttatatcatccgtattcgagatggaaaacaatccatgccttcctccttcaacttgccaaatacggagtgttttgatcaaaaagtttctctaaaattatcacgaaagcaaactaatcagctcaaaaaactttatcgtgattttcccaatgactatcattttattccacacaattctatttttgattttcttccagaaacaagtcgaaaacaagatcctgtaacactctatgaacttccttttcgtatggtgcgtttagaagtggaagaaggaaaatacgaaactttagtgacgaatacagactattcagtccaagaattaaaaaatctctacgccagtagatggggcatagagactagttttcgtgacctgaaatacagtattggcttggtcaattttcacgccaaaaagaagggagggattctccaagaaatctttgctcgctttacaaattttaacttttgtcgttgggtaacctcgcaagttgccatcgacagtagtcacaaaaaacaaagatataaagtgtgtttctcagatgcggcttatgcctgccgtttgttttttaacggttccctttcttccctccagttgaaaaactacctcaagaaacagttatctattattcgaccgaatcgaaaatattcaagaaagataaaagctcaatcggtagttgatttcatctatagagtaacataa

SEQ ID NO: 553 - DNA (genomic), 789 bp, Streptococcus pneumoniae; double-stranded, circular; identical to SEQ ID NO: 552
  misc_feature (B) LOCATION 1...789
  hypothetical: NO
  anti-sense: NO

SEQ ID NO: 554 - DNA (genomic), 1077 bp, Streptococcus pneumoniae; double-stranded, circular
  misc_feature (B) LOCATION 1...1077
  hypothetical: NO
  anti-sense: NO
aaggaaagttacatcatgaataaacgcgtacaagcatttctagctaaaatgcaagaaaaagaactagatggtgtcatcatcaacaatcttaaaaacgtctattatttgactggtttttggggctcaaacggaacagtctttatcagccgtgaccgtcaggtcttagtgacagactctcgctatatcatcgcagctaagcaagaaaccagtggttttgagattgtggctgatcgtgatgaattggctgtcattgcaggaattgttaaggacatgggcttgactcgtatcggttttgaagatgagatttcagtgtcttattaccaccgtatgcaggcagcttttgcaggtttggacttgtttccgcaaactcagtttgtggaaggtcttcgtatgattaaggatgaggcagagattgcagcgattcgcaaggcttgttctatctcagaccaagctttccgcgatgcgcttgactttatcaaaccaggaaaaactgaaattgagattgccaacttccttgacttccgcatgcgtgagttgggagcatctggcttatcttttgatacgatcctagctagcggtatcaattcttctaaaccccatgcccatccaatgcacaaaccagtggagttgggagaagccattaccatggacttcggctgtctctatgaccactatgtcagtgatatgacccggactatctatctagggcatgttagcgatgagcaggcagagatttacaatacggttctaaaagctaaccaagccttgattgaccaagctaaggcaggcttaggtttccgtgactttgacaaaatccctcgtgatattatcattgaggcaggttatggcgactactttactcacggcattggccacggtattggtctggatatccatgaggaaccctactttagtcagacttctacagaaactattaagacaggtatggccttaaccgatgaaccaggtatctatatcgaaggcaaatatggcgttcgtatcgaggatgatatcctgattacagagacaggttgtgaattattgaccctagctccaaaagagttgatagtcatttag

SEQ ID NO: 555 - DNA (genomic), 1053 bp, Streptococcus pneumoniae; double-stranded, circular
  misc_feature (B) LOCATION 1...1053
  hypothetical: NO
  anti-sense: NO
tatcagggttattctaaggaacaaattgagctcttggtgagcttgccttcctttggaatcatgatgatgttactgctaaatggtttcttagaaaaaatatttcctgagcgcttacagattagtttgggcttgctgattttatcattgagcggtacagctcccttctggtaccaagcctatccctttgtctttggaacacggcttctctttggtttgggtcttgggatgatcaatgccaaggccatttctattatcagtgaacgctaccaaggaaaaaggcgaattcagatgttagggctacgcgcttctgcagaggtcgttggagcttctatcattaccttggccgtcggtcagttgttggcttttggttggacagctatctttctagcctatagtgctggatttttggtgctgcccctttatctgctctttgtcccttatggaaaatcaaagaaagaagtcaagaaaagagcgaaggaagcaagtcgtttaactcgagaaatgaaaggcttgatttttaccttagctatcgaagcggcagttgtagtttgtaccaatacagctattaccatccgtattccaagtttgatggtggaaagaggattgggggatgcccagttatctagttttgttcttagtatcatgcagttgatcgggattgtggctggggtgagtttttctttcttgatttctatctttaaagagaaactgctcctctggtctggtattacctttggcttggggcaaatcgtgattgccttgtcttcatccttgtgggtggtagtagcaggaagtgttctggctggatttgcctatagtgtagtcttgacgacggtctttcaacttgtctctgaacgaattccagctaaactcctcaatcaagcaacttcatttgctgtattaggctgtagtttcggagcctttacgaccccattcgttctaggtgcaattggcttactaactcacaatgggatgttggtctttagtatcttaggaggttggttgattgtaatctctatctttgtcatgtacttacttcagaagagagcttag

SEQ ID NO: 556 - DNA (genomic), 420 bp, Streptococcus pneumoniae; double-stranded, circular
  misc_feature (B) LOCATION 1...420
  hypothetical: NO
  anti-sense: NO
cgaattattcttgtaaaaaaatgccacgctatgaaggctcaagcgattgtcacaagtcaagggagaattgtttctttggatatcactgtgaactattgtcatgatatgaagttgttcaaaatgagttgcagaaatatcggacaagctggtaaaatcttggctgacagtggttatcaagggctcatgaagatatatcctcaagcacaaactccacgtaaatccagcaaactcaagccgctaacagttgaagataaagcctgtaaccatgcgctatccaaggagagaagcaaggttgagaacatctttgccaaagtaaaaacgtttaaaataatttcaacaacctatcgaaatcatcgtaaacgcttcggattacgaatgaatttgagtgctggtattatcaatcatgaactaggattctag

SEQ ID NO: 557 - DNA (genomic), 2556 bp, Streptococcus pneumoniae; double-stranded, circular
  misc_feature (B) LOCATION 1...2556
  hypothetical: NO
  anti-sense: NO
aggaacattctaaaatattcggaatttaaagtaaggaaaaacatggctaatattttaaaaacaattatcgaaaatgataaaggagaaatccgtcgtctggaaaagatggctgacaaggttttcaaatacgaagaccaaatggctgctttgactgacgaccaactaaaagcaaaaacagttgaatttaaggaacgttatcaaaatggagaatcactggattcattgctttacgaagcatttgcggttgtccgtgaaggtgccaaacgtgtcctaggtctcttcccttataaggttcaggtcatgggggggattgttcttcaccatggtgacgtgccagagatgcgtacaggggaagggaaaaccttgactgcgaccatgccggtatacctcaatgccctttcaggtaaaggggttcacgtagttacggttaatgaatacctgtcagaacgtgacgcgactgagatgggtgaattgtactcttggcttggtttgtcagtagggattaacttggctaccaaatctccaatggagaaaaaagaagcctatgagtgtgatattacttactcaactaactcagaaatcggatttgactaccttcgtgacaacatggtcgttcgcgctgaaaacatggtacaacgtccgcttaactatgccttggtcgatgaggttgactctatcttgattgacgaggctcgtacacctttgattgtatcaggtgccaatgcggttgaaaccagtcagttgtatcacatggcagaccactatgtaaaatctttgaacaaagatgactacatcatcgatgtgcagtctaagactattggtttgtctgattcagggattgacagggctgaaagctacttcaaacttgaaaacctctatgacatcgaaaacgtggctttgacccactttatcgataacgcccttcgtgccaactacatcatgcttctcgatattgactatgtggtgagcgaagagcaagaaatcttgattgtcgaccaatttacaggtcgtaccatggaaggtcgtcgttattctgatggattgcaccaagctattgaagccaaagaaggtgtgccaatccaggatgaaaccaagacatctgcctcaatcacgtaccaaaaccttttccgtatgtacaaaaaattgtctggtatgacgggtacaggtaagactgaggaagaagaatttcgtgaaatctacaacattcgtgttattccaatcccaacaaaccgtcctgttcaacgtattgaccactcagaccttctttatgcaagtatcgaatctaagtttaaagcggttgtcgaagacgttaaggctcgttaccaaaagggtcaacctgtcttggttggtacagtagcggttgaaactagtgactacatttctaagaaattggttgcagctggtgttcctcacgaagtcttgaatgccaaaaaccactatagagaagcccaaatcatcatgaatgctggtcaacgtggtgccgttaccatcgcaaccaacatggcgggtcgtggtaccgacatcaagcttggtgaaggtgttcgtgaacttggaggactttgtgttattggtacagaacgtcatgaaagtcgtcgtatcgataaccagcttcgtggacgttcaggtcgtcaaggagatccaggtgagtcacaattctacctatctcttgaagatgatttgatgaaacgttttggttctgaacgcttgaagggaatctttgaacgtctcaacatgtctgaagaggcgattgagtctcgcatgttgacgcgtcaggttgaagcagcgcaaaaacgtgtcgaaggaaataactacgatacccgtaaacaagtccttcaatacgacgatgtcatgcgtgaacaacgtgagattatctatactcaacgttatgatgtcattactgcagaccgtgacttggcacctgaaattcaggcaatgatcaaacgcacgattggtcgtgtcgttgacggtcatgcgcgtgctaaacaagatgagaaactagaggcaattttgaacttcgctaagtacaacttgcttcctgaagattctattacgatggaagacttgtcaggcttgtctgataaggccatcaaggaagagcttttccaacgtgccttgaaggtttacgatagtcaggtttcaaaactacgcgatgaagaagcagttaaagaattccaaaaagttttgattctacgagtggtggataacaagtggacagatcatatcgatgcccttgatcaattgcgtaacgcggttggacttcgtggctatgctcagaacaaccctgttgttgagtatcaggcagaaggtttccgtatgtttaatgatatgattggttcgattgagtttgatgtgacacgcttgatgatgaaagcacaaattcatgaacaagaaagaccacaggcagaacgtcatatcagtacaacagcgactcgcaatatcgctgctcaccaagcaagtatgccagaagatttggatttgagccagattggacgcaatgaactttgcccatgtggttctggtaagaaatttaaaaactgtcacggtaaaagacaataa

SEQ ID NO: 558 - DNA (genomic), 402 bp, Streptococcus pneumoniae; double-stranded, circular
  misc_feature (B) LOCATION 1...402
  hypothetical: NO
  anti-sense: NO
gatggcattcttggaattaaaaaatacagagaaaccagcaaagacaaggttcgcaagccatggttggagtttttcggcaacaagccctttacccagcaaccgcaacgagccattagccaagcaaatcaactgctggactacaagagctggtccgaggaggacaggaaaatgtttagtcaactacatatgcgagaagaacaagtcttgttagcacaggactatgccttggaaactgctagggctgaagaccttgaacaaggactagagcgtgggaaagttgaaggaagggcagaaaggaaactttttgccttcctagacatagtacgccaaggtcttctgacttctgaggttgccagccagcaattaggtatgtcagtatctgaatttgaggcactgttgtaa

SEQ ID NO: 559 - DNA (genomic), 1122 bp, Streptococcus pneumoniae; double-stranded, circular
  misc_feature (B) LOCATION 1...1122
  hypothetical: NO
  anti-sense: NO
aaaaggaatttaactatggaagaaattctctgtattggttgtggagcaaccattcagacgacagataaagctggtcttggttttaccccccagtcggcacttgaaaaaggtttggagactggcgaagtctattgccaacgctgtttccgtctccgccactacaatgaaatcacagatgtccagttgacgaacgatgatttcctcaagctcttgcacgaggtgggagacagtgatgctttagtggtcaatgtcattgatatctttgattttaatggatctgtcatcccaggtttaccacgtttcgtctcgggcaatgatgtcctcttggtaggaaataaaaaagatatccttcctaagtcagttaagtctggtaagattagccagtggctcatgaaacgtgcccatgaagaaggtcttcgtccagtcgatgtggtcctaacttcagcacaaaataaacatgccattaaggaagtcattgacaagattgaacactaccgtaagggccgcgatgtctatgtggtcggtgtgaccaacgttggaaaatcaactctaatcaatgctattatccaagaaatcacgggtgatcagaatgtcatcactacttcacgcttcccagggacaaccttggacaaaatagagattccgcttgacgacggatcttatatttacgatacgccgggaattatccaccgccaccagatggctcactacttgacggccaaaaacctcaagtatgtcagtcctaaaaaggaaatcaagcctaagacctatcagcttaatcctgagcaaaccctatttttaggtggtttgggacgctttgactttatagcaggagaaaagcaaggatttactgctttctttgataatgaactcaaactccatcgtagcaagcttgaaggagctagtgctttctacgataagcacctgggaactcttctgacaccaccaaatagcaaggaaaaagaagatttcccaaggctagtccagcatgtctttaccattaaagataagacagacctagtcatctcaggcctaggatggattcgtgtaacaggcacagcaaaagtcgccgtctgggcaccagaaggcgtcgccgtcgtcacacgaaaagcaattatttaa

SEQ ID NO: 560 - DNA (genomic), 819 bp, Streptococcus pneumoniae; double-stranded, circular
  misc_feature (B) LOCATION 1...819
  hypothetical: NO
  anti-sense: NO
aagaggaattttatgagtattaaactaatcgctgtcgatattgacggaaccctagtcaacagtcaaaaggagattactcctgaagtcttttctgccatccaagatgccaaagaagctggtgtcaaagtcgtgattgcaactggccgccccatcgcaggtgttgccaaacttctggacgacttgcagttgagagaccaaggtgactatgtggtgaccttcaatggtgcccttgtccaagaaactgctactggccatgagattatcagcgaatccttgacctatgaggattatctggatatggaattcctcagtcgcaagctcggtgtccacatgcatgccattaccaaggacggtatctatactgcaaatcgcaatatcggaacatacactgtacacgaatcaaccctcgtcagcatgcctatcttctaccgtacccctgaagaaatggctggcaaagaaattgttaaatgtatgtttatcgatgaaccagaaattctcgatgctgcgattgaaaaaattccagcagaattttacgagcgctactccatcaacaaatctgctcctttctacctcgaactccttacaaagaatgtagacaagggttcagccattactcacttggctgaaaaactcggattgaccaaagatgaaaccatggcaatcggtgacgaagaaaatgaccgtgccatgctggaagtcgttggaaaccccgttgtcatggaaaatggaaatccagaaatcaaaaaaatcgccaaatacatcactaaaacaaatgacgaatccggcgttgcccacgccatccgaacatgggtactgtaa

SEQ ID NO: 561 - DNA (genomic), 195 bp, Streptococcus pneumoniae; double-stranded, circular
  misc_feature (B) LOCATION 1...195
  hypothetical: NO
  anti-sense: NO
gtctatctctatcaacttttcttggttttgttccttttacttggtggtttagctctcctgttttctcttttagctttaaccagccataaatggtattacgtgagatttggaaaacgtgtgatgcttctgttatactacctattcgctcacaataagagagaacttttttacgaaaatctattgaatatgccataa

SEQ ID NO: 562 - DNA (genomic), 195 bp, Streptococcus pneumoniae; double-stranded, circular
  misc_feature (B) LOCATION 1...195
  hypothetical: NO
  anti-sense: NO
gtctatctctatcaacctttcttggttttgttccttttacttggtggtttagctctcctgttttctcttttagctttaaccagccataaatggtattacgtgagatttggaaaacgtgtgatgcttctgttatactacctgttcgctcacaataagagagaacttttttacgaaaatctattgaatatgccataa

SEQ ID NO: 563 - DNA (genomic), 195 bp, Streptococcus pneumoniae; double-stranded, circular
  misc_feature (B) LOCATION 1...195
  hypothetical: NO
  anti-sense: NO
gtctatctctatcaacttttcttggttttgttccttttacttggtggtttagctctcctgttttctcttttagctttaaccagccataaatggtattacgtgagatttggaaaacgtgtgatgcttctgttatactacctgttcgctcacaataagagagaacttttttacgaaaatctattgaatatgccataa

SEQ ID NO: 564 - DNA (genomic), 195 bp, Streptococcus pneumoniae; double-stranded, circular
  misc_feature (B) LOCATION 1...195
  hypothetical: NO
  anti-sense: NO
gtctatctctatcaacttttcttggttttgttccttttacttggtggtttagctctcctgttttcttttttagctttaaccagccataaatggtattacgtgagatttggaaaacgtgtgatgcttctgttatactacctgttcgctcacaataagagagaacttttttacgaaaatctattgaatatgccataa

SEQ ID NO: 565 - DNA (genomic), 183 bp, Streptococcus pneumoniae; double-stranded, circular
  misc_feature (B) LOCATION 1...183
  hypothetical: NO
  anti-sense: NO
tttgacctctattcctccatacacaccagagatgaacccattgaacaagtgtggaaagagattcgtaaacgtggatttaagaataaagcctttcgaactttggaagatatcatgaatcaacttcaagatgtcatacaaggactgggagaagaggtgataaagtccatcgttaatcggagatga

SEQ ID NO: 566 - DNA (genomic), 1914 bp, Streptococcus pneumoniae; double-stranded, circular
  misc_feature (B) LOCATION 1...1914
  hypothetical: NO
  anti-sense: NO
catttgatctatacgctaatattaatgatattgtggatggcattagcttttgcaggagatatgagattatttgttaaagataatgatcagaaaaaagctgaaattaaaattagaatgcctgaaaaaattaaggaaactaaatcagaatatccctatgtatcaagttatgggaatgtcatagaattaggggaaggagatctttcaaaaaacaaaccagacaatttaactaaaatggaatctggtaaaatctattctgattcagaaaaacaacaatatctgttaaaggataatatcattctaagaaaaggctatgcactaaaagtgactacctataatcctggaaaaacggatatgttagaaggaaatggagtctatagcaaggaagatatagcaaaaatacaaaaggccaatcctaatctaagagccctttcagaaacaacaatttatgctgatagtagaaatgttgaagatggaagaagtacccaagctgtattaatgtcggctttggacggctttaacattataaggtatcaagtgtttacatttaaaatgaacgataaaggggaagctatcgataaagacggaaatcttgtgacagattcttctaaacttgtattatttggtaaggatgataaagaatacactggagaggataagtccaatgtagaagctataaaagaagatggctccatgttatttattgataccaaaccagtaaacctttcaatggataagaactactttaatccatctaaatctaataaaatttatgtacgaaatccagaattttatttaagaggtaagatttctgataagggtggttttaactgggaattgagagttaatgaatcggttgtagataattatttaatctacggagatttacacattgataacactagagattttaatattaagctgaatgttaaagacggtgacatcatggactggggaatgaaagactataaagcaaacggatttccagataaggtaacagatatggatggaaatgtttatcttcaaactggctatagcaatttgaatgctaaagcagttggagtccactatcagtttttatatgataatgttaaacccgaagtaaacattgatcctaagggaaatactagtatcgaatatgctgatggaaaatctgtagtctttaacatcaatgataaaagaaataatggattcgatggtgagattcaagaacaacatatttatataaatggaaaagaatatacatcatttaatgatattaaacaaataatagacaagacactaaacattaagattgttgtaaaagattttgcaagaaatacaaccgtaaaagaattcattttaaataaagatacgggagaggtaagtgaattaaaacctcatagggtaactgtgaccattcaaaatggaaaagaaatgagttcaacgatagtgtcggaagaagattttattttacctgtttataagggtgaattagaaaaaggataccaatttgatggttgggaaatttctggtttcgaaggtaaaaaagacgctggctatgttattaatctatcaaaagatacctttataaaacctgtattcaagaaaatagaggagaaaaaggaggaagaaaataaacctacttttgatgtatcgaaaaagaaagataacccacaagtaaaccatagtcaattaaatgaaagtcacagaaaagaggatttacaaagagaagatcattcacaaaaatctgattcaactaaggatgttacagctacagttcttgataaaaacaatatcagtagtaaatcaactactaacaatcctaataagttgccaaaaactggaacagcaagcggagcccagacactattagctgccggaataatgtttatagtaggaatttttcttggattgaagaaaaaaaatcaagattag

SEQ ID NO: 567 - DNA (genomic), 1244 bp, Streptococcus pneumoniae; double-stranded, circular
  misc_feature (B) LOCATION 1...1244
  hypothetical: NO
  anti-sense: NO
gtgtttcctatctgaaaactggtatcgagtctggacgatttccgacgggtagtgcctgccttctatccgtcaactacagccttgactttcactgcagcaaggacaccattcaacgagccctgctggaattacggcacgaacaatacctctatgccaagcctcagagtggctactatgtattagaacacgggcaacatcaagacctagaaatcgaggttaccgacgaacatgccagtgcctatgacgatttccgactctgtgtcaatgaaaccttgattggccgagaaaactacctcttcaactactatgacaatcaagaaggattagaagacctaagacagtccattcacaaactcctctttgagcaagctctctactgcaaggctaaccaactagtactgacttctggaacccaacaagccttatttatcctctctcaaatatcctttcctagacaagccaaggaaatcttggtggaacagccaacctaccatcggatgaatcgcctcttgattgcacaggggctggactatcaaacgattgaacgaggcattgatgggattgacttggaggagctggaaggccacttcaaaacaggaaaaattaaatttttctacaccattccccgatttcactatcctctgggacattcctattctgagcaagacaaacgatctattcttaacttagctgccaagtatgatgtctatatcgtagaggacgattatctgggtgatttggactccaagaagggccaaaccttccactatcttgatacagaggagcatgtcatttatatcaagtccttctcgaccagcctttttcctgcccttcgtattacagcactcattcttccaaatgctatcaaagaagcatttgtggcctacaaaaatatcctagactacgacagcaacctcattatgcaaaaggccctgtcactctatattgacagtcaattgtttgaaaaaaatcgtttggctcgcttgaccaatcatgaatcttaccaaaaacaaatcgaggaaaggataactaaaacaccttgtccccttcctcattatcccctacacgatggtttattgctagacctgagacagtatcctaaaatcgccagtctcaaacacagtcaactgggcttggacttctttgaagaggcctatttaagcacctgtccttatcaatttgccaaggtgtccctagacaatctggaaaatgttttaaactatttaaaagcagaattggaatga

SEQ ID NO: 568 - DNA (genomic), 381 bp, Streptococcus pneumoniae; double-stranded, circular
  misc_feature (B) LOCATION 1...381
  hypothetical: NO
  anti-sense: NO
tccgttgttcttgggtttgttcaaaaatctgctcaggtgtcccatcttcaacaaccacaccgctctgccataaagataacacgatctgccacctcacgggcaaatcccatctcatgtgttacgataaccatagtcatccctgacttggcaaggtcttgcataacagccaatacctcacctaccatttcaggatccaaggctgaagttggttcgtcaaagagcaaaacatctggtaccatagccaacccacgcgcgatgcaatccgttgttgttgcccacccgacagactctgtggataagcgtctgccttatctggcaaaccaactttttccaaaagctcttgggctctcttctcagcaacttccctgctttcacctttag

SEQ ID NO: 569 - DNA (genomic), 498 bp, Streptococcus pneumoniae; double-stranded, circular
  misc_feature (B) LOCATION 1...498
  hypothetical: NO
  anti-sense: NO
atcaacccctataaaatcagaaatgcaaaattatcaagtataagacgtaatgaagtatcttttatatttcaagcatataatttaataccttccctgccggtaatagaaaatatagcacttcctttgcgattatcacaaaaaaaattaactattaaaaatgtagaaaacttactcaaaagaatgaagtttaatgctggcttaaacgattttgttggaactctgtctggtggagaacaacagaaggttgctatagctagagcgtttattgctgatagtgatataatatttgctgatgagccaactggtgctttagacagcgtttctcgtgaagtaatttttgatttattgagagagttagtaggggcgggtaagtgtgtaattatggtaacgcacgatatagaattggcctcgaaaactgatcgtgcattaatattgaaagatggaaaaattttcaaagaacttcatagactagcggggaagagttgtataaaatcttag

SEQ ID NO: 570 - DNA (genomic), 474 bp, Streptococcus pneumoniae; double-stranded, circular
  misc_feature (B) LOCATION 1...474
  hypothetical: NO
  anti-sense: NO
tcgatgccctacaaaagacaaaggagtttttcaatggcactttctaaactagatagcctttatatggcagtggtagcagaccattcgaaaaatccacatcaccaagggaagttagaagatgctgagcaaaccagtctcaacaatccgacttgtggggatgtcatcaacctctctgtcaagtttgatgcagaggaccgtttggaagatattgcttttctaaattcaggatgcacgatttcaactgcttctgctagtatgatgacagatgccgttttaggaaaaaccaaacaagaaattttagaactggcgactattttttctgaaatggttcaagggcaaaaagatgagcgtcaaggccaacttggagacgcggcattcttgtcaggtgttgccaaattccctcaaagaatcaagtgtgcaaccctagcttggaatgcccttaagaaaacaattgaaaatcaagaaaaacagtaa

SEQ ID NO: 571 - DNA (genomic), 864 bp, Streptococcus pneumoniae; double-stranded, circular
  misc_feature (B) LOCATION 1...864
  hypothetical: NO
  anti-sense: NO
ttgtctgcctatcaggtcgtggggacaaggatgtggttcaagtcaaagaccgcttggaagcagatgcagcaaagaagggagaagctcatgcctaagacactaacagaaaaattgaatgctataaaagcaactggaaaaggaatttttgttccctatatcatggctggtgaccacgagaaaggtttggacggtcttgctgaaacaattcactttttagaagatttgggtgtctctgcaattgaagtgggtattcccttttcagaccctgttgcagatggacctgttatcgaagaagctggcttgcgcagtttagcccacgggacctctacccaggctttagttgaaaccttgaaaaccattgaaacagagattccactggtcatcatgacctacttcaatcccctctttcagtacggtgtggagaactttgtcaaagatctggctgatacagctgtgaagggcttgattatcccagacttgcctcatgaacatgccaactttgtagaaccatttttggcagatacagatatcgccttgattcctttagtaagcttgaccacaggaattgagcgccagaaagagttgattgaaggggcggagggattcatctatgccgttgccatcaatggagtgacagggaaatcaggcaattaccgtgcagatttggacaagcacttggcgcaacttcatcaagtggccgacatcccagtcttgacaggttttggtgtatctagtcaagccgatctggaacgcttcaatgcggtgtcagatggtgttatcgtcggttcaaaaatagtaaaagctctccaccaaggagagccgattcaggattttatcagacaagcagtagcttaccaaaaataa

SEQ ID NO: 572 - DNA (genomic), 666 bp, Streptococcus pneumoniae; double-stranded, circular
  misc_feature (B) LOCATION 1...666
  hypothetical: NO
  anti-sense: NO
atcaatcactatttcattcttttcttagcaagaatggttgcccccgccaaggtaagaagacctgcaatttcaagtgctagatttgaaatagatccagttgatggcaatgacttcttcggtttatttgttgctttttcgtttgttgaagcttggttagaaggttgcttgtccttgcttaaattatttgtagttgatggcttcttatcatctgcttgtggcttgctattatctggttttggtttttctggttgcggtttaacctctggttttggtttttctggttgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttctggttgcggtttaacctctggttttggtttttccagctgcggtttaacctctggttga

SEQ ID NO: 573 - DNA (genomic), 708 bp, Streptococcus pneumoniae; double-stranded, circular
  misc_feature (B) LOCATION 1...708
  hypothetical: NO
  anti-sense: NO
aaaatggttctaagaggagttcctatgtctcaaattgatctacaaaaattaactaagaaaaaccaagagtttgtccacattgctacccaacaattcatcaaagatgggaaaacagacgctgaaatccagactatttttgaggaagtcattccccaaatccttgaggagcaatctaaaggtacaactgcccgttccctatacggcgcaccaactcattgggctcatagcttcactgtcaaagagcagtacgaaaaagagcatccaaaagaaaatgatgatccaaaactgatgattatggactcagctcttttcatcactagcctctttgcccttgtcagcgccctcacaaccttctttgcggcagatcaagctttcggctatggattgattactcttctattagttggactggttggtggatttgccttctacttgatgtactactttgtttaccaatactatggaccagatatggatcgcagtcaacgtccacctttctggaaatctgtactagttatcctagcttctatgttcctttggttgcttgtcttctttgcaacaagcttcctaccagctagccttaacccagtactggatccattgccactagctattattggagcagccctcctagcccttcgcttctatctcaagaaacgcttgaatatccgtagtgcaagtgcaggaccaacacgctatcaagaataa

SEQ ID NO: 574 - DNA (genomic), 1557 bp, Streptococcus pneumoniae; double-stranded, circular
  misc_feature (B) LOCATION 1...1557
  hypothetical: NO
  anti-sense: NO
cattcaaactatcaaggatgggatatgaaatataggaaatttcagttattgatgtccaagtatggctttagtctttcgattatgctacttgaactttgtcttgtttttggtctctttctttatttaggacgcatggctcccattttatggattactgtcctcattctactgattatcatcacaatcatttcaatattcaaccgtaatacaactcctgagaataaggtaacctggttgttagtagcctttgtgccagtatttggtcccttgctctatctgatgtttggtgaaaggcgattgtccaaaaaagaaatcaaacaactgaagaagctaggctctatgcatttccaagaagcaaatagccagctactaaaagagaaattaaaagaaagtgacaaggcagcttatggagtcatcaagtccttattgagtatggataccaatgctgacatctatgatcaaactgcctctacattttttcctaacggagaagctatgtggaaaaagatggtagaagatcttaaaaaggctgagaaatttattttcttggaatattacattatagaagaaggtttgatgtggaatcgcatactagatatactagagcaaaaggtagctcagggtgtagaggttaagatgctctatgatgatatcggctgtatggctactttaacaggagattatgcacatcgacttcgtcagctgggcatcgaggcccataaattcaataaagttattcctcgtttgacagtggcttataataacagagatcatagaaaaatattgattgttgatggtcagatagcctatactggtggggtcaatctggcagatgagtacattaaccacgtcgagagatttggttattggaaggatagtggaattcgcttagacggactagcagtaaaagccctgacacgcttatttttgaccacttggtacattaatcgaggagaaattagtgattttgatcaatatcatttagaaaatcattctatcccgagtgacggtttaaccattccatacggaagtggacccaagccaatttttcgagcgcaggtagggaaaaaagtttatcagagtttaatcaatcaagcaacagaatcggtctatattacgacaccttatttgattatagattatgatttaacagagacaatcaaaaatgcagctatgagaggggtcgatgttcgaattatcaccccttacataccagataagaagttcattcagttagtcacgagaggagcttatcccgactttctttctgctggtgttcggatttatgagtatagtccaggttttattcatagtaagcagatgttggtagacgaagattttgcggtggtggggacaatcaatctcgactaccggagcttggtacaccattatgaaaatgcagtcttactctataaaactccttctataagggaaatcgcccgagattttcgaaatatatttgcagattctcaggaagtctatcctcattctatcaaaacgagctggtatcaaaagcttgtaaaagaaatcgcccagctattcgcccctatcttataa

SEQ ID NO: 575 - DNA (genomic), 189 bp, Streptococcus pneumoniae; double-stranded, circular
  misc_feature (B) LOCATION 1...189
  hypothetical: NO
  anti-sense: NO
aaactggactataacttattagacttcctgcgaaacaaaacatggtatagtagttctatgaattatgaagcaagtaaacaactaaccgatgcacgatttaagcgtcttgttggtgttcagcgcaccacttttgaagagatgttagctgtgttaaaaacagcttatcaaaaaagtcggacaagctggtaa

SEQ ID NO: 576 - DNA (genomic), 672 bp, Streptococcus pneumoniae; double-stranded, circular
  misc_feature (B) LOCATION 1...672
  hypothetical: NO
  anti-sense: NO
atgatggactatccttatgctacctgttgctctcttaacgatgaagtggctcacgctttccctcgtcattatatcttgaaagatggtgatttgctcaaagttgatatggttttggggaggtccattgctaaatctgacctaaatgtctcaaaattaaacttcaacaatgttgaacaaatgaaaaaatacactcagagctattctggtggtttagcagactcatgttgggcttatgctgttggtacaccgtccgaagaagtcaaaaacttgatggatgtaaccaaagaagctatgtacaagggtattgagcaagctgttgttggaaatcgtatcggtgatatcggtgcggctattcaagaatacgctgaaagtcgtggttacggtgtagtgcgtgatttggttggtcatggtgttggcccaactatgcacgaagaaccaatggttcctaactatggtattgcaggtcgtggactccgtcttcgtgaaggaatggtcttaaccattgaaccaatgatcaatacaggcgattgggaaattgatacagatatgaaaactggttgggcgcataagaccattgacggtggattgtcatgtcagtatgaacaccaatttgtcattacgaaagatggacctgttatcttgactagccaaggtgaagaaggaacttattaa

SEQ ID NO: 577 - DNA (genomic), 1332 bp, Streptococcus pneumoniae; double-stranded, circular
  misc_feature (B) LOCATION 1...1332
  hypothetical: NO
  anti-sense: NO
atgaaacgctaccttcaattttggctagtcaatctaagtgttagcctcattctgattgcagggatggcattaacttggatcagtaaaggcatcggtctctttcttctagccctttctttgggacaaggtggctactggctcttttgcctttggaaatgggaagttgcttttgagaccttgcaccaacctctcttgaccaatagtgaatactttttagaaaaagggcaagaagacttaaagtctttggctcagtatgtgtctgccctaaaaaccaaagtctcccaacaggatcagcaatacaaggacctacccgaaacaatggaggttcttctgtcgcacctaaccatggggacgtttttagtttccgctcaaggtcagatgttattatccagtcgctctctgcctcattattttcccgatgtggacggcgacataagttcacttgatgacctcaaacggatggatattcgaaatttagttcaccaagcctttgatcaaaaaacaaggttaaaacaaaaagtaagtgggtttcatgagggtgacttgattttagaagtgacagcagttcccgtttttagccccacccaatctgtggaagctgtgctcgtcttgctatatgatttaacaacgattagaacttatgaaaagttaaatttagcctttgtctcaaatgcctcccatgaattgaggacaccagttacttcgattaagggctttgctgaaaccattaaggggatgtcagctgaagaagaagcgctcaaggatgactttctagacattatttacaaagaaagcttgcgtcttgagcatattgttgagcatcttcttaccttatctaaggctcaacaaatgcctatacaatggacgaccctttctttggcagaatttgtacaggatttgactcaaagcttgcaacctcagctcaagaagaaggatttacagctaaaggtgcaggtgccagatgatgtcaccctcgtatcagatagtcaattactttcccaaatcttactcaatcttttatccaatgccatccgttacactgaacaagggggaaaaattgaggtcaagacccaaaaggtgaacgaaggcattaagatttctgtatcagatacagggattggtattagtcaattagagcaggatcgtatttttgaacgtttttaccgagttaataaaggtcgaagcagacaaactggtggcactggtcttggccttgccattgtcaaagaactcagtcaattattaggtggccaagtcacggtgacgagtcagcttggcagaggcagttgcttcacgatttttcttcctaaccaatctttcgcacaggactaa

SEQ ID NO: 578 - DNA (genomic), 507 bp, Streptococcus pneumoniae; double-stranded, circular
  misc_feature (B) LOCATION 1...507
  hypothetical: NO
  anti-sense: NO
aattttggctataacatcacgacctgtagttcctcttatagtctaggagattgggttgtgattggagtcgttgcgagagagaatgccgcagagcagatcaaacagtatcaaaaatttactgtgaatatttctgatgaaacttctatgcttgcgatggagcaggctggttttatcagtcatcaggagaaattggaacgtttgggagtgcattatgaaatttctgaacgaactcagatttctattttagacgcctgtccacttgttttagattgtcgggtagataggattgttgaggaagacggtatttgccacatctttgccaagattcttgagcgacttgttgccccagaattcctggatgaaaagggacattttaaaaatcaactgtttgccccaacctatttcatgggagatggatatcagcgcgtttatcgctatctggacaagcgtgtagatatgaagggcagtttcatcaaaaaagcgaggaagaaggatggcaagaactga

SEQ ID NO: 579 - DNA (genomic), 1800 bp, Streptococcus pneumoniae; double-stranded, circular
  misc_feature (B) LOCATION 1...1800
  hypothetical: NO
  anti-sense: NO
gcgaatttatatctaaaagggatattaaagaaaggagatatgcttatgaagatttacaaaaaactatttgcttatgtccaagataagaaatatcttggggttttggccataattttttctgctatatctgctgcacttacagtatatggatattatttaatctacaaatttctagataagttaataattaattcaaacttatccggtgcagagagtatagcattaaaatctgttattacactaacaagtggagcgatattttattttgtctcaggaatgttttcacatatcttgggattcaggcttgaaacaaatttaagaaaaaggggaatcgatggtctggaaaaagcaagttttaggttctttgacttaaatccatctggtcaaataagaaagattatagatgacaatgctgcacaaactcatcaggtggtagcacacatgattcccgatagttctcaggcaataatcacacccgtacttgtacttgcacttggctttatagtaagtataagagttggcataattttgcttgctcttactataattggtggcttaattttaggggcaatgatgggcgagcaagaatttatgaagatataccaagaatccctatctaaactaagtgctgaaactgttgagtacgtgagaggaatgcaagttgtaaaaatatttaaagcaaatgtagagtcttttaaaagcttttataaggcgataaaagattactcaaagtatgcttatgattattccctatcttgtaaaaggccttatgttttgtatcaatggttattttttggactgattgcaattttaattattcctatagtttattttatgactagcttagctagcgcaaaggtgattttacttgagcttatcatgattttatttttatcaggagttctctttgtttcattcatgagaatgatgtggtactccatgtatatttctcaaggaaattatgcagtagatactttagaggcgctttacgaagatatgcaaaaagacaaattagtgcatggtaatgtcaataattttaaaaactataatatagaatttgagaatgttagctttgcttataatgataaagctgtcattgaaaatttatcctttaatttagaagaaggaaagtcctacgcacttgtcggttcatctggatcaggcaaatcaacagtagcaaaacttatatcaggtttttacaatgttaataaaggaagcataaagataggcgggatagcaataagtgaatattctgacgaagccttaattaaagccatttcctttgtttttcaagattcaaaattattcaagaagagcatttatgataatgtagcgttagctaataaagatgcgacgaaagatgacgttatgagagccttaaaattagcaggatgcgatttaatattagacaaattcccagaaagagaaaatacaatcataggctcaaaaggtgtttatttatccggtggagaaaaacaaagaattgcaattgctagagcaattttaaaggattccaaaattattattatggatgaagcatcagcatctattgacccagataacgagtttgaattgcaaaaagcttttaaaaatcttatgaaggataaaacagttatcatgattgcacacaggctatctacaattaaagaccttgatgaaattattgtcatggatagtggaaaaattatagaaagagggtctgacaaagaattaatgtcaaaagatacaaggtataagagcctgcaagagatgtttaacattgcgaatgaatggagggtttcaaatgaaagagttttataa

SEQ ID NO: 580 - DNA (genomic), 897 bp, Streptococcus pneumoniae; double-stranded, circular
  misc_feature (B) LOCATION 1...897
  hypothetical: NO
  anti-sense: NO
cgactttctctgaaatatggtatgataaaggatatacaaggagataaaatgaataataatttactggtattacaatcagactttggtctggttgatggtgcggtatcggctatgattggagtggctttagaagagtctccaaccttaaaaatccatcacttgacgcacgatatcacgccttataatatttttgaggggagctatcgtctctttcagacggtggattactggcctgagggaacgacgtttgtatcggttgtcgatccaggtgtcggttcgaaacgtaagagtgtagttgccaagactgcaaaaaatcaatacattgtcacgccagataatgggacgctttcctttatcaagaaacacgttggcattgtagccattcgtgagatttctgaggtggccaataggcgtcaaaacacagagcattcttataccttccacggtcgtgatgtctatgcctatactggtgctaaactggccagtggtcacattacttttgaggaagtagggccagagctcagtgtggaacagattgtagagcttccagtcgtagcgaccatcatagaagatcatctggtgaagggagccattgatattctggatgtgcgtttcggttcgctttggacctctatcacacgggaagaattttacaagctggaaccagaatttggtgatcgttttgaagtgaccatctatcatgctgatatgctggtctatcaaaatcaggttgtctatggcaaatcatttgcagatgtgagaattgggcaacccatcctttacatcaactctctctatcgtttaggtttggctatcaaccaaggttcctttgccaaggcctataatgtaggtgtcggttcatcttggaccattgaaataaagaaaatagaaggataa

SEQ ID NO: 581 - DNA (genomic), 213 bp, Streptococcus pneumoniae; double-stranded, circular
  misc_feature (B) LOCATION 1...213
  hypothetical: NO
  anti-sense: NO
agactcttataccaggagaaaattacctatcatgttaaggataatcagctagaagtagaaacagataaatacacatatactgccgctagaaatggtagtaaggaagttggtattcaagagtcagatatagcagcaactctaagtgccgatgaatataattctaatcgccaaacttttgagagagaatacaaatacaaaagcaaatgcccttaa

SEQ ID NO: 582 - DNA (genomic), 195 bp, Streptococcus pneumoniae; double-stranded, circular
  misc_feature (B) LOCATION 1...195
  hypothetical: NO
  anti-sense: NO
tatagcctatattatataaataatcaattgcgcagaaatttggtaagaattcatgcgtcaactcataaagaactacttaaaaaattcacagtattcataattattttcgaggagaaaaacagtgaaaaaaagaaaaaagcttgctctgtctcttatcgctttttggctgacggcttgtttagtaggctgtgctag

SEQ ID NO: 583 - DNA (genomic), 1806 bp, Streptococcus pneumoniae; double-stranded, circular
  misc_feature (B) LOCATION 1...1806
  hypothetical: NO
  anti-sense: NO
agtatactatataaagtaaactatgataacatggaggtattgtgtatggttgacaaacaagtcattgaagaaatcaaaaacaatgccaacattgtggaagtcataggagatgtgatttctttacaaaaggcaggacggaactatctagggctctgtccttttcatggtgaaaaaacaccttctttcaacgttgtagaggacaagcagttttaccactgttttggttgtggtcgctcaggtgatgtctttaaattcatcgaggagtaccaaggggttacctttatggaggctgtccaaatcttaggtcagcgtgtcgggattgaggttgaaaaaccgctttatagtgaacagaagccagcctcgcctcaccaagctctttatgatatgcacgaagatgcggctaaattttaccatgctattctcatgacaacgactatgggcgaagaggccagaaattacctttatcagcggggtttgacagatgaagtgcttaaacatttttggattggtttagcacctccagaacgaaactatctctatcaacgtttgtctgatcagtatcgtgaagaggatttactggattcaggcctgttttatctctcggatgccaatcaatttgtagacacctttcacaatcgcattatgtttcccctgacaaatgaccaaggaaaggtcattgccttctcaggtcgtatctggcaaaaaacggattcacaaacttctaagtataaaaacagccgatcgactgcaatttttaacaaaagttacgaattatatcatatggatagggcaaaaaaatcttctggaaaagctagtgagatttacctgatggaaggattcatggatgttattgcagcctatcgggttggaatcgaaaatgctgtggcgtcgatgggaacggccttgagtcgagagcatgttgagcatctgaaaaggttaaccaagaaattggttcttgtttacgatggagataaggctgggcaagccgcgatattgaaagcattggatgaaattggtgatatgcctgtgcaaatcgtcagcatgcctgataacttggatcctgatgagtatctacaaaaaaatggtccagaagacttggcctatctattaacgaaaactcgtattagtccgattgagttctacattcatcagtacaaacctgaaaacagtgaaaatctgcaggctcagattgagtttattgaaaaaatagctcccttgattgttaaagaaaagtccatcgctgctcaaaacagctatattcatattttagctgacagtctggcgtcctttgattatgcccagattgagcagattgttaatgagagtcgtcaggtgcaaaggcagaatcgcatggaaagaatttccagaccaacgccaatcaccatgcctgtcaccaagcagttatcggctattatgagggcagaagcccatctactctatcggatgatggaatcccctcttgttttgaacgattaccgtttgcgagaagactttgcatttgctacacctgaatttcaggtcttatatgacttgcttggccagtatggaaatcttcctccagaagttttagcagagcagacagaggaagttgaaagagcttggtaccaagttttagctcaggatttgcctgctgagatatcgccgcaggaacttagtgaagtagagatgactcgaaacaaggctctcttgaatcaggacaatatgagaatcaaaaagaaggtgcaggaagctagccatgtaggagatacagatacagccctagaagaattggaacgtttaatttcccaaaagagaagaatggagtaa

SEQ ID NO: 584 - DNA (genomic), 198 bp, Streptococcus pneumoniae; double-stranded, circular
  misc_feature (B) LOCATION 1...198
  hypothetical: NO
  anti-sense: NO
ctttgtatatactttgttattcttttctcattaatagtgtctaatgcactagttgcttcatctaaaattacaatactaggattatttattaatgcacgtgccagtgctatccgttgcctttgcccacctgaaatatttgaccccatctctgagatgatagtattaaatttcatcggcatagccatgatttcatcatag

SEQ ID NO: 585 - DNA (genomic), 474 bp, Streptococcus pneumoniae; double-stranded, circular
  misc_feature (B) LOCATION 1...474
  hypothetical: NO
  anti-sense: NO
aggtcctctcttaacagtcaatttgctcacatttttagggcaacttcttatttttctgattggatttggacttgtggccacaattttacgaagaagtttagtcaagattctcctaaaatgaaaatgggcacttacattgttgttgggactatagttcttctagttgttttaggatatgtaggattggcaagctacatacaagaaggagccttttatattccggctccctgggatagtttgtctgtctttacgatttcgctagttatcggtatttggagttggaaagaagcggtctttcgtccctttgtcagtatgattattgcccatcttgtggtgggttctctgctccgttattatgagtggatgggaatttcaaatgttttccttacaaaagttattcctttagctgtcctctttattggaatctttgtcttgttccgtgggtttaagaagataaaatggagtgaagtatag

SEQ ID NO: 586 - DNA (genomic), 249 bp, Streptococcus pneumoniae; double-stranded, circular
  misc_feature (B) LOCATION 1...249
  hypothetical: NO
  anti-sense: NO
aaagtgatatactatatggatacaaaaatgatgtcacaattttctgttatggataatgaaatgcttgttcgtacagaggatggggatgtctctgatatttatagagggtacgctaatcagagaagtccattcgcttcttacccttctatattaaaaaattcaggtccttttccagtaagtgggtactgcctgcgtggttatcatgaccgtggttatataggagcaggttttcatttatgtggaatatag

SEQ ID NO: 587 - DNA (genomic), 2589 bp, Streptococcus pneumoniae; double-stranded, circular
  misc_feature (B) LOCATION 1...2589
  hypothetical: NO
  anti-sense: NO
gatacagtatacagtttttccttttnacacatttcaaattccttcaaaaatggtataatagtaacatcacaaaattggagagagaccatgagtttttacaatcataaagaaattgagcctaagtggcagggctactgngcagaacatcatacatntaagacaggaacagatgcatcaaaacctaagttttatgcgcttgatatgttcccttatccgtctggagctggtctgcacgtaggacacccagaaggttatactgcaaccgatatcctcagtcgttacaaacgtgcgcaaggctacaatgtccttcacccaatgggttgggatgcttttggtttgcctgcagagcaatacgctatggatactggtaatgacccagcagaatttacagcggaaaacattgccaacttcaaacgtcaaatcaatgcgcttggattttcttatgactgggatcgtgaagtcaatacaacagatccaaactactacaagtggactcaatggattttcaccaagctttacgaaaaaggcttggcctatgaagctgaagtgccagtaaactgggttgaggaattgggaactgccattgccaatgaagaagtgcttcctgacggaacttctgagcgtggaggctatccagttgtccgcaaaccaatgcgccaatggatgctcaaaatcacggcttacgcagagcgcttgctcaatgacttagatgaactagattggtcagagtctatcaaggatatgcaacgcaactggattggtaaatcaactggtgccaatgtaactttcaaagtaaaaggaacagacaaggaatttacagtctttactactcgtccggacacacttttcggtgcgactttcactgtcttggctcctgaacatgaattagtagacgctatcacaagttcagagcaagcagaagctgtagcagactataaacaccaagccagccttaagtctgacttggctcgtacagaccttgctaaggaaaaaactggtgtttggacaggtgcctatgccatcaaccctgtcaatggtaaggaaatgccaatctggattgcggactatgttcttgctagttatggaacaggtgcggttatggctgtgcctgcccacgaccaacgtgactgggaatttgccaaacaatttgaccttccaatcgtcgaagtacttgaaggtggagatgtcaaagaagctgcctacacagaggatggcctgcatgtcaattcagacttcctagatgaactcaacaaagaagacgctattgccaagattgtggcttggttggaagaaaaaggctgtggtcaggagaaggttacctaccgtctccgcgactggctctttagccgtcaacgttactggggtgagccaattccaatcattcattgggaagatggaacttcaacagctgttcctgaaactgaattgccgcttgtcttgcctgtaaccaaggatatccgtccttcaggtactggtgaaagtccactagctaacttgacagattggcttgaagtgactcgtgaagatggtgtcaaaggtcgtcgtgaaactaacaccatgccacaatgggctggttcaagctggtactacctccgctatattgacccgcacaatactgagaaattggctgatgaggacctcctcaaacaatggttgccagtagatatctacgtgggtggtgcggaacatgctgtacttcacttgctttatgctcgtttctggcataaattcctctatgacctcggtgttgttccgactaaggaaccattccaaaaactctttaaccaagggatgattttgggaacaagctaccgtgaccaccgtggtgctcttgtggcaaccgacaaggttgaaaaacgtgatggttccttctttcatatagaaacaggggaagagttggagcaagcgccagccaagatgtctaaatcgctcaagaacgttgttaacccagatgatgtggtggaacaatacggtgccgatacccttcgtgtttatgaaatgtttatgggaccactcgatgcttcgattgcttggtcagaagaaggtttggaaggaagccgtaagttccttgaccgagtttaccgtttgattacaagtaaagaaatccttgcggaaaacaatggtgctcttgacaaggcttacaacgaaacagtcaaagctgttactgagcaaattgagtctctcaaattcaacacagctattgcccaacttatggtctttgtcaatgctgctaacaaggaagataagctttatgttgactatgccaaaggctttattcaattgattgcaccatttgcacctcacttggcagaagaactctggcaaacagtcgcagaaacaggtgagtcaatctcttatgtagcttggccaacttgggacgaaagtaaactggttgaagacgaaatcgaaatcgttgtccaaatcaaaggtaaagtccgtgccaaactcatggtcgctaaagacctatcacgtgaagaattgcaagaaattgctctagcggatgaaaaagtcaaagcagaaattgacggtaaggaaatcgtgaaagtgattagtgtaccaaataaattggttaatattgttgtaaaataa

SEQ ID NO: 588 - DNA (genomic), 1212 bp, Streptococcus pneumoniae; double-stranded, circular
  misc_feature (B) LOCATION 1...1212
  hypothetical: NO
  anti-sense: NO
ccatcatctcttgtttttttgtggtacaatagagctatgaaacattttgatactattgtcatcggtgggggacctgctggtatgatggctacgatttccagtaacttttatggacagaaaaccctcctcatcgaaaaaaatcggaaacttggaaaaaaattagctgggactggtgggggacgttgcaatgtgaccaacaatggtagcttagacaacctgctagctggaattcctggaaacggacgctttctttacagtgttttctcccagttcgataatcatgacatcatcaacttttttacagaaaatggtgttaaacttaaggtcgaagaccacggacgcgtctttccagccagtgacaagtctcggactattatcgaagctttggaaaagaaaatcactgaactaggtggtcaagttgctactcaaatagaaatcgtttctgttaaaaaagtagatgaccagtttgtccttaagtcagcggatcaaaccttcacttgtgagaaactcattgtcacaacaggtggtaagtcttatccttcgactggttcgactggttttggtcacgagattgctcgccattttaagcataccatcaccgatcttgaggctgctgaaagtcctttattaacagattttccacataaagccttacaagggatttctctggacgatgtgaccctaagttatggtaagcatgtcatcactcatgatttactctttacccactttggtttgtcaggtcctgctgccctacgcatgtctagctttgtcaaaggtggggaggttctctcactcgatgttttgcctcaactttctgagaaggacttggttacatttctagaagaaaatcgggaaaaatccttgaaaaacgctttaaaaaccttgttaccagaacgcttggccgaattttttgtacaaggatatcctgaaaaagtcaaacagctgactgaaaaggaacgagaacaacttgtccagtccattaaagaacttaaaattcctgtaactggaaaaatgtcccttgcaaagtcctttgttaccaagggtggagtcagtctcaaggaaatcaatcctaaaacccttgaaagtaagctggtacctggcctccactttgcaggcgaagttatggatatcaatgcccacacgggtggctttaacatcacttctgccctctgtaccggctgggtggcgggaagtctgcattatgattaa

SEQ ID NO: 589 - DNA (genomic), 465 bp, Streptococcus pneumoniae; double-stranded, circular
  misc_feature (B) LOCATION 1...465
  hypothetical: NO
  anti-sense: NO
aagaaatctctaaataaagaggatacaataatggacatctgggaaaagatgtacgaagaagcacagaaactatacaatccacatgaagtatcagactttgtttatgccaatcatgttgtagctgcagtagaagcagaagatggacaaatatttacaggattctgtatggagggaacctgtggtgttttccatctctgcgcagaacgggcggccctcttcaatatgtaccaattttcaggacaaactaaggttaagaaagtattagcctttcgagacaaaccaccttatggtggaagttcagccatgccttgcggtgcttgtagagaattccttttagagcttaatgctgaaaataaagatgcagaattcatgatggactataatataagaaaaacagttaaagtcgcagaactaatcccttattggtggggagaagaacgtgcttctaagtttaatgagcgatag

SEQ ID NO: 590 - DNA (genomic), 441 bp, Streptococcus pneumoniae; double-stranded, circular
  misc_feature (B) LOCATION 1...441
  hypothetical: NO
  anti-sense: NO
ttgatttcatatcactgttatataatgcttnttgattntagtttagtattagtaagcagactcaaaactttagaaaatcttttgagatcattgacaggtgtatcgaatcctaccacagattcagcacgtctggttttggcagaggctaagaaagcttttgcagatgatagtttgacagagcaaggtttacgtgatatcttgcaaacagtcaaagatgccattgcttccctagagtccattaaggaaagccagtcagcaactaaggatggaggacaaacagcgggcaaagaaacagcagataaggatgtccttgaaaactctcaagaagaacttcaaaaagcagttttgttcttggcagatgaaaaaggctctgagcatactgaagcagagttgattgataatcttaaagaggttattgctaagttgaaagcaaacgcctaa

SEQ ID NO: 591 - DNA (genomic), 300 bp, Streptococcus pneumoniae; double-stranded, circular
  misc_feature (B) LOCATION 1...300
  hypothetical: NO
  anti-sense: NO
agttgttcatatcttatttcaatttactatagtacaaaactagaaaaggaaaaaatcatgaccaaaacaattcttgttacaggtgggactagctacattggctcccataccgttaaagctcttttaaatgctggctatcaggtgcatgtcctcgataatctctccacaggaaatcgagcggctgtggatagtcgtgctagctttaaagaactggatgtttatgatgctagcgccttaaaagcttacttaaaaaaaaatcaaattgatgctgtcttcccttttccagttgaaattttttga

SEQ ID NO: 592 - DNA (genomic), 315 bp, Streptococcus pneumoniae; double-stranded, circular
  misc_feature (B) LOCATION 1...315
  hypothetical: NO
  anti-sense: NO
aacgcatcatatcaagcacgaaaattccacgaggtcaactacagtcagaaagctgaacaacaagccaaaacgcccaaaaaaggcggcaaaaagcaagcacctgcaagcaacgtgccgaaatggtcaaatcctgattatgtcaacgaattagacccaaaaatcgttgatatgctagtagaatttcacaagtcacaaggcactttggaaactcccgaggcgcaagcagaaatcgcccaaaaacgtgaagaaatcgagcaaaggagagctgagcttgagggtaaaaaacaagagcttttgaaccgcttgaacaaatag

SEQ ID NO: 593 - DNA (genomic), 2700 bp, Streptococcus pneumoniae; double-stranded, circular
  misc_feature (B) LOCATION 1...2700
  hypothetical: NO
  anti-sense: NO
tttatgtctcttcaaaaattagaaaattatagtaataaaagtgttgtgcaagaagaagtcttgattctaacagaattactggaagatattactaaaaatatgcttgccccagagacctttgaaaaaataatacagttgaaagaattatcaacgcaggaagattatcaaggtctaaaccgtctagtgactagcttatcaaatgatgaaatggtctatatttcacgctatttctctatcttgcctcttttgattaatatttcagaggatgtggatttagcttatgaaatcaatcatcaaaataatattgatcaggactatttaggtaaattatctacaacgattaaattggtagcagaaaaggaaaatgccgttgagatcctagaacacttgaatgttgtccctgttttgacagcccatccaacacaagtgcaacgcaaaagtatgttggatttaacaaatcatattcatagtcttttgcgtaaataccgtgatgttaagttggggttgatcaataaagataaatggtacaatgatttgcgtcgttacatcgaaattatcatgcagacagacatgattcgtgagaaaaaattaaaagtgactaacgaaatcacgaatgctatggaatattataacagctcctttttgaaagctgtacctcatttgacgacggagtataagcgcttagcgcaagcgcatggtctgaatttaaaacaggctaaaccaatcaccatgggtatgtggataggtggtgaccgtgatggaaatccatttgttacagcaaagaccttgaagcagtctgcactcactcagtgtgaagtcatcatgaactactatgataaaaagatttaccaactttatcgtgaattttctctttcaactagcattgtcaacgtcagcaagcaagtcagagaaatggctcgtcaatccaaggataactctatttaccgcgaaaaagagctttaccgtcgtgccttgtttgatattcaatcaaaaattcaggcaactaaaacctatctgattgaggatgaagaagttgggactcgttatgaaaccgccaatgatttctacaaggatttgattgccattcgagattctctactagaaaataagggtgagtccttgatttcaggtgattttgtggaattattgcaggcagtagagatatttggtttttacttagcgtcaattgatatgcgacaagactctagcgtctatgaagcctgtgtggcagaactcttgaaatcagcaggaattcattctcgttatagcgagttgagcgaagaagaaaagtgtgaccttctcttgaaagaattagaagaagatccccgaattctttctgcgactcacgcagaaaaatcagaattattagcaaaagaattagctatttttaagacggctcgtgttttgaaagataagttgggagatgatgtcatccgtcagaccatcatttcacatgcaaccagcctttctgatatgctagaattagctattctgttaaaagaagtaggactggtggatacggaaagggcgcgtgttcagattgttcccctttttgaaacaattgaagacttggatcattcagaggaaacaatgagaaaatatctttctcttagccttgccaaaaaatggattgactcacgaaataactaccaagaaatcatgcttggctactctgacagtaataaagatggcggttacttgtcatcatgttggaccctctacaaggctcaacaacaattgactgctattggagatgaatttggcgttaaggttaccttcttccatggtcgtggtggtactgtcggtcgtggtggtgggccaacctatgaagccattacatctcaaccgctcaagtctatcaaggatcgtatccgcttgacggagcagggtgaagtaattgggaataaatacggtaacaaagacgccgcttactataaccttgaaatgctagtatcggcagctattaaccgtatgattactcagaagaagagcgataccaataccccaaatcgttatgaagccattatggatcaagtagtggaccgtagttacgacgtctaccgtgatttggtctttggtaatgagcatttctatgattatgtcttcgagtcaagtccaatcaaggctatttcaagttttaatattggttctcgtccagccgctcgtaagactattactgaaatcggtggattgcgtgccatcccttgggtattctcatggtcacagagtcgtgttatgttccctggatggtacggggttggttcaagcttcaaggaatttatcaataaaaatccagagaatattgctatcttacgagatatgtaccaaaattggcctttcttccaatcgcttctttcaaatgttgatatggttttgtcaaaatcaaatatgaatattgcttttgaatatgctaaactttgtgaagacgagcaagttaaggccatctatgagactattttaaatgaatggcaagttactaagaacgttatcttggctattgaaggacatgacgaactcttagctgacaatccatatctaaaagctagtctggattaccgtatgccttactttaatattctcaactatattcagttggagttgattaaacgccaacgtcgtggagaattgtccagtgatcaagaacgattgattcatatcaccatcaacggaattgcgacaggattgcgtaattcaggttga

SEQ ID NO: 594 - DNA (genomic), 1446 bp, Streptococcus pneumoniae; double-stranded, circular
  misc_feature (B) LOCATION 1...1446
  hypothetical: NO
  anti-sense: NO
aaaatgacatacgaagtaaaatctcttaatgaagaatgtggtgttttcggtatttggggacatccagatgctgctaagttgacctattttggactccacagtcttcaacaccgtggtcaggagggggcaggaatcctctccaacgatcaaggacaactgaagcgccatcgtgacatggggcttttatcagaagttttcagaaatccagctaatttggataaattgacaggagctggtgcgattgggcatgtgcgttatgcgactgctggcgaagcttctgtagataacatccagcccttcctcttccgttttcacgatatgcagtttggcttggctcataatggaaatctgaccaatgcagcctctctcaagaaagaattggaacaaagaggagcaattttcagcgcgacttcggactctgaaatcttggctcacctcattcgtcgcagtcataatcctagcctgatgggcaaaatcaaggaagcgctcagccttgtcaaaggtggttttgcctatatcttgctgtttgagaacaagttgattgcggctcttgaccctaatggctttcgtccgctttctatcgggaaaatggccaacggagcggtggttgtttcctctgaaacctgtgcttttgaggtcattggtgccgagtggattcgtgatttgaagccaggtgagattgtgatcattgatgacgagggcattcagtatgacagctatacagatgatacccagttggcgatttgttctatggagtatatctactttgcccgccctgattctaatatccacggtgtcaatgtccatacggcacgtaagagaatgggagcgcaattggcgcgagaatttaagcatgaggcagatattgtagttggtgtgcccaattcttccctaagcgcggctatgggatttgcggaagaatcaggcttaccaaatgaaatgggtctgatcaaaaaccaatacacccagcgaacttttatccaaccgactcaagaattgcgggagcaaggagtgcggatgaaactgtctgctgtttcgggtgttgtcaaaggcaaacgtgtggtcatggtggatgattccattgtacgtggaacaacctctcgtcgtatcgttcagctcttgaaagaagcgggtgcgactgaggttcacgttgccattggaagtcctgcactagcgtatccatgtttctacgggattgatatccagacccgtcaggagctgattgcagccaatcatacggtcgaagaaactcgccaaatcattggtgcggacagtctgacttatctttcaattgatagcttgattgagtcgattggtatcgaaacagatgcgccgaacggtggtctctgtgtcgcttactttgacggtgactacccaacgcctctctatgactacgaagaagactatcgtagaagtttggaagaaaagaccagtttttacaagtag

SEQ ID NO: 595 - DNA (genomic), 192 bp, Streptococcus pneumoniae; double-stranded, circular
  misc_feature (B) LOCATION 1...192
  hypothetical: NO
  anti-sense: NO
gcctggacatatccaaagggcaacaacttcactactgtgttcctaagggcactatttggggatcaacagttgataaggattatgctctggtttcttgtcttgttgctcctggttttgaatgttgaggattttgaattatttgaaagggtagatctnactggcgacctatccagagcacaaggagatgattga

SEQ ID NO: 596 - DNA (genomic), 1227 bp, Streptococcus pneumoniae; double-stranded, circular
  misc_feature (B) LOCATION 1...1227
  hypothetical: NO
  anti-sense: NO
agcatggcatatcaggaaccaaataaagatggattttacggaaaattcggcggacgttttgtcccagaaacattgatgacagcagttttggagttggagaaggcctaccgtgaaagtcaggcagacccaagtttccaagaggaattaaaccaacttttgcgccagtacgtgggacgtgaaactcccctttactacgcaaaaaacttgacccagcatatcggcggagccaagatttatctcaaacgggaagaccttaaccatacaggagcccacaagattaacaatgccttaggacaagtttggcttgccaaacgcatgggtaaaaagaaaattatcgcagaaacgggtgctggtcagcacggtgtggcaactgcaactgctgcggccctctttaacatggaatgtaccatctacatgggtgaggaagatgtcaaacgccaagccctcaatgtcttccgtatggagcttttgggagctaaggtcgaggccgtgacagatggttcgcgcgtgctcaaggatgcggtcaatgcagcccttcgttcatgggtggctaatatcgatgatacccactatatccttggttctgccttggggcctcatccatttccagaaattgttcgtgacttccaaagtgtcattggtcgagaggctaaacaacagtaccgtgacttgacaggacaaaatctgccagatgccctagtagcctgtgttggtggtgggtcgaatgccatcggtctcttccatccctttgtagaagatgagtcagtagccatgtatggagctgaagcggctggacttggtgtggatacggagcaccacgcagctaccttgaccaagggtcgtccaggtgtccttcacggttccctcatggatgtgctccaagatgcccatggtcaaattcttgaagccttctctatctcagcaggtttggactatcctggtatcggtccagagcattctcactaccacgatatcaaacgtgccagctatgtccctgtgacagacgaagaagctttggaaggatttcaactcttgtctcgtgtggaagggattatcccagccttggaatctagccatgctatcgcctttgcggtgaaattggccaaagaacttggaccagaaaagtctatgattgtctgcctatcaggtcgtggggacaaggatgtggttcaagtcaaagaccgcttggaagcagatgcagcaaagaagggagaagctcatgcctaa

SEQ ID NO: 597 - DNA (genomic), 290 bp, Streptococcus pneumoniae; double-stranded, circular
  misc_feature (B) LOCATION 1...290
  hypothetical: NO
  anti-sense: NO
tcgctaaatacgaaattctttatatcattcgtccaaacattgaagaagaagctaaaaacgctttggtagcacgttttgactctattttgactgacaacggtgcaactgttgttgaatcaaaaacttgggaaaaacgtcgtcttgcatacgaaatccaagatttccgtgaaggactttaccacatcgttaacgttgaagcaaatgacgatgcagctcttaaagagtttgaccgtctttcaaaaatcaacgctgacattcttcgtcacatgatcgtcaaaattgacgcgtaa

SEQ ID NO: 598 - DNA (genomic), 1104 bp, Streptococcus pneumoniae; double-stranded, circular
  misc_feature (B) LOCATION 1...1104
  hypothetical: NO
  anti-sense: NO
caaataaaatatgccgagggttacccaggacgccgttattatggtggaactgatgtagtagacgttgtagagactcttgctattgaacgcgcaaaagaaattttcggtgctaaatttgccaatgtccaaccacattcaggaagccaagctaactgtgcggcttacatgtccttgattgagccaggtgatacggttatgggaatggatttggcagcaggtggacacttgacccacggagctccagttagcttctctggtcaaacctacaactttctttcctatagtgtggatcctgaaacggaacttttggactttgatgctatcttgaaacaagcccaagaagtaaaaccaaaactgattgtagctggtgcttcagcctattctcaaattattgacttttcaaaattccgtgaaattgcagatgctgttggggctaagcttatggttgatatggcccacatcgctggcttggttgcagctggtcttcacccaagcccagtgccatacgctcatatcactacaacaacgacccacaaaacccttcgtggtcctcgtggtggtttgattttgaccaatgatgaggatttagctaagaaaatcaattcagctattttccctggtattcagggtggtcctttggagcatgttgtggctgctaaggcagtttccttcaaagaagttttggatccagctttcaaggaatatgctgccaatgtaattaagaacagcaaggctatggcagatgtcttcttgcaagaccctgatttccgtattatttcaggtggaactgaaaaccatctcttccttgttgatgtgactaaggttgtagaaaacggaaaagttgctcaaaacttgctggatgaagtcaatattaccctaaataaaaattcaatcccttacgaaaccttgtcaccattcaagacaagtgggattcgtatcggagcagcagctattactgcacgtggatttggtgaagaagaaagtcgcaaagtggctgaactcatcattaaaacccttaagaattcagaaaatgaggctgtattagaagaagtgagaagtgcagtcaaagaattgacagatgccttcccattatacgaggaataa

SEQ ID NO: 599 - DNA (genomic), 225 bp, Streptococcus pneumoniae; double-stranded, circular
  misc_feature (B) LOCATION 1...225
  hypothetical: NO
  anti-sense: NO
tcaaaaaaatatgctattatgttaaaaaaatatttttcaaaatataaatggacggatttattttggattttatttgttattttgacctgtctctatattggtaaccatgatttgtttactctcaatcatcaagaattctcttttcgtggtagcgtttggggtctggtactggccttatatcacttactattcattgataagtttgttatatcgaatcgaaaataa

SEQ ID NO: 600 - DNA (genomic), 1464 bp, Streptococcus pneumoniae; double-stranded, circular
  misc_feature (B) LOCATION 1...1464
  hypothetical: NO
  anti-sense: NO
gttgaaaaataccttgtccagtcaccacaccgtaatcaagatctagatttggcttacctgcgttcaggaatcgcggatttaggacacctttcttatccagaacagctcaagtttaaaaccaagcaagtcaaggacagtctctacaagattgctggaattgcagatgtagaagttgctgaaacgcttggtatggaacatccagtcaagtatcgcaataaggcgcaggtgcccgttcgtcgagtgaatggtgtcttggaaacaggatttttccgtaagaattcgcacgacctcatgccccttgaagatttctttatccaggatcctgtcattgaccaagtcgtagtagctcttcgagacctgctccgtcgttttgatttaaaaccttatgacgaaaaggaacagtctggattgattcggaatcttgtggtgcgtcgtggtcactattcaggacaaatcatggtcgttttggtgacaactcgtccaaaagtttttcgtgttgaccaattgattgaacaagttatcaagcagttcccagagattgtgtctgtcatgcaaaatatcaacgaccagaataccaatgcgatttttggtaaggagtggcgcactctttatggtcaagactatattacggaccagatgttgggaaatgacttccaaatcgctggcccagccttttaccaagtcaatactgaaatggcggagaaactctatcaaacagccattgactttgcagagttaaaaaaagatgacgtgattattgatgcctattctggtattggaaccattggtttatcagtcgccaagcatgtcaaagaagtctacggtgttgaactgattccagaagcggttgagaatagtaaaaaaaatgctcagctgaacaatatttcaaacgcccactatgtctgtgacacagctgaaaatgctatgaagaattggcttaaagatgggattcaaccaaccgttatcttggttgatcctccacgcaagggcttgacagaaagctttatcaaagcaagcgcccaaacaggagccgatcgcatcgcctatatctcctgcaatgtcgcaaccatggcgcgtgatatcaaactctaccaagaattgggatatgaattgaagaaagtccagccggtggatctatttcctcaaacgcatcacgtcgagacggtagcacttttgtccaaactcgatgtcgataagcacataagtgttgaaattgagctggatgagatgaatttgacaagtgcggagagcaaagcaacatatgctcaaatcaaagaatatgtttggaataaatttgaattaaaagtttcgacattatatattgcacagataaaaaagaaatgtggaatagaattacgagaacattacaacaagtctaaaaaggataaacaaattattccacagtgtacacctgaaaaagaagaagccatcatggatgctttgagacacttcaaaatgatttaa

SEQ ID NO: 601 - DNA (genomic), 1242 bp, Streptococcus pneumoniae; double-stranded, circular
  misc_feature (B) LOCATION 1...1242
  hypothetical: NO
  anti-sense: NO
ggaggaaaatacatgtcttctcatccaattcaggtcttctcagaaattgggaaactgaaaaaagttatgttgcaccgtccaggcaaggagttagaaaacttgttgccggactatcttgaaaggcttctttttgatgatattcctttcttggaagatgctcaaaaagaacatgatgcatttgcccaagctcttcgcgatgaaggaattgaggttctctacctagaacaactcgctgctgaatcattgacctctccagaaatccgcgatcaatttatcgaggaatacttagacgaagccaacatccgtgatcgtcaaaccaaggttgctattcgtgaattgcttcacggcatcaaggacaaccaagaattggttgaaaaaacaatggctgggattcaaaaagttgaattgccagaaattcctgacgaagctaaagatctaactgacttagttgaatcagagtatccatttgcaattgacccgatgccaaacctctatttcactcgcgacccatttgcaacaattggaaacgccgtatcgcttaaccacatgtttgcagatactcgtaaccgtgaaacactctacggtaagtatatcttcaaataccacccaatctatggcggaaaagtggatttggtctacaaccgtgaagaagatacgcgtatcgaaggtggagacgagctaattctttctaaagacgtccttgcagtaggtatctctcaacgtacagacgcagcttctatcgaaaaacttttggtcaacatcttcaagaaaaatgttggcttcaagaaagttttggcctttgaatttgctaacaaccgtaaattcatgcacttggatactgtcttcactatggtagactatgacaagttcactattcacccagaaatcgaaggcgaccttcacgtttactcagttacttacgaaaacgaaaaacttaaaatcgttgaagagaaaggtgacttagctgaacttcttgctcaaaaccttggtgtagaaaaagttcatttgattcgttgcggtggtggcaatatcgtagcagctgcgcgtgaacaatggaacgacggttctaacactttgaccatcgcacctggtgtggtagttgtttatgaccgcaataccgtgaccaataagattttggaagaatacgggcttcgcttgattaagattcgcggaagtgaattggttcggggccgtggtggacctcgttgtatgtctatgccatttgaacgtgaagaagtgtaa

SEQ ID NO: 602 - DNA (genomic), 237 bp, Streptococcus pneumoniae; double-stranded, circular
  misc_feature (B) LOCATION 1...237
  hypothetical: NO
  anti-sense: NO
tggaggaaatatatcatgattttaatgacaaaaaatataaatctaacaaatgaagaattagagctgatacaaggtggagcagatccatatggtaaaaatcctaatggtaggtacgattgggaaatagaaccagtattaactctgccggttcatggattttgtcccagaggcacctatgatttaggatatattggaggaggcaatcatctttgcaaaggaagtgctgcgagattttaa

SEQ ID NO: 603 - DNA (genomic), 192 bp, Streptococcus pneumoniae; double-stranded, circular
  misc_feature (B) LOCATION 1...192
  hypothetical: NO
  anti-sense: NO
cagtcagaatactacgttcgtttccgcgtactccatgccccgaccaaaatttgggttgctagcttgaggggtttaccgcgttccactctctctgtttccagaaagactccgtcactgtggcactttcaagcctactctggcctatccaaggacttagccatttcaactgccgtaacgattcctcgtccctag

SEQ ID NO: 604 - DNA (genomic), 372 bp, Streptococcus pneumoniae; double-stranded, circular
  misc_feature (B) LOCATION 1...372
  hypothetical: NO
  anti-sense: NO
attatggaatacaaattatttgaagaatttattaccctccaagcactactcaaagaacttggaattacacatagcggaggagctattaaatcatttctctctgaacattctgtttactttaatagggaattagagagtcgtcgtggaaaaaaacttcgtattggcgataaagttgacatccctgacatgaacattgacatcttgttgacacaacctacttctgaagaacaagatgaataccaagctgataaagttgaaaaagaacggatcgctaaacttgtcaaaaagatgaataagggagttaaaaaagacaaatcgaaacctgcttcatcacctaaaagccaacaagctccacgattccctggtagataa

SEQ ID NO: 605 - DNA (genomic), 1995 bp, Streptococcus pneumoniae; double-stranded, circular
  misc_feature (B) LOCATION 1...1995
  hypothetical: NO
  anti-sense: NO
ctttgtcgatacctacgaagaatacacggtcgcaccagttatccagacctgcacctatcacgcagatgccaatctctacggtgcccttgtcaactggctacaggaggaaaagcaatggtaagatttacaggacttagtcccaaacaaacgcaagctattgaggttttaaaaggtcatatttctctaccagatgtggaagtggctgtcactcagtctgaccaagcctctatctctatcgagggtgaggaaggtcactatcaattgacctaccgcaaacctcaccaactttatcgtgccttgtccttgttggtaacagttctagcagaagctgataaagtagagattgaggaacaagcagcttacgaagatttggcttacatggttgactgttctcgaaatgcggtgctgaatgtggcttctgccaagcagatgattgagatcttggctctcatgggctactcaacctttgagctttacatggaagacacttaccagattgaagggcagccttactttggctatttccgtggagcttattcagcagaggagttgcaggaaatcgaagcctatgttcaacagtttgacatgacctttgtaccatgcatccagaccttggcccacttgtcggcctttgtcaaatggggtgtcaaggaagtgcaggagctccgtgatgtagaggacattcttctcattggcgaagaaaaggtttatgacctgattgatggtatgtttgccacgttgtctaaactgaagactcgcaaggtcaatatcgggatggacgaagcccacttggttggtttgggacgctacctgattttgaacggtgttgtggatcgtagtctcctcatgtgccaacatttggagcgcgtgctggatattgctgacaaatatggtttccactgccagatgtggagtgatatgttcttcaaactcatgtcagcggatggccagtacgaccgtgatgtggaaattccagaggaaactcgtgtctacctagaccgtctcaaagaccgtgtgactctggtttactgggattattatcgggatagcgaggaaaaatacaaccgtaatttccgcaatcatcacaagattagccatgaccttgcatttgcagggggagcttggaagtggattggctttacacctcacaaccattttagccgtctagtggctatcgaggctaataaagcctgccgtgccaatcagattaaagaagtcatcgtaacgggttggggagacaatggtggtgaaactgcccagttctctatcctatcaagcttgcaaatctgggcagaactcagctatcgcaatgacctagatagtttgtctgcgcacttcaagaccaatactggtctaacggttgaggattttatgcagattgaccttgccaacctcttaccagacctaccaggcaatctcagcggtatcaatcccaaccgctatgttttttatcaggatgttctttgtccgatacttgaccgacacatgacacctgaacaggacaaaccgcacttcgctcaggctgctgagacgcttgctaacattaaagaaaaagctggaaactatgcttatctctttgaaactcaggcccagttgaatgctattttaagtagcaaagtagatgtgggacgacgcattcgtcaggcctaccaagaggatgataaagaaagtttacaacaaatcgccagacaagaattaccagaacttagaagccaaattgaagacttccatgccctctttagtcaccaatggctgaaagaaaacaaggtctttggtttggatacagttgacatccgtatgggcggactcttgcaacgcatcaaacgagcagaaagccgtatcgaggtttatctggctggccagcttgaccgcatcgacgagctggaagttgaaatcctaccatttactgacttctacgcagacaaggatttcgcagcaactacagctaaccagtggcataccattgcgacagcttcgacgatttatacgacttaa

SEQ ID NO: 606 - DNA (genomic), 294 bp, Streptococcus pneumoniae; double-stranded, circular
  misc_feature (B) LOCATION 1...294
  hypothetical: NO
  anti-sense: NO
ggttgtagatacgactcacatatatacgacaaggcaacgctgacgtggtttgaagaaatttttgaagagtatcattctccatcaaaggcatctttaatatggtcaaagaagccttttttctttggatttactttcaagccaccagcagccgcgaattctttcaaggctactttttggcggtcgttcaagcctgtcggtgttacgacattaacagtaacgtattggtcaccaactgcaccgccacgaaggctcggtgcccccttactacgtaggcggaatttcttaccagtctga

SEQ ID NO: 607 - DNA (genomic), 1698 bp, Streptococcus pneumoniae; double-stranded, circular
  misc_feature (B) LOCATION 1...1698
  hypothetical: NO
  anti-sense: NO
agaaggagatatataacgatgaagaaaattaaaccgcatggaccgttaccaagtcagactcagctagcttatctgggagatgaactagcagcttttatccacttcggtcctaataccttttatgaccaagaatgggggactggacaggaggatcctgagcgctttaacccgagtcagttggatgcgcgtgagtgggttcgtgtgctcaaggaaacgggcttcaaaaagttgattttggtggtcaagcaccacgatggctttgtcctttatccgacagctcacacagattattcggttaaggtcagtccttggaggagaggaaagggcgacttgctccttgaagtatcccaagctgccacagagtttgatatggatatgggggtctacctgtcaccgtgggatgcccatagtcccctctatcatgtggaccgagaagcggactacaatgcctattatctggctcagttgaaggaaatcttatcaaatcctaactatgggaatgctggtaagttcgctgaggtttggatggatggtgccagaggagagggcgcgcaaaaggttaattatgaatttgaaaaatggtttgaaaccattcgtgacctgcagggcgcttgcttgattttttcaacagaaggcaccagtatccgctggattggcaatgaacgagggtatgcaggtgatccactgtggcaaaaggtgaatcctgataaactaggaacagaagcagagctgaactatcttcagcacggggatccctcgggcacgattttttcaatcggagaggcagatgtttccatccgtccaggctggttctaccatgaggatcaggatcctaagtctctcgaggagttggtcgaaatctactttcactcagtagggcgaggaactccactcttgcttaatattccgccgaatcaagctgggctctttgatgcaaaggatattgaacgactttatgaatttgcgacctatcgcaatgagctctataaagaagatttggctctgggagctgaggtatctggtccagctctttccgcagactttgcttgtcgccatttgacagacggccttgagaccagctcttgggcaaacgatgcagccttgcccatccagttagaactcgacttaggttctcctaaaacttttgatgtaattgagttaagagaagatttgaagctagggcaacgaatcgctgcttttcatgtgcaagtagaggtggatggtgtctggcaggagtttggttcgggtcatactgttggttacaaacgtctcttacgaggagcagttgttgaagcacagaagatacgtgtagtcattacagaatcacaggttttgcctttgttgaccaagatttcactctataaaactccgaggttatcacaaacagtagctgttcaggggctagcatttgcagaaaaaagcctagctgtggcaaagggagagactcttcattttaggattgaacgtagtgaaagtagctcctctttagaggctaagatttcgattcaaccggggacaggtgtccatggtgtcgcctatcaggatgagattcaagtccttcaattccaagcaggggaaagcaaaaaagatttgcatctaccaaccctgtatttcgcaggagataaaaccttggatttctatctgaacctaacggtggatggtcagcttgtggatcaacttcaagtccaagtttcataa

SEQ ID NO: 608 - DNA (genomic), 471 bp, Streptococcus pneumoniae; double-stranded, circular
  misc_feature (B) LOCATION 1...471
  hypothetical: NO
  anti-sense: NO
ggtgttactctaatggatgatattttacaagctttagcaaaaatgctaaatatgactgttgatgaagtaagttctttgcttacaacatttaaagggaatgcaccacagatttatgaaatgttcgttaaagaaaagatgttttatgatctcttcagtctttttcaaatcatgtcaattgtaatatttagtatttctgcagtagttttagcagttttaactctcatatattttacatacgatggtggttttgtttattcctatgatatacgtacaggaaaaaccgaggaagaaattaaattagaacgcattgaacggaaaagaaaggacttaaaaataccactaaaaattagttgcatttcatcaagcgcaagtttgataacattagttattgcaattgttttaaaagcaactcttgcacctaattatatattcatcgtgaatgagattttaccaaaattaacgaagagatag

SEQ ID NO: 609 - DNA (genomic), 294 bp, Streptococcus pneumoniae; double-stranded, circular
  misc_feature (B) LOCATION 1...294
  hypothetical: NO
  anti-sense: NO
ataactactctattattaaatagtttagagctgactgttgtatcgatagttgttttgctagctttacgtagcgtaatagcagaactaattctatctaaaaaactggatgtttcggttaagaaagatattgtattagaatttcttttgacgattgtctttatttcttcaagttggtacttaccgatttggcccgcagtaatagtttatttgttagcgtatactttatacttgtatctaaagcgtaaagatataaaaatgtatatagaatattttagaaagaaaatatttgaataa

SEQ ID NO: 610 - DNA (genomic), 183 bp, Streptococcus pneumoniae; double-stranded, circular
  misc_feature (B) LOCATION 1...183
  hypothetical: NO
  anti-sense: NO
attaatactcttcgaaaatctcttcaaaccgtgtcagttttatctgcaacctcaaagcggtgctttgagcaacctgtggctagcttcctagtttgttctttgattttcattgagtataaacttagcaaggagacctctttttcagaaaagcagggttctttttgctgtctattccatccctga

SEQ ID NO: 611 - DNA (genomic), 216 bp, Streptococcus pneumoniae; double-stranded, circular
  misc_feature (B) LOCATION 1...216
  hypothetical: NO
  anti-sense: NO
actaatactcttcgaaaatctcttcaaaccacgtcagcgtcgccttgccgtatatctgcaacctcaaaacagtgttttgagctgacttcgtcagtcttatctactacctcaaaacggtgttttgagcaacctgtggctagtttcctagtttgctctttgattttcattgagtataaagagcttggcaacaggctctttttgtattgcgtttattaa

SEQ ID NO: 612 - DNA (genomic), 1284 bp, Streptococcus pneumoniae; double-stranded, circular
  misc_feature (B) LOCATION 1...1284
  hypothetical: NO
  anti-sense: NO
tggataactctccaaaatcagaaatatctaaggaactattatatcaaaatggattttagcagaaaggataatcagtcaatggaatatcgaaaaatacaagaagcattagaagcattgcagaagggacgacttgttcttgttatagacgacaaggatagagaaaatgaaggagacttaatttgttctgcacaagcagctacaacagaaaatgttaattttatggctacttatgccaaaggattaatttgtatgcctatgagcgaaagtttagctaatcaattaatgctttcacctatggttgaaaacaatacagataatcataagactgcttttacagtttcaattgattataaagaaacgaccacaggtatttctgccgaggaaagaggactgaccgcacgtatgtgtgtagctgaagatataacaccctctgattttcgcaggccaggacacatgtttcctttaattgcaaaaaaaggtggtgtcctagaaagaaatggacacacagaagcaactgttgatttattaaaattagctggactaaaagagtgtggcctatgttgtgaaataatgaatcatgatggcaaaatgatgagaacagatgatttaattcagttctcgaagaaacacaacattccactaattaccatcaaagaattacaagaatatagaaaagtatatgatcagctgatagaacgagtttcaactgtcaatatgcctactagatacggtaatttcaaagcaattagctatatagataaactaaatggggaacatcatcttgctcttattatgggaaatatagaggatgaagccaatgtattatgtcgggtccactccgaatgtttaacaggagatgttttaggctctttacgttgcgattgtggacagcaattcgataaagctatgaaaatgattgttgagaatggttcgggtgtcttactttacttgcgacaggagggacgaggaattggacttatcaataaattaaaagcctatcatttacaagatcaaggcatggatacgcttgatgccaatcttgcattaggctttgaaggtgatttaagagaatatcatattggagcacaaatgcttaaagatctgggacttcagtcacttcatttactgacaaataatcctgacaaggttgaacagttagaaaaatatggaattaccatttccagtagaatatcaatcgaaatagaagccaatccttacgatagtttttatttagaaacaaagaaaaatcgaatggggcacattttaaatatggaggaaaaataa

SEQ ID NO: 613 - DNA (genomic), 3654 bp, Streptococcus pneumoniae; double-stranded, circular
  misc_feature (B) LOCATION 1...3654
  hypothetical: NO
  anti-sense: NO
atggcaactcttgatgaattgaaagtcatgattgacgctgagatagcgcctttcaggaagaagatgaaagaagtcgagaatcaggtcaaaggaacatctgaccaagtgaaaaatgctactgccaaagttcgtgaacagtcgagctcaatcggtagtgcgtttggcaagctggctaagttcgctggttttgcaatccttggtaagaaattacttgatgttgggatgtattcaacgcagacggctcttgaagtatcagcgtctatgaaccaaatcaagcgacagatgggcgagagttcgcaatctttcttaaaatgggttaacgataatgccaacgctatgaatatgggtgtgggtgaggctaccaactacggtgcagtctactcaaacttattttctggatttatcaaagataccaacaagctaagcgcctataccgctaagatgttgcagacatcggcagttgttgctgaaggttcagggcgcacgattacagacgttatggagcggattcgctcaggtttactagggaacaccgaagcgattgaggacctaggaatcaacgtcaacgtggctatgattgagtccactgaagcctttaagaagttcgcaaacggacagagctggcaacagttggattaccaaacccagcaacaaatccgccttatggctattctggaacaggctacagccaagtatggggataccttgtctaattctgtaaatggtcgtatcagcctatttaagtcgctgatgaaggacgcagcattgaaccttggtaactctatgttaccgattatcaatgccattatgcctgtcttgaactcttttgctatggtcttaaagaacgttactgctaaactcgctgagtttatcgctttgatgttcaacaagaaagcaacagtgaaagatggtgttggtggagcagttggagacatgggtaacgccatgaaggatgctgcaggcggagcaggagaccttgctgacgcagtagacgacgctggagattcagcaggaggacttgctgacaatcttggagactccgccaaaaacgctaagaaggccgctaaagagttgctaggtcttttgggatttgatgagattaacatcttgcaaaaaccaaaagatgacgacgcaggcgggtctggaggcggtggcaaaggtggtaaaggaaagggaggcggtggcggacctttcaaagacatcttgccagaagtcgagttgaccgacatggacaacaaattcaagagcatttttgatggtcttggagataagctcaaagggttgtttgacctcttcaagaaaggttttgatgcagcatttagaccagaaggtatagaacgcattaagactgccttagaccaaatagctaagacaatgggagaaatcgccactgacccaagggttgtgaatgcctttaaccgaatggctgagaaaattgcttatgctttagggcaagtgacaggctcaataacaactatcgggctaggtatcggtgttttccttgccgaaagtattgcaaatggccttggaaggcaaaaagaacgcattaccagggcgctagtcgctttgtttgataatattggtaacatttccgaggcagtaggaaacatcgctcaggacttttctagtactttctacgacgtcattacctcaactggtgcggttcgtatcggtagcgctattgtgtcaactctgttgagtttgacatctaccattgttgaagttggtagtaaattagcaggaagtttgtttaaaggttttgaaaaagtcgttgtgacaagcgctcctaaaatttcatcagtcttccaaagtttattagatactgttgcgcctgtatttgagagcattgaaaggtctgttaacaaatttggcgatggcttaagtcgtgtttatgatgaacatgtagcccctgctattaactctattgctaatgcttttaacggactgattgatatcatacaaatcctctgggagaattcttggcaaccttttgctgagtttttatcaggagtattcggtgttagtattgaaggaatttcagatttattaggaggtggccttttagccactttgggactattggcggatgctattaagttagtggcagatggtttcaccgttttttctgactggtgtaaagaaaacaaagaacctatcttggctttgataacaacttggcaaacgattaatttcttatcatgggctgaacaagccgggggacttgcaggagcattcagcttgttaggtagtaaggtctctttgattgttggagggattaagaatctaggtcttgctattaaagcattgacatttgataagttggtcagttttggtgaaacaatctatttgaacaccttatatgcaaaagattttgtggtcaattcaggtaaaacaattgcacagctaggaaaaactgctttagaacttggtaaatcagctctagcatggactgctcatgcagcgaaaatgggattagcaaccgcggcggaatttgcacattctgttgcagcaggagtcgctacagctgcaacatgggcttttaatgcagcgttagcagttttgacaagtccaataacatggattattgcagcaatcgcagctttgattgctatcggtgtcttgctctaccaaaactgggacactgttgttgagtttgctaaaactgcatggcaaggactatgtgattttattagtggtatttgtcgagctattggcgaatttttcagtggtctatggacaaaactacaagaaatctttgagccgataggtcaatggtttggcgagaagttccagcaagcatgggatgccattgtcaacatcttctctggtatcggagagtggttctctggtgtattccaaggtgcatgggacgctatcgttaatatcttcactccaatcggctcatggtttggacaacgttgggcagatgtgactagtgctttggctaatatcggggcatggtttactgacatattccaaaaagcatggactggtctaacaaacatctttagcaaactaggtttatggtttggcgagagatgggcagatgttacaagtgttcttgcgaatgtatcttcttggtttgggaatatgtttactagtgcttataatgcagtcaagaacgcgtttagttcaattggtggcttcttcagcggtgtatggtcaacggttcaaagcatatttgtcaatgctggacaaaaggttggtagcgctgtaggtggagcgtttaagagtgcggtcaatgcggttcttggaacgattgaaaatgtagtcaatgacttcatcggaatgattaatggagttttaggcgttgtcagaaacttacctggtctaggatgggttggtagtgtaagcacagttagcctccctcgtcttgcccgtggtggtatcgtcgatagtccaacaatcgccatgattggtgaagctggtaaagaggcggtcgtaccacttgaaaatacaggatttatccaaacacttggacgagtagtcagcagtgcggtagtaaatgccatggctggtattagtccacaaggtggtttttctagcgacggcgacatcgttattcaaatcgcaggccatgagttcggacgggtagctatccaagaaatcaacaaggaacatgaacgagcaggtcaaaccttgctcaagatttag

SEQ ID NO: 614 - DNA (genomic), 1461 bp, Streptococcus pneumoniae; double-stranded, circular
  misc_feature (B) LOCATION 1...1461
  hypothetical: NO
  anti-sense: NO
aatattttgtatggcgataaagggtgtgtggaaaattctctagaaaatcttcatgcaattgggaatggatttaagttgtcttatcttcatgagattgatgcctgcaaggttcctgactgggtttcaaatacggtatggtatcagatatttcctgaaagatttgccaatggcaatgctctattaaacccagaagggactttagactgggattcatctgtcacacctaagagcgatgatttctttggtggtgatttacaggggattattgatcatatggattacttgcacgacttgggtattactggactatatctttgtcccatctttgaatctacaagcaatcacaagtacaatacgacagattactttgaaattgaccgtcattttggagacaaggagacctttcgggaactggtggatcaagcgcatcatcgtggcatgaaagtcatgctggatgcggtatttaatcatattggttcgcaatctcttcaatggaaaaatgtcgtcaaaaatggtgaacagtctgcttataaggattggttccatattcaacaattcccagtgacaactgaaaagctagttaataagagagacttaccctatcatgtttttggtttcgaggactatatgcctaagctaaatacagccaatccagaggtcaagaattatcttttaaaggttgcgacttattggattgaagagtttaatatcgatgcttggcgtttggatgtggctaatgagattgaccatcagttctggaaggattttcgtaaggcagttttagctaaaaatcctgatctttatatcctaggagaagtctggcatacatctcagccttggctaaatggagatgagttccatgccgtcatgaattatcctttatctgatagtatcaaggactatttcttacgaggaattaagaagacagaccagttcatcgatgaaatcaatggagagtctatgtattacaagcagcagatttcagaggtcatgtttaatctcttggattcacatgatacagagcgaatcctgtggacggccaatgaagatgttcaactggttaaatcagccttagcctttctctttttacaaaaaggaacaccgtgcatttattacggaaccgagctagccttgactggaggaccagatccagattgtcgtcgttgtatgccttgggaacgtgtatcaagtgacaatgatatgctgaactttatgaagaggctgattaagattcggaaatacgcgtcagtaatcatttcgcatggcaagtatagccttcaagaaatcaaatctgatctagtagctctggaatggaaatacgaaggacggatcctcaaagcaatattcaaccaatcaacagaagattatcttttagagaaagaagcagtagcactagcaagcaattgccaagaattggagaatcagcttgtcatctctccagatggatttgtgattttctaa

SEQ ID NO: 615 - DNA (genomic), 1257 bp, Streptococcus pneumoniae; double-stranded, circular
  misc_feature (B) LOCATION 1...1257
  hypothetical: NO
  anti-sense: NO
atagtattgtatgaaagtataaggttagtatatatgaaacgttctctcgactcaagagtcgattacagtttgctcttgccagtattttttctactggtcatcggtgtggtggctatctatatagccgttagtcatgattaccccaataatattctgcccattttagggcagcaggtcgcctggattgccttggggcttgtgattggttttgtggtcatgctctttaatacagaatttctttggaaggtgaccccctttctatatattttaggcttgggacttatgatcttgccgattgtattttataatccaagcttagttgcatcaacgggtgccaaaaactgggtatcaataaatggaattaccctattccaaccgtcagaatttatgaagatatcctatatcctcatgttggctcgtgtcattgtccaatttacaaagaaacataaggaatggagacgcacggttccgctggactttttgttaattttctggatgattctctttaccattccagtcctagttcttttagcacttcaaagtgacttggggacggctttggtttttgtagccattttctcaggaatcgttttattatcaggggtttcttggaaaattattatcccagtatttgtgactgctgtaacaggagttgctggtttcttagctatctttattagcaaggacggacgagcttttcttcaccagattggaatgccgacctaccaaatcaatcggattttggcttggctcaatccctttgagtttgcccaaacaacgacttaccagcaggctcaagggcagattgccattgggagtggtggcttatttggtcagggatttaatgcttcgaatctgcttatcccagttcgagagtcagatatgatttttacggttattgcagaagattttggctttattggctctgtcctggttattgccctctatctcatgttgatttaccgtatgttgaagattactcttaaatcaaataaccagttctacacttatatttccacaggtttgattatgatgttgctcttccacatctttgagaatatcggtgctgtgactggactacttcctttgacggggattcccttgcctttcatttcgcaagggggatcagctattatcagtaatctgattggtgttggtttgcttttatcgatgagttaccagactaatctagctgaagaaaagagcggaaaagttccattcaaacggaaaaaggttgtattaaaacaaattaaataa

SEQ ID NO: 616 - DNA (genomic), 576 bp, Streptococcus pneumoniae; double-stranded, circular
  misc_feature (B) LOCATION 1...576
  hypothetical: NO
  anti-sense: NO
aacgcattgtatcaagtgttaggggctgatatcatgcgtttttctgcttttaagattttttccaactctgtttgtaagcgcatcataacaaagggtctaggattcagggctctcctcctatatactattagtaaagtaaaactaagagaggatattttagtgtcgcagtctattgttcctgtagagattccacaatattgtcgttttgattctaaaaagagaaatggaattctgtttaacgttcgtattgccaatcttaaatttaccttttttagattagacttcctgcgaaataaaatatggtatagtagttctatgaatgatgaagcaagtaaacaactaactgatgcacgatttaagcgtcttgttggtgttcagcgcacgacttttgaagagatgttagctgtattaaaaacagcttatcaacttaaacacgcaaaaggtggacgaaaacctaaattaagcctagaagaccttcttatggccactcttcaatatgtgcgagaatatcgaacttatgaagaaattgcggctgtttttggtatccacgaaagcaacttaatccgtcggagctaa

SEQ ID NO: 617 - DNA (genomic), 372 bp, Streptococcus pneumoniae; double-stranded, circular
  misc_feature (B) LOCATION 1...372
  hypothetical: NO
  anti-sense: NO
atgaatatgtatcgtgttatagaaatgtacggagattttgaaccgtggtggttcttagaaggttgggaagaagatattgtagcaagtagaaaatttgaccagtattatgatgctctcaaatactacaaaacttgctggtttagattggaacaagaatcgcctctttataaaagtagaagcgacttgatgaccattttttgggacccggaagaccaacgctggtgtgatgaatgtgatgagtatttacaacaataccattctttggctcttttgcaggatgagcaggttatcccagacgaaaaactacgctcaggctatgaaaaacaaaccagtcaggaaaggaatcgttcttgccgtatgaaattaaaatag

SEQ ID NO: 618 - DNA (genomic), 360 bp, Streptococcus pneumoniae; double-stranded, circular
  misc_feature (B) LOCATION 1...360
  hypothetical: NO
  anti-sense: NO
gaaatggtgtatcaagtattctcggttctattttcttcggagcgagcatacagtttctcatctcccgtcgcattgcaaaaactaagaaaaatcaagatgaggattaggaggaaactcatgaaaaaagaaaagaaacagttacgttatcctggtctgaaagcaggttcgatttatggaacagtgatattttttataattccactcattgataccctaacaagtgaaaatccaaattttatcagttctcttctaaatacaaaacatatttttaaaactatgctgggagctttctttttcggagtgatgatacatattgtcgactcacttcgtattgcaagagctaaaaaagaccaggattag

SEQ ID NO: 619 - DNA (genomic), 765 bp, Streptococcus pneumoniae; double-stranded, circular
  misc_feature (B) LOCATION 1...765
  hypothetical: NO
  anti-sense: NO
cagaacgatttattttggagtaggatcatgggcttaacttatcaaatgaaaatgaaaattccttttgatatggctgatatgaacggtcatatcaaacttccagatgtgattttgctgtcactgcaagtttcagggatgcagtcgattgaactgggagttagtgataaggccattttggaagaatataatctggtctggattatcgtagaatatgatattgaggtgtttcgtttgcctcgttttgcggaagaaattaccatcgaaacggaagccttgagctacaatcgacttttttgctaccgtcgctttactatttataatgaagcggagcaggagctcatccacatgatggcgacctttgttctcatggaccgcgacagtcgaaaagtccatgttgttgaacctgagattgtggctccttaccagtctgattttgataaaaaacttatccgtggaccgaagtatgagtccttggaagaaccgatcagcaaggattaccatgttcgtttttacgacttggatatgaatggtcatgtcaataacagtaaatacttggactggatttttgaggtcatgggagcggattttttgacccactatattcccaagaaaatcaacctcaagtatgtcaaggaagttcgaccaggtggggtgattacatcggctgttgaacggactggactggaaagcaagcatgaaattacaagtgatggggttatcaatgcccaagcaatcattacttggcaagaaataaaaaaggcttag

SEQ ID NO: 620 - DNA (genomic), 537 bp, Streptococcus pneumoniae; double-stranded, circular
  misc_feature (B) LOCATION 1...537
  hypothetical: NO
  anti-sense: NO
gagaacgatttggtgactaaagtagaaacggctagaagtttagctctagcagtgctagaggatgtttttgtgaatcaagcatattcaaatattgccttaaataaacacctcaaggggagtcagctctctgcagcagacaagggcttagtgaccgagctagtctatggaacggtagcccgtaaactgactctggaatggtacttatcccactttatcgaagacagagaccagttagacagctggctctatgtccttcttctcatgagtgcctaccaactccgctatttggacaagattccagatcatgctgtggtcaatgaagcagtggaattggccaaactccgtaaaaaaggcagtgaaaaattggtcaacgctgtccttcgccgtatcttgcgtgaaggctggccagatattgctagcatcaagcgaaaaaacaagcgtgactccattgcctattctctcccagtttggctagttaccaaactcaaggaagaatacggagaggagagagcaaaagccatctttgaaagcctgtag

SEQ ID NO: 621 - DNA (genomic), 429 bp, Streptococcus pneumoniae; double-stranded, circular
  misc_feature (B) LOCATION 1...429
  hypothetical: NO
  anti-sense: NO
gacctatcgtacaaaagcagactgccagcatacggctatgattggttcctcactaggaggcaatatacccagtttatcggtttggaataccaagaccaaattggttgcttgggcgttttttcatctgcaaactggctccaccaagaagcctttaaccgctatatcgagtgccagaaactatcgcctgaccagcgcatcttcatctatgtaggaacagaagaagcagatgatacagacaagaccttgatggatggcaatatcaaacaagcctatatcgactcgtcgctttgctattaccatgatttgatagcagggggagtacatctggataatcttgtgctaaaagttcagtctggtgccatccatagtgaaatcccttggtcagaaaatctaccagattgtctgagattttttgcagaaaaatggtaa

SEQ ID NO: 622 - DNA (genomic), 696 bp, Streptococcus pneumoniae; double-stranded, circular
  misc_feature (B) LOCATION 1...696
  hypothetical: NO
  anti-sense: NO
tttagcgattttactatgtgccatcttatcgcctctatcggattaaatatggattcgactcccgtgattattggagccatgttaatctctcctttgatgacacctattctgggagtggggctctctctagctatatttgattttaaattgttaagaaaatcttttaaaatattagctattcaaattcttgccagtctaatagcttcaacactttatttttatctttctcccatttcgtatgctagttcggagattgttgctagaacctctccgactatttgggatgttctcattgcttttgtaggagggatagcaggtattattggtgctaggaaaaaagagaccaataatattgttcctggtgttgctattgcaaccgccttgatgcctcctctttgtacagtaggttatgctattgcttctgctaatctaaaatttatcataggctcctcttacctatttctcatcaattgtagctttattgtcattgcgacttatataggtgttaggttgatgatggttaagaaacattattttaaagataatgaagaagactctaaaatgcgtaggattttgcttctagttgctgttttgctgatgattccgagtttcatctctgcaacgactttagtgagagaaacgttgaaaaaagagtcccttaagaaatttatatcagagcaagtttcaggggcataa

SEQ ID NO: 623 - DNA (genomic), 333 bp, Streptococcus pneumoniae; double-stranded, circular
  misc_feature (B) LOCATION 1...333
  hypothetical: NO
  anti-sense: NO
gcgttccagtatttgacaatattatacttcctgcgaaacaaaatatggtatagtagttctatgaatgatgaagcaagtaaacaactaactgatgcacgatttaagcgtcttgttggtgttcagcgtaccacttttgaagagatgttagctgtattaaaaacagcttatcaacttaaacacgcaaaaggtggacgaaaacctaaattaagcctagaagaccttcttatggccactcttcatatgtgcgagaatatcgaacttatgaacaaattgcggctgattttggtattcacgaaagcaactttatccgtcggagccaatgggttgaagtaa

SEQ ID NO: 624 - DNA (genomic), 1638 bp, Streptococcus pneumoniae; double-stranded, circular
  misc_feature (B) LOCATION 1...1638
  hypothetical: NO
  anti-sense: NO
aaagaaaagtataaactaagccctatagggtggcttcgcaccacctttagaaagaagaataacgtgaaatttaatgaattaaacttgtctgctgatttgctagcagaaattgaaaaagctggttttgtagaagctagtcctatccaagaacaaactattcctttggcccttgaaggcaaggatgttattggtcaagctcagactggtacaggaaaaactgcagcctttggcttgcctacccttgaaaaaatccgtacagaagaagcgactatccaagctttggtcatcgctccaactcgtgaactagctgtccaaagtcaagaagaactcttccgctttggtcgtagtaagggagtcaaagtccgttcagtatatggcggatcaagcattgaaaaacaaattaaggctcttaaatctggtgcccatatcgtggtgggaactccaggtcgcctcttggacttgattaaacgcaaggccttgaaattacaagacattgaaacccttatccttgacgaagcggatgaaatgcttaacatgggcttccttgaagacatcgaagccattatttcccgtgtacctgagaaccgtcaaactttgcttttctcagcaactatgccagatgccatcaaacgtatcggtgttcagtttatgaaagcccctgaacatgtcaagattgcggctaaggaattgacaacagaattggttgaccagtactatatccgtgttaaggaacaagaaaaatttgacaccatgactcgtctcatggatgtggcacaaccagaactcgctattgtatttggtcgtaccaaacgccgtgtggatgaattgactcgtggtttgaaaattcgtggcttccgtgcagaaggaattcatggcgacctagaccaaaataaacgtcttcgtgtccttcgtgactttaaaaatggcaatcttgatgttttggttgcgacagacgttgcagcgcgtggtttggatatttcaggtgtgacccatgtctacaactacgatattccacaagatcctgagagttatgttcaccgtatcggtcgtacaggtcgtgctggtaagtcaggtcaatctattacttttgttgctccaaacgaaatgggttaccttcaaatcattgaaaacttgactaagaaacgcatgaaaggtctcaaacctgcaagtgtagaagaatccttccaatcaaaaaaacaggtagctctcaagaaaatcgaacgtgattttgcagatgaaaccattcgtgccaactttgagaaatttggtaaggatgctcgcaaattggctgctgagtttactccagaagaattggcaatgtatatcttgagtctgacagtccaagacccagatagccttccagaagtggagattgcacgtgaaaaaccactaccgtttaaaccatcaggtaatggtttcggtggtaaagctaagggaggtcgtggaggccgtcgtggggacgaccgtcgagagcgtgatcgccgtggcaatggtcgccgtgatgagttcaaaaaaggaagtcgtggcaacgatcgttttgataaggaaaaacgttaccgtaaggataataaaaaaccacgcaatactttaagcgaaaagcaaacaggctttgttattcgtaacaagggcgataaataa

SEQ ID NO: 625 - DNA (genomic), 843 bp, Streptococcus pneumoniae; double-stranded, circular
  misc_feature (B) LOCATION 1...843
  hypothetical: NO
  anti-sense: NO
tacaggaagtatgacagtcgtagaattataaatacttcatttagaaagaaagtgtatgaagaaaagcagtattttatttttattttattgctatgtattggtttacagtatgaaaccatctactatacggacggttcgaggtcaggtgcggaatatggactaatgggagtttctatctttctagctctcttttacatgattccggctctttattttctcttccgtattgggaaaaaatgggaattgccaaagaaggttttgattctgtctttattgggagggatgttccttgcaggctggttgtctagttttgctaatacttatatccatgatttactgggggttcttttcccagatagtccatttttaaatgcctttgaaagtgctattgtggctcctttggtagaagaacccttgaaattattgccacttgtttttgttttggctttgattcctgtgcgaaaattaaaatttttgtttttacttggaattgcttccggtttgggattccaaatgattgaggatattggttatattcgtacggatttgccagagggctttgactttactatttcgcgaattttagagcgtatcatctcaggaattgcctctcactggactttttcaggtctagctgtagtaggtgtttacttgctttacagagcctataaaggacagaaggttggcaagaaacagggtcttatttttctaggtttagccttgggaactcacttcttgtttaactctcccttttgtggagttggaaacagagttgcctttagcgattccagtggttacggctattgctctctatggtttttatcatgcttattgctttgttga

SEQ ID NO: 626 - DNA (genomic), 876 bp, Streptococcus pneumoniae; double-stranded, circular
  misc_feature (B) LOCATION 1...876
  hypothetical: NO
  anti-sense: NO
atgaaggagtatgacatgaaaaagtggtggaaagagctgatagacaagcctttattaaaagcttttttgcattattatcaagcatcagatagtgagttgaccagtgtcgcagtagcctactattggttgatttcgattttccccctgcttttggtggtggtcaatatcctcccctattttcagattcctgtgggagaatttttgggctttatgaaagacgttctgcccccaagcctctatgaaggtgtggaaaaaatagccagagaagttttgacgcaaccttcaacaggtttattgagtttttctgttttatcggcgttatggagtttttcaaaatctatgaatttcttgcaaaaagcttttaacaaggcttatggcgtcgaaaagagtcgtggacttatttcccatcagatgctaagtctcctagtcagttttggcttgcagatcctctttgcgtttgccttgtttttgatcttatttggtcagatgattttggctttacttgctcattattggacaaaagatggcattatctatcaggctttacaagggttggcaggtcctctgatttacgccctcctctttgctatcttggtcatgctttattattttcttcccaatctatctaacaggaaaattagctataccctaccaggcagtgcctttgttctcttagtgattttaggtttactaactctgttctctagttatctcaattactatgtccatcatttggtggatgtccgaattttaggttccgttcttcttgttgttatgatgttttggtttatcttgattgctaaaattgttatcctaggcgcggttatcaatgccagtatgcagagtttgaaagatccggtctttaaaaaagactaa

SEQ ID NO: 627 - DNA (genomic), 1200 bp, Streptococcus pneumoniae; double-stranded, circular
  misc_feature (B) LOCATION 1...1200
  hypothetical: NO
  anti-sense: NO
aagaaggagtatctacgtaatatgaagaaaaaaatcttagcgtcacttttattaagtacagtaatggtttctcaagtagctgttttaacaactgcgcatgcagaaacgactgatgacaaaattgctgctcaagataataaaattagtaacttaacagcacaacaacaagaagcccaaaaacaagttgaccaaattcaggagcaagtatcagctattcaagctgagcagtctaacttgcaagctgaaaatgatagattacaagcagaatctaagaaactcgagggtgagattacagaactttctaaaaacattgtttctcgtaaccaatcgttggaaaaacaagctcgtagtgctcaaacaaatggagccgtaactagctatatcaataccattgtaaactcaaaatcaattacagaagctatttcacgtgttgctgcaatgagtgaaatcgtatctgcaaacaacaaaatgttagaacaacaaaaggcagataaaaaagctatttctgaaaaacaagtagcaaataatgatgctatcaatactgtaattgctaatcaacaaaaattggctgatgatgctcaagcattgactacgaaacaggcagaactaaaagctgctgaattaagtcttgctgctgagaaagcgacagctgaaggggaaaaagcaagtctattagagcaaaaagcagcagctgaggcagaggctcgtgcagctgcggtagcagaagcagcttataaagaaaaacgagctagccaacaacaatcagtacttgcttcagcaaacactaacttaacagctcaagtgcaagcagtatctgaatctgcagcagcacctgtccgtgcaaaagttcgtccaacatacagtacaaacgcttcaagttatccaattggagaatgtacatggggagtaaaaacattggcaccttgggctggagactactggggtaatggagcacagtgggctacaagtgcagcagcagcaggtttccgtacaggttcaacacctcaagttggagcaattgcatgttggaatgatggtggatatggtcacgtagcggttgttacagctgttgaatcaacaacacgtatccaagtatcagaatcaaattatgcaggtaatcgtacaattggaaatcaccgtggatggttcaatccaacaacaacttctgaaggttttgttacatatatttatgcagattaa

SEQ ID NO: 628 - DNA (genomic), 471 bp, Streptococcus pneumoniae; double-stranded, circular
  misc_feature (B) LOCATION 1...471
  hypothetical: NO
  anti-sense: NO
ataaattggtataagatgacgcgctatgctttgctggtgagaggtatcaatgttggtggtaagaataaggtcgtcatggcggagcttcgtcaagaattgacaaacttgggactggaaaaggttgagagctacatcaacagtggcaatattttctttacttcgatagattccaaagcccaattggttgaaaagctagagactttctttgcagtccattatccatttattcagagcttttctttactgagtctagaggactttgaggcggaacttgaaaatctaccagcttggtggagcagagacttggcacgaaaagattttctcttttacactgagggtttggatgtggaccaagtcatcgcgacagttgaaagtttagagctgaaagatgaagtgctttattttggaaaacttgggattttctgggggaaattttctgaagaatcctattctaagactgcctatcagtag

SEQ ID NO: 629 - DNA (genomic), 879 bp, Streptococcus pneumoniae; double-stranded, circular
  misc_feature (B) LOCATION 1...879
  hypothetical: NO
  anti-sense: NO
gaactatggtataataagagaatgaactatccaaaaattgatttaaaaacaattcgtcaggagtcaaaacattttcaggctgacaccccccgtctctttctcctctatatccttcccagtatgctggtcatcttatctggttttcttaatcccttatctcggatccacgggactgttttagaacagccatttttcagcatacttggccaaatacttcaaacctacctctttcctctactagtctcctttatcgggactattcttttgaccagttccgtctatgcaacactgacactcatgaaagattctaaaacggagccatctgtaaaaaacagcctagctctctttgatgaggagcgcttttctcaaacctttttgaccctacttctcaaacgtttctatctctttttatggagtatccctaatttacttgggatttacctcctcttttatagtagctttttagccaaaaaattcgtcaccctacatcctgagtttccaaatctagatctctcatcagttgaaaccgagcgtttcctcatggtctttggactctactttcttgcaagtctcatcttgatcattgtaggaaatatcctctatattccacagtattatgcctattcacaggtggaatttcttctctgttatagtctagacctaggacaggtcccaccaagacgaatcctaaaaactagccgttcctttatgaagggctacaagttccagcactttgtcctagatttacagcttcttccttggtacttcctcaattggattacctttggcattgctagtttttcactcctaccttatatccaatgcactaaaattatgttttaccgagcagtattggcccgaaaacgtccaaaagcttga

SEQ ID NO: 630 - DNA (genomic), 1131 bp, Streptococcus pneumoniae; double-stranded, circular
  misc_feature (B) LOCATION 1...1131
  hypothetical: NO
  anti-sense: NO
atgttagatttgattcagactagacgagatttacaccagataccagagattggcttggaggagttcaagactcaggcttatttgctggatgtgattgagaaattgactacgggcaaggattttgttcaaattcgtacttggcggacagggattttggtctacctgcagggaagtcagccggagcgaaccattggttggcggacagatattgatggcctgcctatcgtcgaacaaacaggtctaccttttgcttctcaacaccaaggtcgcatgcatgcctgtggtcatgattttcatatgaccattgccttaggctgtcttgagcgcgcccttgaggagcaacccaagaataatctgctctttctatttcagcctgctgaagaaaatgaagctggtggtatgctcatgtatgaggacggtgcttttggagattggttgccaaaccaattctatggtctccatgttcgtccagatttgaaagtcggccagattgcgactaatactcatacactctttgcaggaacttgcgaggtgaagatccgtttcaaaggcaaaggtggccacgcagcttttcctcatgaagccaatgacgccttggtggcggctagttactttgtgacccaagtgcagtcagttgttagccgcaatgtcaacccaatcgagggagcagtggtgaccttcggcgtttttcaagctggaaccaccaacaatgtcatcacagacacagcttttttacatggaactattcgtgccttgacacaggacatgagtctcttggtgcaaaagagggtaaaaacagttgcagaaggggttgcagctgcctttgatatggaagtcgaagtggaactcaaacaaggtggatacctacctgttgagaacaatccagccttggcgcgtgaactgatggacttctttgacgagaaagacggaatcgagttgattgatatcgaacctgctatgacaggcgaggactttggttatctcctttcaaaggttgatggcgtgatgttttggctaggtatcgatagtccctacgctcttcatcaccctcaaatgagtcctaaggaagaagtcttagctattggggtggctgcggtgtctagtttcctgaaaaagaaggcagcagaatag

SEQ ID NO: 631 - DNA (genomic), 642 bp, Streptococcus pneumoniae; double-stranded, circular
  misc_feature (B) LOCATION 1...642
  hypothetical: NO
  anti-sense: NO
cttgcgtggtatgacgacagaagagctggcggtagcaacgactgcaaatgcagaacgaatttttggattggacagcaagtaatgaaagagaaaatttctcaagttatcgtggttgaaggtcgcgatgatacggtcaatctcaagcgttatttcgatgtggagacctatgagacacgaggttctgccatcaatgatcaggatatagagcgaattcagcgtctacaccaacgtcatggagtcattgtctttacagacccagattttaatggggagcggattcggcgcatgatcatgacggccattccaacagttcagcatgcctttctcaagcgagatgaagctgttcccaagtccaagaccaaggggcgttctctgggaattgagcatgccagctatgaagacctgaaaacggctctagctcaggtgacagaacaatttgaacatgagagtcagtttgacattagtcgtagcgatttgattcgccttggttttctagcaggggcagacagccgtaagcgtagagaatatctcggagagactctccgaatcggctattctaacggcaagcaactcctcaaacgcctagagttgtttggggttactttggcagaagtggaagaagctatgaaatcttatgagtag

SEQ ID NO: 632 - DNA (genomic), 564 bp, Streptococcus pneumoniae; double-stranded, circular
  misc_feature (B) LOCATION 1...564
  hypothetical: NO
  anti-sense: NO
gaaaagaggtatcttatgacaacatttactatccatacagtagagtcagcaccagcagaagtgaaagaaattcttgaaacagtagaaaaagacaacaatggctatattcccaacctaatcggtctcttggccaatgccccgactgttttagaagcctaccaaattgtctcatctatccaccgtcgcaacagcctgacacccgttgagcgtgaagtggtgcaaatcacggcagccgtgaccaatggttgtgccttctgtgtcgcaggtcacacagccttttccatcaaacaaatccagatgaatgatgacttgattcaagctcttcgcaatcgtactccaattgaaacagatcctaaattggataccctagctaagtttaccttggcagttatcaataccaagggtcgtgtaggagatgaagccttgtctgagtttttagaagctggctacactcaacaaaatgccttggatgtggtttttggtgtcagcctagcaatcctctgtaactatgccaacaacttagctaatacaccaattaatccagaattgcaaccttatgcctaa

SEQ ID NO: 633 - DNA (genomic), 1110 bp, Streptococcus pneumoniae; double-stranded, circular
  misc_feature (B) LOCATION 1...1110
  hypothetical: NO
  anti-sense: NO
atttggaggtattgtatgagcaaggaattacacattaacacaattttggcccaggcgggtattaagtcagatgaagcgacaggtgcattggtgacaccgcttcatttttcaacgacctatcagcatccagagtttggtcgatctactgggtttgactatacgcgcactaaaaatccaactcgtagtaaggctgaggaagtcttggcgactattgagtcagcagactatgccttagcgactagctcagggatgtcagctattgtactggcctttagcggctttccagtaggaagtaaggtcttggcagtgcgtgatctttacggcggttcttttcgctggtttaaccaagtggagcaggaaggtcgtttccattttacctatgccaatacagaagaagagttgattgccgagttagaaaaggatgtggatgttctctatatcgaaaccccaaccaatcccttgatgttggaatttgatatcgaaaaactagcaaaattggctcatgctaagggtgccaaagtggtggtggacaataccttctatagccctatctaccaacgtccgattgaagatggagcagatatcgttctccattcagcaaccaagtatctagcaggccacaatgatgtcttggctggagtggttgtgaccaatagtttagaactatacgagaagcttttttacaatctcaatacaacaggggcagtcttgtctccatttgacagctaccagttgcttcgtggtctcaagaccttgtctcttcgtatggagcgctcaacagctaacgcccaagaagtggttgcctttttgaaggattctccagcagttaaggaagttctctacactggtcgtggaggcatgatttcctttaaagtagccgatgaaacacgcattcctcatattttgaacagtctcaaggtcttctcttttgcggaaagtttgggcggagtggaaagtcttattacttatccaacgactcaaactcatgctgatattccagcagaagtacgccattcttatggtttgacagatgacctcttgcgtttgtctattgggattgaggatgctagagatttgattgcagatttgcgccaagccttagaaggataa

SEQ ID NO: 634 - DNA (genomic), 606 bp, Streptococcus pneumoniae; double-stranded, circular
  misc_feature (B) LOCATION 1...606
  hypothetical: NO
  anti-sense: NO
gcagcagatttagctattggtgattttgaaggaaccattaataaggatcattatttagcgggttatcttctctttaatgctcctgttgaagttatggatgctattaaggaggcaggttatcatgtgctggatttagctcataatcatattttggattcgcaaattgagggagttatttcaacggccgatattattgagaaagctggaatcactccaatcggagtttatacgcacgaaccacgtgatcaggctccgctggtcattaaggaagtgaatgctatcaaggttgcattgttagcctattcctatggtttcaatggaattgagcagtatatttttcaggaagactataatcgttatctttcagatttaaacgaagataagataaaggctgaagttgaacgggcagagaaggaagcagatatcaccattatcatgcctcagatgggtgttgagtatcgattggaaccaactgaagaacaaaaagctctttatcacaagatgatcgattggggagcggatattatctttggagggcatcctcacgttgttgaaccatctgaaacggttgaaaaagatggagataagaaactcattatctattaa

SEQ ID NO: 635 - DNA (genomic), 831 bp, Streptococcus pneumoniae; double-stranded, circular
  misc_feature (B) LOCATION 1...831
  hypothetical: NO
  anti-sense: NO
gccattatntatgatatgaatttaaacatgtctattatntctatggttttagtagtcgttgtagccgtctttgcaggtcttgaaggcatcctcgaccagttccaatttcaccaaccacttgtagcctgtacccttattgggcttgtaacaggtcacttggaagcagggattatcctcggtggatcgcttcaaatgattgcccttggttggtcaaatatcggtgctgctatcgctcctgatgctgcacttgcttctgtcgctgctgccattatcatggttcttggtggtgactttaccaagactggtatcggtgttgcccaagcggttgctatccctcttgccgtagctggacttttcttgacaatgattgttcgtacaatttcagttggtttggttcatactgcagatgctgccgctaaaaaaggtgacttcggcgctgtggagcgtgcgcatttcattgcgctactcttccaaggacttcgtatcgcgcttcctgcagctcttctccttatggtaccaactgaaactgtacaaagtatccttagtgccatgccagactggctcaaagatggtatggctatcggtggtggtatggtcgttgccgttggttacgccatggttatcaacatgatggcaactcgtgaagtatggccattcttcgctcttggtttcgttctcgctgctgtgtcagatattactctaatcggattcggtgctatcggtgttgctatcgctcttatctaccttcacctttctaaaactggtggaaatggtggcggaggagccgcaacttctaacgacccaatcggcgatatcctagaagactactaa

SEQ ID NO: 636 - DNA (genomic), 783 bp, Streptococcus pneumoniae; double-stranded, circular
  misc_feature (B) LOCATION 1...783
  hypothetical: NO
  anti-sense: NO
aatcaatatctattgatggagaaagtgatgtccaaacaccctcattatgaattgttaaatttaattggctacggtcttgccaagtttgacaagctttttataaaagaatttcaatgctctagcaagtcggagttttatcgctatgtggtttctctgggaattgctgaaacaactggagttgtaaaaaatagaatggatttatttgatccttattttgacaataatcgaaaaggttggtggcagaaagctgaagtttatcgttttcgtaaagatttaattgatatgatgtttggaaatgaagatgttcatagttatgctgaaatagttaaaatgttacttgccagtgaagggaagaaaacaggcataaccatcgttgaaaaaccaatagttcgaactaaattcaaacgtctacaggaaacgggaatggaggctgagaattattttatccttcattttgataaagaagaaaaattccaaggtggacagttaaccgatgcccgtctttatggtgatggatatgactttcaggtagatgtccaagagtattcttaccttgccgaagtaaaaggtatccgaaaatctaaggggcgtgtgcgtttaactgcaaaagaatttgaaaaagtcaaggagtttcaatcggattttattttatccttggtcacaaatctagatgatattccaaagttagtgttaatcgataatcctttaaaacattttgagtttaaaaagaatattatcaaaaatgaaatcattgaatatagaagcgtagaggatttgtattag

SEQ ID NO: 637 - DNA (genomic), 306 bp, Streptococcus pneumoniae; double-stranded, circular
  misc_feature (B) LOCATION 1...306
  hypothetical: NO
  anti-sense: NO
gaaatgtatctcgttataggaattgtattagcctttatagtgtcattttggaaggataatagaagtttgtggaatccagtattatttttattatccctcatttcaagttatttttatctatcctaccttttttataaaaatggatacgagaatgttcagttagctttttatgtatttgcctttgtcttacttccttttttgctttttctaagtggcatctttttaatctataatggggtcattttgttgaagcgagagggacgttccaagccccattatctctcaatgctatttgatttttattga

SEQ ID NO: 638 - DNA (genomic), 873 bp, Streptococcus pneumoniae; double-stranded, circular
  misc_feature (B) LOCATION 1...873
  hypothetical: NO
  anti-sense: NO
caaatggatttcacatgggcactgaagtatgccactgaatttttgggaactgccattttgatcattcttgggaatggtgcagttgccaacgttgaacttaaaggtacgaaaggtcaccaaagtggctggatcgtcatcgctgttggttatggtatgggggttatgatccctgccttgatgtttggtaacgtatctgggaatcacatcaaccctgctttcactctagggcttgcagttagcggtcttttcccttgggcacaagtggtaccttatattatcgcgcaagtcttgggggctatctttggccaagccttagttgtggcaacataccgtccattctacttgaaaactgaaaacccaaataacatcttgggaactttctcaactatttcaagtattgaccatggtacaaaagaaagtcgctatgcagcaactgtcaatggtttgattaatgagtttgttggttcatttgttttgttctttgcagctcttggtttgactaaaaacttctttggtgctgaagtgcttcaattcatgaaacaaaaggcaatagaagcaggacaaacagttgatttttctgacttggctattaaagcacaggtggctccacacactgcttcaggactttctgtggctcacttggcacttggattcctcgttatggctttggtaacatcacttggaggacctacaggacctgccttgaacccagcccgtgacttgggaccacgtctccttcatgctttccttccaaaatcagttcttggtgagcataaaggcgattcaaaatggtggtattcttgggtaccagtagtagcacctatcgcagcagcaattgcggcagtagctgtattcaaattcctttatctctaa

SEQ ID NO: 639 - DNA (genomic), 255 bp, Streptococcus pneumoniae; double-stranded, circular
  misc_feature (B) LOCATION 1...255
  hypothetical: NO
  anti-sense: NO
aagcaccatcttcttggccaagtcataaatcttgactggtttgcccatatcaaggataaagacttccccatctttggcataagcaccagcatggataaccagacgactagcttctggaatggtcataaagtaacgggtcatgcggaagtctgtcaccgttacaggcccaccttcagcaatctgacgttcaaagactggaatgacactaccacggctaccaagaacattcccaaaacgaactgcacagtaggttga

SEQ ID NO: 640 - DNA (genomic), 510 bp, Streptococcus pneumoniae; double-stranded, circular
  misc_feature (B) LOCATION 1...510
  hypothetical: NO
  anti-sense: NO
tttaaggattttcttaagggcgtggaagatttcagcaccgtaacgaagggcttctttaaatgttggcgcaccaactggcaagatcatgaactcttggaaagcgattggagcgtcagagtgagaaccaccgttgatgatgttcatcattggagttggaagaactttagtgttgaatccaccaaggtagctgtaaagtgggatttcaaggtagtcagcagcagcacgagctacagcgatagacacaccgaggattgcattcgcaccccatttacctttgttaggagtaccgtcaagtgcgatcatagcacggtcaatagcttgttgatcacgtacatcgtagccaatgatagcttcagcaatgatgttgtttacgttgtcaacagctttttgtgtaccaagaccaccgtaacgagatttgtcaccgtcgcgaagttcaactgcttcgtgttcaccagtagaaagctccttgatggaaccataccacgtccgaaagcacctgattcagtgtaa

SEQ ID NO: 641 - DNA (genomic), 792 bp, Streptococcus pneumoniae; double-stranded, circular
  misc_feature (B) LOCATION 1...792
  hypothetical: NO
  anti-sense: NO
gcaaacaatcttgaaaggagccaagttaagcaaatgacagcaattgtagaattaaaaaatgcaaccaaaatcgttaaaaatggctttgatgaagaaaagattattttaaatgatgtttccttagaaatttttgaacgggactttatcacgattttgggcggaaatggtgctggaaaatcaaccctctttaacactatagcagggaccttatcactaactagtggaactatccgtattttaggtgaagaactcactaagttttcacccgagaagcgtgccaagtacctgtctcgtgtcttccaagatccaaagatggggacagctccccgtatgacggtcgctgaaaatcttttaatcgccaagtttcgtggtgaaaagcgtggattgttaccacgacgcttgactagctataaggatgaatttcaggcaaccattgaaaaagtaggaaatggtcttgagaaacacttgaatacaccgattgagttcttatcaggtggacaaagacaggctttgagtctcttgatggcaaccttgaagcgacctgaattactcttgttagacgagcatactgctgccctggatccaaagactagtgttgctttgatgggattgacagatgaatttgttaagaaagatcaattgacagcccttatgattacccatcatatggaagatgctctcaaatatggcaatcgcttgattgtcatgaaagaaggacgggttatccaagatttgaaacaagaagaaaaagcaaaaatgaaaatctctgattattatcaactctttgaataa

SEQ ID NO: 642 - DNA (genomic), 282 bp, Streptococcus pneumoniae; double-stranded, circular
  misc_feature (B) LOCATION 1...282
  hypothetical: NO
  anti-sense: NO
gaggtaaatctaatggctaaaaaatcaatggtagctagagaggctaaacgccaaaaaattgttgaccgttatgctgaaaaacgtgctgcattaaaggcggcaggggactacgaaggtttatctaaattacctcgcaacgcttcaccgactcgtttacataatcgttgtagagttacggggcgcccacattcagtttaccgcaaatttggtctgagtcgtatcgcttttcgcgaacttgcgcataaaggtcaaattcctggtgtaacaaaagcatcttggtaa

SEQ ID NO: 643 - DNA (genomic), 342 bp, Streptococcus pneumoniae; double-stranded, circular
  misc_feature (B) LOCATION 1...342
  hypothetical: NO
  anti-sense: NO
tttttttttcactttcccccacacccacccccattcccntttcttcctttctttccccctcccaacctccccccnnccccnccttttccttccccctttttccccanacctcccncaacaccctttttttccttcttttcccccccccnnccntcaccccnccttcttcctcctttccctccctccccnttttctccccccccttcnnntttccctcttttttttnntttcccttttnnnnnnnntnnntttttttttttttnnnnnnnnnttnnnnntattnnnttncccccannnnnnnnnnnnnnnnnnnnnnnnnnnnnnnnnnnnnntattcaatga

SEQ ID NO: 644 - DNA (genomic), 1305 bp, Streptococcus pneumoniae; double-stranded, circular
  misc_feature (B) LOCATION 1...1305
  hypothetical: NO
  anti-sense: NO
gtttcttttcatcaggaggagagattgtttaagaaaaataaagacattcttaatattgcattgccagctatgggtgaaaactttttgcagatgctaatgggaatggtggacagttatttggttgctcatttaggattgatagctatttcaggggtttcagtagctggtaatattatcaccatttatcaggcgattttcatcgctctgggagctgctatttccagtgttatttcaaaaagcatagggcagaaagaccagtcgaagttggcctatcatgtgactgaggcgttgaagattaccttactattaagtttccttttaggatttttgtccatcttcgctgggaaagagatgataggacttttggggacggagagggatgtagctgagagtggtggactgtatctatctttggtaggcggatcgattgttctcttaggtttaatgactagtctaggagccttgattcgtgcaacgcataatccacgtctgcctctctatgttagttttttatccaatgccttgaatattcttttttcaagtctagctatttttgttctggatatggggatagctggtgttgcttgggggacaattgtgtctcgtttggttggtcttgtgattttgtggtcacaattaaaactgccttatgggaagccaacttttggtttagataaggaactgttgaccttggctttaccagcagctggagagcgacttatgatgagggctggagatgtagtgatcattgccttggtcgtttcttttgggacggaggcagttgctgggaatgcaatcggagaagtcttgacccagtttaactatatgcctgcctttggcgtcgctacggcaacggtcatgctgttggcccgagcagttggagaggatgattggaaaagagttgctagtttgagtaaacaaaccttttggctttctctgttcctcatgttgcccctgtcctttagtatatatgtcttgggtgtaccattaactcatctctatacgactgattctctagcggtggaggctagtgttctagtgacactgttttcactacttgggacccctatgacgacaggaacagtcatctatacggcagtctggcagggattaggaaatgcacgcctccctttttatgcgacaagtataggaatgtggtgtatccgcattgggacaggatatctgatggggattgtgcttggttggggcttgcctggtatttgggcagggtctctcttggataatggttttcgctggttatttctacgctatcgttaccagcgctatatgagcttgaaaggatag

SEQ ID NO: 645 - DNA (genomic), 915 bp, Streptococcus pneumoniae; double-stranded, circular
  misc_feature (B) LOCATION 1...915
  hypothetical: NO
  anti-sense: NO
atggaaaatcttgtgaaaagcacaagtgatacatatatactggaggaaatcatgtctttttctgatttaaagctgtttgccctttcttctaataaagaattggcagaacgtgtggcgcaggagattgggatagagttggggaaatcaagtgttcgccaattttcagatggagagattcaggtcaacattgaagaatcaatccgtgggaaacacgtctttatcctacaatcaactagttcgcctgtaaatgacaatctgcttgaaattttgattatggtagatgctttgaagcgtgcgagtgcagaatctgtcaatgttgtcatgccttactatgggtatgcacgtcaggatagaaaggcgagagcgcgtgagccaatcacttcaaaacttgtcgcaaatatgcttgaagtagctggagtggatcgtttattgaccatcgacttgcatgctgcgcaaattcaaggattctttgatattcctgtggatcatttgatgggtgctcctctgattgcagattattttgagcgtcgtggtatggttggttctgactatgtggttgtcagcccagaccatggaggggtgactcgtgctcgtaagttggcagaatttttgaaaacatctatcgctattattgataaacgtcgtagcgttgataagatgaatactagtgaagttatgaacatcatcggtaaggttgaaggcaagacttgtatcttgattgatgatatgattgataccgctggaacgatttgtcatgcggcagatgctcttgcggaagctggtgctgttgaagtctatgcaagctgtacgcacccagttctttctggtcctgctacggacaatatccaaaaatcagctattaagaaagtggttgttttggataccatctatctgccagaagagcgctctgattga

SEQ ID NO: 646 - DNA (genomic), 648 bp, Streptococcus pneumoniae; double-stranded, circular
  misc_feature (B) LOCATION 1...648
  hypothetical: NO
  anti-sense: NO
ggtctctttcaatccaaaccctttaaactatacgtcatttcggttcctgcaagtcttgtggtaattttaggtttgattttacttttcttttcacaagagcctctgcacgcttcttatttgatggtcgtcttccctgttttcctacttttattggtaaccaatattaagagtcaacagagggggcgtagtgctagaagaaaccgaagagaaacgccagttagcctatggagtcgtttcttcaaaggaaatctatatctgctagtttttgagtttgtctatcttttgtctgttccttttttgatgaagtttgtcctttatccagtaccttatcaagaacgtaatcgtcttgctgatttggtaaaagaggagacaaatacggaagatgctatctatgcatgggatgatactgcgactctttatcgtaagagtgagcgcttgtcgccatcggcgattttgtccccgttgcactatacagcaactgaggaaaatcgtaataagttacttaatgacttgaaagaaaaacaacctaaggtgattgtggtaaatgataaggtggtagtctggtctgaagtggaaacactcttaaaagaaaattaccaacaagtaaagactgattactcagagtttaaagtctataaaattaaataa

SEQ ID NO: 647 - DNA (genomic), 1932 bp, Streptococcus pneumoniae; double-stranded, circular
  misc_feature (B) LOCATION 1...1932
  hypothetical: NO
  anti-sense: NO
aatcgctttcaaacaagaacaaaatgttatataaggagatttttgcaaatgaacaatcaggaaattgcaaaaaaagtcatcgatgccttgggcggacgtgaaaatgtcaatagtgttgcccactgtgcgactcgtctacgtgtcatggtcaaagatgaagagaaaatcaataaagaagtgattgagaacttggaaaaagttcaaggtgctttctttaactcagggcaataccaaattatctttggtacaggtacagttaacaaaatgtacgatgaagttgttgtacttggcttaccaacatcatctaaggatgacatgaaagcagaagttgctaaacaagggaactggttccaacgtgctatccgtactttcggtgatgttttcgttccaatcatcccagttatcgtagcgacaggtctcttcatgggtgtgcgtggtcttttcaacgctcttgaaatgccacttccaggtgactttgcaacttacacacaaatcttgacagatacagccttcatcatcttgccaggtttggttgtgtggtcaaccttccgtgtatttggtggaaatcctgccgttggtatcgttcttggtatgatgcttgtctctggctcacttccaaacgcttgggcagttgctcaaggtggtgaagtaacagcgatgaacttctttggtttcatccctgttgttggtttgcaaggttccgttcttccagccttcatcatcggggttgtcggagctaaatttgaaaaagctgtccgcaaggttgttccagatgtcattgacctcttggtaacaccattcgtgacacttttggtcatgtctatccttggactctttgtcattggaccagttttccacgttgttgaaaactacatccttattgctacaaaagcgattcttagcattccatttggtcttggtggtttcttgattggtggggttcaccaattgatcgtcgtgtcaggtgtgcaccacatcttcaacttgcttgaagtgcaattacttgctgctgaccatgctaacccattcaacgctatcatcacagctgctatgacagctcaaggtgctgctactgttgcggttggtgttaaaacaaaaaatccaaaactgaaaacacttgctttcccggctgctctttctgccttcctaggtattacagagcctgctatcttcggggtgaacttgcgcttccgtaaaccattcttcctttcattgattgctggtgcaatcggtggtggattggcttctatccttggacttgctggtactggtaatggtatcaccatcatccctggtacaatgctttatgttggtaacggacaacttccacaataccttcttatggtagctgtatcatttgcccttggttttgctcttacttacatgtttggttacgaagatgaagtagacgcaactgcagctgcaaaacaagctgaagtggctgaagaaaaagaagaagttgcgccagcagctcttcaaaatgaaacacttgtaactcctatcgtcggtgatgttgtcgctcttgctgatgtcaatgacccagtcttctcaagtggagctatgggacaaggtatcgctgtgaaaccaagccaaggcgtggtctatgcaccagctgatgctgaagtttcaattgcctttccaacagggcacgcttttggtttgaaaacaagaaatggtgctgaagttttgattcacgttggtattgacactgtatctatgaacggtgacggttttgaagcaaaagttgctcaaggtaataaggtgaaagctggcgatgttcttggaacatttgactcaaacaaaatcgctgcagctggacttgatgatacaacaatggttatcgttacaaatacagctgactacgcttcagtagctccagtcgcaacaggttcagttgcgaagggggatgctgtgatcgaagtgaaaatctaa

SEQ ID NO: 648 - DNA (genomic), 5919 bp, Streptococcus pneumoniae; double-stranded, circular
  misc_feature (B) LOCATION 1...5919
  hypothetical: NO
  anti-sense: NO
attttatttcaaggaggaataatggaaaagtattttggtgaaaaacaagagcgtttttcatttagaaaattatcagtaggacttgtatctgcaacgatttcaagtttattttttatgtctgtattagctagttcatctgtggatgctcaagaaactgcgggagttcactataaatatgtggcagattcagagctatcatcagaagaaaagaagcagcttgtctatgatattccgacatacgtggagaatgatgatgaaacttattatcttgtttataagttaaattctcaaaatcaactggcggaattaccaaatactggaagcaagaatgagaggcaagccctagttgctggtgctagcttagctgctctgggaattttaatttttgctgtttccaagaaaaaggttaagaataaaacggtattacatttagtattggttgcgggaataggaaatggtgtcttagtttcagtccatgctttagaaaatcatcttttgctaaattacaatacggactatgaattgacctctggagaaaaattacctcttcctaaagagatttcaggttacacttatattggatatatcaaagagggaaaaacgacttctgattttgaagtaagtaatcaagaaaaatcagcagccactcctacaaaacaacaaaaggtggattataatgttacaccaaattttgtagaccatccatcaacagtacaagctattcaggaacaaacacctgtttcttcaactaagccgacagaagttcaagtagttgaaaaacctttctctactgaattaatcaatccaagaaaagaagagaaacaatcttcagattctcaagaacaattagccgaacataagaatctagaaacgaagaaagaggagaagatttctccaaaagaaaagactggggtaaatacattaaatccacaggatgaagttttatcaggtcaattgaacaaacctgaactcttatatcgtgaggaaactatagagataaaaatagattttcaagaagaaattcaagaaaatcctgatttagttgaaggaattgtaagagtaaaacaagaaggtaaattaggtaagaaagttgaaatcgtcagaatattctctgtaaacaaggaagaagtttcgcgagaaattgtttcaacttcaacgactgcgcctattccaagaatagtcgaaaaaggtactaaaaaaactcaagttataaaggaacaacctgagactggtgtagaacataaggacgtacagtctggagctattgttgaacccgcaattcagcctgagttgcccgaagctgtagtaagtgacaaaggcgtaccagaagttcaaccagcgttgtccaaagcagttataaccgacaaaggtgagactgaggttcaaccagagtcgccagatactgtggtaagtgataaaggtgaacctgaacaggtagcaccgcttccagaatataagggtaatattgagcaagtaaaacctgaaactccggttgagaagaccaaagaacaaggtccagaaaaaactgaagaagttccagtaaaaccaacagaagaaacaccagtaaatccaaatgaaggtactacagaaggaacctcaattcaagaagcagaaaatccagttcaacctgcagaagaatcaacaacgaattcagagaaagtatcaccagatacatctagcgaaaatactggggaagagtccagtaatcctagtgattcgacaacctcagttggagaatcaaataaaccagaacataatgactctaaaaatgaaaattcagaaaaaactgtagaagaagttccagtaaatccaaatgaaggcacagtagaaggtacctcaaatcaagaaacagaaaaaccagttcaacctgcagaagaaacacaaacaaactctgggaaaatagctaacgaaaatactggagaagtatccaataaacctagtgattcaaaaccaccagttgaagaatcaaatcaaccagaaaaaaacggaactgcaacaaaaccagaaaattcaggtaatacaacatcagagaatggacaaacagaaccagagaaaaaactcgaattaagaaatgtttctgatattgagttgtatagtcagacgaatggaacctacagacaacatgtttcattggatggaattccagagaatacggatacttactttgtcaaggtaaaatcttcagcatttaaagatgtctatataccagtagcttcaataactgaagagaaaagaaatgggcagtcagtttataaaatcacagccaaagctgagaaactccagcaagaactagaaaataaatatgtcgacaatttcaccttctacctcgataagaaggctaaagaggaaaatacaaactttacttcctttagcaacctggtcaaagctataaaccaaaatccctctggaacctatcatttagcggccagcctgaatgctaacgaagtggagcttagtactgatgataaatcctatatcaagggaacctttactggtcagttgattggtgaaaaagatggtaagcattatgctatttacaacttgaaaaagcctctttttgaaaacttgagtggtgctacagtagaaaaactgagtctaaaaaatgttgctatttcagggaaaaatgatattggttcactggcaaatgaagctacgaatggcacaaagattaaacaagttcatgttgatggtgttctggctggagaacgtggtgtcggtggtttgttggctaaggcagaccaatcaagcatcgcagagagcagtttcaagggaagaattgtcaatacctatgaaacgactgattcctacaatattggcggtctggtcggtcatttaacaggaaaaaatgcgtctattgctaaatccaaagcgacagtaaccatttcgtcaaacaccaataggtcagatcagactgtcggtggtcttgcaggtctagtagaccgagacgcacagatccaagatagctatgctgaaggtgatatcaacaatgtcaagcactttggtagagtcgctggagtggcaggcaatttgtgggatcgaacttctggtgatgttaggcatgctggaagtttgaccaatgttctcagcgatgttaatgtaacaaacggaaatgccatcactggataccactatacaggaatgaaggtagctaatacatttagtagtaaggctaatagagttttcaatgtcactttagagaaggatgaggtcgtcagcaaggaatcctttgaagaaagaggaacaatgctagatgcttctcaaattgtaagcaaaaaagcagaaataagtcctctcactctaccaacggtggaacccctctcaacaagtggcaagaaagacagtgatttttctaagatagcccattatcaagctaaccgtgctttggtttataagaacattgaaaaattgttacctttttataataagtcaaccatcgtgaaatacggaaacctggttaaggagaacagtctcttataccaaaaagaactcttatctgcagttatgatgaaggatgaccaagtaatcacagatattgtttccaacaaacagactgcaaacaaactattacttcactataatgaccattcatctgagaaatttgatctcaagtaccagactgattttgccaatctagcagaatataatctaggtaatacgggacttctctacactcctaaccaattcttatatgatcgagactctattgttaaggaagtcttgcctgagttgcagaagcttgattaccagtcagatgctatcagaaagacacttggtatttctccagcagttaagttaaccgagctctatttagaagagcagttctccaaaacaaaacaaaatctgggaggcagcttgaaaaaacttttgtcagcagatgccggtctagctagcgataactcagtcaccagaggctatcttgtagataaaatcaagaataataaggaagccttgctactcggtttaacttatttagaacgttggtataactttaactatggtcaagtgaatgtcaaagacctagttatgtatcatccagacttctttggtaaaggaaatacttccccactagatactctgattgagttaggtaaatctggctttaacaatcttcttgccaagaacaatgtcgatacttatggtatcagtctagccagccatcatggaacgacagatttgtttagcgcacttgaaacttaccgaaaagtctttttaccaaacactagcaacaatgactggtttaaaaaacagaccaaagctttcattgtcgaagaaaaatccactattgcagaggtcaaagccaagcaaaagcaagcaggaactaagtactctatcggtgtttatgaccgaattactagtaatacttggaagtaccggaatatggtcttgcctctccttaccttgccagaaagatctgtatttgtcatctcaaccttgtctagtctaggatttggtgcttacgatcgctaccgtaatagtgaacataaagcaggcaaggacctcaataatttcgttgaagaaaatgcgagtgaaactgccaaacgtcagcgagatcactacgattattggtatcgcattttagataatgagggacgtgaaaaactatatcgtacgattctcctttatgatgcctataagtttggtgatgacacaacatctggaaaagctacagtggaggctaagtttgatagctccaatccagccatgaagaatttctttggtccagttggtaataaggttgttcataatcatcacggtgcctacgcaacaggagatggtgtctactatatgtcttaccgcatgctcgacaaggatggagccattacctatacccatgagatgacccatgattcggatcaagatatttaccttggcggctatggtcgaagaagtggtcttggtcctgagttctttgctaaaggtttattacaagcgccagaccatccatatgatgcgaccattaccattaccattaactctatcttgaaacattcaaaatcagatagcttagaaggatcgcgtctgcaagtcttggatccgacagaaagattccaaaactcagcagatcttcaaaactatgttcacaacatgtttgacctcatctatatgttggaatatctagaagggcaatcgattgttaagaaactgaatgtttctcagaaaatggaagctctcagaaaaatcgagaatcaatatctaacagatcctgctgatggaaatgaggtttacgctactaacgtagtcaaagaattgacagaagaagaggcccgaaacctgaatagttttgatagtttgattgacaataatattctttcagctcgtgagtataaggctggtacatatgagagaaatggctactttactataaaactctttgcaccaatcttttcagcattgagcagtgagaaaggtactcctggagatcttatgggacgaaggatagcttatgaactcttagctgctaaaggatttaaagatggtatggtaccatatatttccaaccaatatgaaggaattgctaaacaaaatggtcagacaatcaacctttacggtaaaaagcaaggattagtgacagataagcttgttttggaaaagatattctctggcaagtatccatcttggacagcctttaaaaaagctatgtatcaagagcgtattgctcagtttgatcatttgactaaagttatttttaaagatccgacaaaaccatggccaagctatggcacaaagactatcaataatgtggatgaattgcaagccctcatggaccaagctgttctcaaggatgctgaaggtccacgttggagtaattataatccagaaatcgacagtgccgttcataagttgaagagagcaatctttaaagcctatcttgaccaaacaaatgattttagaagttcaatttttgagaataaaaaatag

SEQ ID NO: 649 - DNA (genomic), 882 bp, Streptococcus pneumoniae; double-stranded, circular
  misc_feature (B) LOCATION 1...882
  hypothetical: NO
  anti-sense: NO
agccatcttcatatgaacccagaccctgaagccttgggatttcaggtgggattgaaagccttgctggaacatcaggtcccacaaaaaaccatcaaagccgtcggttttgatgaaccaactcttacttggatggctgagatggatcttgttgaagatagggcctaccaaggcgcacttgtcatcgtctgtgatacagctaatactgctcgtatcgatgataaacgctatagtcaaggtgattttctcattaagattgaccaccatccaaatgatgatgtatacggtgacctgtcttgggtcgatactagttcaagtagcgctagcgagatgattaccctatttgcccaaacaacccaactagccttggcagatcgcgatgctgagttgctctttgcaggaattgtcggtgatacaggtcgcttcctctacccttctaccactgcacggactcttcgcctggctgcttatttgagagaacataactttgactttgcagctctcactcgcaaaatggacactatgagctacaaaattgctaaactgcaaggctacatctacgaccatctggaagtggatgaaaatggtgctgctcgcgttatcctgagtcagaaaatcttgaaacaatacaatgtaaccgatgctgaaactgcgaccattgtaggtgcacctggacgcattgacagagtgagtctctggggaatttttgtcgaacaggctgatggccactaccgagttcgcttacgcagtaaagtccatcctatcaatgaaattgccaaggagcatgatggtggaggccaccctctagcaagtggtgctaattcctatagcctaaaagaaaacgaaatcatctaccaaaagttaaaaaacttgcttaaaaactga

SEQ ID NO: 650 - DNA (genomic), 885 bp, Streptococcus pneumoniae; double-stranded, circular
  misc_feature (B) LOCATION 1...885
  hypothetical: NO
  anti-sense: NO
tattttattcagagaaagaaaaagactgaaaggtgggaaatgattatgaatacacatataaatggtattagtaaaaaaggcaaagttcttatatatggttatatgctccttaccattttaatttctattttccctattgcgtggatttttttatcatcattaaaagcagatcctatgaaaaatccaggtattagtttaccgactgactttactcttgaaggttatataaatgtttttacaaaacttcatgttttcacttacttttggaatagctttaaagtagtgtctatatcagttattattagcattgttatgatctccatgtcttcatatgttattgctaggatggaatttagagggaagaagttggtgacttctatgctgtattctactctatttattccagcaacagctatgacttttccagtttatagattagtaaatgagttggggatttataataccccagttgctctaattctggtctactcttgtagtggaattgctatgagtttctttattataaagaactattttgaaattattccaaaagaattggaggaggcagcagagattgatggtgcgacatatgctcaaactttttggaaagtgatgttaccaattgctagaccaggaattttaacagcagcagtacttgcctttattaataactggaatgaatattattgggcatctatgttggtgattgataaaaatgaattaacagtaccagcattactaggtcaatttactacaagttttaatactaattataatggtctattttcagctattgttgtaatcgtattaccaccaatcattctattcgcatttacaagtaaatacttcattgaagctttaggaggaggagcagtaaaaggatga

SEQ ID NO: 651 - DNA (genomic), 735 bp, Streptococcus pneumoniae; double-stranded, circular
  misc_feature (B) LOCATION 1...735
  hypothetical: NO
  anti-sense: NO
ttgaagaatctaaggatagcccttatctcgaaggattggatttggaaagttagaaagaggaataaagaaatgacaaaaagaatacctaatttacaagttgcattagaccattcagacttgcaaggagcgattaaagcagctgtttctgttggtcaggaagtagatattatcgaagctggaactgtttgcttgcttcaagttggaagtgaactggctgaagtcttgcgtagccttttcccagataagattattgtggcagacacaaaatgtgctgatgctggtggaacagttgctaaaaataatgcggttcgtggagcagactggatgacttgtatctgttgtgcaaccatccctactatggaagcagctctaaaggctatcaagactgaacgaggagaacgaggcgaaatccagatcgagctttatggcgattggacttttgaacaagctcagctttggctagatgcaggtatctcacaagctatttatcaccaatctcgtgatgctcttcttgctggtgaaacttggggtgaaaaagaccttaataaggttaaaaaactcattgacatgggcttccgtgtatctgtaacaggtggtctagatgtagatactctcaaactctttgaaggtgttgatatctttacctttatcgcaggtcgtggaattacagaggctgcggatccagcaggagcagcgcgtgccttcaaggatgaaatcaaacgaatttgggggtaa

SEQ ID NO: 652 - DNA (genomic), 186 bp, Streptococcus pneumoniae; double-stranded, circular
  misc_feature (B) LOCATION 1...186
  hypothetical: NO
  anti-sense: NO
ggctgtattcaattgcccttcctagttttgaacctgctaaaactgactgacggcggcaccaagcaaagaagtcttctattaggggttggagctcttcttgacgtttctgtagtcgttcatcagctggcaaagcctcccagtctctttccaaggaaaataactgatcacaataggctaatcctttag

SEQ ID NO: 653 - DNA (genomic), 186 bp, Streptococcus pneumoniae; double-stranded, circular
  misc_feature (B) LOCATION 1...186
  hypothetical: NO
  anti-sense: NO
ggctgtattcaattgcccttcctagttttgaacctgctaaaactgactgacgccggcactaagcaaagaagtcttccattaagggctggagatgttcttgacgtttctgtagtcgttcatcagctggcaaagcctcccagtctctttccagggaaaataactgatcacaataagctaaacctttag

SEQ ID NO: 654 - DNA (genomic), 1011 bp, Streptococcus pneumoniae; double-stranded, circular
  misc_feature (B) LOCATION 1...1011
  hypothetical: NO
  anti-sense: NO
aaaagagttcaattcgaactctttttttgctataatgaggggagaaaaatcagacaggagatcgacatgtcagaaccattatttttacaatcagttatgcaagaaaaaatctggggtggagccaagctacgtgatgagtttggctacgatatcccaagtgaaaaaatcggagaatattgggccatctcagcccatccaaatggagtctctaaagttgccaatggtcgttacgagggaacagatcttgctactttgtatgcggaacaccgtgaattatttggcaatcgtccagaacctgtatttccacttttgaccaagatcctcgatgccaacgactggctcagtgtccaagttcacccagacgatgcttatggactcgagcatgaaggcgaactcggaaaaacagaatgctggtacattatcgcagcggatgaaggttcagagattatctacggtcacaatgccaagtcaaaagaagaactccgccagcaaatcgaggataagaactgggatgcgctgttgacaaaagtgccagttaaagcaggagatttcttctatgtaccaagcggtaccatgcacgctatcggggcgggtatcttgattcttgaaacccagcagtctagcgataccacttaccgtgtctatgactttgaccgtaaggatgacaagggcaatttacgtgaacttcaccttgaaaaatctatcgatgtcttgaacattggtgaacctgcaaatagccgtccagtgacaatcaaagcagatgatctacgttccactctccttgtatccaatgatttcttcgcagtttacaaatgggaaattactggaaaagttaactttgaaaagacagctgactacagcttgttgagtgtcttggctggtcaaggtcaactaactgttgacgggaaaaactatccaatccaaaaagggagacactttatcctaccaagtgatgttgaatcttggactctagaagggcaagatttagaattaattgttagtcatccataa

SEQ ID NO: 655 - DNA (genomic), 381 bp, Streptococcus pneumoniae; double-stranded, circular
  misc_feature (B) LOCATION 1...381
  hypothetical: NO
  anti-sense: NO
cttttggttcaaagtagagaaaggaatatcatggcaaatcatttccgtacggatcgtgtgggcatggaaatcaagcgtgaagtcaatgagattttgcaaaagaaagtccgtgatccacgtgtccaaggtgtgaccatcacagatgttcagatgctgggtgacttgtctgttgccaaggtttattacaccattttgagtaaccttgcttcggataaccaaaaagcccaaatcgggcttgaaaaagcaactggtaccatcaaacgtgaacttggtcgcaatttgaaattgtacaaaatcccagatttgaccttcgtcaaagacgagtccatcgagtatggaaacaagattgacgagatgctacgcaatctggataagaactaa

SEQ ID NO: 656 - DNA (genomic), 1953 bp, Streptococcus pneumoniae; double-stranded, circular
  misc_feature (B) LOCATION 1...1953
  hypothetical: NO
  anti-sense: NO
aagatgtctcatattattgaattgccagagatgctggcaaaccaaatcgcagctggagaggtcattgaacgtcctgccagtgtggtcaaagagttggtagaaaatgccattgacgcgggctctagtcagattatcattgagattgaggaagctggtctcaagaaggttcaaatcacggataacggtcatggaattgcccacgatgaggtggagttggccctgcgtcgccatgcgaccagtaagataaaaaatcaagcagatctctttcggattcggacgcttggttttcgtggtgaagccttgccttctattgcgtctgttagtgtcttgactctgttaacggcggtggatggtgctagtcatggaaccaagttagtcgcgcgtgggggtgaagttgaggaagtcatcccagcgactagtcctgtgggaaccaaggtttgtgtggaggatctctttttcaacacgcctgcccgtctcaagtatatgaagagccagcaagcggagttgtctcatatcattgatattgtcaaccgtctgggcttggcccatcctgagatttcttttagcttgattagtgatggcaaggaaatgacgcggacagcagggactggtcaattgcgccaagcaatcgcagggatttacggtttggtcagtgccaagaagatgattgaaattgagaactctgacctagatttcgaaatttcaggttttgtgtccttgcctgagttgactcgggctaaccgcaattatatcagcctcttcatcaatggtcgttatatcaagaacttcctgctcaatcgtgctattttggatggtttcggaagcaagcttatggttggacgttttccactggctgtcattcacatccatatcgacccttatctagcggatgtcaatgtgcatccaactaagcaagaggtgcggatttccaaggaaaaagaactgatgactctggtttcagaagctattgcaaatagtctcaaggaacaaaccttgattccagatgccttggaaaatcttgccaaatcgaccgtgcgcaatcgtgagaaggtggagcaaactattctcccactcaaagaaaatacgctctactatgagaaaactgagccgtcaagacctagtcaaactgaagtagctgattatcaggtagaattgactgatgaagggcaggatttgaccctgtttgccaaggaaaccttggaccgattgaccaagccagcaaaactgcattttgcagagagaaagcctgctaactacgaccagctagaccatccagagttagatcttgctagcatcgataaggcttatgacaaactggagcgagaagaagcatccagcttcccagagttggagtttttcggacaaatgcacgggacttatctctttgcccaagggcgagatggactttacatcatagatcagcacgctgctcaggaacgggtcaagtacgaggagtaccgtgaaagcattggcaatgttgaccagagccagcagcaactcctagtgccctatatctttgaatttcctgcggatgatgccctgcgtctcaaggaaagaatgcctctcttagaggaagtgggcgtctttctagcagagtacggagaaaatcaatttattctacgtgaacatcctatttggatggcagaagaagagattgaatcaggcatctatgagatgtgcgacatgctccttttgaccaaggaagtttctatcaagaaataccgagcagagctggctatcatgatgtcttgcaagcgatctatcaaggccaatcatcgtattgatgatcattcagctagacaactcctctatcagctttctcaatgtgacaatccctataactgtcctcacggacgtcctgttttggtgcattttaccaagtcggatatggaaaagatgttccgacgtattcaggaaaatcacaccagtctccgtgagttggggaaatattaa

SEQ ID NO: 657 - DNA (genomic), 321 bp, Streptococcus pneumoniae; double-stranded, circular
  misc_feature (B) LOCATION 1...321
  hypothetical: NO
  anti-sense: NO
gatgtccctcaggcaccaaaacaagaaaggaatacgcacatgtcaaaattgctagataagatattatcacgcgaaaatatgctggaagcctacaatcaagtaaaatccaataaaggctcagctgggattgatggaatgactatcgaagagatggataattatctcagacaaaactggcgcttgactaaggaactgataaaacagagaaaatataagcctcaaccagttcttagagttgagatacctaaaccagacggaggtatccgtcaactaggaattccaacagttatggatagaatgattcaacaggccattgtctaa

SEQ ID NO: 658 - DNA (genomic), 966 bp, Streptococcus pneumoniae; double-stranded, circular
  misc_feature (B) LOCATION 1...966
  hypothetical: NO
  anti-sense: NO
aattcacctcacgatattataccaaaattcgctaattttgtcagtttttacaaattttactgcttttgtggtacaatagaaactatggcaagtatcacactcacaccaagcgaaaaggatattcaggcttttcttgaacactatcaaaccagtctggctcctagcaagaatccctatatccgctactttttgaaactacctcaagcaacggtttctatctatacttctggaaaaatcttgcttcagggtgaaggggctgaaaaatacgccagtttctttggctatcaagctgtagagcaaaccagcggacaaaatcttcctttaattgggacagatgaggtgggaaatggttcctactttggtgggcttgcagttgtggctgcctttgtcacacctgaccagcacgactttttacgaaaactcggtgtgggggattctaagactctgaccgaccaaaagatccgtcagattgctcctattctcaaggaaaaaattcagcaccaggcactccttctctcacccagcaagtacaacgaggtcatcggagaccgctacaatgctgtttcggttaaggttgccctccataatcaggctatctatctcctccttcaaaaaggtgttcagcctgagaaaattgtgattgatgcctttaccagtgctaaaaattatgacaagtacttggcacaagaggccaatcgtttcagcaatcctatcagcttagaagaaaaggctgagggcaaatacttgtctgtcgcagtttcttctgtcattgcgcgtgatctctttctggaaaatcttgaaaatctgggacgagaactgggttatcagcttccaagtggagctggaacggcttctgacaaggtggctagccagattttgcaagcctatggtatgcagggactcaacttctgcgccaaattgcactttaaaaacactgaaaaagcgaaaaaacgcttagaaaggtaa

SEQ ID NO: 659 - DNA (genomic), 705 bp, Streptococcus pneumoniae; double-stranded, circular
  misc_feature (B) LOCATION 1...705
  hypothetical: NO
  anti-sense: NO
aaaggaactcacatgtcaattattgaaatgagagatgtcgttaaaaaatacgacaacggaacgactgctctacgcggtgtttcggtcagcgttcaaccgggggaatttgcttacatcgtaggaccttcaggagcagggaagtcaacttttattcgttctctgtatcgtgaagtaaaaatcgataaaggaagcctatcagttgctggttttaatctggttaagatcaaaaagaaagatatcccgcttctacgtcgtagtgttggggttgtcttccaggattataaattgttaccaaagaaaactgtctatgaaaatattgcttacgctatggaagtaatcggggaaaatcgccgtaatatcaaaagacgagtgatggaagttttggacctggttggattgaagcataaggttcgttctttcccaaatgaactctcaggtggggagcaacagcggattgcgattgcgcgtgcaattgtaaataatcccaaagtattgatagctgatgagccaacaggaaatctggatccggataattcatgggaaattatgaatctcttggaacggattaacctacaaggaacaactattttgatggcgactcataatagccagattgtaaataccttgcgccaccgtgtcattgccattgaaaatggccgtgtcgttcgtgacgaatcaaaaggagagtatggatacgatgattag

SEQ ID NO: 660 - DNA (genomic), 183 bp, Streptococcus pneumoniae; double-stranded, circular
  misc_feature (B) LOCATION 1...183
  hypothetical: NO
  anti-sense: NO
aatcttgctcatgtaggttactacagcaagcttagctttttctttttcctgattaatgtctggtacgcttggtttcttgccttctggttgagggcttggtttggtatccggagatggagttgttggtttttgatgctctggattttccggctgcggagtttctggtttagtggaggatcctga

SEQ ID NO: 661 - DNA (genomic), 1725 bp, Streptococcus pneumoniae; double-stranded, circular
  misc_feature (B) LOCATION 1...1725
  hypothetical: NO
  anti-sense: NO
aacccagctcacaccgacttgctacggtgcttctattcgtttgaagcaaaagcaaggcaaagcctctccctctatcttcacgcaacagatgaactgacagtagagcaagtagataagcgaactcttgccctgcgacaagaaggtaaaactgaaaccaacaaaaattcgctaacgatgttcactgccctacaaatgaacacggatattcttgctatcagccaagaagctggagactggcgaattgacttagtaagtagtcaaaccgagatgcaactagccacttctttcatctctccttctcaagctctaatcaatctacctcaagaagattttgatagctgtaaagcaagtgcccaagcggattgggaaaatctcctccatcgttttgatgttatagagacaggagaggctaaccgaaccttctttgaccactgtctctacagactcttcctcttcccacagactttttatgaggttgatgagtcagggcaagccatccacatggatctggctactggtactgtcaagcctggtgtcctctttagcaacaatggtttctgggataccttccgcaccaccttccccctctttgcccttatcataccggagcactatcaacgctttttagaaggtttcctcaatagctaccgcgatactggtttccttccaaaatggctggctccagatgaacggggtatgatgccaggtacacttttagacggtattatcgcagatagcgcctgcaaggacatggcccctgacctagaaggagaactcttccaagccatgctcgaaacagccagcaaagccgaccctctcggcatcaatggccgccacggactagcccaataccaagaactaggttacctctctaccgaccaccacgaaagtgttagccatactctagactatgcctatagtgacttttgtatcgctagctgtgccaaaaaactagagaacatagaaatcgctgaaacctacaaggctgcttcacaaaattaccgccagctatttgacgctgagacaggttacatgcgagcacgagacaatcaaggaaactttcaccctgacttctctccttatagttgggggcgagactacgctgaatgctctgccattcaagctactttaggcgttctccacgacatccctggcttaatccaactgatgggtggaaaagaaacctttagcaactatcttttgaaagcttgtcaagatgctcccctctttgaaacaacaggctatggttacgaaattcacgaaatgagcgagatggctactgctccttttggacaaatagccatttccaaccagcctagtttccacattccttatctcttccgctacagcgattaccctgactacactgcccttcttatcaagacgctccgtcagaaagcttttcacccaagttgggaagcctatcctggagatgaagacaatggtagtctctctgcttggtacatctggtcagctctcggattttatccaacctgtccaggaaaaccaagctatgacctcggaatccctctctttgaccatctacgagtctacctcgctaaagaagataaatggctggatatccatactaaacaaaaccacaaccattttaactttgtcaaagaatgccgactggacaaaacactcgtatcaactattcaacaccaagacctcttaaaagctgaacaactaactttcaccctcagctggttaccaagtcactaa

SEQ ID NO: 662 - DNA (genomic), 219 bp, Streptococcus pneumoniae; double-stranded, circular
  misc_feature (B) LOCATION 1...219
  hypothetical: NO
  anti-sense: NO
atcggagctcacttccttactaagcaagctggtggctctggtgttctacctggtggtgtaccaggtgttccaaaaggaaaagtaactatcatcggtgatggtgtcgtcggtacacatgctgcccgcatcgcccttggtcttggtgctcaagtgactattttagatattagtgccaagcgtctctcagttctaaaagaagtctttggaagtcaaatttaa

SEQ ID NO: 663 - DNA (genomic), 192 bp, Streptococcus pneumoniae; double-stranded, circular
  misc_feature (B) LOCATION 1...192
  hypothetical: NO
  anti-sense: NO
tgtttggctcagatttccatccttcattttgatttcctatctattgacaagcatagtcacactgtctttaatactcttcgaaaatctcttcaaaccacgttagctctatctgcaacctcaaaacagtgttttgagcaacttgcggctagcttcctagtttgctctttgattttcattgagtataaggtatga

SEQ ID NO: 664 - DNA (genomic), 423 bp, Streptococcus pneumoniae; double-stranded, circular
  misc_feature (B) LOCATION 1...423
  hypothetical: NO
  anti-sense: NO
cctatggctcagttaactgtccagatcgtgacaccagatggtctcgtctatgatcaccatgccagctatgtatcggttcgaactctggatggtgagatggggatcttgccacgacatgaaaatatgattgcggttttagcagttgatgaagtaaaggtaaaacgtatcgatgataaagatcacgtgaactggattgcagtaaacggtggcgttattgaaattgccaatgatatgatcacaatcgtcgctgactctgcagaacgtgctcgtgatatcgatatcagtcgtgcagaacgtgccaaacttcgtgcagaacgtgcaattgaagaagcacaagacaaacatttgattgaccaagaacgtcgtgctaagattgctttgcaacgtgccattaaccgtattaatgtcggaaatagactataa

SEQ ID NO: 665 - DNA (genomic), 675 bp, Streptococcus pneumoniae; double-stranded, circular
  misc_feature (B) LOCATION 1...675
  hypothetical: NO
  anti-sense: NO
cagatttatcatcttggacagcctattttcaggagttttggacaatttttcaatggtgtcctctttactctggccctagcgattggatcctttatcctcgccatggtcttaggaatcttctttggtgccaggtcaaccagtaaacgtccaattttacgcattttagctcgcatcttcgtggaattttaccaaaacactcccctcttggtgcagtttgttattgttttttatggcctacctcttatcagtgaccacatcatcatgattccaatttattggacagccgttctctgcgtgggactctatcacggcgcttatatcgctgaggttattcgttcagggattcagtctattcctagtggtcagatggaggccgccttgtcgcaaggttttacctatatcagtgccatgcgcttgattatcttgcctcaggccttccgcatcattctccctccattgaccaaccaaattgttaacctcatcaagaacacatctactgtagctatcatctctggagtagacttgatgtttgtgactaagtcttggtcggctctcaacggaaactatatcccagcctttttaggtgctgctcttctctactttgccctatgcttccctgttgcccagtttggtcgcaagatggagcaagccaataaaaaagcctattcactttag

SEQ ID NO: 666 - DNA (genomic), 186 bp, Streptococcus pneumoniae; double-stranded, circular
  misc_feature (B) LOCATION 1...186
  hypothetical: NO
  anti-sense: NO
aaagcttatcaaggtagaaaaattgggagccaattgcttgctactttagagagtgagctcgctaaaaaagttggttatctgcaggtcaaaacagtggcagaaggttctaataaagattatgatcgaacaaatgacttttatcgaggtcttggctttaaaaagttagagatttgtcttcaactatga

SEQ ID NO: 667 - DNA (genomic), 654 bp, Streptococcus pneumoniae; double-stranded, circular
  misc_feature (B) LOCATION 1...654
  hypothetical: NO
  anti-sense: NO
aaagaagatcttatgaaaatcgcattaatcaatgaaaatagtcaagctagcaagaatcacattatttacgatagtctaaaagaagcgacagataaaaaaggctaccaattatttaactatggtatgcgtggagaagaaggagaaagtcaattaacttatgtgcagaacggactaatggctgccatccttttaaatacaaaggcagttgactttgttgttaccggctgtggtacgggtgtaggggctatgcttgctttaaacagcttccctggtgttgtctgtggtctagcagtggacccaactgacgcttacctttattctcaaatcaatggtggtaacgccttgtctatcccttatgccaaaggatttggctggggggcagaactgaccctcaaattgatgtttgaacgcttatttgctgaagaaatgggcggtggctacccaagagaacgtgtaatccctgaacaacgcaacgctcgtatcttaaacgaggtgaaacaaatcacccacaatgatttgatgaccatccttaaaataatcgaccaagacttcctcaaagacaccatctctggcaaatacttccaagaatacttctttgaaaactgccaagatgatgaagttgctgcttatttgaaagaagtattagccaagtaa

SEQ ID NO: 668 - DNA (genomic), 267 bp, Streptococcus pneumoniae; double-stranded, circular
  misc_feature (B) LOCATION 1...267
  hypothetical: NO
  anti-sense: NO
tataattatcaaaagacaaaaggagttcacctcatggtagaattgaatcttaaaaatatttacaaaaaatatccaaacagcgaacactattcagttgaagatttcaacttgaacatcaaagataaagaatttatcgttttcgtaggaccttcaggatgtggtaaatcaactacactccgtatgattgctggtcttgaagacatcacagaaggtactgcatctatcgatggcgtggttgtcaacgacgtagctccaaaagaccagtga

SEQ ID NO: 669 - DNA (genomic), 342 bp, Streptococcus pneumoniae; double-stranded, circular
  misc_feature (B) LOCATION 1...342
  hypothetical: NO
  anti-sense: NO
aataactatcaaaaaacaaggaagaaaattatgtcattaacatcaaaacaacgtgccttcctcaacagccaggcacacaccctcaaacctatcatccaaatcgggaaaaatggactcaacgaccaaatcaaaaccagcgtccgtcaagctcttgatgcgcgtgaattaatcaaggttactctcttacaaaacacagatgaaaacatccacgaagtagctgaaattttggaagaagaaatcggtgtggatacagtccaaaaaataggacgcatcttgattttgtttaaacaatctagcaagaaagaaaatcgcaagatttctaagaaagtcaaagaaatctaa

SEQ ID NO: 670 - DNA (genomic), 1422 bp, Streptococcus pneumoniae; double-stranded, circular
  misc_feature (B) LOCATION 1...1422
  hypothetical: NO
  anti-sense: NO
tcattgtatcacaaaaggggagattgggataggatggaagtcaaagctgttttttttgatatcgatggaaccttggtcaacaatcgcaagagtgttttgaaatccactaaggatgcgattaagattgtcaaagaacaaggggtactagttggcgtagcgacagggcgaggacctttttttgttaaggaattgatggacgatttggatctggattttgcggtaacctataatggccagtatatctttagtaaagacagagtcttgttcacgagccctatttccaagttacatttgcgccatctaattagctatgctaaaaaagagggcacggagattgccctagggaccaaggatgccatgttgggttctaaaatcatgtcctttggtctgggttctttttcccaacgaattagtcgcttcgttccctctgttttaactcggacggtgagtcagtcttttaatcgcatggtcagcaaggttgttccccaaaaggaagaggacctgcttcacctgatgaatcagcctatctaccaagttttgatgctgatgacaccagaagaatctgagaaggcggcagctgattttgaagacttgaaattgacacgtagcaatccttttgcatcggatgtcatcaatcagggaaattctaaattagaaggcattcgccgagttgggaaagaatatggctttgacctcaatcaagtcatggcttttggtgactcagataatgaccttgaaatgctggctggcgtcggtatgtcggtcgctatgggaaatggtagtagcagtgtcaaggaagctgccaagcacattaccactagcaatcaacaagatgggatccacaaggccttggaacattttggtgttttgtcttcagaaaaagtctttgtcagccgtgactatcatttcaataaggtcaagaccttccaccacatgatggatgaacgaacccaagaagaacctcgagcttgggatttagagggtgcaacccatagggctggttttaaaatagaagaattggtggagtttgttcgagcagccagtccttctgaagaagattttggtcaaggtgtatggcaatttcatcaggcccttgataaggcagcagataaagtagccaagaagacacctgctcagcaagatttgatagggcaagtggatgccttgattgacacgctttacttcacgtacggcagttttgtcttgatgggggtggacccagaacgtatttttgatattgtccatcaggccaatatggggaaaatttttccagatggcaaggctcattttgatccagtgacccataaaatcttaaaaccagataattgggaagaaaaatatgctccagaacctgctattaaaaaggaactgcagcgccagctcaaggcttacgaacgccataaagagagaaataaatcgtaa

SEQ ID NO: 671 - DNA (genomic), 714 bp, Streptococcus pneumoniae; double-stranded, circular
  misc_feature (B) LOCATION 1...714
  hypothetical: NO
  anti-sense: NO
agggtggatctgatggcttatattgagatgaaacactgttacaagcgttatcaggttggggacacggagattgtggctaatcgtgatgtgaattttgagattgaaaagggggagctggttattatccttggtgcttcaggtgcaggcaagtcaacagttctcaaccttcttgggggaatggataccaatgatgaaggggaaatctggattgatggtgttaatattgcggattatagttcccaccagcgcaccaattaccgtagaaatgatgtggggtttgtttttcagttttataatctagtttctaatctgacagctaaggaaaatgtggaactggcttctgaaattgtgacagatgccttgaatcctgatcaggtcttgacagatgtaggtctggctcatcgtctaaataactttccagcccagctttctggaggggagcaacagcgagtctccattgcacgcgcggtagccaaaaatcctaaaattcttctttgtgatgaacctactggagccttggattatcagacgggcaagcaggttttgaaaattctccaagatatgtctcgtcaaaagggagcgacggtgatcatcgtgactcataatggagctttggcgcccattgctgatcgcgtgattcatatgcacgatgccagtgtcaaggatgtggtgctcaaccagcatcctcaggatattgacagtttggagtactag

SEQ ID NO: 672 - DNA (genomic), 567 bp, Streptococcus pneumoniae; double-stranded, circular
  misc_feature (B) LOCATION 1...567
  hypothetical: NO
  anti-sense: NO
aacgtcaatcagccttggtcgtctttagtggtggtcaagattcaacaacctgccttttctcgggcccacggcagtatgaaacagtcgaagctgtcacctttggcctacggcaacatcatcacctcgaaattcaaattgctagagaaatcgccaaggaacaggggcattcgtcacccatatcctcgatatgtctctgctgggacaaatcactgctcaaccacgactttgcgacgatttcatatttcctacatttctgacaagctctgtgtcgagtcaaaatctctcaaactatatctatttagctaccgaaatcacggagatttccacgaaaactgtatcaacaccatcgggaaagacttggtcaacttggtagaccttcgctatttagaaatcgggggaaatttattccgcgcggtggcatgtcaatcgacccctattacaattacggtaagcaaggaaataagtatgaggncttggcagaacaacgcgttttccaacacgacgtttatccagagaaaattgacaaccgctaaagtcatactcaatgaaaatcaaagagcaaactag

SEQ ID NO: 673 - DNA (genomic), 831 bp, Streptococcus pneumoniae; double-stranded, circular
  misc_feature (B) LOCATION 1...831
  hypothetical: NO
  anti-sense: NO
aaggaaaatcatcttatgagtaaatacctgctaaaacttctcgtttattgtttttcagctttaacctttggctctctctttttaatcattggttttatcctcatcaaaggcttacctcatctaagtctatccctcttttcttggacttatacttctgagaacatttcccttatgccagcgattatttccaccgttattctggtttttggtgctcttcttttagccttgcccatagggatttttgctggtttttatcttgtggaatatacaaaaaaagattccctttgtgttaaaatcatgcgattggcctcagataccttgtctgggattccttccattgtttttggtctgtttggcatgctcttctttgtagtcttcttaggttttcaatactctctgttatcaggaatcttaacctcagttatcatggtgttgccagtcattattcgctcaacagaagaagcccttttatctgttagtgatagcatgcgtcaagcaagttatggacttggggcaggtaagttacggactgtttttagaattgttctaccagttgccatgccaggtattttagctggagtgatactagctattggccgtatcgttggtgaaacagctgccctcatgtatacattaggtacctctaccaatacgccaagtagtctcatgtcttcaggtcgttctctagccctgcatatgtatatgctgtcaagtgaggggctacatgtcaatgaagcctatgctaccggtgtgattttgattattactgttttaatgataaatactctatcaagcttattatctcggaaacttgtgaaaggagcttcctag

SEQ ID NO: 674 - DNA (genomic), 198 bp, Streptococcus pneumoniae; double-stranded, circular
  misc_feature (B) LOCATION 1...198
  hypothetical: NO
  anti-sense: NO
aggttgcgtcaaaacttctctggctattttttccacaccttcatagaggcttgggggcagaacgtctttcataaagcccaaaaattctcccacaggaatctgaaaataggggaggatattgaccaccaccaaaagcagggggaaaatcgaaatcaaccaatagtaggctactgcgacactggtcaactcactatctga

SEQ ID NO: 675 - DNA (genomic), 192 bp, Streptococcus pneumoniae; double-stranded, circular
  misc_feature (B) LOCATION 1...192
  hypothetical: NO
  anti-sense: NO
tgccggcgtcagtcagttttagcaggttcaaaactaggaagggcaattgaatacagcctcaagtatgaagaaacctttaagactattttgaaagacggacatctggtcctttccaataatctagctgaacgcgccattaaatcattggttatgggacggagtaaaagaattcagtggactcttttagcctaa

SEQ ID NO: 676 - DNA (genomic), 972 bp, Streptococcus pneumoniae; double-stranded, circular
  misc_feature (B) LOCATION 1...972
  hypothetical: NO
  anti-sense: NO
ccactttgtcttgttcctgcttgtcctgttgggctttctagctaccagtacagtcaactcttacaacattttcctgaaaatcattggcctatccttttgtttgtaggaattacgtctgttttacttttactttggggaggaattgccacctatatggaggctccagacaagctctttctcttagttggagaagaggaaatcaagctccatctcaagcgtcaaactggcatttccctagtcttttggctctttgtacagacccttttcttgctgttatttgcgcccttgtttttagcaatgggttatggcttgccagtttttctgctctatgtgcttttattgggggtaggaaaatatttccactttcgtcaaaaggccagcaaatttttcactgaaactggactggactgggactatcttatttctcaagaaagcaagcgtaagcaagtcttgcttcgtttctttgccctctttacgcaggtcaagggaatttcaaacagtgtcaagcgtcgtgcctatctggactttatcttaaaggctgttcagaaggtgcctgggaagatttggcaaaatctctatctgcgttcttatctgcgaaatggcgacctctttgctctcagtcttcgtcttctcttactttccgtactggcgcaggtttttatcgagcaagcttggattgcgacagcagtggtagttctctttaactacctcttgctcttccagttgctggccctctatcatgcctttgactaccagtatttgacccaactctttccgctggacaaggggcaaaaggaaaaaggcttacaggaggtagttcgaggattgaccagttttgttttacttgtggaagtagttgttgggttgattaccttccaagaaaaactagcccttctagccttactaggagctggtttggttttactagtcttgtatttgccttatcaggtaaaacgtcagatgcaggactaa

SEQ ID NO: 677 - DNA (genomic), 207 bp, Streptococcus pneumoniae; double-stranded, circular
  misc_feature (B) LOCATION 1...207
  hypothetical: NO
  anti-sense: NO
caagaattccagtttatctggagtttccaacatcatttcttcccaagtgtagccggtccaggaccagatgtccttgtctggcaattccttccgaatccgcttaacaagtggcaagagaatcccagtattaagaaaaggctcccctcccaacaaagtcaaaccttgaacatagggctgagcaagatctgccatgatctgctcttctaa

SEQ ID NO: 678 - DNA (genomic), 720 bp, Streptococcus pneumoniae; double-stranded, circular
  misc_feature (B) LOCATION 1...720
  hypothetical: NO
  anti-sense: NO
acaaaaatccagaagaagctaaagcattcgttgaagcagttgcatcaaaacttccttcatcagatcttgttgaagcaggtatcgctgctcacagctcttgatttgacaactgttcttgctgttgcaaaaggctcaaaccttaaagttgctgctcaaaactgctactttgaaaatgcaggtgctttcactggtgaaactagcccacaagttttgaaagaaatcggtactgactacgttgttatcggtcactcagaacgccgtgactacttccatgaaactgacgaagatatcaacaaaaaagcaaaagcaatctttgcgaacggtatgcttccaatcatctgttgtggtgaatcacttgaaacttacgaagctggtaaagctgctgaattcgtaggtgctcaagtatctgctgcattggctggattgactgctgaacaagttgctgcctcagttatcgcttatgagccaatctgggctatcggtactggtaaatcagcttcacaagacgatgcacaaaaaatgtgtaaagttgttcgtgacgttgtagctgctgactttggtcaagaagtcgcagacaaagttcgtgttcaatacggtggttctgttaaacctgaaaatgttgcttcatacatggcttgcccagacgttgacggtgcccttgtaggtggtgcgtcacttgaagctgaaagcttcttggctttgcttgactttgtaaaataa

SEQ ID NO: 679 - DNA (genomic), 708 bp, Streptococcus pneumoniae; double-stranded, circular
  misc_feature (B) LOCATION 1...708
  hypothetical: NO
  anti-sense: NO
aggagaatccatctaatggtaaaattggtttttgctcgccacggtgagtctgaatggaacaaagctaaccttttcactggttgggctgatgttgatttgtctgaaaaaggtacacaacaagcgattgacgctggtaaattgatcaaagaagctggtatcgaatttgaccaagcttacacttcagtattgaaacgtgctatcaaaacaactaacttggctcttgaagcttctgaccaattatgggttccagttgaaaaatcatggcgcttgaacgaacgtcactacggtggtttgactggtaaaaacaaagctgaagctgctgaacaatttggtgatgagcaagttcacatctggcgtcgttcatacgatgtattgcctccaaatatggaccgtgatgatgagcactcagctcacacagaccgtcgttatgcttcacttgacgactcagtaatcccagatgctgaaaacttgaaagtgactttggaacgtgcttttccattctgggaagataaaatcgctccagcttttaaagatggtaaaaacgtattcgtaggagctcacggtaactcaatccgtgcccttgtaaaacacatcaaaggtttgtcagatgatgagatcatggacgtggaaatccctaacttcccaccattggtattcgaattcgatgaaaaattgaacgttgtttctgaatactaccttggaaaataa

SEQ ID NO: 680 - DNA (genomic), 861 bp, Streptococcus pneumoniae; double-stranded, circular
  misc_feature (B) LOCATION 1...861
  hypothetical: NO
  anti-sense: NO
agaatgatccaaatcggcaagatttttgccggacgctatcggattgtcaaacagattggtcgaggaggcatggcggatgtctacctagccaaagacttaatcttagatggggaagaagtggcagtgaaggttctgaggaccaactaccagacggacccgatagctgtagctcgttttcagcgtgaagcgagagctatggcagatctagaccatcctcatatcgttcggataacagatattggcgaggaagacggtcaacagtatcttgcaatggagtatgttgctggactagacctcaaacgctatatcaaggaacattatcctctttctaatgaagaagcagtccgtatcatgggacaaattctcttggctatgcgcttggcccatactcgaggaattgttcacagggacttgaaacctcaaaatatccttttgacaccagatgggacggccaaggtcacagactttgggattgctgtagcctttgcagagacaagtctgacccagactaactcgatgttgggctcagttcattacttgtcaccagagcaggcgcgtggttcgaaggcgactgtgcagagtgatatctatgccatggggattattttctatgagatgttgacaggccatatcccttatgacggggatagcgcggtgaccattgccctccagcatttccagaaacccctgccgtccgttattgcagaaaatccatctgtacctcaggctttagaaaatgttattatcaaggcaactgctaaaaagttgaccaatcgctaccgctcggtttcagagatgtatgtggacttgtctagtagcttgtcctacaatcgtagaaatgaaagtaagttaatcttttga

SEQ ID NO: 681 - DNA (genomic), 1089 bp, Streptococcus pneumoniae; double-stranded, circular
  misc_feature (B) LOCATION 1...1089
  hypothetical: NO
  anti-sense: NO
gcgttttcccatgtaaacattaataccaaatctcttgtggaattgctgcacatcatagaatgttttcataagactcattttaccaaaatttcgtgtttttttcaagaagagactcacacaatgctccttattttcctatcttctttagcgattctaaggcaagtatggtacaataaaaacatgagaattcaacaattacattatattatcaaaatcgtcgaaactggctccatgaatgaggcagccaagcaactctttatcactcagccaagtctctccaatgcagtgcgagatttggaaaatgaaatgggcattgagatctttatccgcaatcccaagggaatcaccttgacccgtgatgggatggagtttctctcttatgcccgtcaggttgtcgagcagacccagcttctggaggaacgctataaaaatcctgtcgcccaccgcgaactctttagcgtttcgtctcaacactatgcctttgtggtcaatgcctttgtctctttgctcaagaaaagcgatatggagaaatacgaactcttccttcgtgaaactcggacttgggagattatcgacgacgtcaagaacttccgcagtgaggtcggggtcctcttcttaaacagttacaaccgtgatgttttaaccaagatgctggatgacaatcacctgctagcccaccatctcttcacagcgcaaccgcatatctttgtcagcaagaccaaccctctggcaaagaaagacaaggtgaaactgtctgatttggagaatttcccttacctcagctatgaccaagggacgcacaactccttctacttttcagaagagattctttctcaagaacaccacaagaaatccattgtggtcagtgaccgtgccaccctctttaatctcttgattggtttggatggttataccattgcgacagggattttgaacagcaacctaaacggagacaatatcgtttctatcccactggatattgatgacccgattgagctggtctatatccagcatgagaaaaccagcctatctaagatgggcgaacgctttatcgactatctactagaagaagttcagtttgatagttga

SEQ ID NO: 682 - DNA (genomic), 228 bp, Streptococcus pneumoniae; double-stranded, circular
  misc_feature (B) LOCATION 1...228
  hypothetical: NO
  anti-sense: NO
ctctattcccagattagaccgagattctggcgttttgctttacaaattctcctatgggatagcctgatgattctctccttggtgtctttaagtgatattccacttttccttcagggaactctcctcatcctaggacatctcatcccttcctatcgcatctgccaaagcctgaaaagagacttcccccaagcatatcaagaaccgatttctttttggagtattttatga

SEQ ID NO: 683 - DNA (genomic), 216 bp, Streptococcus pneumoniae; double-stranded, circular
  misc_feature (B) LOCATION 1...216
  hypothetical: NO
  anti-sense: NO
gaacgttcccagctaagacttttgaagagctatttcagggagttttcgctttggattgggaaaattatttaccacttggagctcggttcccgatttcaaaagctaaatgtgttaagtccaaacttcacaatgagcccagtgttcaggctatttctaagaaagctgttgtcaagaaattgcagaaacactatgctcgcccagaaggggttcctctga

SEQ ID NO: 684 - DNA (genomic), 189 bp, Streptococcus pneumoniae; double-stranded, circular
  misc_feature (B) LOCATION 1...189
  hypothetical: NO
  anti-sense: NO
gtcagctcccagtttgccatcatagctgtatgtctcatctttcaggcgccagcttgttttggtagtgaattggtcggaattgtagctaacagtataaggatgttttgtgtcagagaaatctccgctgtaggtcactttcttaccagcttcatcgattgcaacatcggtaatagttaccttgtttcctag

SEQ ID NO: 685 - DNA (genomic), 759 bp, Streptococcus pneumoniae; double-stranded, circular
  misc_feature (B) LOCATION 1...759
  hypothetical: NO
  anti-sense: NO
ctattgtgtcttctgactattttttggtataatagtagagaaaaaggtgaacatatgaaaaaaatactaattgtagatgatgagaaaccaatctcggatattatcaagtttaatatgaccaaggaaggttatgaagttgtaactgcttttaatggtcgtgaagcgctagagcaatttgaagcagagcaaccagatattattattctggatttgatgcttccagaaattgatggtttagaagttgctaagaccattcgtaagacaagcagtgtgcccattcttatgctttcagccaaagatagtgaatttgataaggttatcggtttggaacttggggcagatgactatgtaacgaaacccttctccaatcgtgagttgcaggcgcgtgttaaagctcttctgcgtcgttctcaacctatgccagtagatggtcaggaagcagatagtaaacctcaacctatccaaattggggatttagaaattgttccagacgcctacgtggctaaaaaatatggcgaagaactagacttaacccatcgtgaatttgagcttttgtatcatttagcatcgcatacaggtcaagtcatcacgcgcgaacacttgcttgagactgtctggggttatgactattttggtgatgtccgcacagttgatgtgactgtacgacgtctgcgtgagaagattgaagatacgcccagccgaccagagtatatcttgacgcgccgtggtgtagggtattacatgagaaataatgcttga

SEQ ID NO: 686 - DNA (genomic), 1104 bp, Streptococcus pneumoniae; double-stranded, circular
  misc_feature (B) LOCATION 1...1104
  hypothetical: NO
  anti-sense: NO
aacgtcgcccaggtgatatcgctgcctgctactcagacccagcaaaagctaaagcagaactcggttgggaagcagaactcgacatcacccaaatgtgtgaagacgcatggcgttggcaaagcaagcatccaaatggatttgaagactaagatgatgatttcaatcatcgtcccttgtttaaacgaagaggaagtacttcctcttttttatcaggctctggaagctttacttccagatttggaaacagaaatcgagtatgtctttgtcgatgatggatcaagtgatgggaccttggaactcttaaaggcctatcgggagcaaaatccggcagtccattatatttctttctctcgaaattttggcaaagaagcagccctttatgcaggcttgcaatatgcgacaggagatttggtggtggtgatggatgcagacctccaagatcctcctagtatgttgtttgagatgaaaaatgtactagacaaaaatgtagacttggactgcgttgggacacggagaactagtcgggagggagaacccttctttcgcagtttctgtgctgttctcttttatcgcctcatgcaaaaaatcagcccagtagctctgccgtcgggtgtccgtgactttcgtatgatgagaaggtctgtggtcgatgccattttaagcttgactgagtccaatcgtttttctaagggactctttgcctgggtcggctttaaaacccactatctggactatccaaatgtcgaaaggcaggctggcaagaccagttggagttttaggcaactctttttttactccattgaagggattgttaatttttcagatttccctttgactatagcctttgtagctggtctcctatcttgttttctttctctgctgatgaccttttttgttgtggttcggaccctcattttgggcaatccgacatctggttggacctctctgatggctgttattctctttcttggaggcattcaactcttgaccattgggattctcggtaagtatatcagtaagatttatttagagactaaaaaaagaccactttatcttatcaaagaaaaaagtgatgataggctaaaaaagatagaatttatctga

SEQ ID NO: 687 - DNA (genomic), 726 bp, Streptococcus pneumoniae; double-stranded, circular
  misc_feature (B) LOCATION 1...726
  hypothetical: NO
  anti-sense: NO
cgtgtttaccaatccaaaagatcagcgcacagaagactatatttcaggacggttcggataaggaaggaaaaacctatgagaaatcaatttgacttagaattgcatgaattagaacaatcctttttaggactagggcaacttgtccttgaaacagcttcaaaagccttactggccttagcctccaaagacaaggagatggcagagctaattatcaataaggatcatgctatcaaccaaggtcaaagcgctatcgaattggcctgtgcccgtttgttagccttgcagcagccacaagtgtctgaccttcgatttgtaattagcatcatgtcttcttgttcagaccttgaacgtatgggagaccatatggcaggcattgccaaagctgttttgcaactaaaagaaaatcaactagcccctgacgaagaacagttacaccaaatgggtaaattatccctcagcatgctagccgatttattggttgcctttcctttgcaccaagcctcaaaagctattagtattgctcaaaaagatgaacagattgaccaatattattatgccttatcaaaggaaatcattggacttatgaaagaccaagaaacctcaattcccaatggaactcaatacctttatatcatagggcatctggaacgcttcgctgattacattgctaacatttgtgaacgcctagtctacctagaaacaggagaactggtggatttgaattaa

SEQ ID NO: 688 - DNA (genomic), 354 bp, Streptococcus pneumoniae; double-stranded, circular
  misc_feature (B) LOCATION 1...354
  hypothetical: NO
  anti-sense: NO
gaatcttaccatggttctagagttaccatgtactttccaacatcctctgccttgattgaatttctcatcttggctgtactggagcagggtgattcttatggttatgagattagccaaaccattaagctgatcgctaatatcaaagaatccacactctatcccattctcaaaaaattggaaggcaatagctttctgacaacctattctagagagttccaaggtcgcatgcgcaaatactactccttgacaaacggtggtatagagcagctcttgaccctaaaagatgaatggacactctatacagacaccatcaatggcatcatagaagggagtatccgccatgacaagaactga

SEQ ID NO: 689 - DNA (genomic), 1719 bp, Streptococcus pneumoniae; double-stranded, circular
  misc_feature (B) LOCATION 1...1719
  hypothetical: NO
  anti-sense: NO
atgtcttaccaagaaaattaccagaaatgggttgattttgtggagcttcctgactaccttcgtcaagatttggaaaatatggacgaaaaaactaaggaagatgccttctatacaaatcttgaatttggtactgcaggtatgcgtggcttggttggtgctggtacaaaccgtatcaacatctacgttgttcgccaagctactgaaggattggctcgtttgattgagtcaaaaggtggaaacgagaaagaacgcggtgtagcaattgcctacgatagccgtcacttctcacctgagtttgcctttgaatctgcggcagttcttgctaaacacggcatcaaatcttacgtatttgaaagccttcgtccgactccagaactatcatttgcagttcgtcatctcaactgtttcgcaggtatcatggtcacagccagccacaaccctgctccatttaacggttacaaggtttacggtgaagacggtggacaaatgcctccacacgatgcggacgctttgactacttatatccgtgcaatcgaaaacccatttgcagttgaagttgctgatgtggaaactgaaaaagcttctggcttgattgaagttatcggcgaagctgttgacgtaaaataccttaaagaggttaaggacgtaaacatcaacccagccttgattgaagaatttggtaaagacatgaagattgtctacacaccacttcatggtactggtgaaatgttggctcgtcgtgctcttgcccaagcaggatttgactctgttcaagttgttgaagcgcaagcaactgctgacccagacttctcaactgtaacatctccaaacccagaaagccaagcagcctttgcccttgctgaagaacttggtcgtcaagttggtgcagatgttcttgtcgcaactgacccagacgctgaccgtgttggtgttgaagttcttcaaaaagatggtagctacctcaacctttcaggtaaccaaatcggtgctatcatggctaaatacatcttggaagctcacaaaaacgctggaactcttcctgaaaatgccgctctctgcaaatctatcgtttcaactgacttggtaacgaaaattgctgaaagctacggcgcaactatgttcaacgtcttgacaggtttcaaatttatcgctgaaaaaatccaagaattcgaagaaaaacacaaccacacttacatgatgggatttgaagaaagcttcggttacttgattaaaccatttgtacgtgataaagatgccatccaagccgttcttgtcgttgctgaacttgctgcctactaccgttctcgtggtttgacacttgctgacggtatcgaagaaatctataaagaatatggctactacgcagaaaaaacaatctctgttactctttcaggtgtcgatggtgctgaacaaatcaaagcgattatggctaaattccgcaacaatgctccaaaagaatggaacgcaacagctatcactgtcgtagaagacttcaaggcacaaactgctactgttgctgacggtactgttacaaacttgacaactcctccaagtgatgtgttgaaatacacacttgctgacggttcatggattgccgttcgcccttcaggtacagaaccaaaaatcaagttctacattgcagttgtaggggaaaccaacgaagaatcacaagctaagattgctaacatcgaagcagaaatcaatgcatttgtaaaataa

SEQ ID NO: 690 - DNA (genomic), 447 bp, Streptococcus pneumoniae; double-stranded, circular
  misc_feature (B) LOCATION 1...447
  hypothetical: NO
  anti-sense: NO
caacgttaccaaaatatcatggtcgcaatcgatggttctaaggaagcggacttggcttttgtcaagggagttcattctgctctacgaaacgacgctaaactcaccatcgcacatgtcattgacacacgcgctctccaaagcgtatccacctttgatgctgaagtttacgaagaactccaagtcgacgctgaaagtctgatgaaagagtacgaaaaacgtgctaaagatgctggggtagcagatgttcatatcgtcattgaaatgggaaatccaaagaccctgctagcacgtactattccagatgccgaggaagtggacctcatcctcgttggcgcaactggtctcaacgcctttgaacgcctcttggtcggctcttcatctgaatacatactccgccatgctaaggtcgatttgctggttgtgagagaacaagaaaaaaccttataa

SEQ ID NO: 691 - DNA (genomic), 270 bp, Streptococcus pneumoniae; double-stranded, circular
  misc_feature (B) LOCATION 1...270
  hypothetical: NO
  anti-sense: NO
cgcctccaccagcagacaagcaggtaccgcatcatgatgttgtcatcgctgatatggataagtcttatacagaatacaagggagaatatggtggctaaaaaaaaaatcttattttttatgtggtcttttcctcttggaggtggtgcagagaagattctatcaaccattgtttcaaatctggatccagaaaagtatgatattgatattcttgaaatggagcactttgacaagggatatgaatcttttccaaagcatgtacgcattttatga

SEQ ID NO: 692 - DNA (genomic), 876 bp, Streptococcus pneumoniae; double-stranded, circular
  misc_feature (B) LOCATION 1...876
  hypothetical: NO
  anti-sense: NO
ccctaccaccagaagaaaaacgcttctacagtcatgaatttcacgcttataaattggaggattaggatgcaatatttagaaaaaaaagaaattaaagaaattcaactagccctgctggactatattgatgagacttgtaagaaatatgatattccttattttctcagttatggaaccatgcttggagccatccgccacaaaggtatgattccttgggatgatgatattgatatttccctttatcgtgaggattatgagcgtttactgaagattattgaagaagaaaatcaccctcgctacaaggttctttcctacgatacatcttcttggtacttccataatttcgcatcgattttggacacttctactgttatagaagaccatgttaagtacaagcgtcatgataccagccttttcatcgatgtcttcccaattgatcgatttacagacttgagcattgtcgacaagagctataagtatgtggcccttcgtcaactagcttacatcaaaaaatcacgagcagttcacggtgatagcaaactaaaagattttcttagattatgtagctggtacgctctccgatttgtcaatcctcgctacttttacaagaaaattgatcaactagtcaaaaatgctgtaaccaacactcctcaatatgaaggaggagttgggatcggtaaggaagggatgaaagaaatcttcccagttgatacctttaaagaactcatcttaactgagtttgagggccgtatgttgcctgttcccaaaaaatatgaccaatttttaacccagatgtatggcgattatatgacaccaccatcaaaagaaatgcaagaatggtatagtcatagtattaaagcttatcgtaaaagctga

SEQ ID NO: 693 - DNA (genomic), 876 bp, Streptococcus pneumoniae; double-stranded, circular
  misc_feature (B) LOCATION 1...876
  hypothetical: NO
  anti-sense: NO
actattaaccagttaagtaatagagaggagtttctgcaatttagaaatgaattgcaactagaaatatcaaatagaaagagagtttcgatgaaaattaataagaaataccttgttggttctgcggcagctttgattttaagtgtttgttcttacgagttgggactgtatcaagctagaacggttaaggaaaataatcgtgtttcctatatagatggaaaacaagcgacgcaaaaaacggagaatttgactcctgatgaggttagcaagcgtgaaggaatcaatgctgagcaaatcgtcatcaagataacagaccaaggctatgtcacttcacatggcgaccactatcattattacaatggtaaggttccttatgatgcgattttcagtgaagaattactcatgaaagatccaaactataagctaaaagatgaggatattgttaatgaggtcaagggtggatatgttatcaaggtagatggaaaatactatgtttaccttaaggatgctgcccacgcggataacgtccgtacaaaagaagaaatcaatcgacaaaaacaagaacatagtccacatcgtgaaaagttggactccaaaaaaaccaagtttccgttgccctggggccctttcgcaagggacgctatactacagatgatggttatatctttaatgcttctgatatcatataggatactggtgatgcttatatcgttcctcatggagatcattaccattacattcctaagaatgagttatcagctagcgagttggctgctgcagaagccttcctatctggtcggggaaatctgtcaaattcaagaacctatcgccgacaaaatagcgataacacttcaagaacaaactgggtaccttctgtaa

SEQ ID NO: 694 - DNA (genomic), 237 bp, Streptococcus pneumoniae; double-stranded, circular
  misc_feature (B) LOCATION 1...237
  hypothetical: NO
  anti-sense: NO
tacaaaaaccaagctgaagaagacaaaccgctatctgataaatatattttcgaaaaaatattaggaaaaacatatgcagccttcaaaaaagatcaaattaatgagcgtgtcgagaaattaggtaagttaaaacctattacaataaattacaacggaaaatcagaagtaattgatagtaaagaaaaattacaagagcttatgaataaagccgttaaagacgaagtggctcaaatatag

SEQ ID NO: 695 - DNA (genomic), 1174 bp, Streptococcus pneumoniae; double-stranded, circular
  misc_feature (B) LOCATION 1...1174
  hypothetical: NO
  anti-sense: NO
tgctattgccaaatccctaatagtggtatactaggtcagtattttataaatatgaaggaaatttttatggctaaaaaaggtaccctaacaggtttgctcctgtttggaatattttttggtgcggggaacttgatttttccgccttctctaggtgctctatctggagaacattttcttcctgccatcgcaggttttgtcttttcaggcgttggtatcgccgtcttgacccttattattggaacgctaaatcctaaaggatatatctacgagatttcagcgaagatagcgccttggtttgcgactctttacctctcagttctttacttgtcaatcggtccattctttgctaccccacgtactgctacaacagcttacgaagtagggattagcccccttttgtcggatgcaaataaaggacttggcttgattgtatttacggttctgtattttgcggcagcctatttgatttcgcttaatccatcaaaaatcttagaccgcattggacgtattttaacgccagtctttgcaattttgattgttatcttggtcgttctgggagctatcaaatatggtggaacaagtcctcaaactgcttcatctgcttatcaagcttctgcctttggtacaggtttcctagaaggttacaataccttggacgcccttgcctcagtggcctttatcgtaatcgcagttcaaaccttgaaacaacttggattttcaagtaagaaaaaatacatttcaactatttgggttgttggtatcgttgttgcccttgccttcagcgctctatacatcggtttaggttttcttggaaatcatttcccagtaccagctgaagcgatgaagggtggaacaccaggtgtttacatcttgtcacaagccactcaagaaatctttggctcaacagctcaactcttccttgcagctatggttaccgtaacctgcttcacaacgactgttggtttgattgtgtcaacagctgagttctttaatgagcgcttcgcacaaatcagctacaaggtttatgcgacagcctttaccttgattggatttgctattggcanatctnnnnaaaacantnnnnnnnntnnntttnttaaaaatattaattcccttgtaaaaaatgttcattnccctaaaatttacaattttccacctttacctcctttcctgt

SEQ ID NO: 696 - DNA (genomic), 675 bp, Streptococcus pneumoniae; double-stranded, circular
  misc_feature (B) LOCATION 1...675
  hypothetical: NO
  anti-sense: NO
ctggcctgccaatcgcaccgacacatgtggtttctagcattgcggagtgggattttgatgaaaactaaattgatcttttggggctctatgctctttctcctctccctctccatccttctgaccatttatctggcttggattttctatcctatggagattcagtggctaaacttaacgaatcgagtctatctaaaaccagaaaccattcaatacaattttcatatcttgatgaattatctgaccaatccttttagtcaggtcttacagatgcctgattttcgttcgtcagcagctggtctgcaccatttcgcagtggtcaagaatctctttcatttggttcagctagtagctctagtgacactgccaagtttctatgtctttgtcaataggattgtgaaaaaggactttttgtctctttatcgaaaaagtctcctggctctagtagttttacctgtaatgattggacttgggggagttttgattggttttgaccaattctttactcttttccatcaaattctctttgtgggagatgatacctggctttttgatccagccaaggatcctgttattatgattttgccagagaccttctttcttcatgccttcctcctcttttttgccctctatgaaaacttctttggctatctgtgtgtgaaaagtcgtaggaagtga

SEQ ID NO: 697 - DNA (genomic), 696 bp, Streptococcus pneumoniae; double-stranded, circular
  misc_feature (B) LOCATION 1...696
  hypothetical: NO
  anti-sense: NO
ggctcaagccagtctgtaggggatacctatatccaacattcgacaggtgttcctgacgggaaagaaggatttgcagccttctttgcagatttctttgagcgtcatccagagcgtcagattaagattgtccgcaccattgaggatggcaatctggtctttgttcatgttcatcaatatctgaatggtggagaagctcaatgggtgacgacggatactttccgtgaggatgagaatggttgtattgttgagcattgggatgtcattgactactatcgaacacctgaaaatgaccaactagatcaaatttttggagattttgaaatcaaggatttggataagaaagcagaaaataaaaagctggttcgccgtttcttgacagaaattttccaaaatggggagctagagcagtggagtgattatgtggcagacgatttgattcagcataatcatgagattggacaaggaagtgctgcttataaaaactatgtggctgaatatagtgtcacttttgactttgttttccaactcttaggacaaggaaactatgtggttagctatggtcagactcagattgatggcgttgcttatgcccagtacgatatcttccgtttagagaacgggaaaattgtggagcattgggataataaggaagtcatgcctaaggtagaagacttgactaatcgagggaagttttaa

SEQ ID NO: 698 - DNA (genomic), 498 bp, Streptococcus pneumoniae; double-stranded, circular
  misc_feature (B) LOCATION 1...498
  hypothetical: NO
  anti-sense: NO
ttttctagtctaataaaagaggcagagaatgaactccaaaggagcataagatgtacgattatcttatcgttggtgctgatctctttggcgcatagctttggctcagtttctattatcgctcacaccatccatcagaagtttaatttgaaggtacccaattatcgccaagaagaagattgggctaggatgggtttaccaatcacacgtaaggaaatctctaattggcatatcaaggcaagtcaatactatttagagtccctttataaccttttacgagaaaagttgttagaacaacctcttcttcatgcggatgaaacctcttatcgggtgctagagagtgatagccatctgacctactattggacctttttgtctgggaaagctgagaatcaagcaatcacgctgtaccatcatgatcagcgtcggagtggtttagtagtacaagaattcctaggagattattctggctatgtgcattgtgatatgttgcggcagtaa

SEQ ID NO: 699 - DNA (genomic), 576 bp, Streptococcus pneumoniae; double-stranded, circular
  misc_feature (B) LOCATION 1...576
  hypothetical: NO
  anti-sense: NO
acatatagtctaatttgtttacaaggaggaaatatgcaagaaagtaacaaacgcttaaaaacaaagcgaactattgaaaatgctatggtacaattactgatggaacagccatttgataaaatttctactgtcaaattagtagaaaaagccggaattagtcgttccagcttctatactcactataaggataagtatgatatgattgagcactatcaaagcaagctattccatacatttgaatatatttttcaaaaacatgctcatcacaaaagagacgctattttagaagtttttgaatatctagagtcagaaccacttctggctgtccttctttctgaaaatgggactaaagaaatccaaaatttcttacgaaataaacttcatatcatgcttagtacagatttacaaaagcgatttatgcaactgaatctaaataccaccgaattagaatatagtagcatctatctaactcatgcactttttggtgtctgccaaacttggattgcacatggaaaaaaagaaagttctcaagaaataacagacttccttatgaaaatgcttggtgatacaaattga

SEQ ID NO: 700 - DNA (genomic), 228 bp, Streptococcus pneumoniae; double-stranded, circular
  misc_feature (B) LOCATION 1...228
  hypothetical: NO
  anti-sense: NO
atgtttttacatcattttacagagatttacgacacttttgccccttttttgccccttttgagcaaacaaaaaaaccgcaagcctgagcctgcggtgaaagaacaatttagaaagtttcctttctatttatttaactgtaatcaagccatctggctctactgtgaactctggcttgtctgccatgctaccgtctggtttgaggtagtaccagcctgttccgtccgctga

SEQ ID NO: 701 - DNA (genomic), 198 bp, Streptococcus pneumoniae; double-stranded, circular
  misc_feature (B) LOCATION 1...198
  hypothetical: NO
  anti-sense: NO
atactcttacagaccgtgaaagaaaatgttctgcgtctacgttttggactagatgatggaaaaatgcgcacacttgaagatgtggggaaagtctttaacgtaactcgtgagcgtatccgtcagattgaagcaaaggctttgagaaaactacgccaaccaagtcgcagcaaaccgcttcgtgattttattgaagactaa

SEQ ID NO: 702 - DNA (genomic), 1035 bp, Streptococcus pneumoniae; double-stranded, circular
  misc_feature (B) LOCATION 1...1035
  hypothetical: NO
  anti-sense: NO
ataggaagtcttacaattatacttctaaaacaagtgacattgaaaagaaatcgactcaggaagcagttctcaataaaaacttccgtcaggctatcaattttgcttttgacagaacatcttatggggctcagtctgaagggaaaagaaggtgcaacaaagattttgcgtaacctagtggttcctccaaactttgtcagtatcaagggaaaagactttggtgaagttgtagcctctaagatggtcaactatggtaaggaatggcaaggtatcaactttgcggatggtcaagacccttactacaatcctgagaaagccaaggctaagtttgcggaagctaagaaagaactcgaagcaaagggtgttcaattcccaatccacttggataagactgtggaagtaacagataaagtaggcatacaaggagttagttctatcaaacaatcaattgaatctgttttaggttctgataatgtagtgattgacattcagcaattaacatcagatgagtttgacagttcaggctactttgctcaaacagctgctcagaaagactatgatttatatcatggcggttggggacctgattatcaagacccgtcaacctatctcgatatttttaatactaatagtggaggagttctacaaaatcttggactagagcctggagaagccaatgacaaggctaaggcagttggactggatgtctatactcaaatgttggaagaagctaataaagagcaagatccagccaaacgttatgagaaatatgctgatattcaagcttggttgattgatagttctttagttcttccaagtgtttcgcgtgggggaacaccatcattgagaagaaccgtaccatttgctgctgcctatggtttaaccggtacaaaaggggttgaatcatataaatacctcaaagtacaagataagattgtcacaacagacgaatatgcaaaagccagagaaaaatggttgaaagaaaaagaagaatccaataaaaaagcccaagaagaattggcaaaacatgtcaaataa

SEQ ID NO: 703 - DNA (genomic), 330 bp, Streptococcus pneumoniae; double-stranded, circular
  misc_feature (B) LOCATION 1...330
  hypothetical: NO
  anti-sense: NO
ggaggaagtcttatgatacaaccagcaagtttagaagaattggcatctttagtagaaaaagacggtaagaaggtcttcctttttgtggcggactggtgtggcgattgccgttatatctatcctgccttaccagaaattgaggagagtaatccagagtttacctttattcgagtggatagagaccagtatatagatttggccaaactctgggatgtatatggaatccctagccttgttgttctagaaaaggacaaggaaatcggtcgttttgtcaatcgcgaccgtaaaagcaagcaacaaattaacgattttttagcaggattgaaatag

SEQ ID NO: 704 - DNA (genomic), 513 bp, Streptococcus pneumoniae; double-stranded, circular
  misc_feature (B) LOCATION 1...513
  hypothetical: NO
  anti-sense: NO
aaactgttacaatgtagaaaaagaaaagaggccctcatgacttcactttatgatttttccgttttgaaccaaaacaaccaagcaactcccttggatagctatcgtggcaaagttctcttgattgtcaacactgctactggatgtggtttaacgccccagtaccagggacttcaagaactctatgaacgctatcaagatcagggcttcgaaatattggatttcccttgcaatcagtttatgggacaagcacccggcagcgcagaggaaatcaacgccttctgtagcctacattttcaaaccaccttcccacgttttgccaagattaaggtcaacggtaaggaagcagaccctctctatgtctggttaaaagaccataaatctggcccactaggaaaacgaatcgaatggaatttcgctaagtttctcattagtcgtgatgggcaagtctttgaacgcttttcttcaaaaacagacccaaaacaaattgaagaggcgatacaaactctactataa

SEQ ID NO: 705 - DNA (genomic), 996 bp, Streptococcus pneumoniae; double-stranded, circular
  misc_feature (B) LOCATION 1...996
  hypothetical: NO
  anti-sense: NO
tccttgagtctatgtgcctatgcactaaaccagcatcgtgcgcaggaaaataaggacaataatcgtgtctcttatgtggatggcagccagtcaagtcagaaaagtgaaaacttgacaccagaccaggttagccagaaagaaggaattcaggctgagcaaattgtaatcaaaattacagatcagggctatgtaacgtcacacggtgaccactatcattactataatgggaaagtaccttatgatgccctctttagtgaagaactcttgatgaaggatccaaactatcaacttaaagacgctgatattgtcaatgaagtcaagggtggttatatcatcaaggtcgatggaaaatattatgtctacctgaaagatgcagctcatgctgataatgttcgaactaaagatgaaatcaatcgtcaaaaacaagaacatgtcaaagataatgagaaggttaactctaatgttgctgtagcaaggtctcagggacgatatacgacaaatgatggttatgtctttaatccagctgatattatcgaagatacgggtaatgcttatatcgttcctcatggaggtcactatcactacattcccaaaagcgatttatctgctagtgaattagcagcagctaaagcacatctggctggaaaaaatatgcaaccgagtcagttaagctattcttcaacagctagtgacaataacacgcaatctgtagcaaaaggatcaactagcaagccagcaaataaatctgaaaatctccagagtcttttgaaggaactctatgattcacctagcgcccaacgttacagtgaatcagatggcctggtctttgaccctgctaagattatcagtcgtacaccaaatggagttgcgattccgcatggcgaccattaccactttattccttacagcaagctttctgctttagaagaaaagattgccagaataggtgcctatcagtggaactggttctacagtttctacaaatgcaaaacctaa

SEQ ID NO: 706 - DNA (genomic), 891 bp, Streptococcus pneumoniae; double-stranded, circular
  misc_feature (B) LOCATION 1...891
  hypothetical: NO
  anti-sense: NO
gttgttatacagggagtaagcatgcaaattcaaaaaagttttaaggggcagtctccctatggcaagctgtatctagtggcaacgccgattggcaatctagatgatatgacttttcgtgctatccagaccttgaaagaagtggactggattgctgctgaggatacgcgcaatacagggcttttgctcaagcattttgacatttccaccaagcagatcagttttcatgagcacaatgccaaggaaaaaattcctgatttgattggtttcttgaaagcagggcaaagtattgctcaggtctctgatgccggtttgcctagcatttcagaccctggtcatgatttggttaaggcagctattgaggaagaaattgcagttgttacagttccaggtgcctctgcaggaatttccgccttgattgccagtggtttagcgccgcagccacatatcttttacggctttttaccgagaaaatcaggccagcaaaagcaatttttcgactcgaaaaaagactatcctgaaactcagattttttatgaatcgccccatcgtgtggcagatacattggaaaatatgctagaagtctacggtgaccgctccgttgtcttggtcagggaattgaccaaaatctatgaagaataccaaagaggtacaatttctgaattgctggaaagcattgctgaaacgtctctcaagggtgaatgtcttctgattgttgaaggtgccagtcaggatgtggaagaaaaagacgaggaagacttgttcttagaaatccaagctcgtatccagcaaggtatgaagaaaaatcaagctattaaggaagtagctaagatttaccagtggaataagagtcaactctacgctgcctaccacgactgggaagaaaaacaataa

SEQ ID NO: 707 - DNA (genomic), 843 bp, Streptococcus pneumoniae; double-stranded, circular
  misc_feature (B) LOCATION 1...843
  hypothetical: NO
  anti-sense: NO
aaggagagtctcatgacggtggttaaagttgagaaattgagtaagaaaataaaagacaaggaaattttgcggaacatctcctttgaaatcaacgatggtgaatgtgttgccttaattggtccaaatggtgccggaaagacaacactcttagattgtttgcttggagataaactggtcacaagcggtcaagtatctattcaaggtttaccagtgacgagttctaagttagactatactagggcttacctccctcaagaaaatataatcgttcagaaattaaaagttaaagagttgattgctttctttcaacgtatctatccaaatcctttgagcaatcaggaaattgatcaactattgcagtttgtcaagcaacaaaaagaacagttggcagaaaaattatcaggcggtcaaaagcgtctcttttctttcatcttgaccttaattgggcgaccaaagattgtttttttagatgagcctactgcgtccatggatacctcaactcgtcaacgtttttgggaaattgtccaggagttaaaagcgcaaggagtcaccattctctattcgtcccattatattgaggaagtggaacacactgcagaccgcattttgctcttaaataagggagagttgattcgagatacgacgcctctagctatgcgtagcgaggaaatagaaaagcactttatccttcctatagcttacaaggaagtcgtagagcagtcaaatttggttgaaaactggaccctaaagcaagattctttacaagtagtcactcgagaagcagatgctttctgggaactattagcccaagcaggatgtaggatgcaaagaaatcgaagttaa

SEQ ID NO: 708 - DNA (genomic), 327 bp, Streptococcus pneumoniae; double-stranded, circular
  misc_feature (B) LOCATION 1...327
  hypothetical: NO
  anti-sense: NO
cctgaaatacagtattggcttggtcaattttcacgccaaaaagaagggagggatctccaagaaatctttgctcgctttacaaattttaacttttgtcgttgggtaacctcgcaagttgccatcgacagtagtcacaaaaaacaaagatataaagtgtgtttctcagatgcggcttatgcctgccgtttgttttttaacggttccctttcttccctccagttgaaaaactacctcaagaaacagttatctattattcgaccgaatcgaaaatattcaagaaagataaaagctcaatcggtagttgatttcatctatagagtaacataa

SEQ ID NO: 709 - DNA (genomic), 195 bp, Streptococcus pneumoniae; double-stranded, circular
  misc_feature (B) LOCATION 1...195
  hypothetical: NO
  anti-sense: NO
gctgaaatacaagaaatgagggaggatttctatgaaaaagtatcaacttctattcaaaataagtgcagtcttctcttacttatttttcgtatttggtctttctcagctgacgcttatcgtccaaaattattggcaattttcttcccagattggcaatttcgtctggattcaaaatatcttgagtttactatttag

SEQ ID NO: 710 - DNA (genomic), 519 bp, Streptococcus pneumoniae; double-stranded, circular
  misc_feature (B) LOCATION 1...519
  hypothetical: NO
  anti-sense: NO
aggagaatacacatgagcttactagatatcgcaaaatcaatcaaaaaagagggctttgacccacgcaaagacagcgccaacggtcctgcaccaatcccagctggtacttatccagtagtcctgaagaaagcaaccttcaacgtatcggacaaaggctgggaaagccttggttatcaatttgaaatccgtggcggtgattacagtggacgctctgaatttgcaacatttggcacactgactgaatggaacggtaagaaccttgactgggcagttgaacgcactatgaaattctttatcaaagccttggtccttgctggcgacagtatgcaaggaaatgaagaagacggtaaagccttggaagaggctctacaacgtaaggcagttggctcttactacaaccttgttatctctgtgactaaggggaaagatggccgtgagttccgaaactatgaccttgaagaagaagaagcacaaccgctgactgaagctgatatcgatgaagatgacctccctttctaa

SEQ ID NO: 711 - DNA (genomic), 399 bp, Streptococcus pneumoniae; double-stranded, circular
  misc_feature (B) LOCATION 1...399
  hypothetical: NO
  anti-sense: NO
agttgttcacatcttatttcaattcactatagaaggaggaaaaggatgattctcagacatctgggaattagcccgaccaatgacttggttgctaagaaaattttcagcaacccagaaatcacttgtcaatttatccgcgatatgctggacttgccagccaaaaatgtgactattttggagggaagtaacattcatgtcttgccttccatgccctactcggtgcaggatttttataccagtatagacgtcttggcggagttggataacggtactcaagtaattattgagattcaagtccatcatcagaattttttcatcaatcacttgtgggcttacctgtgcagtcaggttaatcaaaatcttgaaaaaattcatcagcgagaaggtgatactcactag

SEQ ID NO: 712 - DNA (genomic), 369 bp, Streptococcus pneumoniae; double-stranded, circular
  misc_feature (B) LOCATION 1...369
  hypothetical: NO
  anti-sense: NO
tttatctcacacaaagtggaggtgttctatcacattgtgttcacccctaagtatagacgaaaagtcatctataatcaatatagaagtagtttaggcgaaatatttcatcgcttgtgtagttataaaggtgttgaaatgatcgagggtcacttaatgccagaccatgtacacatgttagtcagtattccgtcgaggctaagtgtttcaagttttatggggtatttaaaaggcaaaagtgcactcatgatgtttgacaaacacgccaatctcaagtacaagtttgggaatcggcatttctgggcggaaggttattatgtaagtccagtagggcttaatgaagccacaattaagaaatatagtcaagattaa

SEQ ID NO: 713 - DNA (genomic), 315 bp, Streptococcus pneumoniae; double-stranded, circular
  misc_feature (B) LOCATION 1...315
  hypothetical: NO
  anti-sense: NO
gggttatcacatataactcaaaaaaagaaagaacaaaaggagagtcaaactatggcttctaaagatttccacgtagtggcagaaacaggtattcacgcacgtccagcaacattgttggtacaaactgctagcaaatttgcttcagatatcactcttgagtacaaaggtaaatcagttaaccttaaatcaattatgggtgttatgagtcttggtgttggccaaggtgctgacgtaactatctcagctgaaggtgcagatgcagatgacgctatcgctgcaatctcagaaacaatggaaaaagaaggattggcataa

SEQ ID NO: 714 - DNA (genomic), 249 bp, Streptococcus pneumoniae; double-stranded, circular
  misc_feature (B) LOCATION 1...249
  hypothetical: NO
  anti-sense: NO
ccacatggtctgcacggaaatgaaccgtcgccgctgccttggatgaataagaanaccctacccaacaatcctgctacaagcaaggatagccatggagttgctgctccaaattgttctgcaaattcaaggttaaagacaactccagaaaaggcacccataaccataattccttcaaggccaacgtttaccacaccaccacgttcagagaaaacaccaccgatacttgtaaagatgagaggtgctgagtaa

SEQ ID NO: 715 - DNA (genomic), 987 bp, Streptococcus pneumoniae; double-stranded, circular
  misc_feature (B) LOCATION 1...987
  hypothetical: NO
  anti-sense: NO
ttctttacacaatctttacatgaatcagggataaacctttacaaagacttgttagactataaatgtagtaagcctacacaagaaaaatacatagagataaaggtgattattatgaaattcaaaaaaatgcttactcttgcagccattggcttatcaggatttgggcttgttgcctgtggcaatcagtcagctgcttccaaacagtcagcttcaggaacgattgaggtgatttcacgagaaaatggctctggaacacggggtgccttcacagaaatcacagggattctcaaaaaagacggtgataaaaaaattgacaacactgccaaaacagctgtgattcaaaatagtacagaaggtgttctctcagcagttcaagggaatgctaatgctatcggctacatctccttgggatctttaacgaaatctgtcaaggctttagagattgatggtgtcaaggctagtcgagacacagttttagatggtgaataccctcttcaacgtcccttcaacattgtttggtcttctaatctttccaagctaggtcaagattttatcagctttatccactccaaacaaggtcaacaagtggtcacagataataaatttattgaagctaaaactgaaaccacagaatatacaagccaacacttatcaggcaagttgtctgttgtaggttccacttcagtatcttctttaatggaaaaattagcagaagcttataaaaaagaaaatccagaagttacgattgatattacctctaatgggtcttcagcaggtattaccgctgttaaggagaaaaccgctgatattggtatggtttctagggaattaactcctgaagaaggtaagagtctcacccatgatgctattgctttagacggtattgctgttgtggtcaataatgacaataaggcaagccaagtcagtatggctgaacttgcagacgtttttagtggcaaattaaccacctgggacaagattaaataa

SEQ ID NO: 716 - DNA (genomic), 561 bp, Streptococcus pneumoniae; double-stranded, circular
  misc_feature (B) LOCATION 1...561
  hypothetical: NO
  anti-sense: NO
ctcaggacacaccaaaagaaccaggtaacaaaaaaccatctgctccaaaaccaggtatgcaaccaagtcctcaaccagaggttaaaccgcagctggaaaaaccaaaaccagaggttaaaccgcaaccagaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcaaccagaaaaaccaaaaccagaggttaaaccgcaaccagaaaaaccaaaaccagataatagcaagccacaagcagatgataagaagccatcaactacaaataatttaa

SEQ ID NO: 717 - DNA (genomic), 435 bp, Streptococcus pneumoniae; double-stranded, circular
  misc_feature (B) LOCATION 1...435
  hypothetical: NO
  anti-sense: NO
cctaaagcacatattaagctgttagcaaatcaacaaaaacatagtgatgcaggagcaactattgaagatgaatattatgtatttatcgctgagagtaaaattgatggcaagaaggaagttattcagtgttgcatgggtgcggcaagggattttttagaactaattaatcacaaagggctacctttttttaatccgcttgtaggtgattctcatgtaaataatagacaagaatatgacaatacagggagtggaaatttacaacctgaaaagtggaatgaaactgcacagcagctttataatgctataatgtggttgattattttatggaatgctaagccggatacacctttatttatttttaaagacgaagtaattaagtataaaacatatgagccttttgaaagcagtataaaattggtatcaatcaatgagtaa

SEQ ID NO: 718 - DNA (genomic), 575 bp, Streptococcus pneumoniae; double-stranded, circular
  misc_feature (B) LOCATION 1...575
  hypothetical: NO
  anti-sense: NO
aaaatggcacatttattagaaaaaactagaaaaattacatcaattttgaaacgctcagaggagcagttgcaggatgagctcccttacaacgctattacgcgtcagttagcggatattattcattgcaatgcctgcattatcaatagtaagggacgtctgcttggctattttatgcgttataaaacaaatacagatcgcgtaaagcaattcttccaaactaagattttcccagatgactacgttcaaggggctaatatgatttacgaaacagaagcaaacttgcctgttgagcatgatatgagtattttccctgttgagagtagagatgattttccagatggcttgacgactattgcaccgattcatgtatcggggattcgccttggttctttgattatttggcgtaatgataaaaaattcgaagatgaggacttggttcttgttgagattgccagtaccgttgttgggattcagcttcttaacttccaacgtgaagaagatgagaaaaatattcgtcgtcgtactgctgtcaccatggcggtcaataccctttcttactccgaactccgtgctgt

SEQ ID NO: 719 - DNA (genomic), 576 bp, Streptococcus pneumoniae; double-stranded, circular
  misc_feature (B) LOCATION 1...576
  hypothetical: NO
  anti-sense: NO
ataatacaacaaaacaaaaaacttgtcaagcaaaaagaagaattgttttgggaatcgcttaaaaaatggtataatgaaaagaaaacgataaggagggaaaggatgcgttgtccaaaatgtggggctaccaagtcaagtgttatcgatagtcgccaagcagaagaagggaacaccattcgtagaagacgagagtgcgacgagtgccaacaccgttttacaacctacgaacgagtagaagaaagaaccttagtggttgttaaaaaagatggcacacgggaacaattctccagagataaaatctttaatgggattatccgctcagcccagaaacgtcctgtgtcaagtgatgaaatcaacatggtagtcaatcgtatcgaacagaaactccgtggtcgaaatgaaaatgaaattcaaagtgaggacattggttcactcgtcatggaggagttggctgaattggacgagattacctatgtacgttttgctagtgtctatcgtagttttaaggatgtcagtgagttagagagcttgctccaacaaatcacccagtcctctaaaaagaaaaaggaaagataa

SEQ ID NO: 720 - DNA (genomic), 2133 bp, Streptococcus pneumoniae; double-stranded, circular
  misc_feature (B) LOCATION 1...2133
  hypothetical: NO
  anti-sense: NO
ctaagtaaacaaaaagaggtaaagaatatgaataacaactttaataattttaataacatggatgatttatttaaccaattgatgggtggtatgcgaggatatagttctgaaaatcgccgttacttaattaatggacgcgaagtcacacctgaggaatttgctcactatcgtgcgactggtcaattaccaggaaatgcagaaactgatgtgcaaatgccacaacaggcatcaggtatgaaacaagatggtgtccttgcaaaactaggtcgaaacttaacagcagaagcgcgtgagggcaagttggaccctgttatcggacgaaacaaggaaattcaagaaacatctgaaatcctctcacgccgcaccaagaacaatcctgttttggtcggagatgcaggtgttggtaagacagcagttgtcgaaggtctagcgcaagccattgtgaacggagatgttcctgctgctatcaagaacaaggaaattatttctattgatatctcaggtcttgaggctggtactcaataccgtggtagctttgaagaaaatgtccaaaacttggtcaatgaagtgaaagaagcagggaatattatcctcttctttgatgaaattcaccaaattcttggtgctggtagcactggtggagacagtggttctaaagggcttgcggatattctcaagccagctctctctcgtggagaattgacagtgattggggcaacaactcaagacgaataccgtaacaccatcttgaagaatgctgctcttgctcgtcgtttcaacgaagtgaaggtcaatgctccttcagcagagaatacttttaacattcttcaaggcattcgtgacctctatcaacaacaccacaatgtcatcttgccagacgaagtcttgaaagcagcggtggattattctgttcaatacattcctcaacgtagcttgccagataaggctattgaccttgtcgatgtaacggctgctcacttggcggctcaacatccagtaacagatgtgcatgctgttgaacgagaaatcgaaacggaaaaagacaagcaagaaaaagcagttgaagcagaagattttgaagcagctctaaactataaaacacgcattgcagaattggaaaggaaaatcgaaaaccacacagaagatatgaaagtgactgcaagtgtcaacgatgtggctgaatctgtggaacgaatgacaggtatcccagtatcgcaaatgggagcttcagatatcgaacgtttgaaagatatggctcatcgcttgcaagacaaggtgattggtcaagataaggccgtagaagttgtagctcgtgctatccgtcgtaaccgtgctggttttgatgaaggaaatcgcccaatcggcagcttcctctttgtagggtctactggggttggtaagacggagcttgctaagcaattggcactcgatatgtttggaacccaggatgcgattatccgtttggatatgtctgaatacagtgaccgcacagctgtttctaagctaattggtacaacagcaggctatgtgggttatgatgacaatagcaataccttaacagaacgtgttcgtcgcaatccatactctatcattctcttggatgaaattgaaaaggctgaccctcaagttattacccttctcctccaagttctagatgatggtcgtttgacagatggtcaaggaaatacagtaaacttcaagaacactgtcattattgcgacctcaaatgctggatttggctatgaagccaacttgacagaagatgcggataaaccagaattgatggaccgtttgaaccccttcttccgtccagaactcctcaaccgctttaatgcagtcatcgagttctcacacttgactaaggaagacctttctaagattgtagatttgatgttggctgaagttaaccaaaccttggctaagaaagacattgacttggtagtcagtcaagcggctaaagattatatcacagaagaaggttacgacgaagtcatgggggttcgtcctctccgtcgagtggttgaacaagaaattcgtgataaggtgacagacttccacttggatcatttagatgctaaacatctggaagcagatatggaagatggcgttttggttattcgtgagaaagcctaa

SEQ ID NO: 721 - DNA (genomic), 366 bp, Streptococcus pneumoniae; double-stranded, circular
  misc_feature (B) LOCATION 1...366
  hypothetical: NO
  anti-sense: NO
atctacaaacacatcgctcctgtttacgtcattgctatcgtggatagtaattatttctcagatgacctggcttttcatagctttagtatgcgcgaagacacaacaggtgaggtattggcgattaccaacaatggacaggaaaaccatctggttaagatggcattcttggaattaaaaaatacagagaaaccagcaaagacaaggttcgcaagccatggttggagtttttcggcaacaagccctttacccagcaaccgcaacgagccattagccaagcaaatcaactgctggactacaagagctggtccgaggaggacaggaaaatgtttagtcaactacatatgcgagaagaacaagtcttgttag

SEQ ID NO: 722 - DNA (genomic), 525 bp, Streptococcus pneumoniae; double-stranded, circular
  misc_feature (B) LOCATION 1...525
  hypothetical: NO
  anti-sense: NO
tgctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagtaacatatatacggcaaggcgaagctga

SEQ ID NO: 723 - DNA (genomic), 708 bp, Streptococcus pneumoniae; double-stranded, circular
  misc_feature (B) LOCATION 1...708
  hypothetical: NO
  anti-sense: NO
atgacaaaacaagtcttattagtggatgatgaagaacacattctgaaattgcttgactaccatttaagtaaggaaggcttttctactcaattggtaacaaatggacggaaggccttagctttggcagaaacagaaccctttgattttatcttgcttgatatcatgttaccacaattagatggcatggaagtttgtaagcggctgagagccaaaggcgtcaaaactccaattatgatggtttctgcgaaaagtgatgaatttgataaggttttagccttggaattaggggctgatgactacctgaccaagccttttagccctagagaattgctggcgcgtgtcaaggctgtcctcaggcgaactaaaggagaacaagaaggagatgattcagataatatcgctgacgattcttggctatttgggaccttgaaagtataccctgagcgtcatgaagtctacaaggcgaataagttactgagtttgaccccaaaagaatttgaactcttgctctatcttatgaaacatcccaacatgacactgactagagagcgtcttttggaacgtatctgggggtatgactttgggcaggaaacacgtttggtggacgttcatattggtaagttgagggaaaaaattgaagacaatcctaaagcccctcaatttattcgaaccattcggggttatggttataagttcaaggagttatag

SEQ ID NO: 724 - DNA (genomic), 1245 bp, Streptococcus pneumoniae; double-stranded, circular
  misc_feature (B) LOCATION 1...1245
  hypothetical: NO
  anti-sense: NO
ctggcaaaacagtttgtgttaaaaacggaactggcgctcaacgtgttccttgaaacaatcaaagataaatacggctttactatcaaaacatttgacactggtgatttaatgaacaacagcttgagtgctggtgccatcgatgccatgatggatgacaaacctgttatcgaatatgccattaaccaaggtcaagacctccatattgaaatggatggtgaagctgtaggaagttttgctttcggtgtgaaaaaaggaagtaaatacgagcacctggttactgaatttaaccaagccttggctgaaatgaaaaaagatggtagtcttgataaaattatcaagaaatggactgcttcatcatcttcagcagtgccaactacaactactctcgcaggattaaaagctattcctgttaaggctaaatatatcattgccagcgattcttcttttgcaccttttgttttccaaaattcaagcaaccaatacactggtattgatatggaattgattaaggcaatcgctaaagaccaaggttttgaaattgaaatcaccaaccctggttttgatgctgctatcagtgctgtccaagctggtcaagccgatggtatcatcgctggtatgtctgtcaaagatgctcgtaaggcaacttttgacttctcagaatcatactacactgctaataccattcttggtgtcaaagaatcaagcaatattgcttcttatgaagatctaaaaggaaagacagtcggtgttaaaaacggaactgcttctcaaaccttcctaacagaaaatcaaagcaaatacggctacaaaatcaaaacctttgctgatggttcttcaatgtatgacagtttaaacactggtgccattgatgccgttatggatgatgaacctgttctcaaatattctatcagccaaggtcaaaaattgaaaactccaatctctggaactccaatcggtgaaacagcctttgccgttaaaaaaggagcaaatccagaactgattgaaatgttcaacaacggacttgcaaaccttaaagcaaacggtgaattccaaaagattcttgacaaatacctagctagcgaatcttcaactgcttcaacaagtactgttgacgaaacaacgctctggggcttgcttcaaaacaactacaaacaactccttagcggtcttggtatcactcttgctctagactcttatctcatttgctattgccattgtcatcggaattatcttcggtatgtttag

SEQ ID NO: 725 - DNA (genomic), 621 bp, Streptococcus pneumoniae; double-stranded, circular
  misc_feature (B) LOCATION 1...621
  hypothetical: NO
  anti-sense: NO
aaaatgaaacaagaacgatttccattggtgtcagatgacgaggtcatgttgactgaaatgccagtcatgaatctctatgatgagtctgatctgatcagtaatatcaagggtgagtatcgagataaaaattatttagaatgggctcctattactgaagaaaaaccagtaaaaccgattgaaaagcaagtcgaaaaacctaaaaaggctcctttaggggttaaaaaagaaggaaagagctatgcggaggtggcgcgtgaagaagcgcgtgcggacttgaaaaagaaacgctctgctaactacctaactcaggatttcagtcttgcgagacgtcattctcagcccagtctagttagacagggcaatcaaccgacagctcctttccaaaaggaaaatcctggtgaatttgtcaaatatagccaaaaattgacccagtctcattatatcttggcggaagaagttcattctatccctaccaagaatgaagaagtgtcagcacctgctccaaagaaaaacaattatgattttctaaagaagagccaaatctacaataaaaaaagtaaacaaacagaacaagaacgtcgggttgcccaagagttgaatctgaccagaatgacagaatag

SEQ ID NO: 726 - DNA (genomic), 477 bp, Streptococcus pneumoniae; double-stranded, circular
  misc_feature (B) LOCATION 1...477
  hypothetical: NO
  anti-sense: NO
ctgcctgaacatactttttatgtcgataatctctttgtctttacgccccttcagcaggtcaagaccatgtactatctgcctgtcgatttctatcgttatttgattgggcgtgaggaccagtctgtcaatgagcaagtgatgattaagtgcattgaccagcaactcaaggtcaatcgactcttggtagaccaacttgatttgtcccaagtgagtcatcccaaaatgcgagaatatctgctgaatcatattgaaatcacgacggtgatttccagtaccctgctcaaccgatctggaacaacggagcatctggcaaaaaaacgccaattgtggacctatattcagcagaaaaatccagaagtctttcaggctattcgtaagaccatgttgagccgtttgaccaaacattctgtcttgccagatcgcaaactgtccaatgtcgtctatcaaatcaccaaatctgtttatggatttaattaa

SEQ ID NO: 727 - DNA (genomic), 261 bp, Streptococcus pneumoniae; double-stranded, circular
  misc_feature (B) LOCATION 1...261
  hypothetical: NO
  anti-sense: NO
gtattagaacatacaatggaggtcgtcatggacaatatcatcgatgtgtcaattcctgttgcagaagtggtggacaagcatccagaagtcttggaaattctagtggagttgggttttaaaccccttgccaatcccttaatgcgcaatacagttggtcgtaaagtatcacttaaacagggttctaagctagcaggaactcctatggacaagattgtacgcacactggaagcgaatggctacgaagtgattggattagactaa

SEQ ID NO: 728 - DNA (genomic), 984 bp, Streptococcus pneumoniae; double-stranded, circular
  misc_feature (B) LOCATION 1...984
  hypothetical: NO
  anti-sense: NO
aagttggaacactcttcgagaaaacattttgtgaagattgttaaggaaccgggcttgaagggggctttgcgctcctttattcatcctgaaaagcagacctttgaagcggtcaaggatttgacctttgaggttccaaaagggcagattttaggatttatcggggcaaatggtgctgggaagtcgacaaccattaaaatgctgacaggaattttgaaaccaacatctggtttttgtcggattaacggcaagattccccaggacaatcggcaagattatgtcaaagatattggcgtagtctttggacaacgcacccagctatggtgggatttggctctgcaagagacctacactgtcttaaaagagatttatgatgtgccaaactcgctctttcataagcgcatggactttttgaatgaagtcttggatttgaaggactttatcaaggatcccgtgcggactctttcactgggacaacggatgcgggcggatattgcggcctccttgctccacaatcccaaggttctttttttagatgagccgaccattggtttggacgtttcggttaaggataatattcgtcgggcaattactcagatcaatcaagaggaagaaactaccattcttttgaccactcacgatttgagtgatattgagcaactttgtgatcggattttcatgattgacaaggggcaagagatttttgatggaacggtgagccaactcaaggagacctttggtaagatgaagactctctcttttgaactgctaccaggtcaaagtcatctcgtctctcactatgaaggtctgtctgatatgaccattgatagacaaggaaacagcctcaacattgaatttgatagttctcgctaccagtcagctgacattatcaagcaaaccctgtctgattttgaaatccgcgatttgaagatggtggatacggatattgaggatattatccgtcgcttctaccgaaaggagctctag

SEQ ID NO: 729 - DNA (genomic), 567 bp, Streptococcus pneumoniae; double-stranded, circular
  misc_feature (B) LOCATION 1...567
  hypothetical: NO
  anti-sense: NO
caagacagacaaacatctctttctcaacccaaaaatttcgcaaatcgaggaatgtcttttgaaaagatgatcaatgctaccaacgactactatttgtctcagggcttggctgttatacataagaaaccaactcctattcaaatcgtacaagtggactatccacaacgaagtcgtgccaagattgttgaagcctattttcgacaagcttcaacgacggactattctggcgtttataatggatattacatcgactttgaagtcaaggaaacaaaacaaaaacgtgcgattccgatgaaaaattttcatccacatcagattcagcatatggaacaagtccttgcccaacaaggaatctgctttgtccttcttcacttttcttctcagcaagaaacctacttattgccggcattcgatttgattcgcttctatcatcaagataagggacaaaaatcaatgccacttgaatatattcgagaatatggatatgaaatcaaggctggtgccttccctcaaattccttatctcaatgttatcaaagaacatttattaggtggtaaaacaagatga

SEQ ID NO: 730 - DNA (genomic), 375 bp, Streptococcus pneumoniae; double-stranded, circular
  misc_feature (B) LOCATION 1...375
  hypothetical: NO
  anti-sense: NO
accagcagacaaaggagaatagacatggcagaaacaaatcaaaacacagataacttactagaccttacaaaaatcacagaaccatttgagcttgcgagcgctttgcgctacatgaaagaaaatggagagttcattcgttgcaagaatgtaagcgatgacttctatatgtatcgtgacgttcaaaaacgtcctgtgatcgtaaatggccgtcgccaattcaaggatgttgaaaccgtttgggcgttcaaccagtggggtggtacaatcgcaacaatcaacgtagccgttctgttgaatcatgaattctatatcatgaaatttgatgcagagggcaatcctgactggacggttccaacggtagaacctaaagaatag

SEQ ID NO: 731 - DNA (genomic), 405 bp, Streptococcus pneumoniae; double-stranded, circular
  misc_feature (B) LOCATION 1...405
  hypothetical: NO
  anti-sense: NO
gacaagagacaagaaagaggacttgatgtgaagattcggatgcgaaatacgattcagtttgatgagcagttggaagtgattgaccagctttatgatgtggaagtgcatgaaaagggagattatagctatttactcttttataatgaggaaaaggaaaaagtagttattaaatttcatggtcaagaactggtgatgagccgattttctaatcccaagaccattatgcgctttttaaaggatagtgatagtttggcctatattcctacccctatgggcatgcaggaatttatcattcaaacgagccgttatcaagttgataggcaaaagattgagctagcttatcaactacaaaatcaagaggggcatccctttgccagctatcaattggaaattacttggggctag

SEQ ID NO: 732 - DNA (genomic), 840 bp, Streptococcus pneumoniae; double-stranded, circular
  misc_feature (B) LOCATION 1...840
  hypothetical: NO
  anti-sense: NO
cactgcggacatgaattttctggtgaaatcatagatgtcggaagcgatgttacccgtgttaaagttggtgatcgtgttgctgtggaaccaattctagctaaaaataacttagttggtgattataatttggatccaaaccttaattttgtcggtttggctgcagacggtggatttgccaaatattgtgttttagacggtgacttagtacatgtcattccagatagcttgagctatgagcaagctgctcttactgaacccgctgctgttgcagtctatgctgttcgtcaatcttctttgaaggctggcgatacagctgttgtctttggtttaggcccgattggtctattaattgtagaagctcttcgtgcagctggtgcttctaagatttatgctgttgaactatcacctgaacgtcaagcaaaagctgaagagttaggagctatcgttgtccgtccggaagaaggtgaaacagctgttgaagctattcatcgtttaacaaacggtggtgtagatgtttcttatgaagtaacgggtgtgccagtagttttaggacaagccttagctgccgtacataaagcaggtgagtgcatggtggtctctatctgggaacgagaagcaaatattaatccgaatgaatttgcaatccaagaaaagacactaaaaggaatcatcgcttatcgtcatatcttccctaaagtattagaattgatggaacaaggctacttctctgctgaaaaattagttactaagaaaattaaattggaaaatatcgtcgaagaaggctttatcgaattaactcaagataagtcacaaattaaaattttggtagaaccagaataa

SEQ ID NO: 733 - DNA (genomic), 210 bp, Streptococcus pneumoniae; double-stranded, circular
  misc_feature (B) LOCATION 1...210
  hypothetical: NO
  anti-sense: NO
gctatgttgcaggtagcattgttgatacagcaattgatgattttacgaatcaatgccggaaaaatcctcatcagtggttctgtgttcgtgtatagatatagtagtgttgtattgtataagaatttatataacttaatgacctatgcagtgatagaaactattcttttgcaaacgagtcgcttattctgttataagtttacgtgctcctag

SEQ ID NO: 734 - DNA (genomic), 981 bp, Streptococcus pneumoniae; double-stranded, circular
  misc_feature (B) LOCATION 1...981
  hypothetical: NO
  anti-sense: NO
aagctcctgcaacagactttgttgcagacttgtttggaggtagtattcatgactaatttaattgcaacttttcaggatcgttttggtgattggttgacagccctatctcaacatttgcagttgtcacttttgaccttgttactagctattttgcttgcgattcccttggctgtttatcttcgctatcatgagaagttggcggattgggtcttacagattgcagggattttccagaccatcccgtctctggccttgttgggactctttattcccttgatgggaattgggactttaccggcattgacagctctagtgatttatgcgatttttccgattttacaaaatactattactgggctgaagggaattgatccgagtcttcaagaggctgggattgcctttgggatgaccagatgggagcgtctcaagaagtttgaaattccacttgccatgcctgttatcatgtctggaattcggacggcagcggtcttgattatcggtacggctaccttggcgaccttgattggggcagggggactgggttcctttatcctgttgggaattgaccgtaataatgccagtttgattttgattggggccctttcttctgcagtgctagctattgcctttaacttcctactaaaagtaatggaaaaagcgaaattgcggacgattttctctggttttgccttggtggctttattactgggtctgtcttatagtccagcccttttggctcaaaaagagaaggaaaacttgattattgctgggaaaataggcccagaaccagaaattttggctaatatgtataaattgctgattgaagaaaataccagcatgactgcgactgttacaccgaattttgggacgacaagtttcctttatgaagctctgaaaaaaggtgatattgacatttatcctgaatttaccggtacggtgactgaaaagtttgcttcaaccatcacccaaggtgagtcatga

SEQ ID NO: 735 - DNA (genomic), 450 bp, Streptococcus pneumoniae; double-stranded, circular
  misc_feature (B) LOCATION 1...450
  hypothetical: NO
  anti-sense: NO
tataatatgcaaaagctaggaggtggtaggatgattgaaaaaatggaactgggggaattttacaaggaattacgtttggcgagaaagcttaagcagacagatgtggcttgtgagggtctaacagcttctcagttgtccaagtttgaactagggcagtctatgctgtctgcggataagttgattctagctatccaaggtataaatgtgacctttgatgagtttgggcacaagctcaacaactatcaagaatctccacatatgcgaatcggtcgaaaggttgtgaatcgctttgcccatcaggatatagctgctttagagcagctattggaggaagtcgatcaagaacagatggcgcagacctatcgtcgtttgaatgccatcgtgattaaagatgccatccattcactaaataaaagttacccattagcagagggggatagcgagttttga

SEQ ID NO: 736 - DNA (genomic), 588 bp, Streptococcus pneumoniae; double-stranded, circular
  misc_feature (B) LOCATION 1...588
  hypothetical: NO
  anti-sense: NO
aattggtcgcatcgtcaagaaagaaaacgaaagtgtcattatcaaatgaaaaaaatagcggtttttgcctctggtaatggctcaaattttcaggtgattgccgaagaatttccagtggagtttgtcttttcagaccatcgtgatgcctatgtgcttgagcgtgcaaagcagctcggcgttctgtcctatgcttttgaactcaaggagtttgagagcaagacagactacgaagcagcccttgtcgaactcttggaagaacaccagattgacttggtttgcctagcaggctacataaaaatcgttggaccaaccttattgtcggcttatgaaggtcggattgtcaacattcatccagcctacttgccagaatttccaggagctcatgggattgaggatgcttggaatgctggcgtgggtcagtctggtgtgaccattcactgggtggattcgggtgtggatacaggccaggtcatcaaacaggttcgcgtgccacgactagctgatgataccagtgacagatgtgaagctcgcatccatgaagcagagtacaggttgtatccggaagtagtgaaggctctatttacagat

SEQ ID NO: 737 - DNA (genomic), 2838 bp, Streptococcus pneumoniae; double-stranded, circular
  misc_feature (B) LOCATION 1...2838
  hypothetical: NO
  anti-sense: NO
ggcaaggcgcatgataaaattgtcatgcatggggcgcgtgcccataatttaaaaaatattgatgtggagattccgcgagacaagttggttgtcgtgactggcttgtcaggttcagggaagtccagtctggcttttgatactctctatgcggagggacaacgtcgctatgtagagagtttgtccgcctacgctcgtcagttcttgggaaatatggaaaaaccagatgtagatgccattgatggtctcagcccagctatttccatcgaccagaaaacgactagtaaaaatcctcgctcgacggtgggaacgacgactgaaatcaatgactatctgcgtctcctctacgcacgtgtggggacgccttactgtatcaacggacatggagctatcaatgcttcttctgtggagcaaatcgttgataaggttttggagttacctgaacgccagcgcttgcagatcttggctcctgtcatccgcaagaaaaaaggccaacataagagtgttatcgagaaggttcagaaagacgggtatgttcgtgttcgtgtggatggggaagtctatgatgtgaccgaagtgccagagttgtctaagagcaagcaacacaatatcgatgtcgtggttgaccgtattgttatcaaggagggcattcgtagtcgtctctttgattccattgaggctgcccttcgtattgcagaaggttatgtcattatcgacaccatggacgattcggagttgctcttctctgagcattatgcctgtccagtttgtggttttactgtcccagagttagagcctcgtctcttctctttcaatgctccttttggctcttgtagtgagtgtgacggcttgggcatcaagctggaggtggatactgatttggtagtgccagatgccagcaaaaccttacgtgagggagcgctagcaccttggaatcctatctcatccaactactatccaaacatgttagagcaggccatgaaagtctttggagtggctatggataagccttttgaggacctgtcagaagaagataagaacttgattctctatgggtcagatggtaaggaattccatttccactatgagaatgaatttggtggcgtgcgcgatatcgacattccgtttgagggagttatcaataatatcaaacgtcgttaccatgaaaccaatagcgattacactcgcactcagatgcgtctctacatgaatgagctgacctgcggaacctgtcaaggctatcgtctcaatgaccaggccttgtctgtccgtgtgggcggccagcaagggccacatattggagaaatctcagacctgtctatcgctgaccacttggacttggtgagccagttaactttgtctgaaaatgaagccatcattgctcgtcccattctcaaggaaatcaaggatcgtttgaccttccttaataatgtgggtcttaactatctaaccctgtcacgttcagcaggaaccctttcaggtggggaaagtcagcgcattcgtttggcaacccagattggttccaacctatcaggcgtcctctatatcctagacgagccgtcaatcggtcttcaccagagggacaatgaccgcctgattgccagtctgaaaaagatgcgtgacttgggcaatactcttatcgtggtggaacacgacgaagataccatgcgtgaagctgattatctgattgacgttggtcctggtgccggtgtttttggtggtgagattgttgcagcaggtacacctaagcaagtggctcgcaacagcaagtctatcacaggtcagtacttgtcaggcaaacgtgtcatcccagtaccagaagagcgccgtgtcggaaatggtcgttttattgaagtgataggagcgcgtgagaacaacttgcaaaatgtcacggctcgctttccactaggaaaatttatcgcagtgacaggtgtgtcgggttcagggaaatcgactctaatcaacagcattctcaaaaaagccattgcccagaagctcaaccgtaattcagacaaacctggtaagtttaagactattacagggattgagcatgtcgaccgtttgattgatattgaccagagccctatcggacggacgccgaggtctaacccagctacctatacaggagtttttgacgatatacgtgacctttttgctcagacaaatgaagccaagattcgaggctacaagaaggggcgcttcagtttcaacgtcaagggaggtcgctgtgaagcttgctcaggtgacgggattatcaagattgagatgcacttcttgccagatgtttatgtggcttgtgaagtttgccacggaacccgctataacagtgaaaccctagaagttcactacaaggaaaagaatatttcgcaggtcttggatatgacggtcaacgatgcggtagaatttttccaacacattccgaaaattcaacgcaaactccagaccatcaaggatgtagggctaggctatgtgaccttgggacagccagctaccaccctttctgggggagaagcccaacgtatgaagttagctagcgaactccacaaacgctcgacaggaaaatctttctacattctggatgagccgacgacagggcttcatacagaggacattgctcgcctgctcaaggttttagctcgctttgtagacgatggcaatacagtcctcgtcatcgagcacaatctggatgttatcaagacggcagaccatatcattgacttgggacctgagggcggtgtcggtggtggaaccatcatcgtaacaggaactccagaagaagtagctgccaacgaagccagctatacaggacactatttgaaaggaaagttacatcatgaataa

SEQ ID NO: 738 - DNA (genomic), 555 bp, Streptococcus pneumoniae; double-stranded, circular
  misc_feature (B) LOCATION 1...555
  hypothetical: NO
  anti-sense: NO
gagggggcgcaggcagccatgccaacggctctgggctatgtcagtatcggcctggcctgtgggactatcggtgcgccctatgtgacacctgttgagatgggcttgatgagtctctttgtttatgctgggagtgcccagtttgccatgttggcactgattgtggttcaagctcctgtggcagctattgctatgacggtttttctaatcaacttgcgtctctttttgttgagtttacacgcatcgacttatttccgtcataccagtctttggtacaatatcggtatgtctagtatcttgacagatgagacctatggcgttttgatgggtgaattggcccatacagacaaggtaaatcctatgtggatgcacggaaacaatcttaacagctatgtggcttggtttgtggggacagtagtcggaacggctctgggtggcctgctaccaaatccagaaatctttggcttggattttgccctggttgggatgtttattggtatttttgcttcgcaatttcagatgatgcaaagacggattcctgttcgcaatctgctcatt

SEQ ID NO: 739 - DNA (genomic), 1608 bp, Streptococcus pneumoniae; double-stranded, circular
  misc_feature (B) LOCATION 1...1608
  hypothetical: NO
  anti-sense: NO
aatcaccagcaggcccagatgttacgggggactgctttgctaacggctagtaactttatcagtcgcctactcggggctgtttacattatcccttggtacatctggatgggggcttatgcagctaaggcaaatggtctctttaccatgggttacactatctatgcttggttcttgttggtttcaacagcggggattccagttgcggtggccaagcaagttgccaagtataataccatgcgagaagaagagcatagctttgccctgattcggagcttcttaggctttatgacaggactaggcctggtttttgctttagtcttgtatgtctttgctccttggctagcagacttgtctggcgtgggcaaagacttgatcccaatcatgcaaagcttggcttggggagtcttgattttcccgtctatgagtgttatccgaggatttttccaagggatgaataacctcaaaccctatgccatgagccaaattgctgagcaggtcattcgtgttatctggatgctcctagcaacctttatcattatgaagctcggttcaggagattatctagcagccgttacccaatcaacctttgctgcctttgtcggtatggtagccagttttgcagtcttgatttatttccttgcccaagaaagttcactcaaaagagtctttgaaacaggagataagattaacagtaagcgtctcttggttgataccattaaggaagccattccttttatcctgacagggtctgccatccagatcttccagattttggatcagctgacctttatcaatagtatgagctggtttaccaactacagcaatgaggacttggttgtcatgttttcttatttctcagccaatcctaataaaatcacgatgattttgatttctgtaggggtttcgattgggagtgttggtttgccacttttgacggaaaactatgtcaagggggacttgaaagcggcttctcgtctcgttcaggacagtctcaccctactctttatgttcttgctaccagcaacggttggagtggttatggtaggagaacctctttatacggtcttctatggtaagccagatagtttggctctgggcttatttgtctttgcagttttgcagtctattattttaggcttgtacatggtcttgtctccaatgcttcaggccatgttccgcaaccgcaaggccgttctctattttatctatggttctattgccaagctagtcttgcaactacctaccatcgccctcttccacagttatggtcctttgatttcaacaaccattgctctcatcattcctaacgtcttgatgtatcgggatatttgtaaagtaactggtgtcaagcgcaaggtgattttgaagcgaaccattttaatcagtttgctgaccctagtcatgtttctgttaataggaaccatccagtggctgttaggatttttcttccaaccaagtggacgtttgtggagcttcttttatgtagctcttgtcggtgccatggggggtggactttatatggttatgagtctgcgtacctatttattagataaggtaataggaaaagcccaagcagatcgcctgcgagcaaaatttaagctttcgtaa

SEQ ID NO: 740 - DNA (genomic), 336 bp, Streptococcus pneumoniae; double-stranded, circular
  misc_feature (B) LOCATION 1...336
  hypothetical: NO
  anti-sense: NO
caaatgcagcaaattactgaaatcatcattgcttttgcgacaagctttttaacagtagcagtaggcggtattgtaaaagcagtaaaagattatcttttgcgtaaaggcggagagaaagcggtgatcatcgctgaaattctagctaaaaatgcagtaaatgccgtggagcaggtagctgctgaaactggctacaagggagatgaaaaactggcacaggctcgcgctaaagtccgtgctgagcttacaaaatacaatattagcatgactgacaaagacttagacaccttcgtagagtcagcagtgaagcagatgaatgacgcatggaaaggacgatag

SEQ ID NO: 741 - DNA (genomic), 660 bp, Streptococcus pneumoniae; double-stranded, circular
  misc_feature (B) LOCATION 1...660
  hypothetical: NO
  anti-sense: NO
gcacataagcaaaaattttcgcctgaaatgatggttaacaagaagcaagtgaaagttggtatttcaaccatctactactggtttcataatggtcatttaggattgacgaaggccgacatgctttatcccagaaaaaggaaaggtgtcaagaagcaagctagtccgaactttaagccggcaggtaaatctatcgaagaacgtcctgacgttattaattttcgcttggaaaatggtcattatgaaattgataccgtcctactgactaagataaaaaattattgcctgttagttttaaccgaccggcggagcagacaccaaattataaggttaattccaaataaaactgctgaatctgtcaatcaggcgcttacgttactattaggggagcatcgtattctgtccattactgcagataatggttcggagttcaaacgattgtctgaggtatttcctgaggaacatatctactacgcacatgcttactcttcatgggagagaggttcaaatgaaaatcataatcgattaattcggagatggttacctaaaggaaccaagaaaacgactccgaaagaagtagcttttatcgaaaattggattaacaactaccctaaaaaatgcttggactacaagtcgccaagtgaatttcttttgggtggctaa

SEQ ID NO: 742 - DNA (genomic), 660 bp, Streptococcus pneumoniae; double-stranded, circular
  misc_feature (B) LOCATION 1...660
  hypothetical: NO
  anti-sense: NO
gcacataagcaaaaattttcgcctgaaatgatggttaacaagaagcaagtgaaagttggtatttcaaccatctactactggtttcataatggtcatttaggattgacgaaggccgacatgctttatcccagaaaaaggaaaggtgtcaagaagcaagctagtccgaactttaagccggcaggtaaatctatcgaagaacgtcctgacgttattaatcttcgcttggaaaatggtcattatgaaattgataccgtcctactgactaagataaaaaattattgcctgttagtcttaaccgaccggcggagcagacaccaaattataaggttaattccaaataaaactgctgaatctgtcaatcaggcgcttacgttactattaggggagcatcgtattctgtccattactgcagataatggttcggagttcaaacgattgtctgaggtatttcctgaggaacatatctactacgcacatgcttactcttcatgggagagaggttcaaatgaaaatcataatcgattaattcggagatggttacctaaaggaaccaagaaaacgactccgaaagaagtagcttttatcgaaaattggattaacaactaccctaaaaaatgcttggactacaagtcgccaagtgaatttcttttgggtggctaa

SEQ ID NO: 743 - DNA (genomic), 393 bp, Streptococcus pneumoniae; double-stranded, circular
  misc_feature (B) LOCATION 1...393
  hypothetical: NO
  anti-sense: NO
tgtcacaagcacaatatgcaggtactggacgtcgtaaaaacgctgttgcacgcgttcgccttgttccaggacactgtaaaatcactgttaacaaaaaaaagagttgaagagtacatcccacacgctgaccttcgtcttgtcatcaaccaaccattcgcagttacttcaactgtaggttcatacgacgttttcgttaacgttgtaggtggtggatacgctggtcaatcaggagctatccgtcacggtatcgctcgtgcccttcttcaagtagacccagacttccgcgattcattgaaacgcgcaggacttcttacacgtgactcacgtaaagttgaacgtaagaaaccaggtcttaagaaagctcgtaaagcatcacaatttagtaaacgttaa

SEQ ID NO: 744 - DNA (genomic), 240 bp, Streptococcus pneumoniae; double-stranded, circular
  misc_feature (B) LOCATION 1...240
  hypothetical: NO
  anti-sense: NO
ctgctaaagcaaaagaaagctggttttaatataaaaatggttgatatcgctggcgctcaattagcagaccgtgttattgctgagaagaataatgcagttgcagatatggtatttggaattggtgctgttgactcaaataaaattagagatcaaaaattactagtacagtacaagcctaaatggttagataaaattgatcaatctttatcagataacgagataattattataatcctgtga

SEQ ID NO: 745 - DNA (genomic), 876 bp, Streptococcus pneumoniae; double-stranded, circular
  misc_feature (B) LOCATION 1...876
  hypothetical: NO
  anti-sense: NO
atgaaaaagcaagaaaaattagctcttgtcgagtcggctttggaagatttttatggagaccagcagtttgcctctagtttacgggagtctgttctctattctattcatgctggtggcaagcgtattcggccttttctcttgttagaagttctggaagccttgcaggttaccatcaaacctgctcacgcgcaggtagctactgccttggagatgattcatacagggagcttgattcacgatgaccttcctgctatggatgatgacgattatcgaagagggcggttaaccaatcacaagaaattcggtgaagctatggccattttggctggagatgccttattcttagactcatatgccttgattgcgcaggcagatttgccaagtcagattaaggtggacttgattgccaacttatcccttgcttcaggtagtctgggtatggtggcagggcaagttttggatatggagggcgaacaccagcacttgtctttggaagaacttcagactattcatgccaataagactgggaagttactagcctatcccttccaagcggcagctattatagctgaattgtcacctgaaatgcaggtgaagctgaaaactgtgggtgaattgattggacttgcttttcaagtcagagatgatgtactggatgtgacagctagttttgaggaaatcggcaagacacctcaaaaggatctgcaggcagaaaaatcaacctatcctgccctgttgggcttggaagagtccattgccttttgtaaccaaaccctggatcaagctaatgaaaaattagaagaaattgcccagcagattccctttgaaacagaatcgattgtaagtgtagtagaaagtttgagaatcaatggctaa

SEQ ID NO: 746 - DNA (genomic), 1281 bp, Streptococcus pneumoniae; double-stranded, circular
  misc_feature (B) LOCATION 1...1281
  hypothetical: NO
  anti-sense: NO
aggagaaagcagatgctactaatcaaaaatggtcgtgtaatggatcctaagtctggtttggatcaagtttgtgatgtcttagttcaagatgggaaaattatcaaaattgcgcctgagatcacggaagaaggagcagaaacgattgatgctactggtcttgtggttgctcctggtttggtcgatattcatgtgcatttccgtgaacctggtcaaacacataaagaagacattcatactggtgccctggcagccgctgcaggtggttttactactgtcgtcatgatggctaataccagtccaaccatttcagacgtggagactttgcaagcagttctccagtcagctgccaaagagaagattaatgtcaagacagttgcgaccattactaaaaactttaatggtaaaaacttgactgactttaaggcgctcttagaagctggtgcggttggtttctctgatgacggtattccgcttgagagcagtaagattgtcaaggaagccatggaggaagccaaaaaactcaatacctttatcagccttcatgaggaagatccaggtttgaacggtgttcttggctttaatgaaaatattgctagagaacatttccatatctgcggtgctactggggtggctgagtacgctatgatggcgcgtgatgtcatgattgcctatgcaactaaagcccatgttcacatccagcatttgtctaaggaagaaagtgttaaagtagtggagtttgctcaggggttaggtgcagaagtcacagcagaagtagcgccacagcatttctctaagacagaagcacttcttttaacacaaggtagcaatgctaagatgaatccaccgcttcgtttggaatcagaccgtcgtgccgttatcgaaggtctcaaatcaggtgtcatcacagttattgcgactgaccacgcgcctcatcatgtagatgaaaaaaatgttgaggatattaccaaagcgccatctggtatgactggcttagaaacatccctgtctctcggcttgacctatttagtagaagctggtgagttgagcttgatggaattacttgaaaaaatgacatacaacccagccaagctttacaactttgaagcaggttacttggctgagaatggtccagcagatatcactatttttgatgccaaggctgaccgccttgtggactcccattttgcttccaaagcagctaattcaccattcatcggtgaaaccttaaaagggcaggttaaatataccatctgtaagggacaaatcgtctatcaagcttga

SEQ ID NO: 747 - DNA (genomic), 834 bp, Streptococcus pneumoniae; double-stranded, circular
  misc_feature (B) LOCATION 1...834
  hypothetical: NO
  anti-sense: NO
aggaggaagcacacgatgactggatctaacaaattaacaaaacgtgattatcttaaaacgtctttgcgggcattcttttgtcaaaatggatttaactatagtaactatcaagggttgggatatgccaatgtgatgtatcctgctttgaaaaaacactatggagaggatcaggaaggtttctaccaagccttggaagaaaactgtgaattctataataccaacccacacttcctgccttttattaccagcttgcaccttgtaatgttggaaaatggccgtccggcaaaagaaacacgtagtatcaagatggccttgatgggaccattggcaggtattggggattctctttctcaattctgtttagctccattgttctcaaccatcgcagcttcgtttgctcaaaaaagcttggttgtcggtccaatcttgttcttccttgcgatgaataccattttaacagcgattaaattgtcaactggtctgtatggatacaaactaggaacaactgtgattgataaactaagcgaacagatggcaacgatttctcgtattgccaatattatcggtgtaaccgtaattgctggtttggcagggacatctgttaagattatggtgccgattacctttgctgcaggggaagttaaagcagacgctaaacaaagtatcgtaagtattcagggaatgcttgataaggttgctccagctcttctaccagccctatttacacttttagtttactacttgatcaaagaaaagaaatggacaacatataaactcgttattttaacagttatcatcggaattatcggaagctggcttaagattatagcttaa

SEQ ID NO: 748 - DNA (genomic), 1548 bp, Streptococcus pneumoniae; double-stranded, circular
  misc_feature (B) LOCATION 1...1548
  hypothetical: NO
  anti-sense: NO
aaggaagagcacatggcacacgaaaatgtcattgagatgcgtgatattaccaaggtgtttggtggatttgttgctaacgacaaaatcaacttgcacctacgaaaaggtgaaattcatgcacttttaggagaaaatggggctggtaagtccacgctaatgaacatgttagcaggccttcttgaaccaactagtggtgaaatcgcggtcaacggtcaagttgtcaatctcgactccccatctaaagcagctagcttgggaatcgggatggttcaccagcactttatgttggttgaagccttcacagtggctgaaaacatcattttaggtagtgaattgactaaaaatggtgtgctagatatcgctggagctagcaaagaaatcaaggctctttctgaacgttatggcttagctgttgacccttctgccaaggtagcagatatctcagttggagcccaacaacgtgtagaaattttaaaaacactttataggggggctgatatccttatctttgacgaaccaacggctgttttgactccatcagaaattgatgagttgatggctattatgaaaaatcttgtcaaagaaggaaaatcaattatcttgattacccacaaattggatgaaattcgcgcagtttctgaccgtgttacagttatccgtcgtgggaaatcaattgaaaccgttgaaattgcaggggctaccaatgctgatttggcggaaatgatggtaggacgttctgtttcctttaaaacagagaagcaagcctctaaaccaaaagaagtggttttgtctatcaaagatttggtggtcaatgaaaaccgtggtgttccagctgttaaaaatctgtccttggatgttcgtgctggagagattgttggtattgcggggattgatggaaatggtcagtctgaactgattcaagccattacaggtcttcgtaaggttgaatctggtagcattgagctaaaaggagattcaattgtaggcttgcacccacgtcagattacagaactaagtgttgggcacgttccagaagaccgtcaccgtgatggcttgattttggaaatgatgatatctgaaaatattgcccttcaaacctactataaagaaccacatagtaaaaatggaattttgaattattcaaatattacttcttatgctaaaaagctgatggaagagtttgatgttcgcgctgccagtgaattagttcctgcagctgcactctcaggaggaaatcaacaaaaagcaattattgctcgtgaaattgatcgagatcctgatctccttatcgttagtcagccaactcgtgggttggatgtcggtgccattgagtatatccacaaacgcttgattgaagagcgtgataatggcaaggctgtccttgttgtcagctttgaattggatgagattttaaacgtctcagaccgtattgccgttatccacgatggtaagattcaaggtattgtatcaccagaaacaaccaataaacaaggacttggtgtcttgatggctggtggaaacttgggaaaggagaagagtgatgtctaa

SEQ ID NO: 749 - DNA (genomic), 348 bp, Streptococcus pneumoniae; double-stranded, circular
  misc_feature (B) LOCATION 1...348
  hypothetical: NO
  anti-sense: NO
ctggaatggcatttgaaaaagctcttgttgtgggggttcttccctttatcattccagaccttggcaaacttctggctattagttttattagccgtcccctacttcaacgccttaaaaatcagacttactttactaactaaaaaaggataccgagttatcatgactcaatatccttttttttattttgaaaacttatactcaatgaaaatcaaagagcaaactaggaagctagccgcaggctgctcaaaacactgttttgaggttgtagatgaaactgacgaagtcagtaaccatacatacggcaaggcaaagctgatgcggtttgaagagattttcgaagagtattag

SEQ ID NO: 750 - DNA (genomic), 1434 bp, Streptococcus pneumoniae; double-stranded, circular
  misc_feature (B) LOCATION 1...1434
  hypothetical: NO
  anti-sense: NO
agtggatggcaagcttgcagccagtggtacccttacttttgcaattgggaactaaggaggttctccatgtttcgaaaaattttaattgccaatcgtggtgaaattgcggttcgtattatccgtgcggcacgtgaattggggattgcgacggtagcggtttattcaactgctgataaggaagctcttcatacgctgttggcagatgaagcagtttgtattggtcctggcaaggcaacagagtcttatctcaatattaatgcagttctatcagctgcagtcttgactgaggcagaagctattcaccctggttttggatttctcagtgaaaattccaaatttgcgaccatgtgtgaagaaataggtatcaagtttatcggtccatctggtcatgttatggatatgatgggggataaaatcaatgcgcgtgctcagatgattaaagcaggtgtgcctgttataccaggttcagatggagaagtgcataactctgaagaagctttgattgttgctgaaaaaattggctatcctgttatgctcaaggcttcagcaggtggaggtggtaaagggattcgtaaggttgaaaaaccagatgacctcgtttctgcctttgaaactgcctctagtgaggccaaggccaattatggcaatggtgccatgtacatagaacgggttatctatccagctcggcacattgaggttcaaatcctaggtgatgagcatggacatgtgattcacttgggtgaacgggattgttctcttcaaaggaataaccaaaaggttttggaagaaagtccctcgattgcaatcggaaaaacgctgcgtcatgaaataggtgctgctgctgttcgagcggcagagtttgttggctatgagaatgcaggaaccattgaatttcttcttgatgaagcaagtagcaatttctatttcatggagatgaatactcgtgttcaggtagaacatccagtaacagagtttgtttcaggtgttgatatcgttaaggaacagatttgcattgcggcaggtcagcctttgtctgttaagcaagaagatattgtcctacgcggtcatgccatcgagtgtcgtatcaatgcagaaaacccagcctttaactttgctccaagtccaggtaagattactaatctctatctgccaagtggtggagttggcttgcgcgtggattcagcagtttatccaggttataccattccgccttattatgatagtatgattgccaaaatcatagtacacggcgaaaatcgttttgacgccttgatgaaaatgcaacgtgccctctatgaattagaaattgaaggagtgcagaccaatgcagatttccagcttgacctcatttcagatcgcaatgtcattgctggggattatgatacttgcttcttgatggaaaccttcttacctaaatatcaagaaaaagaataa

SEQ ID NO: 751 - DNA (genomic), 1464 bp, Streptococcus pneumoniae; double-stranded, circular
  misc_feature (B) LOCATION 1...1464
  hypothetical: NO
  anti-sense: NO
ttgaggtggcaccgcgaatttcgtcctcacgcaagttattttgcgtggggatttttcatacagtcgctacgaactagaattagaactgaaagggaaattacaatggaacgaatcattcatggagatgtcttatcaccaatcttggcttatatgcgcttaaaggggcaacacaaggttatcttagagagtattccgagagacaaggaaacagctcgtttttctatcctagcctataatcctgtttttgagattaagtttgaaaatggagttctttatcaaaatggtcaagtgattgatcgggatcccttggatttcctttatgaagtgattcataagagtcagcaccattcagagctaccttttggtggtggagccattggttttgtgggttacgatatgatttcgctttatgaagaaattggtcaaatccctgaggatacaattgggacgccagacatgcatttctttgtctatgagagctatatagtctttgaccacaagaaggagaagatacatgtcatagaggatgcactttatagtgagcgcagtcaagaggccttggaaaaatccttgaaccaagtgcttgaggaattacgcattcctgctccaaatgaatttgaagacttggatttatcaccacttgacttcaaaccgcatatcgctccacataagtttgagggaatggtagaaacagctcgtgacttgattcgtaacggcgatatgttccaatgtgtactcagccagcgtttctcagcagaagttactggaaatccatttgacttctacagaaatctccgcgtaactaatccttctaattacctttatttctatgattttggggattatcaaatcatcggagctagtccagaaagtttggtttctgtcaaaaatggcatcgtgacaaccaatccgattgcagggacgcgaccaagaggggctacggatgaagaagacaaggccttggcgactgacctcctctctgatgagaaggaaacagcagaacatcgaatgttggtagacttggggcgtaacgatattggccgcatctctgaaacggccagtgtccaagttactaagtatatggaggtggagctcttccgctacgtcatgcatttgaccagtgtggtcaagggacgtttgcttgcagaactcactgccatggatgccttgaaagcaacgcttcctgctggaaccgtttctggagcgccaaagattcgagcgatgagacgtatctatgaactggaaacggaaaaacggggagtatacgctggggcaatcggctacttgtctgcgacgggtgatatggatttggccatcgccatccgaaccatgattctcaaaaatcaaagagcctatgtgcaggctggggcagggattgtctacgactctatcgcccaaaacgaataccaagaaaccattaacaaagcaaaatctatgactagaattggagaactaagaccatga

SEQ ID NO: 752 - DNA (genomic), 354 bp, Streptococcus pneumoniae; double-stranded, circular
  misc_feature (B) LOCATION 1...354
  hypothetical: NO
  anti-sense: NO
caagggtggcaggtcatgtttttgaagcagagtagactgaaaccttatccaatgcgacggtttgaaaagactgtcactgaggaaggtgtcgcgaaagaagggtatgccaaggaagctgagacagtccgccttgaattgtggccagctagtagcaagctacaatctgaattgtatggcgagcgtgtcaatgatattttgaacgcaaatgccaacaagtcagctactatcaaagtaaaagatggtgtgtgtatcgatagtcagacggaagtgactcatagggttatttctaaaaaggtctacacacatcatcaagttttggagttagagcgtgtcagggctactaggggcagatag

SEQ ID NO: 753 - DNA (genomic), 714 bp, Streptococcus pneumoniae; double-stranded, circular
  misc_feature (B) LOCATION 1...714
  hypothetical: NO
  anti-sense: NO
aaaagcaggcatcgtataatgcctactttttcttcaaatgctccctttaatcccaatccgatctctaagatattagtcgtatttatcacaggcttaactgttatgcatagcataaacatccgttttgagctggcaattgtttgtcttattggtattttgctttatttgaatggatacaaaaaaacacttttcaaatggattatattgtgtgggatactttactccttgcctaattttatggtgttatctgaattaaaccctatagttaagatgtttttgagtatacctattgttattagaatgtttattttaccatttatggcagcaagctttatgataaagacctcggatgtaggcgcaataatttcatcgatggataagcttaagatttcaaagaatgtatccatacctattgcggttatgtttagattcttcccatcttttaaggaggagaagaaaaacatcaaaatggctatgagagtaagagggataaattttaaaaacccagtcaaatatcttgaatatgtttctgtgccactactcattatatcatctaatatatcagatgacattgcaaaagcggcagaaacaaaggcaatagaaaatccaattgccaagaccagatacattcgcgtaaagatacagctaattgattttgtttatgttttagcggttgctggacttattgtgggaggcttaatatggttgaaataa

SEQ ID NO: 754 - DNA (genomic), 942 bp, Streptococcus pneumoniae; double-stranded, circular
  misc_feature (B) LOCATION 1...942
  hypothetical: NO
  anti-sense: NO
gaaaggaggcaaataatgtctacaatcgataaagaaaaatttcagtttgtaaaacgtgacgattttgcctctgaaactattgatgcgccagcatattcttactggaaatcagtgtttaaacaatttatgaagaaaaaatcaactgtagtcatgttgggaatcttggtagccatcattttgataagtttcatctacccaatgttttctaagtttgatttcaatgatgtcagcaaggtaaacgactttagtgttcgttatatcaagccaaatgcggagcattggttcggtactgacagtaacggtaaatcgctctttgacggtgtctggttcggagctcgtaactccatcctcatttctgtgattgcgacagtgattaacttggttatcggtgtttttgtcggtggtatttggggtatttcaaaatcagttgaccgtgtcatgatggaagtttacaacgtcatctcaaacatcccacctcttttgattgttattgtcttgacttactcaatcggagctggattctggaatctgatttttgccatgagcgtaacaacatggattggtattgccttcatgatccgtgtgcaaatcttgcgctatcgtgacttggaatacaacttggcgtcacgtactttgggaacaccaaccttgaagattgttgccaaaaatatcatgcctcaattggtatctgttattgtgacaaccatgactcaaatgcttccaagctttatctcatacgaagccttcttgtctttcttcggtcttggattaccgattacagtgccaagtttgggtcgtttgatttcggattattcacaaaacgtaacaaccaatgcttacttgttctggattccattgacaacccttgtcttggtatccttgtcccttttcgtagttggtcaaaacttagcggatgctagtgatccacgtacacatagatag

SEQ ID NO: 755 - DNA (genomic), 390 bp, Streptococcus pneumoniae; double-stranded, circular
  misc_feature (B) LOCATION 1...390
  hypothetical: NO
  anti-sense: NO
gagactgggcaaagagtcgttaaaagcaaaaacgcatactatcaggtattgaaaaaacttgatactatgcgttttattgtgggaagatttacttccttttctactgaaattgagtcttttcccaagatctttttatactcaatgaaaatcaaagtgcaaactaggaagctagccgcaggttgctcaaaacactgttttgaggttgtggatagaactgacgaagtcagctcaaaacatggttttgaggttgtagatgaaactgacgaagtcagctcaaaacatggttttgaggttgcagatgaaactgacgaagtcagctcaaaacatggttttgaggttgcagatagaactgacgaagtcagtaacatatatacggtaaggcgacgctga

SEQ ID NO: 756 - DNA (genomic), 966 bp, Streptococcus pneumoniae; double-stranded, circular
  misc_feature (B) LOCATION 1...966
  hypothetical: NO
  anti-sense: NO
aataaggggcaaagccctaataaattggaggatctaatgaaaaaattaggtacattactcgttctctttctttctgcaatcattcttgtagcatgtgctagcggaaaaaaagcaacaacttctggtcaaaaactaaaagttgttgctacaaactcaatcatcgctgatattactaaaaatattgctggtgacaaaattgaccttcatagtatcgttccgattgggcaagacccacacgaatacgaaccacttcctgaagacgttaagaaaacttctgaggctgatttgattttctataacggtatcaaccttgaaacaggtggcaatgcttggtttacaaaattggtagaaaatgccaagaaaactgaaaacaaagactacttcgcagtcagcgacggcgttgatgttatctaccttgaaggtcaaaatgaaaaaggaaaagaagacccacacgcttggcttaaccttgaaaacggtattatttttgctaaaaatatcgccaaacaattgagcgccaaagaccctaacaataaagaattctatgaaaaaaatctcaaagaatatactgataagttagacaaacttgataaagaaagtaaggataaatttaataagatccctgctgaaaagaaactcattgtaaccagcgaaggagcattcaaatacttctctaaagcctatggtgttccaagtgcctacatctgggaaatcaatactgaagaagaaggaactcctgaacaaatcaagaccttggttgaaaaacttcgccaaacaaaagttccatcactctttgtagaatcaagtgtggatgaccgtccaatgaaaactgtttctcaagacacaaacatcccaatctacgcacaaatctttactgactctatcgcagaacaaggtaaagaaggcgacagctactacagcatgatgaaatacaaccttgacaagattgctgaaggattggcaaaataa

SEQ ID NO: 757 - DNA (genomic), 741 bp, Streptococcus pneumoniae; double-stranded, circular
  misc_feature (B) LOCATION 1...741
  hypothetical: NO
  anti-sense: NO
atggcttttaaccctattgttaaatattctttggctttggtctatgatttgaggaaaaaccttaaaggattaacagtattgagtttattgattacaggtctctttttcttgaccaagtatccactggaaaatgaaatcaccatgctggatgtggggcaaggagaaagtattttcctacgggatgtaactgggaaaaccattctcatagatgtaggtggtaaggcagaatcttataagaaaatcgaaaaatggcaagaaaagatgacgaccagcaatgcccagcgaaccttgattccctatctcaaaagtcgaggagtagctaagattgaccagctaattttgactaacacggacaaggagcatgttggagatttgtcagaggtgaccaaggctttccatgtaggggagattttagtatcaaaaggcagtttgaagcagaagcaatttgtggtagaactacaggcgactaaaacaaaggtgcgtagtatgacagtaggggagaacttgcccatttttggaagtcagttagaagttctatctccaaggaaaatgggagatggaggacacgatgataccctagttctgtatgggaaattcttggataagcaatttctcttcacgggaaatttggaggagaaaggagagaaggacttgctgaagcactatccagacttgaaagtttatgttttgaaagctagccaacatggcaataaaaaatcatcaagcccagcctttntataa

SEQ ID NO: 758 - DNA (genomic), 903 bp, Streptococcus pneumoniae; double-stranded, circular
  misc_feature (B) LOCATION 1...903
  hypothetical: NO
  anti-sense: NO
aatgactttaagagtttaaaccgaaaaggggaatcaatggctctatttagtaaaaaagataagtatattcgaatcaatcccaatcgttcggttagggaaaaacctcaagctaagccagaggttccagatgaattattttcccagtgtccaggctgtaagcataccatctatcagaaggatctgggaagtgaacgtatctgtccgcactgtagctatacctttcgtatttctgcccaagaacgcttggctttgacgattgatatgggaaccttcaaagaattgtttacagggattgaaagcaaggatcccttgcatttccctggttaccaaaagaaactggcatctatgcgtgaaaaaacaggtctgcatgaagccgttgtgacaggaactgctcttattaaaggtcagactgtggctcttgggattatggattctaactttatcatggcttctatgggtacggttgtaggtgaaaaaatcactcgtttgtttgagtatgcgactgtcgaaaaattgccagttgtcctattcacagcctctggtggagcccgtatgcaggaaggaatcatgagtctcatgcagatggctaagatctctgcggcggttaaacgccattcaaatgctggtctcttttacctgaccattttgacagatccaacgactggtggtgtgacagcttctttcgctatggaaggcgatatcattctggctgaaccacagagcttggttggttttgctggacgtcgtgtgattgaaaatacggttcgtgaaagcttgcctgaggatttccaaaaggcagaattcctattagaacatggctttgtggatgctattgtcaaaagaagagacttaccagatacgattgctagcctagtcagattgcatggagggagtcctagatga

SEQ ID NO: 759 - DNA (genomic), 228 bp, Streptococcus pneumoniae; double-stranded, circular
  misc_feature (B) LOCATION 1...228
  hypothetical: NO
  anti-sense: NO
gatggctttaaatttgcgtggaagatggatattctcacaagtcttcaagagtcggagagcctgatttcgattcagaattggcataattcctgcatgaatgggaacatcaatcccagccaagatgcacttgtcctgaaaatcatagaagcgctcattgtcaaagaagagctgagttacgaggctcgaacagcctgcatccactttcttcttaagattttgaatatctga

SEQ ID NO: 760 - DNA (genomic), 618 bp, Streptococcus pneumoniae; double-stranded, circular
  misc_feature (B) LOCATION 1...618
  hypothetical: NO
  anti-sense: NO
ataatgtttaaacgaattcgaagagtgcttgtactagcagtcttcctttttgctggctataaagcttaccgcgttcatcaagatgtcaaacaagtcatgacctatcaacccatggtgcgagaaatcttgagtgaaaaagacaccccagcaaacgaagagcttgtgcttgctatgatttatactgaaacaaaaggaaaagaaggcgatgttatgcagtctagtgagtctgcaagtggttccaccaacaccatcaatgataatgcctctagcattcggcaaggcattcaaactctgacaggcaatctctatctggcgcagaagaagggggtagatatctggacagctgttcaagcctataattttggacctgcctatatcgattttatcgcccaaaatggcaaggaaaataccttggctctagccaaacagtactctcgtgagactgttgcccccttgcttggtaatacgactggaaagacttatagttatattcaccccatttccatttttcacggtgctgaactctatgtaaatggaggaaattattattattctagacaggtacgacttaacctttacatcatcaaatgtttcactctcttttcaacatctggctag

SEQ ID NO: 761 - DNA (genomic), 357 bp, Streptococcus pneumoniae; double-stranded, circular
  misc_feature (B) LOCATION 1...357
  hypothetical: NO
  anti-sense: NO
cagaatttccttacatggtcaataaaaccaatgtgcatgagcatattgttcgcttggttcaggaaaaacgcattgagggtatcacagcagtacgtgatgagtcaaaccgtgaaggtgttcgatttgttattgaagtcaagcgcgacgcctcagccaatgttattctcatataacctcttcaaaatgacccaaatgcaaaccaattttggtttcaatatgctcgctatccaaaatggtataccgaaaattttgtctcttcgtcagattttggatgcttatatcgagcaccaaaaagaatggttgttcgtcgtacacgttttgataaggaaaaagcggaagcgcgcgctcatatcttag

SEQ ID NO: 762 - DNA (genomic), 609 bp, Streptococcus pneumoniae; double-stranded, circular
  misc_feature (B) LOCATION 1...609
  hypothetical: NO
  anti-sense: NO
agagatttcctcagcaatcttctgaaaggatttagtctaggcctggcactttttcttctgaccttgttaggtttagtggtcttaggtcaatatcgtttggaatccattcacttgaatccttattctcttgcctttgtcgtctttactatcccattttggattttacaggggacagcagaagaagtggtggcccgtgcttggctacttcctcaattggcctcaagaaccaatctaaaactagctattcttatatctagcctgttctttaccctgcttcatatgggcaattctggcctcacccctctatctctagtaaatctctttttattcggagttgccatggctctttaccttctcaaaactgatacagtttggggtgttgcaggtattcatggtgcttggaattttgctcagggtaatctctttgggattttagttagtggtcaaccgtcaggaacgtctctgatgacctttttaccacaaggcaatcaagattggctatcaggtggttcttttggcatagaaggttccattatgacaagtctggtattactactgctgattgtctatcttgctaataaattaaagaaagaaaatgaaaggatgtga

SEQ ID NO: 763 - DNA (genomic), 240 bp, Streptococcus pneumoniae; double-stranded, circular
  misc_feature (B) LOCATION 1...240
  hypothetical: NO
  anti-sense: NO
atgaatattaaaattataaggaggacgaaggtggttaaaaatttaaaattaaaattagctcgggtagagcttgatttaactcaaggtcaactagcagatgctgtcggggtgacgcgccagactattggtttgatagaggcggggaaatacaatcccagtctctcgctctgccagtccatttgcagatgtttagggaaaaccctagaccaactattttgggaggaagaagatgaaaaatag

SEQ ID NO: 764 - DNA (genomic), 222 bp, Streptococcus pneumoniae; double-stranded, circular
  misc_feature (B) LOCATION 1...222
  hypothetical: NO
  anti-sense: NO
tcgatttgtttacatcttatttcaatctactatattatctcaataaatgatgatggcgactgttttgtttgtgcttgtcgatttttgaatcctgatcgagcggaagaatatttctgccgaggttgccaaggggaaaatcctgaagatattgaattttatgatgaacaattacaggcagaaaaggtggaggttttgaatattcgattggaagtaaaaaattga

SEQ ID NO: 765 - DNA (genomic), 1641 bp, Streptococcus pneumoniae; double-stranded, circular
  misc_feature (B) LOCATION 1...1641
  hypothetical: NO
  anti-sense: NO
aggagtattaaaatgaaaaaaattgttaaattagctttaacagctgcagcagttttaatagctgtagtaggattggttgcttgtagttcgggaagcaaaaaatctgatttttcagagtctggaaaagaaaaagtattctatttatcaggtttgcttcaaggaactggagatcgtatcccttacgtttggcaaaatggtgatggtttagttccatatttgttataccgtacactgttaatggcagattcaaaatatgaaaaatcaactccagatttagctaaagattggaaaaaatctgatgatgaaaaaacttatgaatttacacttaaagatggattgaaatggtctgatggagaagctttgacagcttccgatgtggaattcagtgttaaattagcattgaaagcttcagtaattaatggaattttcccttcaacattcacaaaaattgaaggagctaaagatttcaaagacgataaagcagataaaatttctggtcttacagttgatggaaataaagtaacatttaaacttactgctccagttggtgactttgagcaaatgatgactcaattctttattcttccaaaacataaattagagtctgaaaatcctcttgaattaaataatagctcattttggacagctcctgttacaagcggtatgtacaaagtaaaagaaattagtgcaggtaatttcttagagtatgacaaaaatgaaaactatgaaaatgaaaaaccaaaatttgataaagtagtattcaactatatttcagatccagttttagcattgcaagatggtaaatcatacttctattcaacaaacaaacctcaagaaattagtcagttggatgctgtatctactttaactaaaaaaccaattgatatcctattctatcgctactttatcgctaacttagcaggtgtcgaaggtaatggagattccttgattgctaatcctaaagttagagaagctattctatatgcaattaatcgtgatgaattagctaaatctgtatttagtggaattgcagatgttaataatactggtgttccttcaagcttagaagctcatctgaaatcagcaaataaatttgaatataatccagaaaaagcaaaacaacttcttaaagaagctaaatacgataatagcagaaatctaattttagcttattactataaagatcaagcctctcaagatttcatgcaagcagtaagttatcaattgaatgaggttggaatcaagaacgaagttgtccaaattacttctgatgcaacaacaggattgttcaaaacacgtaaatatgacctagcttataaaggattatcatcatttggttatgaaacttggtatggtgaatatagttcaacaaatactaactttaaaaatattacaaatggcgaaacaagttttgatgagttgagcaaaaaattgtctgaaacttctgatgtaaaagaaagaaacaaaattttagcaagtctacaaaaattagaacaagaaaaactattgaagttaaacttattcacatttaaaaacttcttgtatttaaatactgaaaaagttttaattcctgacgatgttcaatttggtaatccattctataaatttgattacaaattcgaaaaatgggatgctaaataa

SEQ ID NO: 766 - DNA (genomic), 228 bp, Streptococcus pneumoniae; double-stranded, circular
  misc_feature (B) LOCATION 1...228
  hypothetical: NO
  anti-sense: NO
atccccattaaagacattgatttcagcatcgttaaccaaatgaatgaccttgtctctcttacgatagtggcactgaggagcttcaaaactgagttgatctttttgtgggggattgagcaggtcttgcatgagctgattgatagcatcaatccctgccgtccctcggtacataggagccagaacttggatatcacgggcaggaataccatttctgagggcggcacctaa

SEQ ID NO: 767 - DNA (genomic), 888 bp, Streptococcus pneumoniae; double-stranded, circular
  misc_feature (B) LOCATION 1...888
  hypothetical: NO
  anti-sense: NO
atggaaattaaaattgaaactggtggtctgcgtttggataaggctttgtcagatttgtcagaattatcacgtagtctcgcgaatgaacaaattaaatcaggccaggtcttggtcaatggtcaagtcaagaaagctaaatacacagtccaagagggtgatgtcgtcacttaccatgtgccagaaccagaggtattagagtatgtggctgaggatcttccgctagaaatagtctaccaagatgaggatgtagctgttgtcaacaaacctcagggaatggttgtgcatccgagtgctggtcatactagtggaactctagtcaatgccctcatgtatcatattaaggacttgtctggtatcaatggggttctgcgtccgggaattgttcaccgtattgataaggatacgtcaggtcttctcatgattgctaaaaacgatgatgcgcatctagcacttgcccaagaactcaaagataaaaagtctctccgcaaatattgggcgattgttcatggaaatctgcctaatgatcgtggtgtaattgaagcgccgattggccggagtgaaaaagaccgtaagaaacaggctgtaactgctaaagggaagcctgcagtgacgcgttttcacgtcttggaacgctttggcgattatagcttagtagagttgcaactggagacagggcgcactcatcaaatccgtgtccacatggcttatatcggccattcagtcgctggtgatgaggtctatggtcctcgcaagactttgaaaggacatggacaatttcttcatgccaagactttaggttttactcatccgagaacaggtaagaccttggaatttaaagcagatatcccagagatttttaaggaaaccttggagagattgagaaagtaa

SEQ ID NO: 768 - DNA (genomic), 1347 bp, Streptococcus pneumoniae; double-stranded, circular
  misc_feature (B) LOCATION 1...1347
  hypothetical: NO
  anti-sense: NO
tttatgattaaaatctatgacaccatgtctcgtgatttgcgagaatttgtcccgattgaggacggcaagatcaagatgtatgtttgtgggccaaccgtgtacaactatattcacgtgggaaacgcccgttcgacggtagcttttgatacgattcgtcgctattttgagtaccgtgggtataaggttgcctatatttccaattttacagatgtggatgataagattatcaaccgtgccagggaagaaggcatcacacctcaggaggttgcggataagtacatcgctgcctttcgtgaggatgtgacggcattgggcgtgaaacctgcgactcgccatccgcgtgtagtggagtttatggcagacatcatccgttttgtggaagacttgatcgagaaaggctttgcctatgagagtcaaggggatgtctatttccgtgtagaaaaatcccacaactatgctaaattggctaataaaaccttggaagatttggagctaggtgcttcaggtcgtaccgatgaagaaacggctcgtaaggaaaatcctgtagactttgctctatggaaatcttccaaaccaggtgagatttcttgggatagtccttggggacctggacgtccgggttggcatattgagtgttcagtcatgtcgacagagattttaggtgataccattgatatccacggtggtggagctgacctagagtttccacaccacaccaatgaaattgcccagtctgaagctaaaacaggcaaggcttttgctaactactggatgcacaatggctttgtcaatatcgacaatgtcaaaatgtctaagtccttgggtaacttcattacggtacacgatgcccttaaaactcttgatgggcaagtacttcgtttcttctttgcgacccagcactaccgtaagcctatcaacttcacggaaaaggcagttcgcgatgccgagaccaatctcaagtatctcaagaatacttacgaacaaccatttacaggaaatgtggatgcccaagagttacaaaactttaaagataagtttgtagcagctatggatgaagattttaatgctgccaacggtatcacagttgtctttgaaatggccaaatggatcaactcagggaactatgatgcaagtgtcaagcaagctcttgcagatatgttagaaatttttggaattgtctttgttgaggaagttttggatgcagagattgaagacttgattcaaaaacgccaagaggcgcgtgccaatcgtgactttgcgacagcagaccaaatccgtgaccaattggttactcaaggaattaagctccttgataccaaggatggagtgaggtggacacgtgattga

SEQ ID NO: 769 - DNA (genomic), 474 bp, Streptococcus pneumoniae; double-stranded, circular
  misc_feature (B) LOCATION 1...474
  hypothetical: NO
  anti-sense: NO
actatgattaacaatgttgtacttgtagggcgtatgacacgtgacgctgagttgcgttataccccatcaaatgtagcagttgcgacttttactcttgcagtaaaccgtacatttaagagtcaaaatggtgaacgtgaggctgattttatcaatgtcgttatgtggcgccaacaggctgaaaatcttgctaactgggctaaaaaaggctcacttatcggggtgacaggtcgtatccagactcgtagttacgataaccagcaaggacaacgtgtctacgtgacagaggtcgtggctgagaatttccaaatgttggaaagccgtagtgtgcgtgagggccacacaggtggagcttactctgcaccaactgcaaactattcagcacctacaaattcagtaccagacttttcacgtaatgaaaatccatttggagcaacaaacccattggatatttcagatgatgatttaccattctaa

SEQ ID NO: 770 - DNA (genomic), 1572 bp, Streptococcus pneumoniae; double-stranded, circular
  misc_feature (B) LOCATION 1...1572
  hypothetical: NO
  anti-sense: NO
ctaatgattaaaaaggagaatataatgactaaacgcgtcttaatcagcgtctcagacaaagcgggcattgttgaatttgcccaagaactcaaaaaacttggttgggagattatctcaacaggtggaactaaggttgcccttgataatgctggggtggataccattgctatcgatgatgtgactggtttcccagaaatgatggacggtcgtgtgaagaccctccacccaaatatccacggagggcttctcgctcgtcgtgacttggatagccacttggaagcggctaaggacaacaagattgagctcattgaccttgtggtggtcaacctttacccatttaaggaaactatccttaaaccagatgtgacttatgctgatgcagttgaaaatatcgatattggtgggccgtctatgcttcgttcagcagcgaaaaatcatgccagtgttacagttgtggtagatcctgctgactacgctgtggttttggacgaattggcagcaaacggcgaaacctcttatgaaactcgccaacgtttagcagccaaagtatttcgtcacacagcggcttatgacgccttgattgcagaatacttcacagctcaagtgggtgaaagcaagcctgaaaaactcactttgacttatgacctcaagcaaccaatgcgttacggtgagaatcctcaacaagacgcggacttttaccagaaagctttgcctacagattactctattgcttcagccaaacagctcaacgggaaagaattgtcatttaataatatccgtgatgcagatgctgctatccgtatcatccgtgacttcaaagatagtccaaccgttgtggctctcaaacacatgaatccatgtggaattggtcaagctgatgacatcgagactgcttgggactacgcttatgagtctgacccagtatctatctttggtgggattgtcgtcctcaaccgtgaggtggatgctgcgacagctgagaagatgcacggcgttttcctcgaaatcatcattgcaccaagctatacggatgaagcgctagccattttgatcaataaaaagaaaaacttgcgtatccttgccttgccatttaatgctcaagaggctagcgaagtggaagcagaatacacaggtgtagtcggtggacttctcgtgcaaaatcaagacgtggtcaaggaaagcccagctgactggcaagtggtgaccaaacgtcagccaactgagacagaagcgactgctcttgagttcgcttggaaggctatcaagtacgtcaaatcaaatggtattatcgtgaccaacgaccacatgacacttggtgttggtccaggtcaaaccaaccgtgtggcttctgttcgccttgccattgaccaagccaaagatcgtctggacggggcggtccttgcttcagatgccttcttcccatttgcggataacgtggaagaaatcgccaaagcaggaattaaggccatcatccagcccggtggctctgtccgtgaccaagaatccatcgaagcagcggataaatacggcttgactatggtctttacaggtgtgagacattttagacattaa

SEQ ID NO: 771 - DNA (genomic), 828 bp, Streptococcus pneumoniae; double-stranded, circular
  misc_feature (B) LOCATION 1...828
  hypothetical: NO
  anti-sense: NO
atgatgattaaggtaattgcgacagatatggatgggaccttgctggatgctagaggtcagcttgatctcccacgattggaaaagattttagatcagttggatcaaaggggcattcgttttgtcattgcgacgggcaatgaaattcaccgcatgagacaactactgagtcccttggtggatcgagtggttctggttgttgctaatggcgctcgtatttttgaaaacaatgaattgattcaggctcagacatgggatgacgccattgtcaacaaggctttggctcatttcaagggtcgagcgtgtcagaaccagtttgttgtaacggggatgaagggtgattttgtcaaggaaggtacgatttttacagatcttgaaagttttatgactccagaaatgattgaaaaattctaccaacggatgcaatttgtggatgaattaacatctgacctctttggtggtgtgctcaagatgagcatggttgttggtgaggaacgtttgagttcggttttggaagaaatcaatgctctctttgatggccgtgtccgagctgtatccagtggctatggttgcattgatatcctccaagctgggattcataaagcatggggcttggaggaattactcaagcgctgggacttgaaatcccaagaaatcatggcttttggtgatagtgaaaatgatgttgaaatgcttgaaatggctggaattgcctatgcgatggaaaatgctgatgagaaagccaaagctgtggcgactgctctagcaccagccaacagccaaggaggagtttatcaagtcttggaaaactggttagaaaaaggagaatga

SEQ ID NO: 772 - DNA (genomic), 2256 bp, Streptococcus pneumoniae; double-stranded, circular
  misc_feature (B) LOCATION 1...2256
  hypothetical: NO
  anti-sense: NO
gcgaggattaaaatgaatacattattgacattacgaggtaaaagctttacacaaaaatcaagaaataatggtatgggaccaataactatacccaaaaaaacaataattacattggaacatttgaagtatcttcatttttcattagaagagacgaaaacatattgggagaaaaataacattatcgatggtattttgatcagtatttactataatcgaattgttgccaaaagtaaccgtattaatggctatttcaatgtaggaggagggaatccattccctaatgatactattgtgggagcaaaattcaatgatgagaagacaaaacatattgttactcattatatttctagagatgctcttaataaaacaataaccgttttaagtaagataattgaagtttttgaggaacattttgatagagcgataacatgtgagatgttttctgattcatcaacgtttgcttctataaatttttcggagtatggtatttcaaaaagcaaatttcaacagtatttgagagattcttgctttattgagaattttggagttgagcacactactgtttctgatattcaaaattctatcgtgacattttatgatgtccatacagacatttttagattactgaataaattaaatattgatatttcagaagctaatatcatgaatcagaccacggtcttgcttgatgaaaaaaatattgaattactactatcaaaagcgccctatcttgtctccatgattgtggaagatttttctaagttatctgtagatgatttttctttagataataatgatttaaaaataaatcttccatctccaatgaacgaaccagttgttggcgttattgataccttatttgacaaaagagtttactttaatgagtgggtagaatatcatgattttgtctcacctgatattagcaaagatagccaagattacaagcatgggacagctgtgacttctttaatcgttgatggagccaatttgaaccctaatctggatgatggttgtggaaattttagagtgaggcattttggtgtgtcactacaaagtggatttaattcatttacaatcataaaacagataaaagagattgtttctcagaatgctgatattaaggtttggaatctttctttagggtccaatgatgaaataagagaaaattttatctctgcagagggagcattattagacgaaattcaatttgagaatgatgtaatttttatcatagctgggacaaatgcttcagtaataaatgggaaacgcaaaagaataggtgctcctgctgattcacttaattctataatagtaaattctgttgattttaataatcaatcagtgtcatattcacgagagggtattgttttatcattctttgttaaaccagatgtgtcatattatggaggaggaaatggtgactttataaatgtttgtgaacctctaggattaggtcgtgtagctggaacaagttttgcggcaccttttattgcaaggaaaatggcctatctcattcatattatgggacttagccgagaagaagcgaaggctttgctaattgatgcagcaataccctggaatgataagaaaacattcactgatttatctttgataggaaatggtattgttccaataaaaatggatgatattttatctacacctgatgatgaaattaaatttattgtgtcagatatctctagggcttatgatacctataattatgattttccagtacctatttctagtgagagttatccatatgtagctaaagcaacaatgtgttatttccctaactgctcaagaaaacaaggggttgattatacaaatactgagatgcagcttacttttggtaggttaaagtcagacggtatcaaatcgataaataaagacaaccagcatgccgaagattccccaggatatgtgagagaaaatgctgctagaaatatatttaggaaatgggataatgtcaagcatattggagagtcgtttacttctcgaaagagagctaaagcaattttaaatccatctaatcctcagtgggggatgagtattaaaacaatcgaacgtttgaaaagcggtgatggacaaggagtacgttttggtgtagtagttacattaaaagaattaaatggggttaatcgtattgaagattttattcagcaagctgaattacgcggttggctagttaatagattgcaagtagaagctcaagtagacctctttaatagtttaaatgaagaaattgaatttgaatag

SEQ ID NO: 773 - DNA (genomic), 321 bp, Streptococcus pneumoniae; double-stranded, circular
  misc_feature (B) LOCATION 1...321
  hypothetical: NO
  anti-sense: NO
aacgttgttaaatcaacgttttttatttttatctttggtattcctttgcattcttttgctaaaaagggagtcacaaacagaccctattttaaaaaaaggatagaaaaaaggatacaacatttgtcgcatcctaaaaataatcttttttcgacggaagacatgggattcgaacccacgcacgctattacacgcctaccgcgtttccaacacggcctcttaagcctcttgagtaatcttccaatacttactcaaatagtctaccataaaggctcttatcttgcaataaaaattctagaaataagaaaaaatgatagattttga

SEQ ID NO: 774 - DNA (genomic), 2370 bp, Streptococcus pneumoniae; double-stranded, circular
  misc_feature (B) LOCATION 1...2370
  hypothetical: NO
  anti-sense: NO
aattctgttaaaaaaaatgatataatagaatttatggataaaaataagattatgggattaacccaaagagaagtcaaggaaagacaggctgagggtttggtcaatgactttaccgcatcagccagtaccagcacttggcaaatcgttaaacgaaatgtctttaccctttttaacgctttgaacttagccattgctttggctcttgcctttgtgcaggcttggagcaatctggtcttctttgctgttatctgctttaacgctttttctgggattgtgaccgagctacgagccaaacacatggtggacaagctcaatctcatgaccaaggaaaaggtcaaaaccatccgtgatggtcaggaagttgctcttaatcctgaagaattagtgctaggagatgtcattcgtttgtctgcaggagagcagattcctagtgatgccttggttttggaaggctttgcggaagtcaatgaagccatgttaacgggagaaagtgatttggtgcaaaaggaagttgacggcttacttttgtcaggaagtttcctagccagtgggtcagttttatctcaagttcaccatgtcggtgcagacaactatgctgccaaactcatgcttgaggctaagaccgttaaacccatcaactcccgtatcatgaaatcgctggacaagttggctggttttactgggaagattatcattccctttggtctggctctcttgctggaagccttgcttttaaaaggcctgcctctcaagtcatctgttgtaaactcgtcgacagctcttttgggaatgttgcctaagggaattgcccttttgaccattacttcgctcttgactgcagttatcaagctaggtttgaaaaaggtcttggtgcaggagatgtactctgttgagaccttggcgcgcgtggatatgctctgtctggacaagacgggtaccatcacccaaggaaagatgcaggtggaggctgttcttccgttgacggaaacgtatggtgaagaggctattgccagcatcttgactagctacatggcccatagtgaggataagaatccaactgcccaagccattcgccagcgttttgtgggagatgttgcttatcctatgatttccaatcttcccttctccagcgaccgcaagtggggggctatggagttagaaggcttggggacagttttcttaggggcacctgagatgttgctggattctgaagtcccagaagccagggaggccttggagagaggatcacgtgtcttggtcttagctctcagtcaggagaaattagaccatcacaaaccacagaaaccatctgatattcaggctctagccttgctggaaatcttggaccccattcgagagggagcagcagagacgctggactatctccgttctcaggaggtaggactcaagattatctctggtgacaatccagttacggtgtctagcattgcccagaaggctggttttgcggactatcacagctatgtagattgctcaaaaatcaccgatgaggaattgatggccatggcggaggagacagctattttcggacgtgtttcccctcatcaaaagaaactcatcatccaaacgttgaaaaaagcgggtcatacaacggctatgacaggggacggggttaatgatatcttggcccttcgtgaggcggattgttctatcgtgatggcggagggggatccagcaacccgtcagattgccaatctggttctcttgaactcagactttaatgatgttcctgagattctcttcgagggtcgtcgcgtggtcaataacattgcccacatcgccccgattttcttgataaagaccatctattccttcctgttagcagtcatctgtattgccagtgctttactaggtcggtcagagtggattttgattttccccttcattccgatccagattaccatgattgaccagtttgtggaaggtttcccaccattcgttctgacttttgagcgaaatatcaaacctgttgagcagaatttcctcagaaaatccatgcttcgtgccctaccaagcgctctcatggtcgtcttcagcgtcctgtttgtgaaaatgtttggcgcgagtcaaggttggtctgagttagaaatctcaactctactctattatctcttggggtcaattggtttcttatccgtatttagagcctgcatgccatttaccctatggcgtgtcctcttgattgtttggtcagtaggaggtttcctagccacagctctcttcccaagaattcaaaaactgcttgaaatttcaaccttaacagaacaaacgttgcctgtttatggtgtcatgatgttggtctttaccgtgattttcatcctgaccagtcgttaccaagcgaaaaaataa

SEQ ID NO: 775 - DNA (genomic), 471 bp, Streptococcus pneumoniae; double-stranded, circular
  misc_feature (B) LOCATION 1...471
  hypothetical: NO
  anti-sense: NO
tctttagttaaagtgagaagaaatctgatagatagtttgattcagtatatgcttataataggggtaaacaactcaggaggttcttgtaggttgcgagagtttggcgaaaaaattaaaagattacgtttggctaaaaaaatcagtcgttcagaattttgtggtgatgagtctgaattaagtatccgtcaattaattagaattgaaaatggagaatccagaccaacactaacaaagttaaaatatatcgctgaacgtttgggggttgaagattacaagttgatgccaagttatatagagttggataaggaatacctagaattgaagtatttcttgatgagaactcctacatacgaagatgaaactatcgcccaaaagaaagagagtgttttgataagatttttgaagagtattatgataggctacctgaggaagaaagatttatcatcccaaattattcatatctggcactaa

SEQ ID NO: 776 - DNA (genomic), 570 bp, Streptococcus pneumoniae; double-stranded, circular
  misc_feature (B) LOCATION 1...570
  hypothetical: NO
  anti-sense: NO
actatagttaaggaggtatttcccatgataaaacagataaaagcccacttgaataagagtattcagagtatcattggccaaaaagttgagttcgtcaaacaagatgaacaggcctttactcgtaaaagaaggttatcactagaaactatgattcgtacaattctgggcatgggaggaaaatcactatcaaaagaattactagatgccagactgacagtttcaaattcagcctttgttcaaagacgctatcagataaaacctgaagctttctatgctctatttaaagaatttacagcacctattccacttaatactgattttccaatattcgctgcagatgggagtgatatctgtattcctcgaaatcccatggatacagaaacctctatccaaacccaaacggatgttaaatcctataatctcatacacataaatgccctatacgacttgacgactggagtgtatagagatgtctctattcaagacaaacatgcacaacatgagcgcttagctctgattcagatgatggaggcttctccctttcgagaaagctcttgttatcatggatag

SEQ ID NO: 777 - DNA (genomic), 570 bp, Streptococcus pneumoniae; double-stranded, circular; identical to SEQ ID NO: 776
  misc_feature (B) LOCATION 1...570
  hypothetical: NO
  anti-sense: NO

SEQ ID NO: 778 - DNA (genomic), 570 bp, Streptococcus pneumoniae; double-stranded, circular; identical to SEQ ID NO: 776
  misc_feature (B) LOCATION 1...570
  hypothetical: NO
  anti-sense: NO

SEQ ID NO: 779 - DNA (genomic), 2061 bp, Streptococcus pneumoniae; double-stranded, circular
  misc_feature (B) LOCATION 1...2061
  hypothetical: NO
  anti-sense: NO
tcaacagttaaaaaaaatctagtcatcgtggagtcgcctgctaaggccaagacgattgaaaaatatctaggcagaaactacaaggttttagccagtgtcgggcatatccgtgatttgaagaaatccagtatgtccgtcgatattgaaaataattatgaaccgcaatatatcaatatccgaggaaaaggccctcttatcaatgacttgaaaaaagaagctaaaaaagctaataaagtttttctcgcgagtgacccggaccgtgaaggagaagcgatttcttggcatttggcccatattctcaacttggatgaaaatgatgccaaccgtgtggtcttcaatgaaatcaccaaggatgcagtcaaaaatgcttttaaagaacctcgtaagatcgatatggacttggtcgatgcccaacaagctcgtcggatcttggatcgcttggtagggtattcgatttcgcctattttgtggaagaaggtcaagaagggcttgtcagcaggtcgcgttcagtccattgcccttaaactcatcattgaccgtgaaaatgaaatcaatgccttccagccagaagaatactggacagttgatgctgtctttaaaaagggaaccaaacaatttcatgcttccttctatggagtagatggtaaaaagatgaaactgaccagcaatgacgaagtcaaggaagtcttgtctcgtctgactagtaaagacttttcagtagatcaggtggataagaaagagcgcaagcgcaatgctcctttaccctataccacttcatctatgcagatggatgctgccaataaaatcaatttccgtactcgaaaaaccatgatggttgcccaacagctctatgaaggaattaatatcggttctggtgttcaaggtttgattacctatatgcgtaccgattcgactcgtatcagtcctgtagcgcaaaatgaggcggcaagcttcattacggatcgttttggtagtaagtattctaagcacggtagcaaggtcaaaaacgcatcaggtgctcaggatgcccatgaggctattcgtccgtcaagtgtctttaatacaccagaaagcatcgctaagtatctggacaaggatcagctcaagctatatacccttatctggaatcgttttgtggctagccagatgacagcggccgtttttgataccatggctgttaaattgtctcaaacaggggttcaatttgctgccaatggtagtcaggttaagtttgatggttatcttgccatttataatgattctgacaagaataagatgttaccgacatggtgttggagatgtgtcccacaggtcaatagcaaaccagagcaacatttcacccaaccgcctgcccgttattctgaagcaacactgattaaaaccttagaggaaaatggggttggacgtccatcaacctacgcgccaaccattgaaaccattcagaaacgttattatgttcgcctggcagccaaacgttttgaaccgacagagttgggagaaattgtcaataagctcatcgttgaatatttcccagatatcgtaaacgtgaccttcacagctgaaatggaaggtaaactggatgatgtcgaagttggaaaagagcagtggcgacgggtcattgatgccttttacaaaccattctctaaagaagttgctaaggctgaagaagaaatggaaaaaatccagattaaggatgaaccagctggatttgactgtgaagtgtgtggcagtccaatggtcattaaacttggtcgttttggtaaattctacgcttgtagcaatttcccagattgccgtcatacccaagcaatcgtgaaagagattggtgttgagtgtccaagctgtcatcagggacaaattattgagcgaaaaaccaagcgtaatcgcctattctatggttgcaatcgctatccagaatgtgaatttacctcttgggacaagcctgttggtcgtgactgtccaaaatgtggcaacttcctcatggagaaaaaagtccgtggtggtggcaagcaggttgtttgtagcaaaggagatgactcttcaccacgagtgcngngcaca

SEQ ID NO: 780 - DNA (genomic), 645 bp, Streptococcus pneumoniae; double-stranded, circular
  misc_feature (B) LOCATION 1...645
  hypothetical: NO
  anti-sense: NO
agggaggttaatatgattgaacttaaacaggtgagtaaatcttttggagaacgagagttattttcgaatctttcaatgacatttgaggctggaaaagtctatgccttaattggttcaagtggtagcggaaaaacaaccttgatgaacatgattgggaaattagaaccttatgatgggacgattttttaccgaggtaaagacttggccaattataaatcgagtgattttttccgtcacgaattgggttacctcttccagaactttggcttaattgaaaaccaaagtattgaagaaaaccttaagctaggtctcactggtcaaaagttgagtcggtcggaacagcggttgaggcagaagcaggctttagaacaggtcggcctggcttatcttgacctagataagcgcatctttgagttatcgggcggagaatcgcaacgggttgccttggcaaaagttatcttaaagaatccaccctttattctggcagatgagccaacagcttcaatagacccagcaacctctcagttgattatggagattttgctatctcttcgagatgataataggctaatcattatcgcaacacataatccagcaatttgggagatggctgatgaagtgttcacgatggatcgtctgaaataa

SEQ ID NO: 781 - DNA (genomic), 600 bp, Streptococcus pneumoniae; double-stranded, circular
  misc_feature (B) LOCATION 1...600
  hypothetical: NO
  anti-sense: NO
tttggggttaagtatctgcaaagaatgattgcccttacagatactggcttaacctttacaaaagatccttttgactgtgagcgctacgaggacttgcgaagtctgttatctgaaatgttgaatcagggatcagacctggatgcagaagaagtagcagaagtcttgaaaccaacttcagcttatgcgactcccttaatggacgtccgtgcttggattgttgaggatgagaagatttgtctggttaggggacaaggagaggatagttgggctttgccaggtggctttggtgaagtcggctattctccaactgaaaatattctcaaggaaattgaagaagaaaccggttttaaagccaaagttgaaagactgctagctgtttttgataccaatcgtttccaactacagagcaaacaatatgcaaagtttgtttttgaatgtaagcttctcgatggacaattccaagaaaatcaagaaatcgctgaccttcaattttttgcaattgaccaactgccgaatttatctgaaaaacgcattaccaaggagcaaatcgagattctttggcaggtttatcaaggtcagagggagcaatatcttgactaa

SEQ ID NO: 782 - DNA (genomic), 366 bp, Streptococcus pneumoniae; double-stranded, circular
  misc_feature (B) LOCATION 1...366
  hypothetical: NO
  anti-sense: NO
attaattctaaagaattgagtatttctatgttaaaaaaatatccttgtacgatgcaacatgaccagtcagattgtgctgcggcagttgtttcaacagttcttttatcttacaaaaaggaactatcaatcatgaagattcgggaaattattggtacagacatgtatggaacgactgtcagtggtattgtttcaggtctgaataagttgaattttacagtaaaagctgttcgagtagcactggaagatttgactccaaaattaacatttcctgcgattcttcaagttaagaatgatttaggtcaaaatcattttgtggtattacatagtataaaggagaaaataaagggaactcgtattaccaaataa

SEQ ID NO: 783 - DNA (genomic), 231 bp, Streptococcus pneumoniae; double-stranded, circular
  misc_feature (B) LOCATION 1...231
  hypothetical: NO
  anti-sense: NO
gctttctctaaggaaaacttatactcaatgaaaatcaaagagcaaactaggaagctaaccgcaggttgctcaaaacactgttttgaggttgtggatgaaactgacgaagtcagctcaaaacatggttttgaggttgtagatgaaactgacgaagtcagctcaaaacaccgttttgaggtggcagatagaactgacgaagtcagtaacatatatacggtaaggcgacgctga

SEQ ID NO: 784 - DNA (genomic), 393 bp, Streptococcus pneumoniae; double-stranded, circular
  misc_feature (B) LOCATION 1...393
  hypothetical: NO
  anti-sense: NO
tcctcatctaaacttgtttttttaaaattgaaggatgattttggaggatataagatgacattgactattcatgtatattataaaggtgatggagatagtgcaataaagtttgcaagagaaatgcttgatagtggccttgttgaagaaattagaaatcaaaaaggtaacttgaaatacgaatattttttaccaattgaaaaagagggaactattctccttattgatcagtggataaatcaagaaactttagataaacattatcaatcaaagacaatgcagaaaatcttagatttaagaaaaaaatatcacttgcagatgcaagttgaacgttatatagaagatgattctgggatgccagaaagcgataagtcgtttatagacacagggaattag

SEQ ID NO: 785 - DNA (genomic), 1488 bp, Streptococcus pneumoniae; double-stranded, circular
  misc_feature (B) LOCATION 1...1488
  hypothetical: NO
  anti-sense: NO
atgtcatctaaggttattgttacaattttcggtgcgagtggagacctggctaaacgcaagctctacccttccctttttagactatatcaatccggcaatctttccaagcactttgccgttattggaactgcccgtagaccttggagtaaggaatattttgaatctgtagttgtcgagtccatccttgatttggcagatagtaccgagcaagcccaagaatttgctagccacttctactatcaaagccatgatgtcaatgattcggaacattatattgctttgcgtcaattacaagctgagcttaatgaaaaataccaagctgaacacaataagctcttcttcttgtctatggcacctcagttctttggaaccattgccaaacacctcaaatctgaaaacattgtcgatggcaaaggttttgagcgcttgatcgttgaaaaaccatttggtacagattacgcaactgcaaacaagttgaatgacgaactcctagcaacatttgacgaagaacaaattttccgtatcgaccattatcttggtaaggaaatgatccaaagcatctttgcagttcgctttgcaaacttgatttttgaaaacgtttggaacaaggattttatcgacaatgttcaaattacctttgcggagcgcttgggtgtagaagaacgtggtggctactatgaccaatccggtgccctccgtgacatggtccaaaaccacactctacaacttctttcgctcctcgccatggacaaaccagcaagcttcacaaaagacgagattcgtgctgaaaagattaaggtctttaaaaacctctatcatccaactgatgaagaactcaaagaacactttatccgtgggcaataccgctctggtaagattgatggcatgaaatacatctcttatcgtagcgagccaaatgtgaatccagaatcaacaactgaaacctttacatctggtgccttctttgtagacagcgatcgattccgtggtgttcctttctttttccgtacaggtaaacgactgactgaaaaaggaactcatgtcaacatcgtttttaaacaaatggattctatctttggagaaccacttgctccaaatattttgaccatctatattcaaccaacagaaggcttctctcttagcctaaatgggaagcaagtaggagaagaatttaacttggctcctaactcacttgattaccgtacagatgcgactgcaactggtgcttctccagaaccatacgagaaattgatttatgatgtcctaaataacaactcaactaactttagccactgggatgaagttggtgcatcatggaagttgattgaccgtattgaagagctctgggctgaaaatggtgccccacttcatgactataaagctggaagcatgggacctcaagccagctttgacctacttgaaaaattcggtgccaaatggacttggcaaccagatatcgcctatcgtcaagatggtcgtttcgaataa

SEQ ID NO: 786 - DNA (genomic), 1065 bp, Streptococcus pneumoniae; double-stranded, circular
  misc_feature (B) LOCATION 1...1065
  hypothetical: NO
  anti-sense: NO
tttacttgtttttgtgatataatagtcttatctttacacagaggtatagtaatgaaagaaactgtttattttggaacttatacacgtcgtacttctcaagggatttacaaggcagactttgatacagaaactggtcagctttcaaatctagaactttttgcagctgagccaagtccaacctaccttgcctttgaccagcaccaacatttatacactgttggtagccaagacgataaggggggaattgcagcctatcaaactgacgggactgtgttaaatcatgttgttgaagaaggagctccccactgttatgttgctgtcgatgaaaagcgtgatttggtttacgcagctaactatcacaagggacaagtccttgtttataaacgccaggaagatggtagtcttctacttagtgatatggatcaacacagtggccaaggtccacatgaaaatcaagcttccccccatgttcactatacagatttaacacctgaccactatctagtgacctgcgacttgggaactgaccaagtcatcacctatgacctcgatcaagaaggaaaattatctaagctctatacctatcacagcaagccaggagcaggctcacgccatatcattttccataaccactataaaatcgcttatctcatttgtgaactcaatagtactatcgaagttttaatctacgatggcgttggcgaatttgaacgtatgcaggtcatttcaactttaccggaagcttacgaaggctttaatggaaccgctgctattcatctctctaaagacggtaaatacctctacgcttctaaccgtggccatgattctatcgcagtatataccatccttgcggacggtagcttagagttattagaaatcgttccaacgcatggtcagactccacgtgattttgatttgacacccgaccaaaaatttctcattgttgtccatcaagactctgacaatgcaactgtctttaaacgtaattgtgacaatggtcgtctagcagaactctccaacgacttccatgttcccgaagcagtctgcatccgttttgctccttaa

SEQ ID NO: 787 - DNA (genomic), 1086 bp, Streptococcus pneumoniae; double-stranded, circular
  misc_feature (B) LOCATION 1...1086
  hypothetical: NO
  anti-sense: NO
catatgtctaaattacaacaaatcctaacatatcttgaatcagaaaaactagacgtcgctgtcgtatctgaccccgtcacaatcaattacctcactgatttttacagtgatccccatgaacgccaaatgttcctctttgtcctagcagatcaggaacctctcctctttgtcccagctcttgaagtagaacgtgcaagtagcaccgtttccttcccagtagtgggctatgtcgattctgaaaatccatggcaaaaaatcaaacatgctcttccacaacttgacttcaaacgtgtcgctgttgagtttgacaatctcatcttgaccaaataccatggtttgaaaacagtttttgagactgctgagtttgacaacctcactcctcgtatccaacgcatgcgcctcatcaaatcagctgatgaagtgcaaaaaatgatggttgcaggtctttatgctgacaaggctgttcatgttggttttgacaatatttctcttgataagactgagacagatatcatcgcacaaattgactttgccatgaaacgtgaaggttacgaaatgagctttgataccatggtcttgactggtgataatgctgcgaatccacacggcattccagcagctaataaggttgaaaatgatgctcttctcctctttgacctgggtgttctggtcaatggctatgcgtcagatatgactcgtacagtcgctgtcggcaaaccagaccaattcaagaaagatatttacaacttgactcttgaagcccaacaagctgctcttgactttatcaagccaggtgtgactgctcatgaagtggaccgcgctgcccgtgaggtcatcgaaaaagctggttatggtgagtacttcaaccaccgtctcgggcatggtatcggtatggatgtccatgaattcccatctatcatggaaggaaacgacatggtcatcgaagaaggcatgtgcttctctgttgaaccaggtatctatatccctggtaaagtcggtgttcgtattgaagactgcggtgttgttaccaaggatggcttcgacctctttacaagcaccagcaaagatttgctttattttgattaa

SEQ ID NO: 788 - DNA (genomic), 678 bp, Streptococcus pneumoniae; double-stranded, circular
  misc_feature (B) LOCATION 1...678
  hypothetical: NO
  anti-sense: NO
atgatgtctaacaaaaataagggaattctgatttttgcgattctctatacagtcctctttgtgtttgatggcgttaaattgctggcttctttaatgccatctgtcattgcaaattatcttgtttatgtagttttagctttatatggctccttcttgttcaaggatagattgatccaacaatggaaggagattagaaagactaaaagaaaattcttctttggcgtcttaacaggatggctctttctcattctgatgactgttgtctttgaatttgtatcagagatgttgaagcagtttgtgagactagatggacaaggtctaaatcagtctaatattcaaagtacctttcaagaacaaccactactgatagctgtttttgcttgtgtcattggacctctggtagaagaattatttttccgtcaggtcttattgcattacttgcaggaacggttgccaggtttactaagcattattctggtaggacttgtttttgctctgactcatatgcacagtttggccctatcagagtggattggtgcagttggttacttaggtggaggccttgccttttctattatttatgtgaaagaaaaagagaatatctactatcccctacttgttcacatgttaagcaacagcctctccttaatcattttagctatcagtatagtaaaatga

SEQ ID NO: 789 - DNA (genomic), 345 bp, Streptococcus pneumoniae; double-stranded, circular
  misc_feature (B) LOCATION 1...345
  hypothetical: NO
  anti-sense: NO
gcatggtctaataaagctatggcatataatactgattttaaacaaggagcattagattccatcaaaggagggcacagacatgtcgaggcggccaaagttttttggtgttggcgtcagaactctcttcacgtgggaaaagaaagacgtgaacaaaggaacttagagcggaaaaagcgagtcgtcaaaaagcgtaagatccctttagaagaattgaaagcctttgtagaggctcatccagatgcttttttacgggaaattgcggcacattttgattgtgctgttccttcagtatgggcagctttaaagcagattaaggtcactttaaaaaaagatgacgatctttaa

SEQ ID NO: 790 - DNA (genomic), 825 bp, Streptococcus pneumoniae; double-stranded, circular
  misc_feature (B) LOCATION 1...825
  hypothetical: NO
  anti-sense: NO
ccgctgcctaaaggagaagccatgtcaacatataactgggatgagaagcatatccttacctttcctgaagaaaaagtagccctttctactaaggatgtccatgtttactatggtaaaaatgaatccattaaggggattgatatgcaatttgaaagaaataaaattacagctttgattggtccgtcgggatcggggaaatctacctacttacgcagtctcaatcgcatgaatgataccattgatattgctaaagtaactgggcagattctctatcgtggaattgatgtcaaccgtccagaaatcaacgtttatgaaatgcgtaaacacattggaatggtttttcaacgccccaatccatttgctaagtcaatttaccgtaatattacctttgcgcatgaacgtgctggagttaaggataagcaagtcctagatgaaatcgtagaaacctcccttcgtcaggctgccctctgggatcaggttaaagacgatctccacaagtcagccttgaccttatcaggtggtcagcaacaacgtctctgtatcgctcgtgccatctctgttaagccagatatcctcttaatggatgagccagcctcagccttggatccgattgcgaccatgcaactagaagagaccatgtttgagctcaagaaaaactttaccatcatcattgtaacgcataatatgcagcaggctgctcgtgcaagtgactatacaggcttcttttacttgggtgatttgattgagtatgacaagactgcaactattttccaaaatgccaagctacagtccaccaatgactatgtatctggtcactttggttag

SEQ ID NO: 791 - DNA (genomic), 966 bp, Streptococcus pneumoniae; double-stranded, circular
  misc_feature (B) LOCATION 1...966
  hypothetical: NO
  anti-sense: NO
atcatgcctaagaaaatccttgttttacatacgggtggaactatttccatgcaggccgatgcttctggcgctgttgtgacgagttcagataatcccatgaaccatgtgtccaacccacttgaaggaatccaagtccacgccttggacttttttaaccttccaagtccccatatcaaacccaaacatatgctggtcctctaccagaaaattaaagaggaagcagataactacgatggagtggtgatcacacacggaaccgatactttagaggaaacagcctatttccttgataccatggaagttccccatatgcctatcgttctaacaggagccatgcgtagctccaatgagctcggtagtgatggtgtttataattacctaagtgctttacgagtggccagtgatgacagggctgctgacaaaggagttttggtcgttatgaacgatgaaatccacgctgccaagtatgtcaccaaaacacatacgactaatgtcaacaccttccagactccaacacatggccccctcggtctcatcatgaaacaggaaatcctctacttcaaaacagctgaacctcgtgttcgctttgaccttgatcacatacaaggtttagtccctatcatctcggcttatgctggtatgacagatgagctgattgatatgctggatttagaacacttggacggtttgattatccaagccttcggagctggtaatattcccaaagaaacggctcaaaaattagaaagccttctgcaaaaaggaatcccagtcgctctggtatcacgatgctttaacggtattgccgagcctgtttatgcctaccagggtgggggcgtacagttgcaaaaagcaggcgttttctttgttaaagaactcaacgcccaaaaagcccgcttgaaactcctcatcgccctcaatgccggactaacaggacaggctttgaaagactatatggaaggctaa

SEQ ID NO: 792 - DNA (genomic), 1296 bp, Streptococcus pneumoniae; double-stranded, circular
  misc_feature (B) LOCATION 1...1296
  hypothetical: NO
  anti-sense: NO
aaagcgcctaaacaactcattagaaagtatcttatggaacacatcaatcataccacattactcatcggaataaaagacaaaaacatcaccttaaataaagccattcagcacgatacccatatcgaagtcttcgctacacttgattatcacccacctaaatgtaaacactgtaaaggaaaacaaatcaaatacgacttccaaaagccttctaaaatcccttttatcgagattggtggtttccctagcctcattcatttgaaaaagagacgatttcaatgcaagtcctgtcggaaagtcactgtagctgaaacaactctcgttcagaaaaattgccaaatctcggaaatggtgagacagaaaattgcccaactcctactcaacagagaggctcttacacatatcgcttctaaattagccatctctacctctacctctaccgtctatcgtaagctcaagcaatttcatttccaagaggattacaccactttgcctgaaatcctctcctgggatgaattctcctaccagaaggggaaattggctttcattgctcaggatttcaacactaagaaaatcatgaccattcttgataacagacgtcaaacaaccatccgaaatcatttcttcaagtactcgaaagaagctagaaaaaaagttaaagtcgtcactgttgatatgtctggaagttatatccctctcattaagaaattatttcccaatgctaaaattgttctcgatcgtttccacattgtccaacacatgagcagggctcttaatcagactagaatcaacatcatgaagcaatttgatgataaatctctggaatacagagctcttaaatattactggaaatttatcctaaaagatagtcggaaactctctcttaagcctttctatgctagaactttcagagagaccttaactcctagggagtgtctgaagaaaatctttactctagtacctgaacttaaagattactatgacctgtatcaactactcctatttcatctacaagagaagaatactgaccagttttggggcttaattcaagacacgttacctcatctcaaccgcacctttaaaaccactttgagcacatttatttgctataaaaactacatcactaacgccattgaattgccttattctaacgctaaacttgaggccactaacaaactcatcaaagacatcaagcgcaatgcctttggttttcggaactttgaaaacttcaaaaaacggattttcatcgctctgaacatcaaaaaagaaaggacaaaatttgtcctttctcgagcttag

SEQ ID NO: 793 - DNA (genomic), 510 bp, Streptococcus pneumoniae; double-stranded, circular
  misc_feature (B) LOCATION 1...510
  hypothetical: NO
  anti-sense: NO
acctacactaaaacatataaagggggaaaacttatgacaattgtaggatgccgtattgatggacgtttgatccacggacaagtagccaatctttgggctggaaaactaaatgtttcacgcattatggttgtagacgacgaagttgtcaacaacgatattgaaaagagtggtttgaaacttgcgacaccaccaggtgtgaaattgagtattttgccagttgagaaagctgcagccaatattcttgctggcaaatacgatagccaacgtctctttatcgtggctcgtaaaccagaccgcttccttggtttggtagaagcaggtgtaccacttgaaactcttaatgttgggaatatgtctcaaacaccagaaactcgttctattacacgttctatcaacgtagtagacaaggatgtggaagacttccacaaactggcagaaaaaggtgttaaacttactgctcagatggttccaaatgatccaatttcagactttttgagcttattaaaatag

SEQ ID NO: 794 - DNA (genomic), 924 bp, Streptococcus pneumoniae; double-stranded, circular
  misc_feature (B) LOCATION 1...924
  hypothetical: NO
  anti-sense: NO
gaaatgactaaaacagcctttttatttgctggtcaaggtgcccagtatctagggatgggacgggatttctatgatcagtatccgattgttaaagaaacgattgatcgagcgagtcaggtgctcggttatgatttgcgttatctcatcgatacggaagaggacaaactcaatcagacccgctatacgcaaccagccattctagcgacttcggttgctatctaccgtttattgcaagaaaagggctatcagcctgatatggtcgctggtttgtctcttggagaatactctgccttggtggcaagcggcgccttggattttgaagatgcggttgccttggtagctaagcgtggagcctatatggaagaagcggctcctgctgactctggcaagatggtagcagttctcaatacgccagtagaggtcattgaagaagcctgtcaaaaagcttctgaacttggagtggttactccagccaactataacacacctgcacaaatcgtcattgctggagaagtggttgcagttgatcgagcggttgaacttttgcaagaagcaggtgccaaacgcttgattcctcttaaggtgtcaggtccctttcacaccgctctccttgagccagctagccagaaactagctgaaactctagctcaggtaagtttttcagattttacttgtcccctagtcggcaatacagaagctgctgtgatgcaaaaagaggacattgctcagctcttgacgcgtcaggtcaaggaacccgttcgtttctatgaaagtattggggtcatgcaagaagcaggcataagcaactttatcgagattggaccggggaaagtcttgtcaggttttgttaaaaaaattgatcaaactgctcacttagctcatgtggaagatcaagcgagtttagtagcacttttagaaaaatag

SEQ ID NO: 795 - DNA (genomic), 480 bp, Streptococcus pneumoniae; double-stranded, circular
  misc_feature (B) LOCATION 1...480
  hypothetical: NO
  anti-sense: NO
ttcatggctaaggtgttattagggtttatgggggctggaaaatcgactattgcaagaggcttggacactaattaccttgatatggatgctctgattgagaagcgcctaggtatgtccattgcgaattttttcgctgaaaagggagaagagacctttcgtcaggtagaatcagaagtcctagctgatttactacaaacagaccaagtcgtgtcaactggaggaggagtggttatttctcagagaaatcgtgacttactcaagactaatacagataacatctacctgaaagcagattttgaaaccctctaccaacgtatcgcagctgataaggacaatcagcgaccgctttttctaaataatagcaaggaagaactagtagctatttttcaagaaagacaggcttggtatgaggaagtggctagtcgggttttggatgtgaccaagctaagcccagaggaaattatagaggaactaagatga

SEQ ID NO: 796 - DNA (genomic), 477 bp, Streptococcus pneumoniae; double-stranded, circular
  misc_feature (B) LOCATION 1...477
  hypothetical: NO
  anti-sense: NO
gctcgggctaaatcagtccactggactgatttactacaccaggatagcttcaagctctgtcagaaacgattctatcagcccacgtttcgaatgcacttaacccatcgggaagtacgagataaactgctttcttactctgagggattacaggttcactacgaactctatcaactcctgctctttcattttcaagagaagaatgccgaccatttctttggattgattgagcaagaactgccaacggttcatccgctttttcaaacggtcttttggacttttttaagggatagagataagattatcaacgcacttaagctgccttattccaacgctaaacttgaagcgaccaataatttgattaaggttatcaagtgcaaagcctttggtttccggaactttaacaattttaaaaaacggattttgatgactttgaacatcaaaaaagagagtacgaatttcgtactctccagattgtaa

SEQ ID NO: 797 - DNA (genomic), 918 bp, Streptococcus pneumoniae; double-stranded, circular
  misc_feature (B) LOCATION 1...918
  hypothetical: NO
  anti-sense: NO
atctattataacaaaggaatgagaaatatgaaggcaaaatatgctgtttgggtggcttttttcttaaatttgacttatgccattgttgagtttattgcaggtggaatatttggttctagcgctgttcttgctgactctgtgcatgacttggtagatgcgattgcaattggaatatcagcttttctagaaacaatctccaatcgtgaagaagacaatcagtacaccttgggctataagcggtttagcctgctaggagccttggtaacagctgtgattctcgtaacgggctctgttctagtcattttggaaaatgtcacgaagattttgcatccgcaaccagtcaatgatgaggggattctctggttaggaattattgcgattactatcaatctgttagcgagtctggtggttggtaagggaaagacaaagaatgagtctattctgaatctgcattttctggaagatacgctagggtgggtagctgttatcctgatggcgattgttcttcgatttacggactggtatatcctagatcctcttttgtcccttgtcatttctttctttattctttcaaaagccctttcacgtttttggtctacactcaagattttcttggatgctgtgccagaaggtcttgatatcaagcaagtaaagagtggcctggaacgattggataatgtggccagccttaatcagcttaatctctggactatggatgctttggaaaaaaatgccattgtccatgtttgtctaaaagaaatggaacatatggaaacttgtaaagagtctattcgaattttcctaaaagattgtggttttcaaaatattaccattgaaattgatgctgacctagaaactcaccaaacccataagcgaaaggtgtgtgacttggaacggagttatgagcatcaacattag

SEQ ID NO: 798 - DNA (genomic), 351 bp, Streptococcus pneumoniae; double-stranded, circular
  misc_feature (B) LOCATION 1...351
  hypothetical: NO
  anti-sense: NO
agaccctataaaattccttaccttgagacaactggtatgcctactagaattctccttagaaagcgtcgctttaagtgctatcactgttcaaaaatgatggtcgctgaaacttctatcgtcaagaagaatcaccaaatccctcgtatcatcaaccaaaagattgctcaaaagttaattgaaaagatttctatgactgatattgcccatcagctggccatttcaacttcaactgtcattcgcaagctcaatgactttcactttgagtgtaattttagaaatctgcctaagattatgtcttgggacgttgaaacagtccggggagtgactgtttcaatcgggagatggagatga

SEQ ID NO: 799 - DNA (genomic), 2040 bp, Streptococcus pneumoniae; double-stranded, circular
  misc_feature (B) LOCATION 1...2040
  hypothetical: NO
  anti-sense: NO
aaatactataagtatgctaaaataggaatagcacatggagagaggattcttatgatcaatcacattacagataatcaatttaaactagtatcaaaatatcaaccatcaggagatcaaccccaagctatcgagcagttggtggataacattgaggggggagaaaaagctcagattctgatgggggcgactggaacagggaagacctatactatgagtcaggtcatttctaaagtcaataaaccaactctggttattgcccacaataaaactctggctggtcagctctatggggagtttaaggaatttttccctgaaaatgcagttgagtatttcgtatcctactatgattattaccagccagaggcctatgtcccttctagcgatacctatattgagaaggatagttctgtcaatgacgagattgacaagcttcgccactcagctacctcagcccttttggagcgtaatgatgttattgtcgtggcctcagtctcttgtatctatggtttgggttcgcccaaggaatacgctgatagtgtcgttagtctccgtcctggtctagagatttctcgtgataaactcttgaatgacttggtcgatattcagtttgaacgcaatgatattgatttccaacgcggaagatttcgcgttcgtggggatgtggtagagattttcccagcttcccgagatgaacatgcctttcgagtagaattttttggagacgaaattgaccgtattcgtgaagttgaggctctgacaggtcaggtgttgggagaagtggatcatttagcgattttcccagcgacacactttgtgaccaatgacgaccacatggaagttgccattgcaaagattcaggccgagttggaagaacaattagctgtctttgaaaaggaaggtaaactgcttgaagcccagcgtttgaaacagcggacagagtatgatatcgaaatgttgcgtgagatgggctataccaatggggttgaaaattattctcgccacatggatggacggagcgaaggagagcctccttatacgcttctcgacttcttcccagatgatttcttgattatgattgacgagagtcatatgaccatagggcaaatcaagggcatgtacaatggagaccgttcgcgtaaagaaatgctggttaattatggtttccgtttgccgtctgctttggacaatcgtcctctacgtcgggaggagtttgagagtcacgttcatcagattgtttacgtttcagcgacacctggtgactatgaaaatgaacagaccgagacagtgattgagcaaatcattcgtccaacgggactcttggatccagaggtggaagtccgtccgactatgggacagattgatgacctcttgggtgaaatcaatgcccgcgttgaaaaaaatgagcgtacctttatcacaactttgaccaagaaaatggcagaggacttgaccgactacttcaaggaaatgggtatcaaggtcaagtacatgcactcggatatcaagaccttggaacggacggagattatccgtgacctgcgcttgggtgtctttgatgtcttggtcggaattaacctgctccgtgaaggaattgacgttcctgaagtgagcctcgtagctattctcgatgctgacaaggaaggtttccttcgcaacgaacgtggactcatccagactattggacgtgctgctcgtaacagtgaaggccatgtcatcatgtatgcagacacggttacccagtctatgcaacgtgctatcgatgaaactgcccgccgtcggaaaattcagatggcctataatgaagagcatggtatcgtaccacagacaatcaagaaagaaatccgtgacctgattgccgtgaccaaggcagttgctaaggaagaggacaaggaagtcgacatcaatagcctcaacaaacaagagcgcaaagaactcgtcaagaaactagaaaaacaaatgcaagaagccgtcgaagtgcttgactttgaactggcggctcagatccgtgatatgatgttggaagtcaaggccttggattag

SEQ ID NO: 800 - DNA (genomic), 279 bp, Streptococcus pneumoniae; double-stranded, circular
  misc_feature (B) LOCATION 1...279
  hypothetical: NO
  anti-sense: NO
atttgctataataggaccatggaagaagaacaattattaaaatcaggagagcgcattaaccagctcttttcgacagatatcaaaatcattcaaaatagagaggtttttagctattcggtggatagtgttctcttatcacgatttccacgttttcctaagaaggggttgattgtggatttctgtgctgggaatggagcagtggggctttttgctagcactcgtactcaagcacagatattgtctgttgagatttcaggagcgtttggcggatatggctga

SEQ ID NO: 801 - DNA (genomic), 1599 bp, Streptococcus pneumoniae; double-stranded, circular
  misc_feature (B) LOCATION 1...1599
  hypothetical: NO
  anti-sense: NO
atttgctataacaatgtcttagccatccttactcattctccattgattaatctagcttttttagccttgattgtaattaaccttctggttgcttattttcaaataggactcctctttattggtgctcgtcatctcctctataatgaaaagcgaaggctaattgagtatatccgcaaggttttccatgaaagttttggatttatgaaaaagctaacttgcgctaaagccttgtttatctttttctatatagctatgctgtttccttttatacggaaaatgctgaagatttattatcttaataaaatcgtcattccagagtttatccaagcttatttagaagatagatattggatgtggtggctgagcatcctacttctatctcttatctttctctatgtctctgtcagattgatgtttgcccttccgaagattgtatatgatcagctgactgttcgagaagcagtgatgtttagcttggagaaaaccaagaagagagttactttttatgcttggaatttattttacatcttgctcaaagcacatttattattttatcttcctttgattcctttattattggctcaaactttggtagatgatatcactcagagagagtctctgattcttggtattttgaattttgtcgtgattaaaaatctctattatatggctctgacttattccccggttaaatttgtttcatttttgacaggaaaggagctggatatgcttcctaggagagaaaaagatcacatcgtgcgatggggtgtcatgacttgtgccagtcttttctttgccttagaaggttatatttatctggaggctcccatggttcatctacctcaacttatttctcaccgaggggtttccaatgcaaatgggattcaaaatacagtagagtccttggaaactacagcacaactcaaaccagacttggtggagacggacgtgcaggaaacaaaagatgggcagtttgtcatgatgcatgatgctaacttgaaaaatctagcaggtatcaataaaagtcctcaagacttaaacttggaggagcttaaagggattgatatttttgaaaatggctaccagactaaaatttcaagctttgaagattatctcagtcgagccaacgaacttggtcaaaaattactaattgaaattaaaaccagtaaaaaagatagtccagacatgatgaaccgctttttagcccgttatgctgcaatgctcaagatttatggacatcaaatccagtctttagactaccatgttgtcgaaaaagtaagacagtatgatgccgaactgccagtttatttcatcatgccctacaattctgtctttcctaaaacaagagcgacaggatatactatggagtactcaaccttggatgaatattttgtaagcaaactatggacaacggatcagaaactttatgtctggactgtcaatgattcagaagctatcagcaaatctcttcacttaggagtagatggagtgattacagatgatttggaaaaagttcagcgggaaatagaagtagcccaagaagatccagaatatacggatttgctcttgaaaaaagcattggaattctttgaattttag

SEQ ID NO: 802 - DNA (genomic), 726 bp, Streptococcus pneumoniae; double-stranded, circular
  misc_feature (B) LOCATION 1...726
  hypothetical: NO
  anti-sense: NO
cattcatataacataaaaaagggaggaactgttatggatgcaatctttgacctaatcggaaaggttttcaatcccatcttagaaatgggtggacctgtcatcatgttaatcattttgacagtattggctttactttttggagtgaaattctccaaagcgcttgaaggtggtatcaaacttgccatcgctcttacaggtatcggtgctatcatcggtatgctaaatggtgctttctcagcatcacttgcaaaattcgttgaaaacactggtatacaattgagtattaccgacgttggttgggcaccactcgcaacaatcacttggggttctgcttggacactatacttcttgctcatcatgttgattgtcaacgtagtgatgcttgctatgaagaaaaccgatacacttgatgtcgatatctttgatatctggcacttgtctatcacaggtctcttgattaaatggtatgctgataacaatggtgtgagtcaaggggtttcactctttattgctacagcagctatcgtccttgtcggtgtgttgaaaattatcaactctgacttgatgaaacctacatttgatgaccttcttaacgccccaagttcatcaccaatgacatcaactcacatgaactacatgatgaacccagttatcatggttttggataagatttttgaaaaatcttcccaggccttgatanatatgactttgatgctgctaaattga

SEQ ID NO: 803 - DNA (genomic), 438 bp, Streptococcus pneumoniae; double-stranded, circular
  misc_feature (B) LOCATION 1...438
  hypothetical: NO
  anti-sense: NO
gtaaaatataataataaaggagttaaaacaatgacagtaattaataaatttgttttaatggagcaagcaaaaaaagttttaaaaaatgcttactgtccgtattccaaatttcctgtaggtgcagcaattttatttaaagatggtaaagtaattacaggagcaaatatagaaaatgtatcgtttggtgtaactaactgtgcagaacgtagtgctattttttatggggcttctcaaggatatagaaaaggagatattcttgcgattgctgttgcaggtgaaactgaagactacttaccaccatgcaacatttgtcgtcaagttatggtagaattttgtgagcctgataccttagtctttctattaaatggtaagggaaacatacttgaattgcgattagaggaattagtcccatattcgttctcaagtctagaaatgtaa

SEQ ID NO: 804 - DNA (genomic), 2283 bp, Streptococcus pneumoniae; double-stranded, circular
  misc_feature (B) LOCATION 1...2283
  hypothetical: NO
  anti-sense: NO
aaaatgtataactaccctatgcgcattcattaccatcgtaagaatggagaatatgacacttgctcctttgtaaaaagtcaggatcaacgaattgatttgctaacctacaaagaagattattttggagctttatttagctttgaacacccaagttcacatgttatagaaagcttgaattttgtggttcatacaggtcaaactagtaaagaatattctatccgttttaatcactatcccctattaacagaggtctggattttggaaggcgatgataggatttattactctgaaaatcctgctattgccagtcctttctataaaaatcaaaatccttttgcctttgataaggccattaacagtgctagttttgatcatcattggggttaccaaggagaattgggttgccgtgtagaggacaatcaggctcatttttccctctggtcacctacagcgacaaaagtgcaagttgtcgtttatgaatcagctgctaatgatgcacccgtttggaagacttttgagatgaaaagaggcaatagctactcttataatcataaggacaatacaatcggtgtctggagtttggatgttgaagaagatttggtaggtaagacttatcagtatcaagtccaattccctcatcaccaaacactgacacgtgatccttatacaatcgcgaccagccctgatggcaaacgttcagctattctgagccatgtagaaaagcaagttgaaaacttcgaggttaagcacggttcggaggctacttggcgcttggaaaatccatgtaaggcagttatctgtgaaatgcacattcgtgatttgactaaatcacctacatcgggtgtagatgaacatcttcgaggaactttcttgggtgctgctcaggctggaacagttaaccaatacggccagtcaactgcttttgattacatcaagaagctgggctacaattatgttcaattgcaaccaattgcagaccgtcataaagaatacgatgaggatggaaatgtaacctacaactggggttatgatccacaaaactataacgcgccagaaactagtttttcaactaatccagatgatccagctcaggtcattcgtgatttgaaggtgatggttcaagcttatcacgatgcgggtattggagtcattatggatgtagtctataaccataccttctcagttgttgatgcaccattccaaacaacagtccctgattactattatcgtatgaatccagatggtaccttccagaatggaacgggtgttggaaatgaaacagccagtgaacacgaaatgtttcgcaagtatatgattgattctcttctatactgggtgcaggaatataatattgacggcttccgttttgacttgatggggattcatgatgtcaagaccatgcagatgattcgtcaaagcttggatgaaatcgactccaacattatcctctatggagaaggatgggatatgggaacaggtcttgccccttatgataaggccaagaaggacaatgcctaccagatgccaaatattggtttctttaatgacaatcagcgcgatgctgtcaaagggggagaagtttatggtgctatcaagtcaggttttgtcagtggtgctgcgacagagccaattctagctaaagcaatcctaggaagtcgtgaattaggaagctatacacatccaaatcaggtgcttaactatgtagaagcccatgacaattacaatcttcacgatttattggcaacccttcatccagaccaaagttcagagcaaatcatgcgcaaggtcgaaactgccacagccatgaatctgctcatgcaggggatggcctttatggaaatcggtcaagaatttggtcgtaccaaactggttgcgactggtgaaaatggtgagttgacccatgatgatagagagcgtgcgatgaatagctataatgctcctgacagtgtgaaccaagtgaactggaacttgattaatgagcgtcaagacagtattgagtttatccgtcaagtcatccgattgaagacaaaaactggtgccttttcttactctagctatgatgaaatttaccatcatgtctttgtgcattctgcgattgaacatagcggctgccttatctatgaagttcacggcaaagaacacctcttggtagttgtgaatgctaaatcagaaccctatcaatttgaaaatgcaggaaatttagctatgttggtaaccaacagtcgctcaaaagaagataatgttttaaatgatattagtctagctgtcttgagtgttttataa

SEQ ID NO: 805 - DNA (genomic), 456 bp, Streptococcus pneumoniae; double-stranded, circular
  misc_feature (B) LOCATION 1...456
  hypothetical: NO
  anti-sense: NO
aaatggtataatatagtgagaaggatagaggagaagtgtaaattgatcgcacaaatagatacaaaaacagtctatagttttatggaaagcgtcatttcgatcgaaaagtatgtgagagcagctaaagaatacggctacactcatttggctatgatggatattgacaatctttatggcgctttcgactttctagagattacaaaaaaatacggcattcatcctttgctagggcttgaaatgacagtgtttgtagatgatcagggagtaaatttgcgctttttagctctatctagtgtgggctatcagcagttgatgaagctttcgacagccaagatgcagggggagaaaacttggtcagtcctgtcccagtacctggaggatatcgcggtcattgtgccttattttgatagagttgactcgttagaagtaggtttaaataagccttacaccagcaat

SEQ ID NO: 806 - DNA (genomic), 615 bp, Streptococcus pneumoniae; double-stranded, circular
  misc_feature (B) LOCATION 1...615
  hypothetical: NO
  anti-sense: NO
gttattcataaaaatttctctatcaaatatcataatgcgtcgtttaaggagatggttacaatgcaatatagttgtggaaaaataaatattaatatccctgatggatatggagacattaaggatatagtgttttcggctcatattatagttaggtataataatggacattgtggaggtatagatccgcatataattggactttgtaaaaagcagatcagaaggatgtctctatatcctattttgataatcgtatctagagattcaaaggttattgatgattataaaaatttagatattgcctatgttgattgtactcaatgttcaaataattttgaaactgccttacacgttaaaaatattttaaaattattaaaaatccgacttatacactgtcatggctactcaactaattattttttatatatgttaaaaaaacttgacaagaatggatttggaaaggttaagacagtgataacatgccatggatgggttgaatataacttaaaaaagaaattcttgacttattttgatttttggacatattctatgggagatgcttttatttgtgtatctgaaactatgaaaaaaagattggagagtataataaaaaaataa

SEQ ID NO: 807 - DNA (genomic), 972 bp, Streptococcus pneumoniae; double-stranded, circular
  misc_feature (B) LOCATION 1...972
  hypothetical: NO
  anti-sense: NO
gcgaatcataaaaaatttcattttgattttaaaacagttcaagaaagtcaaaaaattattctatttgaaagagaggtgccgactgtgaaagtcaataaaatccgtatgcgggaaacagtgatttcctacgctttcctagcaccagtattattcttctttgtcatctttgtgttggctccgatggtgatgggcttcattacaagtttctttaactactcaatgactagatttgagtttgtaggcttggataactatatccgtatgtttaaagatcctgtctttacaaaatctctgattaacacagttattttggttattggatctgtaccagttgttgttctattctcactctttgtagcatctcagacctatcatcaaaatgtcattgccagatccttctaccgtttcgtcttcttccttcctgttgtaacgggtagtgttgccgtgacagttgtttggaaatggatttatgacccgctatcagggattctaaactttgtccttaagtcaagccacatcatcagccaaaacatttcttggttgggagataaaaactgggcattgatggcgattatgattattctcttgaccacttcagttggtcagcccatcatcctttatatcgctgccatggggaatattgacaattcactggttgaagcggcgcgtgttgatggtgcaactgagtttcaagttttttggaagattaaatggccaagccttcttccaacaactctttatattgcaatcatcacaacaattaactcattccagtgtttcgccttgattcagcttttgacatctggtggtccaaactactcaacaagtaccttgatgtactacctttacgaaaaagccttccaattgacagaatacggctatgccaacacaattggtgtcttcttggcagtcatgattgctatcgtaagctttgttcaatttaaagtacttggaaacgacgtagaatactaa

SEQ ID NO: 808 - DNA (genomic), 234 bp, Streptococcus pneumoniae; double-stranded, circular
  misc_feature (B) LOCATION 1...234
  hypothetical: NO
  anti-sense: NO
agtagtcataagaaaatgagtacagataaaaggagcaaatcaatgccaaattacaatattccattttcaccgcctgatatcacagaagcagaaattgctgaagtagcggataccctgcgttctggttggatcacaacaggtcctaaaacaaaagaactggagcgccgcttgtctctttacacacagacacctaagactgtttgtctcaactctgcgacagcgctctggagttga

SEQ ID NO: 809 - DNA (genomic), 726 bp, Streptococcus pneumoniae; double-stranded, circular
  misc_feature (B) LOCATION 1...726
  hypothetical: NO
  anti-sense: NO
gattggcataaaatggttgaatcgtatagtaagaatgctaaccataacatgcgtcgtcctgtcgtcaaagaagaaattgtagacttgatgcgtcagcgtcaaaagcaggtcacaggtttcttgaaagaattggaagactttgcccgcaaggaaaatattcctattattccccatgaaacggttgcttatttccgttttcttatggaaaccatgcagcctaaaaatattctggaaattgggacggctatcggtttttcagctctcttgatggctgaacatgcgccaaatgctaagattacaactattgatcgtaatccagaaatgattggttttgccaaggaaaattttgcccagtttgacagtcgcaagcaaatcactctcctagagggagatgcggtggatgtcttatctacactgacagagtcttatgatttcgtctttatggattctgccaagtctaaatacatcgtctttctgccagaaatcctcaaacatttggaagttggtggtgtggttgtcttggatgatatttttcaaggtggtgatgttgccaaggatattatggaagtccgtcgtggtcagcgaaccatttatcgaggccttcaaaaattatttgatgcaaccttagacaatccagaactcaccgcaacattagtgcctttaggagatggtattctcatgcttcgtaaaaatgtagcagatgttcaactgtctgaaagcgaatga

SEQ ID NO: 810 - DNA (genomic), 273 bp, Streptococcus pneumoniae; double-stranded, circular
  misc_feature (B) LOCATION 1...273
  hypothetical: NO
  anti-sense: NO
atgaaaaataagcgttatttttttgacacaattttaataattttactgcttataagcacgatattttgtgtcagcccagtatttataaaattggacatcttaggaactccctctcatgccatcttaacctttgtattggcgataccgttattctatattttgtctcaatgcttacatactttgctattactagtttcctcaatcttttgtaaattaagaccaatttatttttattttatatttgtgatcattataggagcggatgaattataa

SEQ ID NO: 811 - DNA (genomic), 654 bp, Streptococcus pneumoniae; double-stranded, circular
  misc_feature (B) LOCATION 1...654
  hypothetical: NO
  anti-sense: NO
aaggaaaataagatgattgatattcaaggattggaaaagaaatttaatgaccgcgcgattttctctggtttgaatctcaagctggagaagggcaaggtttatgccttaatcggaaagagtggaagcggaaagacgacgctgctgaatatcttgggaaagctagaaaagatagatggaggaagggttctctatcaggggaaagatttaaaaaccattcccactcgtgagtattttcgagatcagatgggctatctctttcaaaattttggcctcttagaaaaccaatcaatcaaagaaaatttggatttgggttttgttggtcagaaaatctcaaaagtagaacgtttggaaaggcaagtgggggctttagaaaaagttaatctagggtatttggatttagaacaaaaaatttatactttatctgggggagaggcccaacgagttgcccttgcaaaaactattttgaaaaatccacccttgattttggcagatgaaccaacagcagctcttgatcctgaaaattcagaggaggttatgaatctcttggtggatttgaaagatgaaaatcgaattatcatcattgcgacccataatcccctagtctggaataaggctgatgaaatcattgatatgaggaaacttgctcatgtgtga

SEQ ID NO: 812 - DNA (genomic), 1062 bp, Streptococcus pneumoniae; double-stranded, circular
  misc_feature (B) LOCATION 1...1062
  hypothetical: NO
  anti-sense: NO
ggaagaaataaagagaggcttttggttttagtaatagagggagttagtgagatgattaaatttgataatattcaaattaaatatggtgattttgttgcaattgataatctgaatttagatatacatgaaggggaattctttacatttcttgggccttcaggatgtggtaaatcaactactttgagagcattggtaggttttttagatccatcatcaggaagtattgaagttaatggaacagatgtcactcatttggaacctgaaaagcgtgggattggtattgtatttcaatcttatgcgctatttccaactatgactgtttttgataatattgcatttggtttaaaagttaagaaggtagctccagatgttattaaagctaaagtatcagcagtggcagcaaaaattaagatctctgatcaacagttacagcgtaatgtatcagaattatctgggggtcaacaacaaagggtagcattggctcgtgctctggttcttgaacctaaaattctttgtctagatgaaccattgtcaaaccttgacgcaaaattacgtgtagatttgagaaaagagttgaaaagacttcaaaaagagttaggtattactactttatatgttactcatgatcaagaggaagccttgactttatctgatagaattgcagtctttaacaatggatacatcgaacaggtcggtacaccagtagagatttatcataattctcaaactgaatttgtatgtgattttattggagatattaatgttttgaccgatgaaacagtccacgaagtattattgaaaaatacaagcgttttcttagaggataaaaaaggatacattcgattagagaaagttcgattcaatcgtgaaactgaacaagattttattctaaaagggacaattattgatgttgagttttctggagttacaattcactatacaataaaagtttctgaaagtcagattcttaatgtaacaagtattgatagtcaggctgctattagatctgtcggagaaagtgtggaattatttatcacaccatcagacgttctgcaattttaa

SEQ ID NO: 813 - DNA (genomic), 291 bp, Streptococcus pneumoniae; double-stranded, circular
  misc_feature (B) LOCATION 1...291
  hypothetical: NO
  anti-sense: NO
ggaggaaataagtatgttaaaagaagtattaaccgttgcaaaagttgcgaaaaaatcttcattatttttgggtggtgtcgcattggtacccttggtttgaaaatcttagcaagtaaggaagctaaaaaaggttattctaaagctttggctaaggcttacaatttgaaaaacaagctaaatgcatctgtttctgttgtgaagcaacatggaaacaatgtcttgcaaaatgccaaatatttgtacgagcaagagaaaaaagaaaagcaattagatagccttataggtgaataa

SEQ ID NO: 814 - DNA (genomic), 432 bp, Streptococcus pneumoniae; double-stranded, circular
  misc_feature (B) LOCATION 1...432
  hypothetical: NO
  anti-sense: NO
actatgaataatctttcgcttgtccttatggatatatctgttcaaaatcgtcaagaagcctacaaagaattagcaaatcaaatcagccttcttgtttctgaagatacagaaaaaatagaagagcttctatattaccgtgagagacagggaagtatagaggttgctaaaggtgttcttctaccacattgtgaaggaaactttcaacatcatgtcttagtgattactagattaaaatcacctatcagagaatggtcgaaggatatccagtgtgttgaccttattatcggtttggccattgcagtatcacaggacaagtcatgtattaaaacattgatgagaagactagcagatgaatcattcataaatcaattaaaacagttaacaaaagaagaattacgggagataatatatggaaatcaaagatattcttaa

SEQ ID NO: 815 - DNA (genomic), 1443 bp, Streptococcus pneumoniae; double-stranded, circular
  misc_feature (B) LOCATION 1...1443
  hypothetical: NO
  anti-sense: NO
aaaatgaataaaagtatgattcgttacctcctttcaaagttacttttgattgaagctgttctcctcttggttcctgtggctatcgctgtctattaccgtgaatcgagccaagtctttacggccctcttttcgaccatagggattctcgtattgttaggcggttcagggagtttacagaagccaaaaaatcaacggatttatgccaaggagggagtcttgatcgttgccctctgttggatcctttggtctttctttggtggtctcccctttgtcttttctgggcaaatccctagcgttattgatgccttttttgaaattagttctgggtttacaactactggagcaagtattttgaacgacgtttcggttctcagccgttccctcctcttctggcgaagttttacccacttgattggagggatgggagtgcttgtttttgcacttgctattatggacaatgccaaaaatagccacctagaggtgatgaaggctgaggttccaggtcctgtttttggcaaggttgtatccaaactaaaaaacactgcccagattctctatctcctttatctagctctcttctccctctttgtcatcatctattatctagctggtatgcctctctacgatagttttgtcattgctatggggacagcgggaactggaggctttaccgtctataacgacggaattgcccactatggcagctcactgattacctatctggtcagtatcggagttctgatttttggggtaaatttcaacctctactactacctcatgctccgtcgcatcaaggccttctttggtgacgaagaacttcgggcttacttggtcattgtactggtttctacaggcttgattagcctcaacaccctctacctctacccagggttttcaaagagctttgaaatgaccttcttccaggtttccaacatcattacaacaactggttttggatatggagatattaccaactggcccctcttctcccagtttatcctcctcttcctcatgacaatcggtggttctgctggatcaactgcaggtggactcaagattattcgaggcctcatcctttcaaaaattgccaaaaatcaaattttgtccattctatctccccaccgtgttttgactctccatgtgaataaaacggtgattgataaggatacccagcataaaattctcaagtactttgtcatctatgctatgattttgctatcccttatctttattgtcagcctagatagcaatgattttctgatcgtgaccagcgctgtctttagctgtttcaataatatcgggcctattctaggaaccacttctagtttctcaatctttagtcctatctcaaaaattctcctctcctttgcaatgattgcaggccgcttggagatttacccaatcctacttctctttatgaagagaacttggtctaagagataa

SEQ ID NO: 816 - DNA (genomic), 414 bp, Streptococcus pneumoniae; double-stranded, circular
  misc_feature (B) LOCATION 1...414
  hypothetical: NO
  anti-sense: NO
cgaatgaataatccaaaaccacaagaatggaaaagcgaggaacttagtcaaggtcgtatcattgactacaaggcctttaactttgtggacggcgaaggcgtgcgtaactctctctatgtatcaggctgtatgtttcactgcgagggatgttataatgttgcgacttggtcttttaatgctggcattccctatacagcagaattagaagagcagatcatggcagatcttgctcagccctatgttcaaggtttgactttgttgggaggggagccttttcttaatactgggattctcttgccacttgttaagcggattcggaaggaattgccagacaaggacatctggtcctggaccggctacacttgggaagaaatgatgttggaaactccagataaactggaattcttgtcactg

SEQ ID NO: 817 - DNA (genomic), 771 bp, Streptococcus pneumoniae; double-stranded, circular
  misc_feature (B) LOCATION 1...771
  hypothetical: NO
  anti-sense: NO
tttcttgataaaatagaggttatgacgagatataaagcaactatttcctatgatggttatgcctttgatggctttcagcgccagcctcatgcgcgtagcgttcaggaagaaattgaaaaaaccttgaccagattaaataaagggcaaaccattactgttcacggtgctggtaggacagatagtggggttcatgccctgggacaggtcattcattttgacctgccttatcagatggatgaggagaaactccgttttgccttggatacccagtctcctgaagatattgatgtgatttcgattgagcttgtggcagatgattttcattgccgttatgccaaacatagcaagacctatgagtttattgtggatagaggacgtcccaaaaatcctatgcgccgtcactatgccacccactttccctacccactcgatgtggaacgaatgcagattgcaatcaaaaagctagagggaacccatgattttaccggttttacagcctctgggactagtgtagaggataaggttcgcaccatcacagaagctagtttaatagtcgatgagacaggacaatttttgacctttaccttttcaggaaatggtttcttgtataaacagattcgcaatatggtggggactcttctcaaaatcggtaacaaccgcatgccagtagagcagattgctctcatcttggagaagaaggacaggcaacttgcaggtcccactgcagcaccaaatggtttgtatttaaaggagattcgttatgaagaataa

SEQ ID NO: 818 - DNA (genomic), 183 bp, Streptococcus pneumoniae; double-stranded, circular
  misc_feature (B) LOCATION 1...183
  hypothetical: NO
  anti-sense: NO
gcccttgataaccactgtcagccaagctttcacaagcttatccagatgattatcttttattcgttatggacaatgctaatggacaatgctatatggcataaatcaagtgccttaaagattccgactaatattggctttgcatttattcctccatacacaccagaaatgaaccccattgaataa

SEQ ID NO: 819 - DNA (genomic), 2001 bp, Streptococcus pneumoniae; double-stranded, circular
  misc_feature (B) LOCATION 1...2001
  hypothetical: NO
  anti-sense: NO
tctgctgataaaaaatcaatgcttagaaactatgaaataataaaaaaggagaacatcatgattaacattactttctcagatggcgctgttcgtgaattcgaatctggcgtaacaacttttgaaattgcccaatctatcagcaattccctagctaaaaaagccttggctggtaaattcaacggcaaactcatcgacactactcgcgctatcactgaagatggaagcatcgaaattgtgacacctgatcacgaagatgcccttccaatcttgcgtcactcagcagctcacttgttcgcccaagcagctcgtcgtcttttcccagacattcacttgggagttggtccagccatcgaagatggtttctactacgatactgacaacacagctggtcaaatctctaacgaagaccttcctcgtatcgaagaagaaatgcaaaaaatcgtcaaagaaaacttcccatctattcgtgaagaagtgactaaagacgaggcacgtgaaatcttcaaaaatgacccttacaagttggaattgattgaagaacactcagaagacgaaggcggtttgactatctatcgtcagggtgaatatgtagacctctgccgtggacctcacgttccatcaacaggtcgtatccaaatcttccaccttctccatgtagctggtgcgtactggcgtggaaacagcgacaacgctatgatgcaacgtatctacggtacagcttggtttgacaagaaagacttgaaaaactaccttcaaatgcgtgaagaagctaaggaacgtgaccaccgtaaacttggtaaagagcttgacctctttatgatttcacaagaagtgggacaaggtttgccattctggttgccaaatggtgcgactatccgtcgtgaattggaacgctacatcgtaaacaaagagttggcttctggctaccaacacgtctacactccaccacttgcttctgttgagctttacaagacttctggtcactgggatcattaccaagaagacatgttcccaaccatggacatgggtgacggggaagaatttgtccttcgtccaatgaactgtccgcaccacatccaagtttttaaacaccatgttcactcttaccgtgaattgccaatccgtatcgctgaaatcggtatgatgcaccgttacgaaaaatctggtgccctcactggccttcaacgtgtacgtgaaatgtcactcaacgacggtcacctattcgttactccagaacaaatccaagaagaattccaacgtgcccttcagttgattatcgatgtttatgaagacttcaacttgactgactaccgcttccgcctctctcttcgtgaccctcaagatactcataagtactttgataacgatgagatgtgggaaaatgcccaaaccatgcttcgtgcagctcttgatgaaatgggcgtggactactttgaagccgaaggtgaagcagccttctacggaccaaaattggatatccagattaaaactgcccttggaaaagaagaaaccctttctactatccaacttgattttttgttaccagaacgcttcgacctcaaatacatcggagctgatggcgaagatcaccgtccagtcatgatccaccgtggagttatctcaactatggaacgcttcacagctatcttgattgagaactacaagggggccttcccaacatggctggcaccacaccaagtaaccctcatcccagtatctaacgaaaaacacgtggactacgcttgggaagtggccaagaaactccgtgaccgcggtgtccgtgcagacgtagatgagcgcaatgaaaaaatgcagttcaagatccgtgcttcacaaaccagcaagattccttaccaattaattgttggagacaaagaaatggaagacgaaacagtcaacgttcgtcgctacggccaaaaagaaacacaaactgtctcagttgataattttgttcaagctatcctagctgatatcgccaacaaatcacgcgttgagaaataa

SEQ ID NO: 820 - DNA (genomic), 719 bp, Streptococcus pneumoniae; double-stranded, circular
  misc_feature (B) LOCATION 1...719
  hypothetical: NO
  anti-sense: NO
cagctgataaaaaatcagaagccttgtatctagtgcaggactctgttgctggtttggatgactatatcactggtaaaacaagcgacttttcaactgtcggtgtcaaggcacttgatgaccaaacggttcaatatactttggttaaaccagaactttactggaattcaaaaacacttgcaacgatactttttcctgttaatgcagatttcctgaaatcaaaaggggatgattttgggaaagcggatccatctagtattttgtacaatggacctttcttgatgaaagcacttgtctcaaaatctgctattgaatataagaaaaaccctaattactgggatgctaagaatgtctttgtagacgatgtgaaattgacctactatgatggtagcgaccaagaatcactggaacgtaattttacagctggtgcttatactacggctcgtctttttcctaacagctccagctatgaagggattaaagaaaaatacaaaaacaatatcatctatagtatgcaaaattcaacttcatatttctttaattttaacctagataggaagtcttacaattatacttctaaaacaagtgacattgaaaagaaatcgactcaggaagcagttctcaataaaaacttccgtcaggctatcaattttgcttttgacagaacatcttatggggctcagtctgaagggaaaagaaggtgcaacaaagattttgcgtaa

SEQ ID NO: 821 - DNA (genomic), 1734 bp, Streptococcus pneumoniae; double-stranded, circular
  misc_feature (B) LOCATION 1...1734
  hypothetical: NO
  anti-sense: NO
aattgtgataaaatagtagaaaagtccaaaaaggagctcttaatgaatacaaaagaattgattgctagcaaattatctagcatcattgatagcctggaccaagaggctattttaaagttactggaaacccctaaaaactcagaaatgggagacattgctttccctgctttttctcttgcaaaagtcgaacgtaaagcaccacaaatgattgcggctgaactggctgaaaaaatgaacagccaagcctttgaaaaagttgtcgcaacaggaccttacgttaactttttccttgataaatctgccatttctgctcaagtattgcaagctgttaccactgaaaaagaacactatgctgaccaaaatattggtaaacaagaaaatgttgttatcgacatgtctagtccgaatatcgctaaaccattttctattggccacctgcgttcaactgttatcggagatagcttgtcacatattttccaaaaaatcggttatcaaacggtcaaggtcaaccatttgggagactggggtaaacaatttgggatgttgattgttgcctacaaaaaatggggcgacgaagaagctgtaaaagctcatccaatcgatgaactccttaaactctatgtccgcatcaacgctgaagctgaaaatgaccctagcttggatgaagaagcgcgcgaatggttccgtaaacttgaaaatggagatgaggaagctctcgctctttggcaatggttccgcgatgaaagtttagtggaatttaaccgcctttacaatgaattgaaggttgaatttgacagctataacggagaagccttctacaatgataagatggatgcagttgtagacattctttctgaaaaaggactacttcttgaatcagaaggtgcccaagttgtgaatcttgagaaatacggaattgaacatccagccctcatcaagaagtctgatggtgcaactctctatatcacacgtgacttggctgcagccctctaccgtaaaaatgaataccaatttgctaaatctatctacgtcgttggtcaagaacaatctgcccactttaaacagctcaaagctgtcttgcaagagatgggctacgattggagtgacgacattacccacgttccttttggtctggttacaaaagaagggaagaagctctctactcgtaaagggaatgtcatcttgctagagcctactattgcagaggctgttagccgtgccaaggtccaaatcgaggctaaaaatcctgaactagaaaacaaagaccaagtagcacatgctgttggggttggagccattaaattctatgacctcaaaaccgaccgtacaaatggatacgacttcgacctagaagctatggtatccttcgagggtgaaactggaccttacgttcaatatgcctacgctcgtatccaatctatcttacgcaaagccgatttcaaaccagaaacatctggcaactatagcttgaatgatactgaaagctgggaaatcattaaactcattcaagacttcccacgtattatcaaccgtgcggcagataactttgaaccttctatcattgctaaatttgcaattagcctggctcaatcctttaacaaatactatgcacatacacgtatcttggatgaaagcccagaacgcgacagccgtctagccctcagctacgcaaccgcagtcgttctcaaagaagcccttcgcttgcttggagtagaagcgccagagaagatgtaa

SEQ ID NO: 822 - DNA (genomic), 282 bp, Streptococcus pneumoniae; double-stranded, circular
  misc_feature (B) LOCATION 1...282
  hypothetical: NO
  anti-sense: NO
aaacgtgataaaggagaaataaagatggcagaaatttatctagcaggtggttgtttttggggcctagaggaatatttttcacgcatttctggagtgctagaaaccagtgttggctacgctaatggtcaagtcgaaacgaccaattaccagttgatcaaggaaacagaccatgcagaaacggtccaagtgatttacgatgagaaggaagtgtcactcagagagattttactttattatttccgagttatcgatcctctcatctatcaatcaacaagggaatga

SEQ ID NO: 823 - DNA (genomic), 597 bp, Streptococcus pneumoniae; double-stranded, circular
  misc_feature (B) LOCATION 1...597
  hypothetical: NO
  anti-sense: NO
atgtcagataatttttttggaaaaacacttgcagtgcgtaagattgatgctataccaggactgctagagtttgacattcccgttcatggagacaatcgtggttggtttaaggaaaacttccagaaggaaaagatggagccacttggctttcctgaaagcttctttgctgcagggaaattgcaaaacaacgtcagcttttctcgcaaaaatgttcttcgaggattgcatgcagaaccttgggacaagtatatctctgttgcagacgatgggaaggttttaggatcttgggttgatctacgcgagggtgaaacctttgggaatacctatcagacagtgattgatgcgagtaagggaatctttgttcctcgaggcgtagctaatggcttccaagttttatcagatacagtgtcatatagctatctggtcaatgattactgggctcttgaactcaaacccaagtatgcctttgtgaactacgctgatccaagccttggtattgaatgggaaaatattgcagaagcagaggtttcagaagcagataaaaatcatccactacttaaggatgtaaaacctttgaaaaaagaagatttggaataa

SEQ ID NO: 824 - DNA (genomic), 189 bp, Streptococcus pneumoniae; double-stranded, circular
  misc_feature (B) LOCATION 1...189
  hypothetical: NO
  anti-sense: NO
gataaagataaaaccctatttagcgctaaccttttagtaaccaacggaactaaaagactcgcaacaaaagaggatattcctattaagataggaactagtgatgtggcaattactgattttgaaataatgtatatgttagcaatgattgttactctaaagaaaatatctgctaaatttgcaaataattga

SEQ ID NO: 825 - DNA (genomic), 573 bp, Streptococcus pneumoniae; double-stranded, circular
  misc_feature (B) LOCATION 1...573
  hypothetical: NO
  anti-sense: NO
gccgaggataatctaatggctcgactctttaccctttcagaatcaaagtactacctgatggcgctggatgcaggcaccggaagtattcgggctgtgatattcgacctggaaggcaatcaaatagcagtgggacaggcggagtggcggcatctggcagtaccggacgttcctggttctatggaatttgatctcaacaaaaactggcaactggcgtgtgagtgtatgcgccaggcgctgcacaacgccggcatagccccggagtatatcgctgccgtttcggcatgttcgatgcgtgaaggcattgttttatataataatgaaggagccccgatctgggcctgcgccaatgtggatgccagagcggcacgcgaagttagcgaacttaaagaactgcacaacaatacctttgaaaacgaagtttatcgcgcgaccggacaaacactggctttaagtgccatccccagattactttggctggcgcaccatcgttccgatatttaccgtcaggcatcaaccatcaccatgatcagcgactggctggcctatatgctcagcggcgaactggcggtggat

SEQ ID NO: 826 - DNA (genomic), 720 bp, Streptococcus pneumoniae; double-stranded, circular
  misc_feature (B) LOCATION 1...720
  hypothetical: NO
  anti-sense: NO
aacttttgtaatagaaaaggaattgaaatgaaaataggaattattgctgctatgccagaagaactggcttatctggtccagcatttagataatacccaggagcaagttgttttgaggaatacctatcatacaggaaccattgcttctcatgaagtcgttcttgtagaaagtggaattggtaaggtcatgtctgctatgagtgtggcgattttggctgatcatttccaggtggatgcccttattaatacgggttcagctggggcagtagcagaaggtatcgctgttggggatgtcgtgattgctgacaaattagcctatcatgacgtggatgtcacagcttttggctatgcttatggacaaatggcgcaacaaccgctttatttcgaatcagacaaaacctttgttgctcaaatccaagagagtttatctcaattggaccaaaactggcatcttggtttgattgctacaggagatagttttgttgcaggaaatgacaagatagaagcgattaagtcccatttcccagaagttttagccgtggagatggagggggcagctattgctcaagcagcgcatgccctcaatctcccagtcttagtcatcagagctatgagtgacaatgccaaccacgaagcaaacatcttttttgatgagtttattatcgaagctggacgtcgctctgcccaagtcttgttgacctttttgaaggctttagattaa

SEQ ID NO: 827 - DNA (genomic), 252 bp, Streptococcus pneumoniae; double-stranded, circular
  misc_feature (B) LOCATION 1...252
  hypothetical: NO
  anti-sense: NO
caagattgtaaaaggaagggaagtctgatggcagaagtagaagagttacgagtacaacctcaagatatcttagctgagcaatccgttttaggggctatctttattgatgagagtaaacttgtttttgtgcgagaatacattgagtctcgggacttttttaagtatgcccatcgtttgattttccaagccatggtcgatttatccgatcgtggtgatgccatagatgcaacaacggttccgtactatccttga

SEQ ID NO: 828 - DNA (genomic), 1404 bp, Streptococcus pneumoniae; double-stranded, circular
  misc_feature (B) LOCATION 1...1404
  hypothetical: NO
  anti-sense: NO
gactactgtaatggaataaaatatggtataattgataagatagatagaatcgaggatgttatgtcatttacgaaatttcaatttaaaaactatattagagaagccttgaaggagttaaaatttacaactccaacagaggtgcaagacaagttgattcctattgttttggcaggtcgtgacctagtaggagaatcaaaaacaggttcaggtaagactcatactttcttgttaccgattttccagcaattagatgaagctagcgatagtgtgcaagcagtgattactgcaccgagtcgtgagttggctactcaaatttaccaagtagcgcgtcagatttcagctcactcagatgtcgaagttcgtgtggttaattatgtgggtggtacggataaggctcgccagattgagaaattggcaagcaatcagcctcatattgttattggaacaccaggccgtatctacgacttggttaaatctggtgatttagctattcataaagccaagacatttgttgttgatgaagcagatatgaccttggatatgggattcttggaaactgttgataagattgctggcagtcttccaaaagacttgcaattcatggtcttctcagcgactatcccacaaaaactgcaaccattcttgaaaaaatacttatcaaatcctgttatggagaaaattaagaccaaaacggttatttctgacaccattgataattggttgatttcgaccaagggacatgataagaatgctcaaatttaccagttgactcagttgatgcagccgtatttggcaatgatttttgttaacactaaaacgcgtgctgatgaattgcattcatatctgactgctcaaggcttgaaggttgcaaaaatccatggcgatattgcccctcgtgaacgcaagcgaatcatgaatcaggtgcaaaatctggattttgagtatattgtcgcaacagatttggcagcacgtgggattgacattgaaggtgtcagccatgtcatcaatgatgccattccgcaagacttatctttttttgttcaccgtgttggtcgtactggacgaaatggcctaccaggtacagctattaccctttatcagccaagtgatgactcggatatccgtgagttggagaaattgggaatcaagtttagtcctaagatggtcaaagacggggaatttcaagatacctatgaccgtgatcgtcgtgccaaccgtgagaaaaaacaagataaacttgatatcgaaatgattggtttggttaaaaagaaaaagaaaaaagtcaaaccgggttataagaagaaaattcaatgggcggttgatgaaaagcgccgtaaaaccaagcgtgctgaaaatcgcgctcgcggtcgtgcagagcgtaaagctaaacgtcaaacattttaa

SEQ ID NO: 829 - DNA (genomic), 918 bp, Streptococcus pneumoniae; double-stranded, circular
  misc_feature (B) LOCATION 1...918
  hypothetical: NO
  anti-sense: NO
ggacactgtaaaattatgatacgtaaactaattgttttcttactaatgctccctctttttgtcttgtggctagagttgcatgtcctagtgaataacttactattgaatctagaatctccccttgattttgtgattagtatgagtcttgctttctgtagtttgattttatcaaaaatagttttagacatactatacgcattgaaagatttgtacaagaaagaagctcttattacgatttttccttttatttttataggcaggaagaaagtaaatgtgaggttctcgccctatttttcattccatcgtaaaagtttgtcgcctgatgatttaagatctaggattatatggagttttattcttgaaattgctattatcctagtatttattttaaaaattccttttgcaatcatcatgcttactacaatatttttctggactataatggatatcaatcatctcgtttttaataagacggaatttctttttaatcaaaataaatgggaaaaagaagattcgtttgaaagcgatttgacgaaaacgttaaaggataaaatacaaaaatcagagctaagttattctgacttaatgtcccttcttctctatgatgcgatgaaccaatccacctttttaacggatagtgaactttttgaggatattttgaaaaaaatcgaagattctcataacacccttctgtgtacaggttttgtcgagttactgctgtatgaaatgtctattagtaacaataacaactggtccaacaaggttgataaaattagaatacacctcatcagaataaatcaattagattttttctattatacaagttggttaaggcaaaattttgatttctgtatgaatagagagtatcataaaatgaaatctcggaaattattactgagtaataaaaagatagtttaa

SEQ ID NO: 830 - DNA (genomic), 2058 bp, Streptococcus pneumoniae; double-stranded, circular
  misc_feature (B) LOCATION 1...2058
  hypothetical: NO
  anti-sense: NO
agaaaatgtaaaggaaaaaacatgacaaaaaacttattagtagaactcggtcttgaagaattaccagcctatgttgtcacaccaagtgaaaaacaactaggcgaaaaaatggcagccttcctcaaggaaaaccgcctgtcttttgaagccattcaaaccttctcaacaccacgtcgtttggctgttcgtgtgactggtttatcagacaaacagtctgatttgacagaagatttcaagggaccagcaaagaaaattgccttggatagtgatggaaacttcaccaaagcagctcaaggatttgtccgtgggaaaggtttgactgttgaagatatcgaattccgtgaaatcaagggtgaagaatatgtctatgtcactaaggaagaagttggtcaatcagttgaagccattgttcctggtgttgtagatgtcttgaagtcattgactttccctgtcagcatgcactgggctggaaatagctttgaatacatccgccctgtccacactttaactgttctcttggatgagcaagagtttgacttggatttccttgatatcaagggaagtcgtgtgagccgtggccatcgtttcttggggaaagaaaccaaaattcagtcagcattgagctatgaagaagaccttcgtaagcagtttgtaatcgcagatccatgtgaacgtgagcaaatgattgttgaccaaatcaaggaaattgaggcaaaacatggtgtacgtatcgaaattgatgcggatttgctgaatgaagtcttgaatttggttgaatacccaactgccttcatgggaagttttgatgctaaataccttgaagttccagaagaagtcttggtgacttctatgaaggaacaccagcgttactttgttgttcgtgatcaagatggaaaactcttgccaaacttcatttctgttcgtaacggaaacgcagagcgtttgaaaaatgtcatcaaaggaaatgaaaaagtcttggtagcccgcttggaagacggagaattcttctggcgtgaagaccaaaaattggtgatttcagatcttgttgaaaaattaaacaatgtcaccttccatgagaagattggttcccttcgtgaacacatgattcgtacgggtcaaatcactgtacttttggcagaaaaagctggtttgtcagtggatgaaacagttgaccttgctcgtgcagcagccatttacaagtttgacttgttgacaggtatggttggtgaatttgacgaactccaaggaattatgggtgaaaaatacacccttcttgctggtgaaactccagcggtggcagctgctattcgtgaacactacatgcctacatcagctgaaggagaacttccagagagcaaggtcggcgcagttctagccattgcagacaaattggatacgattttgagtttcttctcagtaggattgattccatcaggttctaatgacccttatgcccttcgtcgtgcaactcaaggtgtggttcgtatcttggatgcctttggttggcacattgctatggatgagctgattgatagcctttatgcattgaaatttgacagtttgacttatgaaaataaagcagaggttatggactttatcaaggctcgtgttgataagatgatgggctctactccaaaagatatcaaagaagcagttcttgcaggttcaaactttgttgtggcagatatgttggaagcagcaagtgctctcgtagaagtaagcaaggaagaagattttaaaccatctgttgaatcactttctcgtgcctttaacctggctgagaaggcagaaggggttgctacggttgattcagcactatttgagaatgaccaagaaaaagctttggcagaagcagtagaaacactcgttttatcaggacctgcaagtcagcaattgaaacaactctttgcgcttagcccagtcattgatgctttctttgaaaatactatggtaatggctgaagatcaggctgtccgtcaaaatcgtttggcaatcttgtcacaactaaccaagaaagcagctaagtttgcttgttttaaccaaattaacactaaataa

SEQ ID NO: 831 - DNA (genomic), 1074 bp, Streptococcus pneumoniae; double-stranded, circular
  misc_feature (B) LOCATION 1...1074
  hypothetical: NO
  anti-sense: NO
acctatcgtaacggttgttttacctctcctagttccaaccttactagcagctccttgcttgtatttatgagagcattctcagactttggaacgcctatgttgattggcgaaggatatcggactttccctgtcctgatttatacccaatttattagcgaagttgaaggaaattctgcttttgcaattatggcgattatcattgccttggcaattttccttatccaaaaacacattgcaaaccgctacagtttcagcatgaatctgatccatccaattgagcctaaaaaaactacaaaaggaaaaatggctgccatttatgcaacagtctacggaattatctttatctctgttttacctcaaatctacttaatttatacctctttcctaaaaacatcaggtatggtatttgttaaaggttattctccaaacagttacaagctagctttcaatcgtatgggatctgctattttcaataccattcgtatccctttgattgccttagttctagttgttctatttgcgacatttatctcctacctagccgttagaaaacggaatttgtttacaaacttaattgacaacctcagtatggtaccttatattgtaccaggaaccgttctagggattgccttcatttcttccttcaatactggtctatttggaagtggatttcttatgattacagggactgctttcatcttgattatgtctctatctgtcagaagattaccttatactattcgctcatctgttgctagcttacaacaaatagcaccaagtattgaagaagctgctgaaagcttaggaagtagtcgtctcaatacctttgctaagattacaactccaatgatgctatctggtatcatttctggagccatcttatcttgggtcacactgatttcagaactctctacttctatcctctatcctcctctacaatgtcaaaacaagaacaatgactgtagctatttatacagaggttctcagaggaaattacggtgtagccgcagccttgtcaactatcctgactgttctaacagtaggttccttgctcttgtttatgaaaatctctaa

SEQ ID NO: 832 - DNA (genomic), 366 bp, Streptococcus pneumoniae; double-stranded, circular
  misc_feature (B) LOCATION 1...366
  hypothetical: NO
  anti-sense: NO
gcaactagtaaatccgccagctcggtagcgctccataggagtgcaagccgctgtggtacaacatttaaaggagaaaatataaaaatgggacgcagtcttaaaaaaggacctttcgtcgatgagcatttgatgaaaaaagttgaagctcaagctaacgacgaaaagaaaaaagttattaaaacttggtcacgtcgttcaacgatcttcccaagtttcattggttacactattgcagtttatgacggacgtaaacacgtacctgtttacatccaagaagacatggtaggccacaaacttggtgaatttgcaccaactcgtacttacaaaggtcacgctgcagacgacaagaaaacacgtagaaaataa

SEQ ID NO: 833 - DNA (genomic), 343 bp, Streptococcus pneumoniae; double-stranded, circular
  misc_feature (B) LOCATION 1...343
  hypothetical: NO
  anti-sense: NO
gatttaagtaaagaaaagctagaaaacgtttcagaggatattatgagtattgaaatgaccgtcagtgagattgcagaggtcttaggattatctcgccaagcaatcaataaccgtgtcaaagaattaccagaagaagacacagataaaaatgacaaaggggtaacagttgttaccagaagtggcttgattaagctagaagaaatctataaaaaaacgatttttgaagatgagcctgtcagtgaagatgtcaaacaacgtgaactgatggagattctagtggatgagaagaatgcagcaatcttgtctttagaacaatgccacacaaggctccgaatttgtagat

SEQ ID NO: 834 - DNA (genomic), 483 bp, Streptococcus pneumoniae; double-stranded, circular
  misc_feature (B) LOCATION 1...483
  hypothetical: NO
  anti-sense: NO
aaagcgagtaaatttatgtcccgttcccaattaacgattttaacaaatatttgtctgattgaagaccttgaaactcagtgcgtggttatgcagtaccgtgctcctgaaaccaatcgctggtctggttatgcctttcctggaggtcatgtagaaaatggtgaggcttttgcggagtctgtcattcgtgaaatttacgaagaaacaggattgactatccaaaatccgcaactggtaggtgttaaaaattggcctttggatacaggggggcgctacattgtcttttgttacaaggcgaccgagtttactggaactcttcaatcttcagacgagggagaagtttcttgggtgcaaaaagaccagattccaaacttgaatctggcctatgatatgctaccattgatggaaatgatggaagctcccgacaagtcagagtttttctaccctcgccgtacagaagacgattgggaaaagaaaatcttctag

SEQ ID NO: 835 - DNA (genomic), 192 bp, Streptococcus pneumoniae; double-stranded, circular
  misc_feature (B) LOCATION 1...192
  hypothetical: NO
  anti-sense: NO
cttcagagtaatgatcaaactcctaccagaacagagcaaggcaatctctttaaattaaccgctcttgcaaaactatctaacgaggatagtaaactcatccaatatggcttacaaggtcgcgtcactagtgtaactacaaagaaaacatattttgattatttcaaagataaaattttaacccattctgattaa

SEQ ID NO: 836 - DNA (genomic), 288 bp, Streptococcus pneumoniae; double-stranded, circular
  misc_feature (B) LOCATION 1...288
  hypothetical: NO
  anti-sense: NO
ataataggtaatccaaaaattaatggttcattaatattaaataaggctggaactacagatgctcgtcctattgctttaagctgttcagatttagaggcaaaagcaatatataaacatagtcctaaagttgcaccagaaccacctgcaattacaaacatattagaaaattcacctgcaacagcgaagtgcccgccagcagcattttcagccatgttggcaagagcaattggactaacaaatgcaaaaacaatgttcgcaccgtggatacctacaatccaaagtagttga

SEQ ID NO: 837 - DNA (genomic), 363 bp, Streptococcus pneumoniae; double-stranded, circular
  misc_feature (B) LOCATION 1...363
  hypothetical: NO
  anti-sense: NO
aagcgaggtaatctcatggaacaatttttagataacatcaaagaccttgaagtcactacagttgtgcgtgcgcaagaagctcttgataaaaaagaaactgcaaccttctttatcggtcgcaaaacttgcccttactgccgtaaatttgcaggtacattgtcaggtgtcgtagctgaaaccaaagctcacatttacttcatcaatagtgaagaaccaagccaactcaatgatttgcaagcattccgctcacgctatggaatcccaactgtaccaggttttgttcatattacagatggacaaatcaacgtccgttgcgactcttcaatgtcagcacaagaaatcaaagatttcgcaggattgtaa

SEQ ID NO: 838 - DNA (genomic), 1326 bp, Streptococcus pneumoniae; double-stranded, circular
  misc_feature (B) LOCATION 1...1326
  hypothetical: NO
  anti-sense: NO
ttagtgggtaagaaaaggagatttattatgtcaaagatggatgttcagaaaatcattgcaccgatgatgaagtttgtgaatatgcgtggcattatagctctaaaagatgggatgttagcaattttgccattgacagtagttggtagtttgttcttgattatgggacaattgccgttcgtaggattaaataaaaacattgctagtgtttttggagctaattggacagagccgtttatgcaagtatattcaggaacttttgctattatgggtctaatttcttgtttttcaattgcctattcttatgctaagaatagcggagtagaggctttaccagctggagttctatctgtatctgcattctttattttgctaagatcatcttatatccctaaacaaggtgaggcgattggggacgctattagtaaagtttggtttggaggccaaggaattatcggtgctatcattataggtttggtagtaggaagtatttataccttctttataaagagaaaaattgttattaagatgccagaacaagttccacaagctattgccaaacagtttgaagcaatgattccagcatttgtaattttcttatcttctatgattgtatatattttagcgaagtcattgactaatggcggaacattcatagaaatgatttattctgctattcaagttccgttgcaaggtttaactggatctttgtatggtgctattggaattgcattctttatatcatttttgtggtggtttggtgttcatgggcaatcggtagtaaatggagtagtgacagctctgcttttatctaatcttgatgctaataaagctatgttagcctctgctaatctatcattagaaaatggtgcacatattgttactcaacaatttttagattcatttttaattctatcaggttcagggattacgtttggtcttgtagttgccatgctttttgcagcaaaatcaaaacaataccaagccttaggaaaagttgcagcttttccagcaatatttaacgtaaatgagccagttgtatttggatttccgattgtcatgaatccagttatgtttgtacctttcattcttgttcctgtacttgcagctgtgatagtatatggagctattgcaacaggtttcatgcagccattctcaggggtaacattgccttggagtacaccagctattttatcaggatttttggtgggtggatggcaaggagttattactcagctggtgatattagcgatgtctacattggtttattttccattctttaaagtacaggatcgtttagcttaccaaaatgaaatcaaacaatcttag

SEQ ID NO: 839 - DNA (genomic), 525 bp, Streptococcus pneumoniae; double-stranded, circular
  misc_feature (B) LOCATION 1...525
  hypothetical: NO
  anti-sense: NO
ttttggggtaagacaatgaatagcagagtagaatttcggattttcactattgttgatttggacaaggaagaagaatatttacatgagatgcatttgaaaggttggaggtatagaacgagtcgttttggtttgttctattttgaccaatgtcaaccagacgatgtcatctaccgtatctatgattctagatttcttaaaaaatataagcatgaactgcaagattttagagatagaggttgggaattgataggagcaggttcttgttcgattcttcgtaaatcgtcttctgatttacttccagaggatcaagtctatatgagtaaggggctcaaatgggaagttatgcgatctagacttcgttcctgtacaactactttcttaggtggtcttgttgtttgtacgagtttgtttagagaggatctttctatgtctttctttcttatttttgttttatatgcttttctgatttcttatctaattcatggttatttcagactaaaaaggaaataccgagtagatgaatag

SEQ ID NO: 840 - DNA (genomic), 861 bp, Streptococcus pneumoniae; double-stranded, circular
  misc_feature (B) LOCATION 1...861
  hypothetical: NO
  anti-sense: NO
tttatctgtttgggttgcgattgttttggttcgatttttaggagaaaacttagtgcgttttctggcgatgataggatgaataaagggatttatcagcatttctccatagaagatcgtccatttcttgacaagggaatggaatggataaagaaggtagaagatagctatgctccttttttaactccttttatcaatcctcatcaggagaagctattaaagattttggcaaaaacctatggtcttgcttgtagcagtagtggggaattcgtctcgagtgagtatgttcgagttttattatacccagattatttccaaccagagttttcagattttgaaatatctcttcaggaaattgtgtattccaataaatttgaacatttaacgcatgctaagattttagggacagtcatcaatcaattagggattgaacggaaactttttggagatatcctagtagatgaagaacgggcgcagattatgattaatcagcagtttcttcttctctttcaagatggactaaagaaaattggtcgtatacctgtttcgctggaggaacgtcctttcaccgagaaaatagataagctagaacagtatcgagaactggatttatctgtgtctagttttcgattagatgttcttttatcaaatgttttgaaactatttaggaatcaagcaaaccagttgattgaaaagaaacttgtccaagtaaattatcatgtggtagacaaatcagattacactgttcaagttggagacttgattagtgtgagaaaatttggtcgcttgagattacttcaagataagggacaaacgaaaaaagagaagaaaaaaataaccgtccagttattattaagtaagtga

SEQ ID NO: 841 - DNA (genomic), 723 bp, Streptococcus pneumoniae; double-stranded, circular
  misc_feature (B) LOCATION 1...723
  hypothetical: NO
  anti-sense: NO
ttttccatccttctcacgaataataaagtgaggaggatttttatgtacagtatttcattccaagaagattcactattaccaagagaaaggctggccaaggaaggagttgaagcgcttagtaaccaagagttgctagctattttactcaggacaggaacacgtcaagttagcgtttttgaaattgcccaaaaagtcttgaacaatctttcaagcctaacggatttgaaaaaaatgaccctgcaggaattgcagagtttgtctggtattgggcgtgttaaggccatagaattacaagctatgattgaactggggcatcgtattcacaaacacgagactcttgaaatggaaagtattctcagcagtcaaaagttggccaagaagatgcagcaggaattaggggataaaaaacaagagcacctggtggcactctatctcaatactcaaaatcaaatcatccatcagcagaccatttttatcggttctgtaactcgtagtatcgctgaaccgcgagagattcttcactatgcaatcaagcatatggcgacttctcttatcttggtccacaatcatccttcaggagcggtagcgcctagccaaaatgatgatcatgtcactaaacttgttaaagaagcctgcgaactgatgggaattgttctcttggaccatttgattgtctctcattctaattactttagttatcgtgaaaagacagatttaatctaa

SEQ ID NO: 842 - DNA (genomic), 828 bp, Streptococcus pneumoniae; double-stranded, circular
  misc_feature (B) LOCATION 1...828
  hypothetical: NO
  anti-sense: NO
gaaaccatcctcaagaaaaatcttcctttcacgggaaatattgcctacacaacgagagagttcacctatgataatcccctcatgcagttggtccgtcacactattgaatacattaagaatcagaaaagcattggtcaaggggtactagataatctctcaactagtcgtgaaaacgtatctgaaatcgtgcgtgtaacgccctcttataaactagctgatcgtgctaagattattcggggaaatcaatctaaacctatacgtcatgcatactttcacgagtacagaaatttacaagaactttgtctgatgatcctaaaccaagaaaagcacggtttagggtatcaagatcaaaaaatctatggtattctctttgatgttgcctggctttgggaagagtatgtttacaccttgttgccaaaaggttttgtacatcccagaaataaggataagacggatggaatttcagtattttctgttgggaaacgaaaagtatatccagatttttatgacagagaacgaaagattgttctagatgcaaaatataaaaaactggaattgactgaaaaaggaatcaaccgtgaggacttattccagctgatttcctattcttatattttaaaagctgagaaggctggactgatttttcctagtatggagcagtcagtaaatagtgaaataggaaaagtagctggctatggagctcaattgaagaagtggtctattcgaatccctcagaatgcctcatcctatagtgcattttgtaaaatgatggaaaattcagaagaaaattttaaagcgattattgatgaagaagtggggagaaaataa

SEQ ID NO: 843 - DNA (genomic), 819 bp, Streptococcus pneumoniae; double-stranded, circular
  misc_feature (B) LOCATION 1...819
  hypothetical: NO
  anti-sense: NO
aacgttttcaaggaaggtaacgatatgtctgaagaaacaattgattatggacaagtgacaggaatggtgcattcgacagaaagctttgggtcagtagatgggcctggtattcgctttattgtctttttgcagggctgtcacatgcgttgccagtattgccacaacccagacacttgggctatggagtccaataagtcacgtgaacggacggtagatgatgtcttgacagaggccttgcgctaccgtggtttctggggaaataagggtgggattacagtcagtggaggagaagctctcttgcagattgatttcctgattgctctcttcaccaaggctaaggaacaaggaatccactgtaccttggatacctgtgctcttcctttccgtaataaaccacgttaccttgagaagtttgacaaactcatggctgtcactgacttggttcttttggatatcaaggaaatcaacgaagaacagcacaagattgtcactagccaaactaataaaaatatcttggcttgtgcccagtatctatcagatattggaaaacctgtctggattcgccacgtgctagttccaggattgacagacagagatgatgacttgattgaacttggtaagttcgtcaagaccctcaaaaatgttgataagtttgaaattctaccttatcacaccatgggtgagttcaagtggcgtgaacttggaattccatattccctcgaaggagtcaaaccaccaacagcagatcgcgtcaagaacgctaaaaaactcatggataccgaaagttatcaagattatatgaaacgtgtacatggatag

SEQ ID NO: 844 - DNA (genomic), 192 bp, Streptococcus pneumoniae; double-stranded, circular
  misc_feature (B) LOCATION 1...192
  hypothetical: NO
  anti-sense: NO
acctatttcaaccccattatctataggcgtatttttacgcctttttatatacttgaagcacataagaaacattatgggaagtttgctgatggaagtactcaagaaattgatgttccttatgatattcctgatacttgggagtgggtgaggtttactacattggttaaaattgtcaaaagtggctcttcctga

SEQ ID NO: 845 - DNA (genomic), 204 bp, Streptococcus pneumoniae; double-stranded, circular
  misc_feature (B) LOCATION 1...204
  hypothetical: NO
  anti-sense: NO
gctcatttcaaaattacgttaacttttttcacgaaaaggagaaaattatgcgttatgattatggatagcgctttcaaatttttaaactctatcccatccttttatctatattatgagcgaaaatataataactgtcaagtaactaaagtgaattttataaaaaaattacaagccaaatttgtaaagtttacactaagccgctag

SEQ ID NO: 846 - DNA (genomic), 1188 bp, Streptococcus pneumoniae; double-stranded, circular
  misc_feature (B) LOCATION 1...1188
  hypothetical: NO
  anti-sense: NO
ttggacttcaacccctgtggtagaagacagactggtgatgttgttagtgctgaagtattgacagttgatgcgactcaagctaacgttgcaatctctggaactggtgttgaaggtgtcttgactcttcgcgaattgacaaacgatcgtgatgcagatatcaatgactttgttaaagtaggagaagtattggatgttcttgtacttcgtcaagtagttggtaaagatactgatacagttacataccttgtatctaaaaaacgccttgaagctcgcaaagcatgggacaaacttgttggtcgcgaagaagaagttgttactgttaaaggaacgcgtgccgttaaaggtggactttcagtagaatttgaaggtgttcgtggatttatcccagcttcaatgttggatactcgtttcgtacgtaacgctgagcgttttgtaggtcaagaatttgatactaaaatcaaagaagttaacgctaaagaaaaccgcttcatcctttcacgtcgtgaagttgttgaagcagctactgcagcagctcgcgctgaagtattcggtaaattggctgttggtgatgttgtaactggtaaagttgctcgtatcacaagcttcggcgctttcatcgaccttggtggtgttgacggattggttcacttgactgaattgtcacatgaacgtaacgtatcaccaaaatcagttgtaactgttggtgaagaaattgaagtgaaaatccttgatcttaacgaagaagaaggacgtgtatcactttcacttaaagcaacagtaccaggaccatgggatggcgttgagcaaaaattggctaaaggtgatgtagtagaaggaacagttaaacgtttgactgacttcggtgcatttgttgaagtattgccaggtatcgatggacttgttcacgtatcacaaatttcacacaaacggattgaaaatccaaaagaagctcttaaagttggtcaagaagttcaagttaaagttcttgaagttaacgcagatgcagaacgcgtgtcactttctattaaagctcttgaagaacgtccagcccaagaagaaggacaaaaagaagaaaaacgtgctgctcgtccacgtcgtccaagacgtcaagaaaagcgtgatttcgaacttccagaaacacaaacaggattttcaatggctgatttgtttggtgatatcgaactttaa

SEQ ID NO: 847 - DNA (genomic), 531 bp, Streptococcus pneumoniae; double-stranded, circular
  misc_feature (B) LOCATION 1...531
  hypothetical: NO
  anti-sense: NO
aggagcttcaatatggagtatgaattgctcattagggaagcagagcccaaagatgcagctgaattagtggcctttttaaatcgtgtgagtttggagacagactttaccagcctagacggagatggtattctcttgactagtgaggagatggaaatattcctcaacaagcaagctagttcggacaatcagataaccttacttgcattcttaaatggcaaaattgctggtattgtaaatattacagctgatcagcgtaagagagtccgtcatattggagatctcttcattgtgattggaaaaagatattggaataatggcttgggaagtttgttgctagaagaagcgatagagtgggcacaagcaagtggcattctgcgtcgtctccaactgactgtccaaactcgtaatcaagcagcagtccatctttatcaaaagcatggctttgtcattgaaggtagccaagagcgtggggcatatatagaagaagggaaatttatcgatgtttacttgatgggtaaactgataggttag

SEQ ID NO: 848 - DNA (genomic), 435 bp, Streptococcus pneumoniae; double-stranded, circular
  misc_feature (B) LOCATION 1...435
  hypothetical: NO
  anti-sense: NO
tcttcattcaaaatttctgtctcgaaaagagttttcccttgtaagtcacatagactgagaaagatacctaggacgtttatttcaatacctccaacaacatacggaatattatctgtgatagaaatagtttttctacgtcttccagatccggaaaactcgctaaattcatcaccagtttcgtatatgagggactgttcgcttagttcttttatgatgttagtcgttgttgctggagtaagtcctgtttcattaacaatatctgtacgggatgttgctggatttcgatatagaaactccagtatagtggctctattttgtaaaaagnnnnnnnnnnnnnnnnnnnnnnnnnnnnnnnnnnnncgcggggnnnnaaaannannannannaannaanaaaaaacncnnacaaaaacccccaccttcattttcaagttaa

SEQ ID NO: 849 - DNA (genomic), 828 bp, Streptococcus pneumoniae; double-stranded, circular
  misc_feature (B) LOCATION 1...828
  hypothetical: NO
  anti-sense: NO
ataagattcaagctatcaaggaggtgctccatgttagcaagtgaagtgatccaagcttatgaagccttttgccctcaggaattttctatggagggagacagccgtggtctgcaaattggcactttagacaagggtatccaaagggtcatggttgccctcgatattcgtgaagagacggtggcagaggccattgaaaagggtgtggacttgattatcgtcaagcacgcgcctatctttcgtcctatcaaggacttgcttgccagccgtccgcaaaatcagatttacatcgacctgattaagcatgatatcgcagtttatgtcagccataccaatattgatatcgttgaaaatgggctcaatgactggttttgtcagatgctaggaatcgaggagacgacttatctgcaggaaacaggtccagaacgtggaattggacgtattgggaatattcagcctcagacattttgggaattggcccaacaggtcaagcaagtctttgacctagatagccttcgaatggtgcattatcaagagaatgatttgcagaagcctatttcaagagtagcaatttgtggtggaagcgggcagtctttctataaggatgctttggcaaagggggcagatgtctatatcactggcgacatctactaccatactgctcaggatatgctgtctgatggcttgttagcattggatccaggtcactatatcgaagtgctttttgtggaaaaaatcgcagcactccttactcaatggaaagagaaaaaaggctgggaactagagattttacctagtcaagcatcgaccaatcctttccgtcatatctag

SEQ ID NO: 850 - DNA (genomic), 960 bp, Streptococcus pneumoniae; double-stranded, circular
  misc_feature (B) LOCATION 1...960
  hypothetical: NO
  anti-sense: NO
atggatatcaaaataaaaagggaggaaattatgaaaaagttttcaaaaacattgagagacaactggatctttctcttgatggttttgccaggggcactctggttgattctattcttttacattccagtatttgggaacgtggttgccttcaaagactaccacatgaccagtaatggtttcatagatagtatcataaatagtaaatgggtcggactcgataatttcagattcttatttagttcaagagacgcctttattatcacacgaaatactgtcctctacaatcttggctttatctttctaggtttagttgtatctgtagggattgccattatcctcagcgagctccgttctaagagaatggtgaagatttttcaaacttctatgttgttcccttacttcttgtcttgggttatcatcagtttctttacagatgccttcctaaatattgataaaggggtgttcaatcatctattggaaagtcttggtctcaaagaagtcaatttctacgctgacctgggcatctggccctatctcctacttttcctaggtatttggaaaggttttggatatagcagtgtcatgtactatgcgacgatcatgggaattgatccaacctactacgaagcagcgacagtggacggagctagcaagtggcaacgtattcgcaacgtaaccattcctcagttgactccgcttgtaactgtattgaccatccttgcagtcggaaatatcttccgcgcagacttcggtctcttctatcaaatcccacacaatgctggtcagctttacaatgtaaccaacgttttggacgtatatgtttttaatggtttgactcagacagcagatatcggtatggctgcagcagccggtctttaccaatccgttgttggtttgattctggttatcctatcaaacttgcttgcaagacgagtcgatccaaactcagctttgttctag

SEQ ID NO: 851 - DNA (genomic), 309 bp, Streptococcus pneumoniae; double-stranded, circular
  misc_feature (B) LOCATION 1...309
  hypothetical: NO
  anti-sense: NO
aggagtatcaatatgaaacaaacagttaaaaaattagctcttgtagcgagcattgcagcaacattaggtggaagtgtagcagttgcctctgcagccgttcaatacccagaaggtggtgtttggacttatggttcaggtaacggtggtgcttactcaaactactatcacccttcaaaataccatagttcaacagttgttagcagaaaaactggttcatctgacaagggatatgctggtgctggagggacttctcgtgcatggattcgtacttcttggggagagaaagttgcattctactataatgtttag

SEQ ID NO: 852 - DNA (genomic), 279 bp, Streptococcus pneumoniae; double-stranded, circular
  misc_feature (B) LOCATION 1...279
  hypothetical: NO
  anti-sense: NO
gtcgccatcaaaatagttgttccttgtaggttaatccgttccaagagattcataatttcccatgaattatccggatccagatttcctgttggctcatcagctatcaatactttgggattatttacaattgcacgcgcaatcgcaatccgctgttgctccccacctgagagttcatttgggaaagaacgaaccttatgcttcaatccaaccaggtccaaaacttccatcactcgtcttttgatattacggcgattttccccgattacttccatagcgtaa

SEQ ID NO: 853 - DNA (genomic), 1302 bp, Streptococcus pneumoniae; double-stranded, circular
  misc_feature (B) LOCATION 1...1302
  hypothetical: NO
  anti-sense: NO
cacatgatcaaccgttactctcgccctgagatggcgaatatttggagtgaagaaaataaataccgtgcttggcttgaggtggaaatcctctctgacgaggcatgggctgagttgggggaaatccctaaggaagatgtggctttgattcgcaagaaggcggactttgacatcgaccgtattttggaaattgagcaggagacgcgccacgatgtggtggctttcacgcgtgcggtttctgagactcttggtgaagagcgcaagtgggttcactatgggttaacttctaccgacgtggtggatactgcttatggttacctctacaagcaggccaacgacatcatccgtcgtgaccttgaaaacttcactaatatcatcgctgacaaggccaaggagcacaagttcaccatcatgatggggcgtactcatggtgtgcacgctgagccgacaacctttggtcttaaattggcaacttggtacagcgaaatgaaacgcaatatcgagcgtttcgagcatgcagctgctggtgtagaagctggtaagatttctggtgcggttgggaactttgccaatatcccaccatttgtagaggagtatgtctgcgataaacttggcatccgtgcccaagaaatctctacacaagtccttcctcgtgaccttcacgctgagtactttgcggttcttgccagcattgcgacttcaatcgaacgtatggcgactgagattcgtggtctacaaaaatctgagcaacgcgaagtagaagagttctttgctaaagggcaaaaaggatcttcagcaatgcctcacaaacgcaacccaatcggttctgaaaatatgactggtctggcgcgtgtcattcgtggtcacatgattacggcttatgaaaacgtcgctctctggcacgaacgcgatatttcccactcatcagctgagcgtatcatcacaccagatacgaccattttgattgactacatgctcaaccgttttggaaatatcgtcaagaacttgacagtcttcccagaaaatatgatccgaaacatgaactcgacttttggtcttatctttagccaacgggctatgttgacattgattgaaaaaggcatgacccgtgagcaagcctatgacttggtgcaaccaaaaacagcctactcttgggacaaccaagtagactttaaaccacttcttgaggcagattcagaagtaacatcacgtctcactcaagaagaaatcgatgaaatcttcaacccagtttattacaccaaacgagtggatgatatctttgaacgtcttggactaggtgattaa

SEQ ID NO: 854 - DNA (genomic), 441 bp, Streptococcus pneumoniae; double-stranded, circular
  misc_feature (B) LOCATION 1...441
  hypothetical: NO
  anti-sense: NO
atatttgtcaaatgttttatattacatttttattacaaatttctatatcataagcttctactccaaaaagataaagacactacttttgcccttttcgattctctttttaaacatagcatcatcttccttcattcctataaaaacacttccgatgagagagcttgttttttaatttcgttaaacaacaaaaaacgcaagcttaagcctgcggacaatctttatagccatttcatttctttcacatctgttttacgaactttagcatatttcttagcgcttgtaaaatgtagagtaactggtttaaatactccgcttttgtctcttcgtaaacctaaaactgcggatcttttatttttatcctcaaaaaatatgacgtccaatttcatagtatttttagataaatcgctagctacgatgcaacaacttattattttagaatag

SEQ ID NO: 855 - DNA (genomic), 240 bp, Streptococcus pneumoniae; double-stranded, circular
  misc_feature (B) LOCATION 1...240
  hypothetical: NO
  anti-sense: NO
gggcatgtcaagaataccttgatggaccatcccgttaatggagaaattgaaaccttgcttaaactgtcttgtcgcagagatgtgcaacattttctagaacaagtcgagcattctgactttagacctctatctgaattgacagatggcatccattaccacctagtcgaagccgaaacacaacaagacctccactatatcgaggaagccttggatcagctaggttatttagtaaaagactag

SEQ ID NO: 856 - DNA (genomic), 189 bp, Streptococcus pneumoniae; double-stranded, circular
  misc_feature (B) LOCATION 1...189
  hypothetical: NO
  anti-sense: NO
caaagtgtcaaggaggaaactgatgaactggacaaaaaacaagcctacatcgtcagctgccacagtggtttgcgcagctatatcgcagagcctatcctcaagcaagcaggatttaccgcccaaaaccttgacggcgcttattcactatacaaaatggttaacccanaaagagtaaaatatggaaactag

SEQ ID NO: 857 - DNA (genomic), 882 bp, Streptococcus pneumoniae; double-stranded, circular
  misc_feature (B) LOCATION 1...882
  hypothetical: NO
  anti-sense: NO
atatcagtcaaactatacggcccaggaacttgtttatatttacaaagaggagaaaaaaccatgccgtcgatgaaagaatacgcattacagtaccaaaagttagggttctcagtcattccaatcaatcctaaaaacaagatgcctttaatcgaatttgctgataaaccagccatgactccatctgagattgaaaacttttgggacggctaccctaatgcaaacattgccctaaagactaccaacttctttgtcattgatattgacaaacacggcaaatcgaacggttttgaatcgctaaaaaaatggaaacatctaaatttaatcgaaccgacactgcaagctaagacggctagtggcggtaaacatctattctacttcaaacgagaagatgagccgatcactcagatgattggattcttgcctggtgttgatattaaggctcacgaaaataattatgtgttagtcgcaccctctgccacagataaagggcagtatgagtgggatctggaaaagtctaaggaaggtggcacgatggtcactccttcaaaatatttaatccagtctataaaaaaacagtatggcgaaactcacggttataagtatgatggtaaggacggtcttagggatttagttagacgttcacatactagagaccgaacacagactacagatctctttgaaaccatcgcccttggttttggtgatgaaggtggacgaaatgacaaactagcaaaattcgtaggtggtctcttatatcgtgcggtcgacgatggtgtagttgttcaacttgcaagattagcaaatgcaaatagtccaacccctttgcctgaaaaggaaatgatgcgtactattgaaagtatgattaaaaaagataggaggtga

SEQ ID NO: 858 - DNA (genomic), 234 bp, Streptococcus pneumoniae; double-stranded, circular
  misc_feature (B) LOCATION 1...234
  hypothetical: NO
  anti-sense: NO
acaccagtcaaaccttctgcagcaacacggtcagctttcttagctgccttagccatacctttttcacgaagcaattcaatcgctttttcgatgtcaccgtctgtttctacaagcgcttttttagcgtccataacaccggcaccagatttttcacgcaactcttttacaagtttagctgtaatttctgccattttaattctcctatattttttgaaaataggagagccgggctaa

SEQ ID NO: 859 - DNA (genomic), 603 bp, Streptococcus pneumoniae; double-stranded, circular
  misc_feature (B) LOCATION 1...603
  hypothetical: NO
  anti-sense: NO
caggtggtcaaactgactacctgctatttttgtgattatggctcttattatgggaatatacctatgaattgggttgttataaaaataaaagatattttttcaatgaatacaggtctttcttacaagaagggcgatttaagcattaataataaaggtgttagaattatacgtggtggtaatattaagcctttagaattttctctgttggataatgattactacattgatacacaattcatctcctctgaacaagtttatttaaaacataatcagctaataacacctgtatcaacctctttagaacatattggaaagtttgcaagaatcgataaagactatgatggtgttgtggctggtggatttattttccaattaacaccattcgaaagttcagagattatttcaaaatttctattatttaacttgtcttctccgttattttataaacaattgaaagcaataactaaactatcaggtcaagctttatataatattcctaaaactacactgagcgagctattaattccgttagctccttttgaggaacaggaacttattactcaaaaagttgagaaactttttgaaaaagtaaatcaactttga

SEQ ID NO: 860 - DNA (genomic), 219 bp, Streptococcus pneumoniae; double-stranded, circular
  misc_feature (B) LOCATION 1...219
  hypothetical: NO
  anti-sense: NO
cgcgcggtcaatgcggttcaagctgggcaagccgacgctatcatggcagggatgacaaagactaaagaacgtgaaaaagtcttcaccatgtctgatacttactatgatacaaaagttgtcattgctactacaaagtcacacaaaattagcaagtacgaccaattaactggcaaaacagtttgtgttaaaaacggaactggcgctcaacgtgttccttga

SEQ ID NO: 861 - DNA (genomic), 234 bp, Streptococcus pneumoniae; double-stranded, circular
  misc_feature (B) LOCATION 1...234
  hypothetical: NO
  anti-sense: NO
tatctttccaagcattgtagtacagcagatttttgcccaaggactgagcctcctttaacaactcaaactcccttacattatatcggccagccccatggaaagattatagccagactaatcaataatataatacatactagaatacaaaatatttttttattcatactttttctcctatctttattttctacctacatagtacctcttattaagctcatttcaaaattacgttaa

SEQ ID NO: 862 - DNA (genomic), 189 bp, Streptococcus pneumoniae; double-stranded, circular
  misc_feature (B) LOCATION 1...189
  hypothetical: NO
  anti-sense: NO
gatttctccaatcgttttattttgattataccatatttgaaagggggtgaggaaatgagaccaagacgatatccgtatagtgggaaaaaagagtccaccttcgtaaaggcagaccctgagttaatgttgaatatcaataagattgatgttggaaatatacaagcgaaaaatatatttggaaaaatttaa

SEQ ID NO: 863 - DNA (genomic), 999 bp, Streptococcus pneumoniae; double-stranded, circular
  misc_feature (B) LOCATION 1...999
  hypothetical: NO
  anti-sense: NO
tcagactccaagtcatacaagaaaagaatactctcaataccaactagtaagaaaggcaacattatgaaatcctaccaagctgtctaccaaatcctatctaaagaaaccgactatatcagcggagaaaaaatcgcagaaaaactatccctaagccgaacagcaatttggaaagccatcaagcgactagaacaagaaggcattgaaattgatagtatcaaaaatagaggatataaactgatgaatggtgaccttattcttccagagattctagaagaaaatcttccaattaaagtcagctttaaacccgaaacaaaatcaacacaactagatgcaaaagaagcaattgatttaggccatgaagcaaataccctctatctagcttcctatcaaacagcaggccgaggccgttttcaacgttccttctactcaccacaaggtggtatttatatgacactccatcttaaaccaaatctcccctatgacagattaccatcctacacactacttgtagctggagctgtctacaaagccattaagaacctaactttaatagatgtcgacataaaatgggtcaatgatatctatctaaacaatcataaaattggaggaatccttactgaagcaatgacctctgtagaaactggcttagtcacagatatcattattggagtaggtatcaatttcactattaaagacttccctcaggaattaaaagaaaaagctgccagcttatttaaagctacagctcctataacaaggaatgaattgatcatagaaatctggcgtgctttcttcgaaacaccagcagaagagctattatacctatacaaaaaacagtcattcattctaggaaaagaagtcactttcacactagagcaaaaagactacaagggacttgctaaagacatctcagaaaatggaaaacttttagttcaatgtgataacggaaaagaaatctggctaaatagtggcgaaatttctctcaatagttggaagtaa

SEQ ID NO: 864 - DNA (genomic), 336 bp, Streptococcus pneumoniae; double-stranded, circular
  misc_feature (B) LOCATION 1...336
  hypothetical: NO
  anti-sense: NO
caattatccaatctgcaatattggaccagtttgtttgcaagtccatggacgatagctatcaatctgattgatattttgattgttgcttatattttataccattttacaaaaggtattgcaggaaccaagattatgattttggtacgtggagttttggtatttatttttagctcaaatccttgcaaatatgattggtttgactacgatttattggttattcaatcaaattattacttatggggttattgcggcggttgttatcttctctccagagattcggactggtttggaacgtttgggaagagcgacagatttcttttccaatgcccctattag

SEQ ID NO: 865 - DNA (genomic), 216 bp, Streptococcus pneumoniae; double-stranded, circular
  misc_feature (B) LOCATION 1...216
  hypothetical: NO
  anti-sense: NO
acgattcccaatcccagtaaccgtcgttatgatcgagttgaactcagccatcaagtcattgacacatgtttccgccttgtcaatgagcctcttgtaatgtttgatgttttcattacacgagataaaacgtttatgcgttatcaaactcatgaccaattgaaacaaaaagctgtggttagatcctttcggaaattgtcaagcgattggaggaaatga

SEQ ID NO: 866 - DNA (genomic), 189 bp, Streptococcus pneumoniae; double-stranded, circular
  misc_feature (B) LOCATION 1...189
  hypothetical: NO
  anti-sense: NO
aattctcccaaagtcagagttttatttctaacttttgagagaacttcatttttgattcagactttttctactgctattccttacgctatgaaatcagataaattcttttttatcacttctccacttggcaatcttaattcaatcgttccatccatattgaatataacactatctaagcctaatccgtaa

SEQ ID NO: 867 - DNA (genomic), 927 bp, Streptococcus pneumoniae; double-stranded, circular
  misc_feature (B) LOCATION 1...927
  hypothetical: NO
  anti-sense: NO
atcgttaccaaagagctgttaaaggtttggcttcttatggaggatcagatgaaaagtaaaaacggagttccttttggccttctctcaggtattttctggggcttgggtctaacggttagtgcttatatcttttcgatttttacagatttgtcaccctttgtggtggctgcagctcatgattttttgagcatctttatcttactagcttttctcttggtaaaagaagggaaagttcgcctctcaattttcttaaatattcgcaatgtcagtgttatcatcggagccttgctagcaggccctatcggtatgcaggccaatctttatgcagttaagtatatcggaagttctttagcttcatctgtatcggctatttaccctgcgatttcagttctattggctttcttctttttgaagcacaagatttcgaaaaatactgtatttgggattgtcttgattattggagggattattgcccagacctataaggttgaacaggttaattccttctacattgggattctctgtgctttggtttgtgctattgcatggggaagtgagagtgttcttagctcctttgctatggaaagtgaactgagtgaaatcgaagccctcttaatccgtcaagtgacttcgttcttgtcctatcttgtgattgtgctcttctctcatcagtcatttactgcagtagtcaatggacaattgctaggtctcatgattgtttttgcagcctttgatatgatttcctacttggcttattatatcgctatcaatcgcttggcaaccagccaaggttacaggcttgaacgtgagctatgtagtattggacgggtcttgtttggcaattgtttttttaggggtgcacccgctagatatgctgaccattatgacgtcacttgtcgtcattgctggagtttatattattattaa

SEQ ID NO: 868 - DNA (genomic), 720 bp, Streptococcus pneumoniae; double-stranded, circular
  misc_feature (B) LOCATION 1...720
  hypothetical: NO
  anti-sense: NO
gatttcaccaacatatggttcatactaccaaaagcaatcagaagtattatcggtaatgatgatttgattaaaattgataatactttacagtatccgtattcgacttcagctatggttttatctaagtattatggagtagccgatggaatgaatgtagaagggaggggaagtgcgaattttattaaagataatgtgttaattacagcggctcacaactactacagacatgactatgggaaagaagcggatgatatttatgttcttccggctgttagtccaagtcaagaaccatttggaaagatcaaagtaaaggaagttcgttatttgaaggaatttagaaatttaaattctaaggatgcaagggaatatgacttggctttattaattctagaaaagcccattggtgcaaaattagggactttgggtcttcctactagtcaaaaaaatttgacaggaataactgtgactatcacaggctatccatcatataattttaaaatttatcaaatgtatacagataaaaaacaagttttaagtgatgatggcatgttcttggattaccaagttgatactttagaggggtctagtggatctacagtttatgatgctagtcaccgtgtagtaggagtgcatactttaggagatggagctaatcaaattaacagtgcagttaaattaaatgaacgaaatttgtcatttatttatttattcggttcttaa

SEQ ID NO: 869 - DNA (genomic), 423 bp, Streptococcus pneumoniae; double-stranded, circular
  misc_feature (B) LOCATION 1...423
  hypothetical: NO
  anti-sense: NO
tcaaccaccaacctattttccaactttgtgcatagcacacgatttaaaactaaagaggtgaaaactgtgatttcaaaaccagataaaaacaaactccgccaaaaacgccaccgtcgcgttcgcggaaaactctctggaactgctgatcgcccacgtttgaacgtattccgttctaatacaggcatctacgctcaagtgattgatgacgtagcgggtgtaacgctcgcaagtgcttcaactcttgataaagaagtttcaaaaggaactaaaactgaacaagccgttgctgtcggtaaactcgttgcagaacgtgcaaacgctaaaggtatttcagaagtggtgttcgaccgcggtggatatctatatcacggacgtgtgaaagctttggctgatgcagctcgtgaaaacggattgaaattctaa

SEQ ID NO: 870 - DNA (genomic), 231 bp, Streptococcus pneumoniae; double-stranded, circular
  misc_feature (B) LOCATION 1...231
  hypothetical: NO
  anti-sense: NO
aaagccaccaaaccagaagcatcattcaagagtccttcgcccttaagaatattggacacgcgcttaggaaagctaaaacgctccgaaagagaggcaaaggccaccaagtccgtaggaccaagggctgcaccaacagccaagcaagctgccaagggaaggctgaaccaaagaagatgggccaagccacccaaactcagggtcgagataaaaatcactggaaatatgagataa

SEQ ID NO: 871 - DNA (genomic), 870 bp, Streptococcus pneumoniae; double-stranded, circular
  misc_feature (B) LOCATION 1...870
  hypothetical: NO
  anti-sense: NO
tccgtaaccaagactcgccatggcgttgtttcaatgttcatgagaatggccaggaggtgggccatgcttagtttattatcttacgactttatacaacgcgcctttttggcggttattgctatgagtcttttctcaccggtattgggaaccttcctcatcttgcgtcgtcagagtttgatgagtgatacccttagccacgtctcactttcaggtgtagcctttggtctggttttggggatttctccaactgtttctactattgccattgtcttgattgcggcggtctttctggagtatctccgtacggtttacaagagctttatggaaatcgggacagctatcctcatgtcaacaggtctggctgtttctctgattgtcatgagcaagggtaaaagctcgagttcaatgagtttggaccaatatctctttggttcgatcgtgactatcagtgaagaacaggtcatttccctctttgtcattgcggcggttgttttgattttgacctttctctttcttcgtcctatgtatatcttaacttttgacgaagatacggcctttgtggatggcttgccagttcgtaccatgtccattctttttaacatggtgacaggggtggctattgcccttatgattcctgcagcaggagctcttctggtatcgaccattatggtcttgccagctagtattgccctgcgtctggggaaaaactttaaatcggttatgctgcttgccagtgcgattggctttttgggaatggtagcaggactttacatttcctactatgcagaaacacctgcaagtgcaagtattaccattatttttgtaactgtctttatactaatcagtttagtaagacgttttatcaaatag

SEQ ID NO: 872 - DNA (genomic), 282 bp, Streptococcus pneumoniae; double-stranded, circular
  misc_feature (B) LOCATION 1...282
  hypothetical: NO
  anti-sense: NO
gaagcaaccaagtctgcagctaagaataatcaaaacgtggttcaaggtgttatgaccactctggcggaaatctttactccgataattccagccttgattgttggtggattgatcctcggtttccgtaatgtcttggaaggtgtccattggtcgatgttggatggcaagaccatcacagaatcctctcagttttgggcaggggttaatcacttcctctggttgcctggtgaagctatcttccagttcttaccagttagggattacttggtctgtttctcgtaa

SEQ ID NO: 873 - DNA (genomic), 552 bp, Streptococcus pneumoniae; double-stranded, circular
  misc_feature (B) LOCATION 1...552
  hypothetical: NO
  anti-sense: NO
aaagcgaccaaacaactcattagaaagattcatatggaacaattacattttatcacaaaattactagacattaaagaccctaatatccagattttagacatcatcaataaggatacacacaaggaaatcatcgccaaactggactacgacgccccatcttgccctgagtgcggaaatcaattgaagaaatatgactttcaaaaaccttctaaaattccttatcttgaaacgactggtatgcctactagaattctccttagaaagcgtcgattcaagtgctatcactgttcaaaaatgatggtcgctgaaacttctatcgtcaagaaaaatcaccaaatccctcgtatcatcaaccaaaagattgctcaaaagttaattgaaaagatttctatgactgatattgcccatcagcttttcatctcaacttcaactgttattcgtaagctcaatgattttcactttaaacatgatttttcttgtcttcctgagattatgtcttgggacgttgaaacagtccgggtagtgactgtttcaatcgggagatggagatga

SEQ ID NO: 874 - DNA (genomic), 630 bp, Streptococcus pneumoniae; double-stranded, circular
  misc_feature (B) LOCATION 1...630
  hypothetical: NO
  anti-sense: NO
actcttgccaagcaattttatccaaatttcccaatcagaaatcatcaatatcgattccatctctcacctcaagctcacgccaaacggtctggtagaaattttcttgaaaaacgaaagcttcacctactcttcacgccgttatctaaaaaccatcaaggagaaattagaactatgaaaaaacaagtatttcacgatgcagctaccggtgttcttatcggcctcatcctctctatcctcttttcactcatttatgcaccaaatacctacgcaccactaaatccctactctctcatcggccaagtgatggatcagcatcaggttcacggtgccctggtcttgctctactgcacacttatctgggcaaccatcggtatgctcttcaactttggcaaccgcttatttagccgtgactggagcatgcttcgtgccactctgactcatttcttccttatgctggctggctttgtcccactagcaactcttgctggttggttccctttccactggattttctacctccagctcattatcgagtttgcgattgtctatctcatcatctgggctattctctataaaagagaggctaaaaaagtagatcacatcaatcaactcttggagcatagaaaatag

SEQ ID NO: 875 - DNA (genomic), 480 bp, Streptococcus pneumoniae; double-stranded, circular
  misc_feature (B) LOCATION 1...480
  hypothetical: NO
  anti-sense: NO
atctgtgccaagataggttgggtagatagccaaatgttaagattagaagatgggaaaaaagaaggaaaatcaaatagagaaattgcctctctacttggaaaagctcctcaaactatccatactgaaatcaagtatgggacagtccgaaaatgtcttggaaaagggcgcttcaaagaggtttattctgccgactatgctcaacagtcttatgaaaataatcgcaagcactcggtcaagagatcaagcttgaccaaggaactaaaggaaaagattctccactatcataaccaaaaatttttgcctgaaatgatggtgatggctaaaggggttaacgtgggaatttcaaccatttactattggattcatcatggaaagttggggttaagcaaacaggatttgctttatcctagaaaaggaaaatctgttaagaaacaagttagtcccaattttaaacccgctgatcaatctatcgaatcataa

SEQ ID NO: 876 - DNA (genomic), 1719 bp, Streptococcus pneumoniae; double-stranded, circular
  misc_feature (B) LOCATION 1...1719
  hypothetical: NO
  anti-sense: NO
aatccagccaagtctattgtgaaatcaatgcatcccaacatggaaaggaggactagaatgaaacgacaaactgtaaaccagacgctcaaacgtttagccgtagatttagcaagccatcctttcctccttttcctagcctttctaggaactattgctcaagttggcttatcaatttacctacctattctgattgggcaggtcattgaccaagtcctagtggctggttcatcaccagttttttggcagatttttctccagatgctcttggtggtaataggaaatactctggtacaatgggccaatcctctcctctataatcgtctaatcttctcttataccagagatttacgggagcgaatcatccataagctccatcgtttaccgattgcctttgtagataggcaaggtagtggagagatggttagtcgtgtaaccacggacatcgaacagttggcagctggcttgaccatgatttttaaccaatttttcattggtgttttgatgattttggtcagtattctagccatgctccaaattcatctcctcatgactctcttagtcttgctgttgacgccactgtccatggtgatttcacgctttattgccaagaaatcctatcatctcttccagaagcaaacagagacgaggggaattcagactcagttgattgaagaatcgcttagtcagcagactataatccagtccttcaatgctcaaacagaatttatccaaagattgcgtgaggctcatgacaactactcaggctattctcagtcagccatcttttattcttcaacggtcaatccttcgactcgctttgtaaatgcactcatttatgcccttttagctggagtaggagcttatcgtatcatgatgggttcagccttgaccgtcggtcgtttagtgacttttttgaactatgttcagcaatacaccaagccctttaacgatatttcttcagtgctagctgagttgcaaagtgctctggcttgcgtagagcgtatctatggagtcttagatagccctgaagtggctgaaacaggtaaggaagtcttgacgaccagtgaccaagttaagggagctatttcctttaaacatgtctcttttggctaccatcctgaaaaaattttgattaaggacttgtctatcgatattccagctggtagtaaggtagccatcgttggtccgacaggtgctggaaaatcaactcttatcaatctccttatgcgtttttatcccattagctcgggagatatcttgctggatgggcaatccatttatgattatacacgagtatcattgagacagcagtttggtatggtgcttcaagaaacctggctcacacaagggaccattcatgataatattgcctttggcaatcctgaagccagtcgagagcaagtaattgctgctgccaaagcagctaatgcagactttttcatccaacagttgccacagggatacgataccaagttggaaaatgctggagaatctctctctgtcggccaagctcagctcttgaccatagcccgagtctttctggctattccaaagattcttatcttagacgaggcaacttcttccattgatacacggacagaagtgctggtacaggatgcctttgcaaaacntcatgaagggccgcacaagtttcatcattgctcaccgtttgtcaaccattcaggatgcggatttaattcttgtcttagtagatggtga

SEQ ID NO: 877 - DNA (genomic), 246 bp, Streptococcus pneumoniae; double-stranded, circular
  misc_feature (B) LOCATION 1...246
  hypothetical: NO
  anti-sense: NO
gttcaagtcctacaaggtccatttgaatattggaggattacccaagtccggctgaagggaacggtcttgaaaaccgtcaggcgtgtaaaagcgtgcgtgggttcgaatcccacatcctccttttatattattaacgcgggatggagcagctcggtagctcgtcgggctcataacccgaaggtcgtaggttcaaatcctgctcccgcaataaggctcggtagctcagttggtagagcaatggattga

SEQ ID NO: 878 - DNA (genomic), 189 bp, Streptococcus pneumoniae; double-stranded, circular
  misc_feature (B) LOCATION 1...189
  hypothetical: NO
  anti-sense: NO
tcggaagtcctagactcacgcggtaacccaacacttgaagtagaggtttacactgaatcaggtgctttcggacgtggtatggttccatcaaggagctttctactggtgaacacgaagcagttgaacttcgcgacggtgacaaatctcgttacggtggtcttggtacacaaaaagctgttgacaacgtaa

SEQ ID NO: 879 - DNA (genomic), 186 bp, Streptococcus pneumoniae; double-stranded, circular
  misc_feature (B) LOCATION 1...186
  hypothetical: NO
  anti-sense: NO
acgcaatacaaaaagagcctgttgccaagctctttatactcaatgaaaatcaaagagcaaactaggaaactagccacaggttgctcaaaacaccgttttgaggtagtagataagactgacgaagtcagctcaaaacactgttttgaggttgcagatatacggcaaggcgacgctgacgtggtttga

SEQ ID NO: 880 - DNA (genomic), 1083 bp, Streptococcus pneumoniae; double-stranded, circular
  misc_feature (B) LOCATION 1...1083
  hypothetical: NO
  anti-sense: NO
ttactgtacaaaatattctttttgttctgtatctggtcactatcttttataaaacacatttccgtgatccaaattaccataaatacggagatttttatgcccgttacgattaaagacgtggccaaggctgctggtgtttcgccttcaaccgtaacccgtgttattcaaaataaatcaaccattagcgacgaaacaaaaaaacgcgttcgcaaggctatgaaggaactcaactaccacccaaacctcaacgctcgtagcttggtaagcagctatactcaggttatcggattggttcttcctgatgactcagacgccttctaccagaatcctttctttccatcggttctacgtggcatctctcaagtcgcatctgaaaaccactatgccattcagatagcaacagggaaagatgagaaggagcgtctcaacgctatttcacaaatggtctacggcaagcgtgtagatgggctaatctttctctatgcccaagaagaagaccctctcgtaaaactcgtcgcagaagaacagttccccttccttatcttaggtaaatctctatctcctttcatcccacttgtcgacaacgacaatgttcaagctggttttgatgcgactgaatatttcatcaaaaaaggctgcaaacgcattgcctttatcggaggaagtaaaaagctcttcgtgaccaaagaccgtttaacaggctatgaacaggcgcttaaacattacaaacttaccactgacaacaatcgcatctactttgccgacgagtttctggaagaaaagggctataaatttagcaagcgattattcaagcacgatccacaaattgacgctatcatcacaaccgatagcctcctagctgaaggtgtttgtaactatattgccaaacaccagctggatgtccctgttctcagctttgactcggttaatcccaagctcaacttggcagcctatgtcgatatcaatagtttagagcttggtcgtgtttcccttgaaactattctccagattattaatgataataaaaacaataaacaaatttgttaccgtcaattgatcgcccacaaaattatcgaaaaataa

SEQ ID NO: 881 - DNA (genomic), 411 bp, Streptococcus pneumoniae; double-stranded, circular
  misc_feature (B) LOCATION 1...411
  hypothetical: NO
  anti-sense: NO
cagtcggtccttatgctcacattcgtccaaattcaagtctgggtgccccaagttcatattggtaactttgttgaggtgaaaggatcttcaatcggtgagaataccaaggctggtcatttgacttatatcggaaactgtgaagtgggaagcaacgttaatttcggtgctggaactattacagtcaactatgacggcaaaaacaaatacaagacagtcattggagtcaatgtctttgttggttcaaattcaaccattattgcaccagtagaacttggtgacaattccctcgttggtgctggttcaactattactaaagacgtgccagcagatgctattgctattggtcgcggtcgtcagatcaataaagacgaatatgcaacacgtcttcctcatcatcctaagaaccagtag

SEQ ID NO: 882 - DNA (genomic), 366 bp, Streptococcus pneumoniae; double-stranded, circular
  misc_feature (B) LOCATION 1...366
  hypothetical: NO
  anti-sense: NO
attttaaacaagcttttgagctattcacaagacttgaaacatcactatcagctctatcaactcttgctgtttcactttcagaataaggaaccggagaaatttttcggacttattgaggacaatctaaagcaggctcatcctctttttcagactgtctttaaaacctttctaaaggacaaagagaaaatcgtcaacgcccttcaactacactattctaacgccaaattggaagcgaccaataatctcatcaaacttatcaagcgcaatgcctttggttttcggaactttgaaaacttcaaaaaacggatttttatcgctttgaacatcaaaaaagaaaggacgaaatttgtcctttctcgagcttag

SEQ ID NO: 883 - DNA (genomic), 513 bp, Streptococcus pneumoniae; double-stranded, circular
  misc_feature (B) LOCATION 1...513
  hypothetical: NO
  anti-sense: NO
ctggtaaacaaaatgtcaaagaatagtatttttctcttaaaaaagagaagtctaaaaggaaaggagtcagatatgagacagctagcaaaggatatcaatgcttttttgaatgaggtgattttgcaggcggaaaatcagcatgaaatcctaataggtcattgcactagcgaggtggccctgaccaatactcaggagcatatccttatgctcttgtcagaggaatctttaacaaattcagaattggcccgtcgtctcaatgtcagtcaggcggcagttaccaaggccattaagtctttggtcaaggaagggatgttggaaacatctaaagattctaaagatgcgcgtgtgattttttatcagttgactgacttggctcgtccaatcgctgaggagcaccaccatcaccatgagcatacacttttaacctatgaacaagtggcgactcagtttactccaaatgaacaaaaagtgattcagcggtttttgactgctttagtaggagaaatcaaataa

SEQ ID NO: 884 - DNA (genomic), 1140 bp, Streptococcus pneumoniae; double-stranded, circular
  misc_feature (B) LOCATION 1...1140
  hypothetical: NO
  anti-sense: NO
attatgaacaatactgaattttatgatcgtctgggggtatccaaaaacgcttcggcagacgaaatcaaaaaggcttatcgtaagctttccaaaaaatatcacccagatatcaacaaggagcctggtgctgaggacaagtacaaggaagttcaagaagcctatgagactttgagtgacgaccaaaaacgtgctgcctatgaccagtatggtgctgcaggcgccaatggtggttttggtggagctggtggtttcggcggtttcaatggggcaggtggcttcggtggttttgaggatattttctcaagtttcttcggcggaggcggttcttcgcgcaatccaaacgctcctcgccaaggagatgatctccagtatcgtgtcaatttgacctttgaagaagctatcttcggaactgagaaggaagttaagtatcatcgtgaagctggctgtcgtacatgtaatggatctggtgctaagccagggacaagtccagtcacttgtggacgctgtcatggcgctggtgtcattaacgtcgatacgcagactcctcttggtatgatgcgtcgccaagtaacctgtgatgtctgtcacggtcgaggaaaagaaatcaaatatccatgtacaacctgtcatggaacaggtcatgagaaacaagctcatagcgtacatgtgaaaatccctgctggtgtggaaacaggtcaacaaattcgcctcgctggtcaaggtgaagcaggctttaacggtggaccttatggtgacttgtatgtagtagtttctgtggaagctagtgacaagtttgaacgtgaaggaacgactatcttctacaatctcaacctcaactttgtccaagcggctcttggtgatacagtagatattccaactgttcacggtgatgttgaattggttattccagagggaactcagactggtaagaaattccgcctacgtagtaagggggcaccgagccttcgtggcggtgcagttggtgaccaatacgttactgttaatgtcgtaacaccgacaggcttgaacgaccgccaaaaagtagccttgaaagaattcgcggctgctggtggcttgaaagtaaatccaaagaaaaaaggcttctttgaccatattaaagatgcctttgatggagaatga

SEQ ID NO: 885 - DNA (genomic), 216 bp, Streptococcus pneumoniae; double-stranded, circular
  misc_feature (B) LOCATION 1...216
  hypothetical: NO
  anti-sense: NO
ttatcgaacaagttttatgatagctaccttgttgggatgctcttattttttatcagacaaaacaaaaggattaagggagttaatttccttaatccgatagttcttattcttgacgttgtccgaaatctgcaatcatctgctccatttcttgtcgactcggagtggtcagcatatacaggtaatctccttgaagttccgcgaaggcagctggcatga

SEQ ID NO: 886 - DNA (genomic), 525 bp, Streptococcus pneumoniae; double-stranded, circular
  misc_feature (B) LOCATION 1...525
  hypothetical: NO
  anti-sense: NO
tatgagaacaagggagaatatatgaccttagaatgggaagaatttctagatccttacattcaagctgttggtgagttaaagattaaacttcgtggtattcgtaagcaatatcgtaagcaaaataagcattctccaattgagtttgtgaccggtcgagtcaagccaattgagagcatcaaagaaaaaatggctcgtcgtggcattacttatgcgaccttggaacacgatttgcaggatattgctggcttacgtgtgatggttcagtttgtagatgacgtcaaggaagtagtggatattttgcacaagcgtcaggatatgcgaatcatacaggagcgagattacattactcatagaaaagcatcaggctatcgttcctatcatgtggtagtagaatatacggttgataccatcaatggagctaagactattttggcagaaattcaaattcgtactttggccatgaatttctgggcaacgatagaacattctctcaactacaagtaccaaggggatttcccagtatga

SEQ ID NO: 887 - DNA (genomic), 1995 bp, Streptococcus pneumoniae; double-stranded, circular
  misc_feature (B) LOCATION 1...1995
  hypothetical: NO
  anti-sense: NO
gaggttgacaaaatgaatcaaacagttttagatgtaaaaaacttaaaaactgaattcatcactgataaaaaagcatttccgattattaaagatgtaaacttcactttggaaagagggaaagttttagggattgttggtgaatctggatgcggtaagagtgtaacagtgaatacagtgttaaacttattacctaaaaatggacgcattgctgaaggtgaaatcacatatttcgatgaagataagccgatagagcttcaaaaattaaagcaatatggtaaagaatttcgaaagttacgtggtgaaaacatatcaatgattttccaagatccaatgtctgcattgaatccagtatatacaattggtaatcaaattactgaagtccttcatgaacattatgacatttctaaagaggaggcaaataaacgtgctatagaaatgttagaaaaacttggaattcataatgctgcagaacgcatgaatgactatccacaccaatttagtggagggcagcgtcaaagaatagtcatagcgattgcaatggtatgtaatccagatattctaattgcagatgaaccaacaactgcccttgatgtaacaatccaagcacaaatacttgatttacttgatgatttacgtaaagagcatggaacttctattatcttaattactcacgatttaggcgttattgctcaaattgcggatgaagttgcagtgatgtatgctggtgaagtcgttgaagttggaactgtagctcagatctttgatcaacctaaacacccgtatactcgttctctattaagatctattcctaatcctgaaaatatggataaaaagctacatgttatccaggggagcgtaccttcaatttctgaaatatctgaaaaaggatgcagattcgcaaatcgtattccatggttagaaaaagaacatcatgaagaagaacctcaattgcatgatttaggtgacggacattttgtaaggtgttcttgctataaacatttctttttcgaagataaggaagaagaaacattagcggaaaaacatgtaggtaatgttgttttagaagtaaaaaatattaaaaagtactactatcctaagaagcaactattcaagccactaggttctccgttgaaagcacttgatgacgtatctctagagttaagaaaaggaactactattggtatcgtaggagagtctggaagcggtaagagtacgattgcgaaatcattaatgaaactccatgatattacagatggtgaaatcaatattgatttgaatgggaaaactcaaaatatttatggaattaaacgtaaggaagatttggatttccgtaagaaagttcaaatggtattccaagatccttatgcatcattgaacccaactaagaaaatttataattcatttgatgaaccgatgattgtccataatattggaaacaaagaggaacgctttgaacgtatgaaagaagccttgaagatggtaaacgtgccagttgagtacttggagcgttatcctcatgaattttcaggcggacaacgtcaacgtttatgtattgctcgtgccctttgtatgaaaccagaaattttaattttagatgaacctgtttcagcattagatctatctgtacaagcgcaagttttgaattatcttgttgaaatccaaaataaagaagatttgacttatgtatttatttctcatgacctaggtgttgtgaaatacatgtgtgactatctatatgttattcataaaggacgtattgtagaagctggttctcgagaagatatctacaataacccaatgcatatttacactaaaaaactattagctgctattccagaagttgattatcacttcaaagaggcattggcaacaaaacgtaaagaaaatgaagttgaatttaaagcacagtaccatgaattttatgatgaagatggccgtgcttatgatcttaagcaggtttcaccaacacattttgtagcgttaaaaccagaatag

SEQ ID NO: 888 - DNA (genomic), 237 bp, Streptococcus pneumoniae; double-stranded, circular
  misc_feature (B) LOCATION 1...237
  hypothetical: NO
  anti-sense: NO
aattatgacaaaacacattcacaagaaggctacgacattttaaaaggtgagggcggatgtatcgtttgccctactaaagttggttacattatcatgaccagcaacaaggcaggacttgagcgtaagttcgcagccaaagaacgtaagcgtaacaaaccaggtgttgttctctgcggtagcatggatgaacttcgcgctttagcgcaactcaacccagaaattgaagcattctactaa

SEQ ID NO: 889 - DNA (genomic), 507 bp, Streptococcus pneumoniae; double-stranded, circular
  misc_feature (B) LOCATION 1...507
  hypothetical: NO
  anti-sense: NO
tcgccttgcaagaaggtcgcacatcgtgtggctttttttgattattcgaagggtggtgatggaaaattgagtggattgagaataaaacaaaagagatttgcagatgagtacatcatctcaggtaatgcgacggaagcctataagaaagcaggttatcgtgtttctagtgatagagtggcaggcgttgaaggacataagttactaaagaatcctaagattaaaagctatatagatgaacgactgaaacagcttgattctgaaaagattgcggatcagcaagaggtcttaggttatctaacttcagtcatgcgaggagagacgcaagaacagaccttgataagcattggagaactagggcagacgattacggatatagatgtaggagctaaagatagaatcaaggcggctgaacttcttggtaaacggcataggctttggacggataaggtagaggcggatgtttctggaacggtggtgtttgcaaatgagtcagacatatcagattaa

SEQ ID NO: 890 - DNA (genomic), 264 bp, Streptococcus pneumoniae; double-stranded, circular
  misc_feature (B) LOCATION 1...264
  hypothetical: NO
  anti-sense: NO
tgtgtctgcaaggctcgtcaaaaaggttttgatgtggtggtcgaaattcttcaccatatcttgcaagaagatgttcagattgttcttttgggaactggcgatccagcctttgaaggagctttctcatggtttgctcagatttacccagacaagctatcagcaaatatcacttttgatgtcaaacttgctcaggaaatttacggtgcttgtgacctcttcctcatgccaagtcgttttgaaccgtatggtttgtcttacatgtng

SEQ ID NO: 891 - DNA (genomic), 240 bp, Streptococcus pneumoniae; double-stranded, circular
  misc_feature (B) LOCATION 1...240
  hypothetical: NO
  anti-sense: NO
ggattatgcaagagaagtataggctttaatgaagttgaagaaaacatcaatcaaggtactggtcaaataactacttttaatcaattaggcttcaagggatattcagataagccagatggttggtatttacctaaaaatatgaatgatgtagcaataatccttgaaacaaaatcagaagaaagagatattagcaaacaaatttttattgatgagttaatgaaaaatatagacataatttaa

SEQ ID NO: 892 - DNA (genomic), 462 bp, Streptococcus pneumoniae; double-stranded, circular
  misc_feature (B) LOCATION 1...462
  hypothetical: NO
  anti-sense: NO
ggaaaatgcaatggcaaacccaactttcggagaaaaaaagtgaatacagactatattgctcgctatggcgtatatgcagttatccctaatcctgaacaaaaacaaattgttcttgttcaagaaccaaatggtgcttggttcctaccatgtggaaaaattgaagcaggtgaaaatcatcaggaagccctaaagcgtgagttgattgaagagcttggtttcacagcagaaattggtacctattacggacaagctgacgaatatttctattctcgtcatcgtgatgcctactactacaatcctgcctacctctatgaagcaactcctttcaaagaagtacaaaagccactagaaaactttaatcatattgcctggttccctattgacgaggctatcaaaaaccttaaacgtggtagccataaatgggccattgaatcttggaaaaaacagcataagattgactaa

SEQ ID NO: 893 - DNA (genomic), 219 bp, Streptococcus pneumoniae; double-stranded, circular
  misc_feature (B) LOCATION 1...219
  hypothetical: NO
  anti-sense: NO
gcttatcgcaagggaacagtttttagctctgccaagccacatagtgtgcttactactatgtgtccatgtcaccatgaattgccgaacggtttaacgagaaagtatagtagattgaaacaagatgtgaacaaatcgattaggaaagtcaaattaatttctagaaatattttaacagtcataacggactattccagattcaatctactatattacttttag

SEQ ID NO: 894 - DNA (genomic), 1221 bp, Streptococcus pneumoniae; double-stranded, circular
  misc_feature (B) LOCATION 1...1221
  hypothetical: NO
  anti-sense: NO
tgcaggcgcaaggcttctaccatcatctattcaataaataaggagaatgtcatgaatcctaatctttttagaagtgtcgagttttatcagagacgttaccataactatgcgacagtgttcattatacctctttcattactatttactttcatcttgattttctcccttgttgccacaaaagaaattactgttacttcccaaggagaaatcgcccctacaagtgtcattgcatctattcagtcgaccagtgataatcctatccttgctaatcatttagtggcaaatcaagtagttgagaaaggtgacttactcatcaaatactctgaaacaatggaagaaagtcagaaaactgccttagcaactcaattacaaagacttgagaagcaaaaagaaggacttggaatcttgaaacaaagcttagaaaaagcgactgatcttttttctagcgaggatgagtttggctaccataatacctttatgaattttactaaacaatcccatgatattgaactgggtatctcaaagactaacactgaagtttcaaatcaagctaatcttaccaatagcagttcatcagccatcgaacaagaaattacaaaagttcaacaacaaattggagaatatcaagagttgagagatgctatcataaataacagagcacgcttaccaactggcaatccgcaccagtcaattttaaatcgttatcttatagcctctcaaggacaaacacaaggaacggcagaggagccatttttatctcaaattaatcaaagtattgcaggtctggaatcatctatcgcaagcctcaaaattcagcaagctggtatcggaagtgtagcaacttatgataatagtttagcaaccaaaattgaagtactccgcactcagtttttacaaacagcctcacagcaacaactaaccgtggagaatcaattaacagaattaaaagtacaactagatcaagcgacacagcgcttagaaaataataccttaaccgctccaagtaaaggtatcgttcatctgaacagcgaatttgaaggtaaaaatagaattccaactggtacagaaattgctcaaatattccctgtcatcacagatacaagagaagtactaatcacttactacgtatcatctgactatctccccttactagataaaggacaaactgtaagattaaaactggagaagaatggaaatcacggcaccaccatcatcggctaa

SEQ ID NO: 895 - DNA (genomic), 192 bp, Streptococcus pneumoniae; double-stranded, circular
  misc_feature (B) LOCATION 1...192
  hypothetical: NO
  anti-sense: NO
ttaaggcgcaatatacctgagggttatttcgggaaaatcaatcagtttatggagcaggtctattctcaggggattatttatccacccaaggaaaaggtttttcaggctctcttgacaacactgcttgaagaagttaaggtggtaattctaggcaagacccctatcacggaccaggtcaagcgcagggcttga

SEQ ID NO: 896 - DNA (genomic), 921 bp, Streptococcus pneumoniae; double-stranded, circular
  misc_feature (B) LOCATION 1...921
  hypothetical: NO
  anti-sense: NO
ctcttaagcaaggtccaacctatgctaaagattttgactacgaatgaattccgtaactacttggatgagcttggggattctctcctcgttgttaacgatgatgaaattgtcaaagtccatgttcatacagaagatccaggacttgttatgcaagaaggtctcaaatatggtagcttggtcaaggtaaaagttgacaatatgcgtaatcaacacgaagcacaggttgagaaagaagctactcaagttatcaagtcggctgaagaaaaagagtatgctttgattgctgtggtggctggtaaaggtctagcagatatcttctgttctcaaggcgtggattatgttatcgaaggcggtcaaaccatgaacccttcaacagaagactttatcaaggctgttgaacaggtcaatgcccgtaacatcatcttcttgccaaacaacaagaacatcttcatggcagctcaatctgcggcagaagttttggagcaaccagcagtagtggtagaggctcgcactcttcctcaaggtatgacaagtcttcttgcctttgatccaagcaagtccattgaagaaaaccaagagcgtatgacagctgctcttagcgatgttgttagcggaagcgtcacaacagccgtgcgtgatacaacgatcgatggcttagaaatccatgaaaacgataatctaggtatggtggatggaaaaattcttgtgtcaaaccctgatatgcaccaaacattgactgaaaccttgaaacatatgttggatgaagacagtgaaatcgtaaccttctatgtcggtgaagacggaagcgaagaacttgccaatgaaatcgctcaagaaatcgtagaagaattcgaagacgttgaagtcgagattcaccaaggtcaacaacctgtttacccatacctatttagtgtggaataa

SEQ ID NO: 897 - DNA (genomic), 297 bp, Streptococcus pneumoniae; double-stranded, circular
  misc_feature (B) LOCATION 1...297
  hypothetical: NO
  anti-sense: NO
aaaaggagcaaactcatgaaaaaagaaaccttcactgaaaaactgatcaaacgcacatacggtatttctggtccccttgacgaatacaaacggcgtgaggccgatagtattgggaaccaagtctttatcgtcctcttttatctgatgattttcggaaatcttattccactccttctggcctataaataccctcaagaagtggctctaatctatcctcctctgattttagtgattgccctcatcgctgctggctatgtcacctaccaaatgaaaaaaaacaggcatcacagtcattga

SEQ ID NO: 898 - DNA (genomic), 216 bp, Streptococcus pneumoniae; double-stranded, circular
  misc_feature (B) LOCATION 1...216
  hypothetical: NO
  anti-sense: NO
gtttttttaaactttttttcatcaagtgttccaaccgcaacataccatagtccgtacgggattcgaacccgtgttaccgccgtgaaaaggcggtgtcttaaccccttgaccaacggacctgagttgttattttcaactcttactattatacagtcttttcaaactttgtcaactactttttctaatttttttcattttttttgcatgacttactag

SEQ ID NO: 899 - DNA (genomic), 210 bp, Streptococcus pneumoniae; double-stranded, circular
  misc_feature (B) LOCATION 1...210
  hypothetical: NO
  anti-sense: NO
gcttttttaaactttttttcatcaagtgttccaaccgcaacataccatagtccgtacgggattcgaacccgtgttaccgccgtgaaaaggcggtgtcttaaccccttgaccaacggacctgagttgttattttcaactcttactattatacagtctttttatgttttgtcaactactttttctaattttttttattttttcaacttatag

SEQ ID NO: 900 - DNA (genomic), 348 bp, Streptococcus pneumoniae; double-stranded, circular
  misc_feature (B) LOCATION 1...348
  hypothetical: NO
  anti-sense: NO
atgaatttaaatcaattagatattatcgtttcaaatgttccccaagtctgtgctgacttggagcatattttggataaaaaggcagattatgctgatgatggttttgctcagtttacgattggtagtcactgccttatgttgtcacaaaatcatttggttcctttggaaaactttcagtcaggaatcattattcatatcgaggttgaggatgtagaccagaactacaaacggttgaacgagcttggtataaaggttttacacggaccaactgtaaccgattggggaacagagtccttattagttcaaggacctgctggtctagtgcttgatttttatcgtatgaaatag

SEQ ID NO: 901 - DNA (genomic), 192 bp, Streptococcus pneumoniae; double-stranded, circular
  misc_feature (B) LOCATION 1...192
  hypothetical: NO
  anti-sense: NO
attgatttaaattctcaaatcatattattcagttcttatttcattttgctctacaatcctgttgagaagacacgtgttcatatcaaaaaggtattggcaagttgcaatacctttttacgaggctcttttatcttatttttgtttcaactgactatatctcctatggttctagttcagaaggctaggctataa

SEQ ID NO: 902 - DNA (genomic), 804 bp, Streptococcus pneumoniae; double-stranded, circular
  misc_feature (B) LOCATION 1...804
  hypothetical: NO
  anti-sense: NO
caaatttccctcaaattagctagtagcattgcctgtttgtactggctaaaaacaggctatttcaaattcagtttcagaccatctggcatggaaaaatctgttataataatagaaaaggagaagcgcatgcacaagattttattaatagaagatgatcaggtcattcgtcaacaggtcgggaaaatgctctctgaatggggatttgaagtggtcctggtagaagactttatgaaagttttgagtctatttgttcagtcggaacctcatctggtcctcatggatattggtttgcccttgtttaatggttatcactggtgtcaggaaatccgcaagatttccaaggtacctatcatgtttctttcttcgagagaccaggctatggatattgtcatggcaatcaatatgggggcggatgactttgtgaccaagccttttgaccagcaggttcttttagctaaggttcagggcttgttgcgtcgttcctatgagtttgggcgtgatgagagtttgctggaatatgctggtgttatcctcaataccaaatccatggatttacattatcaagggcaagtcttgaatttgaccaagaatgaattccagattttacgcgtgttatttgagcatgcaggcaacatcgtagcacgtgacgacctgatgcgggaactttggaacagtgactttttcattgatgataataccctctctgtcaatgtggctcgtttgcgtaaaaagttggaggagcagggattggtaggatttatcgagaccaagaaaggaatagggtacggattgaagcatgcttga

SEQ ID NO: 903 - DNA (genomic), 1392 bp, Streptococcus pneumoniae; double-stranded, circular
  misc_feature (B) LOCATION 1...1392
  hypothetical: NO
  anti-sense: NO
aaaagcttaaagactatgttacagtggattaagaatttctctattcccctaatttacctgagttttctgttactttggctttactacgctattttctcagcatcctatcttgctttgttgggatttgtttttctgctagtctgtctctttttccaatttccttggaaatctgctagcaaagttctagtgatttgtggaatctttggattttggtttgtttttcaaaattggcaacagagtcaagcgagtcaaaatctggcggattctgttgaaagggtacggattttgcctgatactattaaggtcaatggtgatagtctatcctttcgtggcaagtctaacggtcgtgctttccaagtctattataaactccagtccgaggaggagaaagaagcctttcaagctttaaccgacctgcatgagataggactagaagggaagctttcggagccagaagggcagagaaattttggtggctttaattaccaagcctatctgaagactcagggaatttaccagacactcaatattaaaagaatccagtcactccaaaaggttggcagttgggatataggtgaaaaactgtccagtttacgtcgaaaggctgtggtttggattaagatgcacttcccagaccctatgcgcaattacatgacaggactcttgctaggacatctggacaccgattttgaggagatgaatgagctttattccagtttaggaattattcactnttttgccttgtcaggtatgcaggtagggtttttcatgaatggatttaagaaacttctcttgcgattgggcttgacccaagaaaagttgaaatggctgacttatcccttttcccttatctatgcgggactaactggattttcagcatcggttattcgcagtctcttgcaaaagctactggctcaacatggggttaagggcttggataattttgccttgacggtgcttgtcctctttattgtcatgccaaactttttcttgacagcaggaggagtcttgtcctgcgcttatgcttttatcctgaccatgaccattaaagaagggaaggggctcaaggctgttgctagtgaaagtctagtcatctccttgggcatattgcccattatatccttctattttgcggaatttcaaccttggtctatccttttgacctttgtcttttcctttctatttgacttgaccctcttaccgctcctgtctattttatttgtcctttcctttctctatccagtcattcagctgaactttatctttgaatggttggagggcattattcgcttggtctcacaggtgacaagtaggcctctagtctttggacaacccaatgaatggcttttaaccctattgttaaatattctttggctttggtctatgatttga

SEQ ID NO: 904 - DNA (genomic), 204 bp, Streptococcus pneumoniae; double-stranded, circular
  misc_feature (B) LOCATION 1...204
  hypothetical: NO
  anti-sense: NO
aatcaattaaaaactgaacaaatttattgggaaattcaaatcactttcttaaaatattttaggaaccgtagtgtaatattccagattcaattcactataaaactagcctttctcctgcaaaagaaaaaggaaagacttcctttcgtgcctttcctcttacttgctacttgtttgattatttttggtaagctactgcttgtctga

SEQ ID NO: 905 - DNA (genomic), 579 bp, Streptococcus pneumoniae; double-stranded, circular
  misc_feature (B) LOCATION 1...579
  hypothetical: NO
  anti-sense: NO
aacaaattaaataaggagaaaatcatggtaaaagtagcagttatattagctcagggctttgaagaaattgaagccttgacagttgtagatgtcttgcgtcgagccaatatcacatgtgatatggttggttttgaagagcaagtaacgggttcgcatgcaatccaagtaagagcagatcatgtctttgatggagatttatcagactatgatatgattgttcttcctggaggtatgcctggttctgcacatttacgtgataatcagaccttgattcaagaattgcaaagcttcgagcaagaagggaagaaactagcagccatttgtgcggcaccaattgccctcaatcaagcagagatattgaaaaataagcgatacacttgttatgacggcgttcaagagcaaatccttgatggtcactatgtcaaggaaacagtagtggtagatggtcagttgacaaccagtcggggtccttcaacagcccttgcctttgcctacgagttggtggagcaactaggaggggacgcagagagtttacgaacaggaatgctctatcaagatgtctttggtaaaaatcagtaa

SEQ ID NO: 906 - DNA (genomic), 750 bp, Streptococcus pneumoniae; double-stranded, circular
  misc_feature (B) LOCATION 1...750
  hypothetical: NO
  anti-sense: NO
gaaagattaaaatgtgaaaaaaggagattcctaatgggacgtaaatgggccaatatcgtagctaagaaaacggctaaagatggagccaactctaaagtatatgcaaaatttggtgtagaaatctatgtagcagctaaaaaaggtgatccagatccagaatcaaactcagctttgaaattcgttatcgaccgtgctaaacaagcccaagtgccaaaacacattatcgataaagcgattgataaagccaaaggaaacacagacgaaacctttacagaaggacgttacgaaggttttgggccaaatggctctatgctaattgtggatactttgacttctaacgtcaaccgtacagcagccaatgtccgtgcagcctttggtaaaaacggcggaaacatgggcgcttcaggttctgtttcttacctttttgacaacaaaggtgttattgtatttggaggtgaagatgcggacgcagtctttgagcaattgctcgaagcggatgtggatgtggatgacgtagaagcacaagaaggtacaatcacagtttacacagcgccaactgaccttcacaaggctatcgttgctctccgtgagtctggtattgaagaattccaagtgactgaattggaaatgattcctcagtcagaagtggaattgtcaggcgaagaccttgaaacctttgaaaaactttacagcgttcttgaagacgacgaagacgtccaaaagatttatacgaacgtagatgggttttaa

SEQ ID NO: 907 - DNA (genomic), 288 bp, Streptococcus pneumoniae; double-stranded, circular
  misc_feature (B) LOCATION 1...288
  hypothetical: NO
  anti-sense: NO
aatatgttaaaggaaataaaaaggagaaacagaatgaaaaataaacgtttaattggaattattgctgcattagcagtcttagtagcaggaagcttgatttattcttcaatgaataaatcagaagctcagaataataaggatgagaagaaaataactaagattggtgtgcttcaatttgtgagccatccatcccttgatttgatttataaagggatccaagatggacttgcagaagaaagatataaagatgatcaagttaaaattgattttatgaactcagaaaggtga

SEQ ID NO: 908 - DNA (genomic), 288 bp, Streptococcus pneumoniae; double-stranded, circular
  misc_feature (B) LOCATION 1...288
  hypothetical: NO
  anti-sense: NO
ataatgttaaaaattggtacagcttgtggttcaggattaggttcaagttttatggtacagatgaatattgaatctgtattgagtgatttgaatgtttcggatgtagaagttgaacattatgatttaggtggagcagatccaaatgcagctgatatttggattgttggtcgtgatctagctgattcagctagtcatcttggagatgttcgtatcttaaatagtattattgatatggacgaactacgagaattaattactaaaatttgtgaagaaaaaggacttatatag

SEQ ID NO: 909 - DNA (genomic), 201 bp, Streptococcus pneumoniae; double-stranded, circular
  misc_feature (B) LOCATION 1...201
  hypothetical: NO
  anti-sense: NO
aagatgttaaatttacaatttgcagaaacaatggaattgacagaagctgagttggagacagtttatggaggggaatttgggaataatgctgttatcccagccggtgcttggggaggtttaggaacgtcttggtcaatcactaatttctggaagaaatattttaaccatgattcttccactgttaatcgtcgccattattga

SEQ ID NO: 910 - DNA (genomic), 381 bp, Streptococcus pneumoniae; double-stranded, circular
  misc_feature (B) LOCATION 1...381
  hypothetical: NO
  anti-sense: NO
atggcgttaaaatacacaacttggaaagttactgacgaaaaagagttgaagctacgtttgacatctcatcaaactgcaactgtggaagaaaaaatcggcatgaacttgctgaagattttcatgcctgaagctggcgaagagttcactttaccgcctttgaaagttatgttgttgttagttcacggagccttgcagcagtatgaacatgggtattctcttgaggatgtctatgatttatacgatgaatacgtggacaatggcggagaccaaacaaccttcatgacagaggtgttgatgccactctttgaagtatcgggttttactccacgaggaagcaaggacaagaaaacttccaagaagaaaatgacagtagacaagtaa

SEQ ID NO: 911 - DNA (genomic), 345 bp, Streptococcus pneumoniae; double-stranded, circular
  misc_feature (B) LOCATION 1...345
  hypothetical: NO
  anti-sense: NO
agaaagttaaaaaaagaggaaaacaaaatgaataaaacaactgaaatgatcgtatttcgtagccgtaaaactggagaatttcttaattcttacaaggacagaagttctttagcatttgcagctgacttttgcagcttggaatattgtttgaagcttcctcgtaaaaaatacgaagacaacaaaaagacttacaaggctcttgctgcagcttttgactgtgaaattgtcgcagttgaagcggaatacaaattgacctatccgaatggatcagaagttgaacctatcaagcgtgaccgttcatcaattgaggacatgattaaggatattattggaggggttctctaa

SEQ ID NO: 912 - DNA (genomic), 1953 bp, Streptococcus pneumoniae; double-stranded, circular
  misc_feature (B) LOCATION 1...1953
  hypothetical: NO
  anti-sense: NO
ttgcattccctagtgatttttgttaagataaatgcaaatacaaatgaaagcgagaacaagatgacacgttatcaagatgatttttatgatgctatcaatggagaatggcaacagacagctgaaatcccagcagataagtctcaaacaggaggttttgttgatttagaccaggaaattgaagacctgatgttggcgacaacagacaagtggttagcaggtgaagaagtgcctgaggatgctatcttggaaaactttgtcaaataccaccgcctagttcgtgattttgacaagagagaagctgacggtatcacacctgtcttaccactccttaaagaattccaagaattggaaacttttgcggattttacagctaaactagcagagtttgagcttgcaggaaaaccaaacttccttccttttggtgtatcgccagactttatggatgctagaatcaatgttctatgggctagcgctccaagcacaatcttgccagatacgacctactatgcagaagaacatcctcagcgcgaagagctcttgactctttggaaagaaagcagcgcaaatctcctcaaggcttatgatttctctgatgaagaaattgaagacttgctagaaaaaagacttgaattggaccgccgagttgcggcagtggtgctctctaatgaagaaagttcagaatatgctaaactctatcatccatattcttacgaagatttcaagaaattcgcgcctgccctacctttggatgacttcttcaaagcagttattgggcaattaccagacaaggttattgtagacgaggaacgtttctggcaagcagcagagcaattctacagtgaggaagcctggtctctccttaaagcaaccttgattttgagtgttgtcaatctttcaaccagctatttaacagaggatatccgtgttttgtctggtgcctacagccgtaccctttctggagttccagaggcaaaagataaggtcaaagcagcttatcatctagcacaggaacctttcaagcaagccctgggtctttggtacgcccgtgagaagttctctccagaagccaaggcggatgtggagaaaaaagtggcaaccatgattgatgtctataaggagcgtctgcttaagaatgactggctcactccagaaacctgtaaacaggctatcgtgaagctcaatgtgatcaaaccttatattggctatccagaagaattgcctgcacgttacaaggataaggtagtgaatgaaactgccagtctttttgagaatgctctagcctttgcgcgtgtggaaatcaagcacagttggagtaagtggaaccagcctgtaaactataaggaatggggcatgcctgctcatatggtcaatgcctactacaatcctcagaagaacctgattgtctttccagcggccattttacaggcgcctttctatgacttgcatcagtcatcttctgctaactacggtggtattggggcagtgattgcccatgaaatttcccacgcctttgatactaacggagcttcctttgacgaaaatggtagcctcaaggattggtggacagagagcgactatgctgccttcaaggagaaaacacaaaaagtcattgaccaatttgatggacaggattcttatggagcaaccattaacggtaaattgactgtatcagaaaacgtggctgacttgggaggaatcgcagcagcgcttgaagcagctaagagagaagcagacttctcagcagaagagttcttctacaacttcggtcgcatctggcgcatgaaaggtcgtccagaatttatgaaacttttggctagcgtcgatgtgcacgcaccagccaaactccgtgtcaatgtgcaagtaccaaacttcgacgatttctttacaacctatgatgtcaaagaaggagacggaatgtggcgttcaccagaggagcgcgtgattatttggtaa

SEQ ID NO: 913 - DNA (genomic), 573 bp, Streptococcus pneumoniae; double-stranded, circular
  misc_feature (B) LOCATION 1...573
  hypothetical: NO
  anti-sense: NO
cctttactaaaaattaaggaaaaacgaatgaaaaaagaacaaattcccaatctcttaacaataggtcgaattctctttatacctatttttatctttattttaacgataggaaattcgatagagagtcatatagttgcagctattatctttgctgttgccagtattaccgactatttagatggatatttagctcgtaaatggaatgtggtcagtaattttggtaaatttgcagatcctatggcggataagttactagttatgtcggcttttattatgttgattgagttaggtatggctccggcttggattgttgcagtgattatctgtcgtgagttagctgtgacaggtttaaggcttttattggttgaaactggtggaacaattttagcagcagcaatgcctggaaaaattaaaacttttagtcagatgtttgccattattttcttgctattacattggactttgcttggtcaagttctactttatgtagccttatttttcactatctactctggctatgactatttcaagggtagtgcctatgtatttaaagggacatttggttcgaaatga

SEQ ID NO: 914 - DNA (genomic), 234 bp, Streptococcus pneumoniae; double-stranded, circular
  misc_feature (B) LOCATION 1...234
  hypothetical: NO
  anti-sense: NO
cctaagctaaattttaaaaagcgagggtggttattttctcaaagttttgaaggagctaaagcaacagctattattatgagtttgttggaaacagctaaacgtcatcaattaaatagcgagaaatatctattctatcttctagaatgtcttccaaacgaggaaactctcgtaaacaaagaggttttagaggcttatttaccatggactaaagttgtacaagaaaagtgcaaataa

SEQ ID NO: 915 - DNA (genomic), 1338 bp, Streptococcus pneumoniae; double-stranded, circular
  misc_feature (B) LOCATION 1...1338
  hypothetical: NO
  anti-sense: NO
aacaatataaataagatgaaagaaattgaaaacaatcagtggattgctaactaccggacggatcaaccgcattttggcttggaacgaatggtggaactgttagctttgcgtggcaatccccatctcaaactcaaggtcctccatatcggaggaactaacggcaagggctcgactattgcttttttgaaaaagatgctagaaaagctagggctgagagttggcgtgtttagctcgccctatctcattcattacacagaccagattagcatcaatggggaatcgatctcagaagtgaggctagaagctctcatggcagactatcagtctttgctggagggagaagcggtcgccaatttacagggcacaaccgagtttgagattatcacagccctagcctatgactactttgcctcagagcaagtagatgtggctatcatggaagttggcatgggtggacttttggatagtaccaatgtctgtcagcccattttgacaggaattacaactattggcttggatcatgtggccctacttggtgacaccttggaggccatagcagagcagaaggcaggtattatcaaacaagggatgcccttggtaacagggcgtattgctccagaagccttggctgtgattgaccgcattgcggaagggaaagatgcgccgagacttgcctacgggacagattatcaggttcgtcatcaagaaagtgtggtgacaggggaagtctttgactatacaagtgctgtcagacaaggtcgcttccagactagcctgcttggtttgtaccaaatagagaatgctgggatggccatagctttacttgatactttttgtcaagaagatggtcgagagctagcaagcaatgattttcttggtcaagccttggaagaaacaagttggccagggcgtttggaaatcgtgtcaagagatcccttgatgattttggatggagcccacaatccccatgctatcaaggccttgttggtaaccttgcaagaacgttttgcggattatcataaggaaatcctcttcacttgtatcaaaaccaaggccttggaggatatgttggacttgctgggagccatgccagataccgagcttactctaacacattttgcggatagtcgggcgacggatgaaaacgtgctgaaagaggcagctaagtctagaaatctcagctaccaagattggcatgattttctagagcagaatttgacagataaaaaagaagagaaacaaacagttaggattgtcacaggttccttgtatttcttgagccaagtgagggcctatctgatggagaggaagaacgagaatggatacacaaaagattga

SEQ ID NO: 916 - DNA (genomic), 357 bp, Streptococcus pneumoniae; double-stranded, circular
  misc_feature (B) LOCATION 1...357
  hypothetical: NO
  anti-sense: NO
accatcataaagcttagctttaacgtcaaccattgggtaacctgcaagaacaccgttagccatagattctaccaaacctttttcaaccgctgggataaattcacgaggaaccacaccaccgacgattgcgttttcgaattcgaatcctttaccttcttcgtttggagtaaattcaatccatacatcaccgaattgacctttaccaccagactgacgtttgaagaatccacgtgcttgagtagaagcgcggaatgtttcacggtaagatacttgaggcgcacctacgttcgcttcaactttgaactcacgacgcatacgatcaacaaggacgtcaaggtgaagttcacccatacctga

SEQ ID NO: 917 - DNA (genomic), 237 bp, Streptococcus pneumoniae; double-stranded, circular
  misc_feature (B) LOCATION 1...237
  hypothetical: NO
  anti-sense: NO
tactcaataaaaatcaaagagcaaactagaaagctagccgcagtcagctcaaaacactgttttgaggttgtggatagaactgacgaagtcagctcaaaacactgttttgaggttgtggatagaactgacgaagtcagtaaccatatatacagcaaggcgaagctgacgtggtttgaagagattttcaaagagtataagttatacttttacaacttgaacctcgtctttaccgagtaa

SEQ ID NO: 918 - DNA (genomic), 1056 bp, Streptococcus pneumoniae; double-stranded, circular
  misc_feature (B) LOCATION 1...1056
  hypothetical: NO
  anti-sense: NO
aaggcaataaataatagaaaagagagaaaagctatgacagttcaaatggaatatgaaaaagatgttaaagtagcagcacttgacggtaaaaaaatcgccgttatcggttatggttcacaagggcatgcgcatgctcaaaacttgcgtgattcaggtcgtgacgttattatcggtgtacgtccaggtaaatcttttgataaagcaaaagaagatggatttgatacttacacagtagcagaagctactaagttggctgatgttatcatgatcttggcgccagacgaaattcaacaagaattgtacgaagcagaaatcgctccaaacttggaagctggaaacgcagttggatttgcccatggtttcaacatccactttgaatttatcaaagttcctgcggatgtagatgtcttcatgtgtgctcctaaaggaccaggacacttggtacgtcgtacttacgaagaaggatttggtgttccagctctttatgcagtataccaagatgcaacaggaaatgctaaaaacattgctatggactggtgtaaaggtgttggagcggctcgtgtaggtcttcttgaaacaacttacaaagaagaaactgaagaagatttgtttggtgaacaagctgtactttgtggtggtttgactgcccttatcgaagcaggtttcgaagtcttgacagaagcaggttacgctccagaattggcttactttgaagttcttcacgaaatgaaattgatcgttgacttgatctacgaaggtggattcaagaaaatgcgtcaatctatttcaaacactgctgaatacggtgactatgtatcaggtccacgtgtaatcactgaacaagttaaagaaaatatgaaggctgtcttggcagacatccaaaatggtaaatttgcaaatgactttgtaaatgactataaagctggacgtccaaaattgactgcttaccgtgaacaagcagctaaccttgaaattgaaaaagttggtgcagaattgcgtaaagcaatgccattcgttggtaaaaacgacgatgatgcattcaaaatctataactaa

SEQ ID NO: 919 - DNA (genomic), 231 bp, Streptococcus pneumoniae; double-stranded, circular
  misc_feature (B) LOCATION 1...231
  hypothetical: NO
  anti-sense: NO
attaaaataaatcactgtgactgcctgtcctcagcaaatttaaaatcaattccgacttatctactttataaaccaaaagccaatctggctgggtatggcattcacgaactccttgaaaatgcttggatgccgtcaatgaatgatcacgatatctggcaggatgttctttttcttgaaccagaaaattcaaaacttcttctaataattctgccttcaaaccacgcttcatag

SEQ ID NO: 920 - DNA (genomic), 234 bp, Streptococcus pneumoniae; double-stranded, circular
  misc_feature (B) LOCATION 1...234
  hypothetical: NO
  anti-sense: NO
gataaaataaatataacaggagaaattatcatgtcagtagaagaaaaattaaatcaagctaaaggttctattaaagaaggtgttgggaaagccatcggtgatgaaaaaatggaaaaagaaggagcagctgaaaaagttgtttctaaagtaaaagaagttgccgaagacgctaaagacgctgtagaaggtgctgtagaaggtgttaaaaacatgttgagtggcgacgataaataa

SEQ ID NO: 921 - DNA (genomic), 774 bp, Streptococcus pneumoniae; double-stranded, circular
  misc_feature (B) LOCATION 1...774
  hypothetical: NO
  anti-sense: NO
gaaaaaataaaagaggtggagggcagcattccttgtcgcccgtcccttctttttaatggagacagaaagatgatgaatgaattatttggagaatttctagggactttaatcctgattcttctaggaaatggtgttgttgcaggtgtggttcttcctaaaaccaagagcaatagctcaggttggattgtgattactatgggttgggggattgcagttgcggttgcagtctttgtatctggcaagctcagtccagctcatttaaacccagctgtgaccatcggtgtggccttaaaaggtggtttgccttgggcttccgttttgccttatatcttagcccagttcgcaggggccatgctgggtcagattttggtttggttgcaattcaaacctcactatgaggcagaagaaaatgcaggcaatatcctggcaaccttcagtactggaccagccatcaaggatactgtatcaaacttgattagcgaaatccttggaacctttgttttggtgttgacaatctttgctttgggtctttacgattttcaggcaggtatcggaacctttgcagtgggaactttgattgtcggtatcggtctatcactaggtgggacaacaggttatgccttgaacccagctcgtgaccttggacctcgtatcatgcacagcatcttgccaattccaaacaagggagacggagactggtcttacgcttggattcctgttgtaggccctgttatcggagcagccttggccgtgcttgtattctcacttttctaa

SEQ ID NO: 922 - DNA (genomic), 342 bp, Streptococcus pneumoniae; double-stranded, circular
  misc_feature (B) LOCATION 1...342
  hypothetical: NO
  anti-sense: NO
gctgaaataaatggtattatagctgttttggcaggaattttggtatatggaggagttcagcttattggtttaactgctaatcatgagatgagaatatttattctcatcatcctaacaagtttagtattcatgtctatggtgaccactttagcaacgtggaatagccgtataggagcttttttctcacttattttgcttttactacagttagcatcaagtgcaggtacttatccacttgctttgacaaatgatttctttagatctattaatccctggttaccaatgagctattcagtttcgggattacgacaaacaatctctatcaacaagtcattttcctag

SEQ ID NO: 923 - DNA (genomic), 702 bp, Streptococcus pneumoniae; double-stranded, circular
  misc_feature (B) LOCATION 1...702
  hypothetical: NO
  anti-sense: NO
aaggaaataaacatgtttgcatcaaaaagcgaaagaaaagtacattattcaattcgtaaatttagtattggagtagctagtgtagctgttgccagtcttgttatgggaagtgtggttcatgcgacagagaaggaggtaactacccaagtagccacttcttctaatagggcaaatgaaagtcaggcaggacataggaaagctgctgaacaattcgatgaatatataaaaacaatgatccaattagatagaagaaaacatacccaaaatttcgccttaaacataaagttgagcagaattaaaacggagtatttgcgtaaattaaatgttttagaagagaagtcgaaagctgagttgccgtcagaaacaaaaaaagagatagacgcagcttttgagcagtttaaaaaagataccaacagaaccaaaaaaacggtagcagaagctgagaagaaggttgaagaagctaagaaaaaagccaaggctcaaaaagaagaagatcaccgtaactacccaaccaatacttacaaaacgcttgaacttgaaattgctgagtccgatgtggaagttaaaaaagcggagcttgaactagtaaaagaggaagctaaggaatctcgagacgatgaaaaaattaagcaagcagaagcgaaagttgagagtaaaaaagctgaggctacaaggttagataaacatcaagacagatcgtga

SEQ ID NO: 924 - DNA (genomic), 477 bp, Streptococcus pneumoniae; double-stranded, circular
  misc_feature (B) LOCATION 1...477
  hypothetical: NO
  anti-sense: NO
tctagaataaatgataatagaaaagagaaaattatgaaaattcgtggttttgaattggtttcgagttttacagatgaaaatttattgcccaagcgtgagacagcgcatgcggctggttacgacttaaaggttgctgtgcgtacagttgttgcgccaggagagattgtcttggttccgacaggggttaaggcttatatgcagccgactgaggttctctacctctatgatcgttcttcaaatcctcgtaagaagggcttggttttaattaactcagttggggtcattgatggggattattatggaaatcctggaaatgaagggcatatttttgcgcagatgaagaatatcacagaccaagaggttgttcttgaagttggggagcgtattgtccaggctgtttttgctactttcttaattgcagatggagatgcggctgatggcgttcgaactggtggatttggatcgacagggcactag

SEQ ID NO: 925 - DNA (genomic), 1344 bp, Streptococcus pneumoniae; double-stranded, circular
  misc_feature (B) LOCATION 1...1344
  hypothetical: NO
  anti-sense: NO
cttatgataaaaaatcctaaattattaaccaagtcctttttaagaagttttgcaattctaggtggtgttggtctagtcattcatatagctatttatttgacctttcctttttattatattcaactggagggggaaaagtttaatgagagcgcaagagtgtttacggagtatttaaagactaagacatctgatgaaattccaagcttactccagtcttattcaaagtccttgaccatatctgctcaccttaaaagagatattgtagataagcgactccctcttgtgcatgacttggatattaaagatggaaagctatcaaattatatcgtgatgttagatatgtctgttagtacagcagatggtaaacaggtaaccgtgcaatttgttcacggggtggatgtttacaaagaagcaaagaatattttgcttttgtatctcccatatacatttttggttacaattgctttttcctttgttttttcttatttttatactaaacgcttgctcaatcctcttttttacatttcagaagtgactagtaaaatgcaagatttggatgacaatattcgttttgatgaaagtaggaaagatgaagttggtgaagttggagaaattggaaaacagattaatggtatgtatgagcacttgttgaaggttattcatgagttggaaagtcgtaatgagcaaattgtaaaattgcaaaatcaaaaggtttcctttgtccgtggagcatcacatgagttgaaaacccctttagccagtcttagaattatcctagagaatatgcagcataatattggagattacaaagatcatccaaaatatattgcaaagagtataaataagattgaccagatgagccacttattggaagaagtactggagtcttctaaattccaagagtggacagagtgtcgtgagactttgactgttaagccagttttagtagatattttatcacgttatcaagaattagctcattcaataggtgttacaattgaaaatcaattgacagatgctaccagggtcgtcatgagtcttagggcattggataaggttttgacaaacctgattagtaatgcaattaaatattcagataaaaatgggcgcgtaatcatatccgagcaagatggctatctctctatcaaaaatacatgtgcgcctctaagtgaccaagaactagaacatttatttgatatattctatcattctcaaatcgtgacagataaggatgaaagttccggtttgggtctttacattgtgagtaatattttagaaagctatcaaatggactatagttttctcccttatgaacacggtatggaatttaagattagcttgtag

SEQ ID NO: 926 - DNA (genomic), 672 bp, Streptococcus pneumoniae; double-stranded, circular
  misc_feature (B) LOCATION 1...672
  hypothetical: NO
  anti-sense: NO
atgaatgtaaaagaaaatacagaacttgtttttcgagaagttgcagaggctagtctgagtgctaatcgagagagtggttcggtctctgtcattgcagttaccaagtatgtagatgtaccgacagcggaagccttgcttccgctaggtgttcatcatatcggtgaaaatcgtgtagataagtttctggaaaaatatgaagctttaaaagatcgagatgtgacttggcatttgattggtaccttgcaaagacgtaaggtgaaagatgtcattcaatacgttgattatttccatgcattggactcagtaaagctagcaggggaaattcaaaaaagaagtgaccgagtcatcaagtgtttccttcaagtaaatatttctaaagaagaaagcaaacacggtttttcgagagaggaactgctggaaatcttgccagagttagccggactagataagattgaatatgttggtttaatgacgatggcaccttttgaggctagcagtgagcagttgaaagagattttcaaggcggcccaagatttacaaagagaaattcaagagaaacaaattccaaatatacctatgaccgagttaagtatgggaatgagtcgtgattataaagaagcgattcaattcggttccacttttgttcgtataggtacatcattttttaagtag

SEQ ID NO: 927 - DNA (genomic), 741 bp, Streptococcus pneumoniae; double-stranded, circular
  misc_feature (B) LOCATION 1...741
  hypothetical: NO
  anti-sense: NO
aacgatgtaaaggtatttttaaatgctaggaaatactatcgaattctctttcaccaactaatgggatttagtccaggaatagcagtgttttataaggagagtcaaacaactaagaatctgtttaaattttactacttcttgtactttacaacactaatttcatactattttttctttacttttgtgtatgacaaaccgttgcttttgcctcttattccattttctattatcatagcattagtacaaaaactttatagaattgagaatcaacaattatttctgttaaaatcaaaggtactaacaatactggaatctaagaagaattgtgagtttaatcttcaggattatcatgaaatttggaaattgcaatcaaaatctgagttgccatgcgtggctttatcttatatcagtttgatcaagccatatctttcagagagcgtgcgtgaacaaattgatttattagaagttaagcgatttaaaaaaataaatcatccaatatcactttatggtatgttggatgttataaaattaaatctatatttacggcattataatgaaaaaaataaatatgaatcaatgttaaagaaaattttagaggtaagaccagactttgttttaatcgagcagaatattgatgatagtttaaatagctcgcaaccattatctttatctttagccatttcagaaatccaacttttgcttgaagtgtatatggggatcaaacatgtttcaaccaagtga

SEQ ID NO: 928 - DNA (genomic), 420 bp, Streptococcus pneumoniae; double-stranded, circular
  misc_feature (B) LOCATION 1...420
  hypothetical: NO
  anti-sense: NO
caaatcgtaaagtcaatgattaaggcctttaccatgctggaaagtctcttggctttgagtcttgtgagtatccttgccttgggcttgtccggctctgttcagtccacttttgcggcagtagaggaacagattttctttatggagtttgaagaactctatcgggaaacccaaaaacgcagtgtagccagtcagcaaaagactagtctgaacttagatgggcagacgattagcaatggcagtcaaaagttgccagtccctaaaggaattcaggccccatcaggccaaagtattacatttgaccgtgctgggggcaattcgtccctggctaaggttgaatttcagaccagtaaaggagcgattcgctatcaattatatctaggaaatggaaaaattaaacgcattaaggaaacaaaaaattag

SEQ ID NO: 929 - DNA (genomic), 525 bp, Streptococcus pneumoniae; double-stranded, circular
  misc_feature (B) LOCATION 1...525
  hypothetical: NO
  anti-sense: NO
agccaagtaaagagaaacgagaagcacatgtatattgaaatggtagatgaaactggtcaagtttcaaaagaaatgttgcaacaaacccaagaaattttggaatttgcagccaaaaaattaggaaaagaagacaaggagatggcagtcacttttgtgaccaatgagcgtagtcatgaacttaatctggagtaccgtgacaccgaccgtccgacagatgtcatcagccttgagtataaaccagaattggaaattgcctttgacgaagaggatttgcttgaaaatccagaattggcagagatgatgtctgagtttgatgcctatattggggaattgttcatctctatcgataaggctcatgagcaggccgaagaatatggtcacagctttgagcgtgagatgggcttcttggcagtacacggctttttacatattaacggctatgatcactatactccggaagaagaagcggagatgttcggtttacaagaagaaattttgacagcctatggactcacaagacaataa

SEQ ID NO: 930 - DNA (genomic), 771 bp, Streptococcus pneumoniae; double-stranded, circular
  misc_feature (B) LOCATION 1...771
  hypothetical: NO
  anti-sense: NO
tctccttcaaaagtcgcctgtatgggtggcttttattttatcattcatgatataatagaagcaaacggaggacggaaaatggtaaaagtacgattgtatttggtacgtcatggcaagaccatgtttaacacgattggtcgcgcgcaaggttggagcgatactcccttaactgctgaaggtgaacgagggattcaagagttaggaatcggtttgcgagaatctgatctacagtttgagcgcgcttattcgagtgattctggtcgtaccattcagaccatgggaattatacttgaagaacttggcttgcaggggaaaatcccttatcgcatggacaagcgtatcagagaatggtgtttcggtagttttgatggagcctatgatggcgatcttttcatgggcattattcctcgtatctttaatgtggaccacgttcaccaattgtcttatgctgaactggctgagggcttggtagaggtcgatacagctggttgggctgaaggttgggaaaaactcagtggccgaatcaaggaaggctttgaaataattgcaaaagaaatggaagatcaaggtggaggtaacgcccttgttgtcagccatggaatgactattggaaccattgtttatctgattaatggcatgcatccgcatggtctagataatggtagcgtgacgattcttgaatatgaggacggtcagtttagggttgaagttgtcggtgaccgtagttaccgagagctaggacgtgagaagatggaagaaggctctatttaa

SEQ ID NO: 931 - DNA (genomic), 2571 bp, Streptococcus pneumoniae; double-stranded, circular
  misc_feature (B) LOCATION 1...2571
  hypothetical: NO
  anti-sense: NO
gtaccttcaaagcaaaagatatcacaggggaagctaaattccgcttctggccaatcacccgtatcggaacattttaagaaacctaagaggccgagaatcaccaatctcagcctcttcttctatcgtgagaaaatgattggtaactatctaaacttaccagaacagaaacacctcaactctcacctattcatgcaaaggaattttatggaagtttatttttcaggaactattgaacggattatttttgaaaatcccagcaatttttatcgcatcctcctcctagaaatcgacgatacggacgcagaggattttgatgattttgaaatcattgtcacaggaaccatggctgatgtaattgagggcgaagactatactttttgggggcaaattgtccagcactccaagtatggagaacaactgcaaatcagtcgttatgatcgcgcaaaaccaactagtaagggcttggtcaagtacttttcaagtagccatttcaaggggattggtctcaagacagctcagaaaatcgtggatacctatggcgaaaataccattgacgaaattttgcaacacccagaaaagttagaaggcatcgcaggactctctgccaaaaatcgcgaggctttcgtctccactctccgtctcaactacggaacggagatgattttggccaaactagccaactacggcattcccaacaaactagcctttcagattcaagacttttacaaggaagaaacccttgatgtggttgaaaattatccctaccaactggttgaggatatcaagggtttgggctttaccattgctgaccaactagctgaggaactaggcatcgaaagtcaggctcctgaacgcttccgcgccggtctagttcacagtctttttcagacctgtatggaaacaggggacacctatgttgaagcacgggatttgctggaacaaacccttactctccttgagtcttcccgtcccgtggaactagaccccagccaagttgcccaagagctctcctacctgatcgaagaagacaaggttcagcagattgataccaagatctttgacaacagcctctttttcgctgaggaaggtatccgcagtcacttgattcgtatccttgaaaaaggaaaacagaagagccaagatttagaaactattcaaaagcatatcactactgtcgagcaagaactggggattgagtatgataacattcaaaaacaagctatttgtgacgctatccagaacaaggtctttatcctgacaggtgggcctggtactggtaagacaactgttatcaatggaatcatcgctgtttatgcccttttagaaggacttgacttcaggaagaaaaacaatctgcccattcttcttgctgctccaactggtcgagctgctcgtcgcatgaatgaattgacaggtttgcctagcgcgaccatacatcgccacttgggaatgacaggtgacgatgataccagtcatctggaagattacctagatgctgactttatcatcgtggatgaattctctatggtggatacttggctggccaatcaactcttctccaatatctcttctaacagtaagatcctcatcgtaggtgacagtgatcagctaccttctgtcagtcctggacaggttctagcggatctgcttcatattcctttgattcctcagactcgcttggaaaaaatttatcgacaaagcaaagaatcaaccatcgtcaccctagctagtcagattcgacagggcatcttgccagctgatttcacccaaaaaaaagctgaccgttcctactttgaaattgctagtggccatattcctgccaccattgaaaaaatcttaggtgccgccctcagaaatggtattcctgcccgtgatatccaagttctggctcctatgtaccgagggacggcagggattgatgctatcaatcagctcatgcaagacctgctcaatcccccacaaaaagatcaactcagttttgaagctcctcagtgccactatcgtaagagagacaaggtcattcatttggttaacgatgctgaaatcaatgtctttaatggggatttaggagctatcacagacctgattcctggtaaatacaccgaatcgaaacaagacgagattgtcattgattttgatggtaatgaagtctcttacccccgtaacgaatggtacaagattcgcttggcctatgccatgagtattcataagtctcagggaagtgagttcccagttgtcatcctaccgattactagtgctagccgacgtatgctggagcgaaatctcatctacacagccattacacgtgccaaaagcaaactcatcttactaggcgaattacaagccttcgactatgctacccaacacatcggaactgcccgaaaaacctatctgattgaacgcttcagtgatctactggagaatgttgaagaaaagcaacaagctgtctctgaaacagtcacatcaagtgcctctgaacaatcctacatcctaaccgaagaaaactgggaccgcatcccagccatgattgggattacagacacagacctcaaagagatttttggaaaatag

SEQ ID NO: 932 - DNA (genomic), 750 bp, Streptococcus pneumoniae; double-stranded, circular
  misc_feature (B) LOCATION 1...750
  hypothetical: NO
  anti-sense: NO
gtcttctcaaaattcgataacctttctggtcttgcagttggttcatttgggccgattgatattgacaaaaactcaaaaacttatggctttatcacgacgactccaaaaccaaactgggcaaatgtggacttgcttggtgcctttcgtcgcgccctaaacgtgccaatgtacttcacaacagacgtaaacagctctgcttacggtgaaatggttgcccgtaacaatgctggtggtcgtatcgaaaacttggtttactacacaatcggtacaggtatcggtgcaggcgtcatccaacgtggtgagtttatcggtggtgtgggtcaccctgaaatgggtcattattatgttgctagacacccaatggatattgaaaaagagtttaagggtgtttgtcctttccataagggatgtctagaaggttatgcagctggtccaagtttggaagctcgtacaggtgtacgtggggaaaatattgaactcaacaaccctgtttgggatgttcaagcctactatatcgctcaagctgcggttaatgcgacagtgactttccgcccagacgtgattgtctttggtggaggggtcatggctcaacaacatatgctggaccgtgtccgtgagaaatttacatctcttcttaatggttacctaccagtaccagatgtgcgtgactatatcgtgacgccagcagtcgcaggaaatggttctgccacacttgggaactttgttcttgcaaaagaagtttcaaaataa

SEQ ID NO: 933 - DNA (genomic), 201 bp, Streptococcus pneumoniae; double-stranded, circular
  misc_feature (B) LOCATION 1...201
  hypothetical: NO
  anti-sense: NO
atgatatcaaaaatctcttggatgaagattggggcaagtcccattgatggttcatctaaaagaagaagttttggtgttgacataagagcgcgtcccatggcaagcatttgttgttcccctcctgaaagagtagctgcatcttggttcttccgttcttcaagacgaggaaagcgtgagaaaaccttcttcaagttagcttga

SEQ ID NO: 934 - DNA (genomic), 654 bp, Streptococcus pneumoniae; double-stranded, circular
  misc_feature (B) LOCATION 1...654
  hypothetical: NO
  anti-sense: NO
ataccatcaaaggagaggtttatgaatagagaagcgcttagactatatctggtaaccaatcgctatcaagattccgtggaaagctttcttgcaaaagttgagacggcctgccgttcaggggttaccatagtccaattgcgagaaaaaaatctcacaaccaatcaatattatcaactggcaaaacaagtcaaggaaataacagatgcttatcaggtccccttgataatcgatgatcggttggatgtttgtcttgcggttgatgctgctggtctgcatattggagatgacgaactcccagtttcggttgcccgacaagtcttgggtcctgaaaaaatcctcggtgtcaccgctaaaacggttaaaagagctctggaagcggagaaatcaggtgcagattacttggggacaggagccatttttccgacaaccaccaaggaaaatgcacccatcaccctgatttcaaccttgaaaacaatttgccaaacggttgccattccaatagttgctattggcggcttgacttcggagaatattgatcagcttatgggcactggcatagctggtgtagctgttgtacgtgatttgatgcaagcagaagatattgaggcaaaaacgcaagcctttttaacaaagttgcatgacattctttcctaa

SEQ ID NO: 935 - DNA (genomic), 423 bp, Streptococcus pneumoniae; double-stranded, circular
  misc_feature (B) LOCATION 1...423
  hypothetical: NO
  anti-sense: NO
gtaccatcaaatcctagacctgtatacggtctagcctcttttaaaattatttttttcccatcttcttttagcctagcattatatatcccaccactgtttgaaaatctaattgcattatctataataaagggaaagtctccctgttttttatctttcttgtcaagccatttattcaaaaagtcagggggcactataccttttggaattttaaatactggtaaacgttcatctttaacaacttcatcgccaacaattaattcatcaatagcaaccttcttttcatcatcccttgacggcctaaacacaccatacctcagatatattggtgcttcatcccaacgtttatcgcttaaaatatatggtccattatattgctttaaggcactttctaacctttgcaaaaccgactctaattcattttga

SEQ ID NO: 936 - DNA (genomic), 699 bp, Streptococcus pneumoniae; double-stranded, circular
  misc_feature (B) LOCATION 1...699
  hypothetical: NO
  anti-sense: NO
aagccatcaaactctcaaggagagcaggcacgtattcaggagcaaggcttgtccctcgcttatcagcaaactagtcagcaagttgaagaactggaaactctttggaaactccaagaagaggaaatagatcgtctttctgagggagattggcaagcggataaggaaaaatgtcaagagagccttgctactatcgccagtgacaagcaaaatctggaagctgagattgaagaaattaagtctaataaaaacgccatccaagaacgctatcaaaatttgcaggaagaggtggcgcaagctcgcttgcttaagacaaaactgcaagggcaaaaacgttatgaagtagctgatattgagcgtttaggcaaggaattggacaatcttaatatcgaacaagaagaaattcagcgcatgctccaagaaaaagttgacaatcttgagaaggttgatacagaattgctcagtcaacaggcggaagaatccaaaactcagaaaacaaatctccaacaaggtttgattcgcaagcagtttgagttggatgatatagaaggtcaactggatgatattgccagtcacttggatcaagctcgccagcagaatgaggagtggatgcccaagcaaacacgtgctgaagccaagaaagaaaaggtcagcgagcgtgcgccatctacaaaatcaattaacagaccagtaccagattag

SEQ ID NO: 937 - DNA (genomic), 786 bp, Streptococcus pneumoniae; double-stranded, circular
  misc_feature (B) LOCATION 1...786
  hypothetical: NO
  anti-sense: NO
aagcaatcaaaaaggcttggtctagcagcccttgctacagtcgcaggtttggctcttgcagcttgcggaaactcagaaaagaaagcagacaatgcaacaactatcaaaatcgcaactgttaaccgtagcggttctgaagaaaaacgttgggacaaaatccaagaattggttaaaaaagacggaattaccttggaatttacagagttcacagactactcacaaccaaacaaagcaactgctgatggcgaagtagatttgaacgctttccaacactataacttcttgaacaactggaacaaagaaaacggaaaagaccttgtagcgattgcagatacttacatctctccaatccgcctttactcaggtttgaatggaagtgccaacaagtacactaaagtagaagacatcccagcaaacggagaaatcgctgtaccgaatgacgctacaaacgaaagccgtgcgctttatttgcttcaatcagctggcttgattaaattggatgtttctggaactgctcttgcaacagttgccaacatcaaagaaaatccaaagaacttgaaaatcactgaattggacgctagccaaacagctcgttcattgtcatcagttgacgctgccgttgtaaacaataccttcgttacagaagcaaaattggactacaagaaagcacttttcaaagaacaagctgataaaaactcaaaacaatggtacaacatcattgttgcaaaaaaagattgggaaacatcacctaaggctgatgctatcaagatagtaatcgcagcttaa

SEQ ID NO: 938 - DNA (genomic), 639 bp, Streptococcus pneumoniae; double-stranded, circular
  misc_feature (B) LOCATION 1...639
  hypothetical: NO
  anti-sense: NO
accttgtcaaatggttggtgtagtatgagcgacagtcgcggaaagtcaaccttggctcaattgattccacgtctctttgatccacagaacggggccattaaaatcggtggcacggatattcgagacgtgagtgaagggaacctgcgtcaaacagtttcatcgttctccaaacgttccattctttttagtgtgacgnttgcagataacttgagacaggggaagggaaatgctactctatttgaaatggagcgcgcagccaatattgcccaggctagtgaattcattcatcgtatggagaaaaactttgaaagtccagttgaagaacggggaaccaatttctctggtggacaaaaacaaaggatgtcgattgcgcgtgggattgtcagcaatccacgtattctgatttttgacgattcgacctcagccttggatgccaaatcagagcgcttggtgcaagaagctttgaataaggacttgaaggggacgacaaccattattattgctcaaaaaattagctcggttgtccatgcagacaagatcttggttctaaatcaaggacgattgattggtcaaggcacgcatgcagacttggttgccaacaatgccgtttaccgtgaaatctatgaaacacagaaatga

SEQ ID NO: 939 - DNA (genomic), 720 bp, Streptococcus pneumoniae; double-stranded, circular
  misc_feature (B) LOCATION 1...720
  hypothetical: NO
  anti-sense: NO
atatcgtcaaagcagacgctgctaaacgttttccttgacaaacttgctggcgtttctgatcctgaacaaaaacgtaaaatcatcggtaacgagtctgtctatgtattcgatgacgaagccggcaagctcaaagatgtgaaattccttgctcaaggtactttatatacagatgttgtcgagtctggtacggatacagctcagactatcaagtcacaccacaacgtgggtggtcttccagaagatatgcagtttgaattgattgaaccactcaatactctttacaaggatgaagttcgtgctcttggtacagagcttggtatgccagaccatatcgtatggcgccaaccattcccaggaccaggacttgctatccgtgtcatgggtgaaatcactgaagagaaacttgaaaccgttcgtgaatcagacgctattcttcgtgaagaaatcgctaaagctggacttgaccgcgatatttggcaatacttcactgttaacacaggcgttcgttcagtcggtgttatgggtgacggtcgtacgtatgactacacgattgcaatccgtgctatcacttctatcgatggtatgactgctgattttgccaaaattccatgggaagtacttcaaaaaatctcagtacgtatcgtaaatgaagtggatcatgttaaccgtatcgtctacgatattacaagtaaaccacctgcaacagttgagtgggagtaa

SEQ ID NO: 940 - DNA (genomic), 267 bp, Streptococcus pneumoniae; double-stranded, circular
  misc_feature (B) LOCATION 1...267
  hypothetical: NO
  anti-sense: NO
aatgcgtcaaaggctatttctttcattctttttcttctaatactcttcgaaaatctcttcaaaccacgtcagcgtcgccttaccgtgcgtatgttaccgacttcgtcagttttatctgcaacttcaaagctgtactttgagcagcctacgactagcttcctagtttgctctttgattttcattgactataaaatggttttaattctttttttcaaatctggcactacttctgcctcaaaccaaggatttttggccatccagatttga

SEQ ID NO: 941 - DNA (genomic), 306 bp, Streptococcus pneumoniae; double-stranded, circular
  misc_feature (B) LOCATION 1...306
  hypothetical: NO
  anti-sense: NO
ctccctccaaagtttgccgcccttgcccaaatcattccaagccctgtcctcggtggtgccatgctggtgatgtttgtttttgtatcgattcaagggatgcaaatcctcgcccgtgttgactttgctaacaatgaacacaacttccttatcgcagctgtttcaatcgctgcaggtgtcggactcaataacagtaatctctttgtcagcatgccgacagccttccaaatgttcttctcaaacggaatcgtcgtagccagcctactcgctattgtcctcaatgccgtattaaatcataaaaagaaataa

SEQ ID NO: 942 - DNA (genomic), 270 bp, Streptococcus pneumoniae; double-stranded, circular
  misc_feature (B) LOCATION 1...270
  hypothetical: NO
  anti-sense: NO
tggcctccaaagctggattgcccttttcccctccaaagggctcaaaacctgtcactaatactttcatttctaactcctcaaaaccaattcaatgagacttttttcttaaaaacaagtataacatatttcccttattctggattaaaaaggattagcgagattagaatcgaccttcaagtgtatttaaagagtaaaatactaatcaaggccaaaatagctgatccaccttgtttcaaaataatttttttatccgctgttaaagagccgtaa

SEQ ID NO: 943 - DNA (genomic), 393 bp, Streptococcus pneumoniae; double-stranded, circular
  misc_feature (B) LOCATION 1...393
  hypothetical: NO
  anti-sense: NO
aaatatccaaaaagtagcgagtttgaagatatcacagatgacattttcaaatttacaaccaacttcacagaagaaacgctggaagctggggaagcttgggtcaatgataatgtccctggtgttaaggccatgacaactggctttgaatctattgatattgttctggactatgtcgataagggagtggccattgttgaattagttaaaaaacttggtatcacaatggatcaggtcatggcttttggagacaatcttaatgacttacatatgatgcaggttgtgggacatcctgtagctcctgaaaatgcacgacctgaaattttagaattagcaaagactgtgattggtcaccataaggaccagtcggttatagcttgtatggagggcttataa

SEQ ID NO: 944 - DNA (genomic), 291 bp, Streptococcus pneumoniae; double-stranded, circular
  misc_feature (B) LOCATION 1...291
  hypothetical: NO
  anti-sense: NO
ccaccaccaaaagcagggggaaaatcgaaatcaaccaatagtaggctactgcgacactggtcaactcactatctgatgcttgataataatgcaaaaaagcttttaataaaggcttgtctatcagctctttccaccactttttcatgtcatactccttcatttataatcttatactcaatgaaaatcaaagagcaaactagaaagctagccgcaagctgctcaaaacactgttttgaggttgtagataagactgacgaagtcagtcacatacatacggtaaggcgacgctga

SEQ ID NO: 945 - DNA (genomic), 468 bp, Streptococcus pneumoniae; double-stranded, circular
  misc_feature (B) LOCATION 1...468
  hypothetical: NO
  anti-sense: NO
cattttacaaaagaggagaaaataaaaatgaaacttcatgaattgaaacctgcagaaggttctcgtaaagtacgtaaccgcgttggtcgtggtacttcatcaggtaacggtaaaacatctggtcgtggtcaaaaaggtcaaaaagctcgtagcggtggcggagttcgccttggttttgaaggtggacaaactccattgttccgtcgtcttccaaaacgtggattcactaacatcaacgctaaagaatacgcaattgtgaaccttgaccaattgaacgtctttgaagatggtgctgaagtaactccagttgttcttatcgaagcaggaattgttaaagctgaaaagtcaggtattaaaattcttggtaacggtgagttgactaagaaattgactgtgaaagcagctaaattctctaaatcagctgaagaagctatcactgctaaaggtggttcagtagaagtcatctaa

SEQ ID NO: 946 - DNA (genomic), 873 bp, Streptococcus pneumoniae; double-stranded, circular
  misc_feature (B) LOCATION 1...873
  hypothetical: NO
  anti-sense: NO
ccaaacacaaaaactagaagaattaaacaaataatgaaattagctcaattattttcaaattttgaagaagagttgataagacaaggagaggaagcggaaagcctctcttttgtctatcgtagtctgaaaaatctatcttttacagactttatttttgccctccagcaggaggtgacaacagaggaagaaaaacaatttgtagaagatatttaccagcaactagcagctcacaagccagctcagtacatcattggacaggcagatttttatggaatgcatttaaaggtggatgaacgggttttgattcctcgtccagaaacagaggagttagtggagcttattctaactgaaaatcttgagacgaatctctcagttctggatattggaacaggtagtggagctattgctctcgctctagcaaaaaatagaccagattggtcagtgacagcagcagatgtttctcaagaggccttagagcttgcatcagagaatgctagcgatcaaaatcttaatatattttttaaaaaatctgattgttttgcagaaatttctgaaaaatatgatataattgtatccaatccaccctatatctctcgtgaagatgagtcagaggtaggcttgaatgttttgcattcggagcctcatctagctctctttgcagacgaggatggcctagctatttactgtagaattgcggaagatgcaaaagactatctcaaggatggtggtaagatttaccttgaaattggatacaagcaaggtcaaagtgttcccgaactttttagaaaacatcttcctgaaaaaaaagttcgaacactcaaagaccaatttggtcaagataggatggtcgtggttgatgatggacaggattag

SEQ ID NO: 947 - DNA (genomic), 276 bp, Streptococcus pneumoniae; double-stranded, circular
  misc_feature (B) LOCATION 1...276
  hypothetical: NO
  anti-sense: NO
tgcataacaaaaagctctactttacctagtagagcccaaagtctatgtcaaaaaaactctattaacatgccagaaaaagagcataaaagagcacacaaaaagagacaaaaacaagatctactaaataaaggttctttatttgatagacttagttgttcatgtctcccttacctccgagtattagtatctttatactatacctttaaggaaattttgtcaacagaaaactggaaattctatgctctaaaatccaaaaacaggtccataaaaacttag

SEQ ID NO: 948 - DNA (genomic), 1245 bp, Streptococcus pneumoniae; double-stranded, circular
  misc_feature (B) LOCATION 1...1245
  hypothetical: NO
  anti-sense: NO
aatgtaacaaattcatttacaacaaatcgaaatctaaatgaaatggaattttctatgaaatcagtcaaaggactactctttatcatagctagttttatcttgactcttttgacttggatgaacacttctccccaattcatgattccaggactagctttaacaagcctatctctgacttttatcctagccactcgtctcccactactagaaagctggtttcacggtttggagaaggtctacaccgtccacaaattcacagcctttctctccatcatcctactaatctttcataactttagtatgggcggtttgtggggctctcgcttagctgctcagtttggtaatcttgccatctatatctttgccagcatcatccttgtcgcctatttaggcaaatacatccaatacgaagcttggcgatggattcaccgcctggtttacctagcctatattttaggactctttcacatctacatgataatgggcaatcgtctccttacatttaatcttctaagttttcttgttggtagctatgcccttttaggcttactagctggtttttatatcatttttctatatcaaaagatttccttcccctatctagggaaaattacccatctcaaacgcttaaatcacgatactagagaaattcaaatccatcttagcagacctttcaactatcaatcaggacaatttgcctttctaaagattttccaagaaggctttgaaagtgctccacatcccttttctatctcaggaggtcatggtcaaactctttactttactgttaaaaattcaggcgaccataccaagaatatctatgataatcttcaagccggcagcaaagtaaccctagacagagcttacggacacatgatcatagaagaaggacgagaaaatcaggtttggattgctggaggtattgggatcacccccttcatctcttacatccgtgaacatcctattttagataaacgggttcacttctactatagcttccgtggagaagaaaatgcagtctaccttgatttactccgtgactatgctcagaaaaatcctaattttgaactccatctaatcgacagtacaaaagacggctatcttaattttgaacaaaaagaagtgcccgaacatgcaaccgtctatatgtgtggtcctatttctatgatgaaggcacttgccaaacagattaagaaacaaaatccaaaaacggagcttatttacgaaggattcaagttcaaataa

SEQ ID NO: 949 - DNA (genomic), 1467 bp, Streptococcus pneumoniae; double-stranded, circular
  misc_feature (B) LOCATION 1...1467
  hypothetical: NO
  anti-sense: NO
gaattgacaaacgatctttatcgtcatattctttccttgcccaagcatagcagagaccgtctgacaacttctagtttggtcactcgcttgacttcggatacctaccagattcagactggtatcaatcaattcctgcgtctctttttgcgagcgcccattatcgtttttggtgccatttttatggcttatcgaatctcagctgagttgactttctggttcttagtcatggttgccattttgaccattgtcattgtagggttatctcgattggtcaatcctctctacagtagtctcagaaagaaaacggaccaactggttcaggaaacgcgccagcaattgcaagggatgcgggttattcgtgcttttggtcaagaaaaacgagagttacagatttttcaaacccttaaccaagtttatgctagattacaagaaaagacaggtttctggtctagtttattaacacctctgacctatctgattgtcaatggaactcttctcgttattatctggcaaggctatatttcaattcaaggaggagtgctcagtcaaggtgctctcattgctcttatcaattacctcttacagattttggtggaattggtcaagctagccatgttgatcaattccctcaaccagtcctatatctcagtcaagcgaatcgaggaagtctttgttgaggctccagaggatatccattcagagttagaacaaaagcaagctaccagagataaggttttacaagtccaagaattgacttttacctatcctgatgcggcccagccttctctgagatacatttcctttgatatgactcaaggacaaattctaggtatcatcgggggaactggttctggtaaatcaagcttggtgcaactcttacttggactttatccagtagacaaggggaacattgacctttatcaaaatggacgtagtcctcttaatttggagcagtggcggtcttggattgcctatgtacctcaaaaggtcgaactctttaaaggaaccattcgttccaacttgactctaggtttcaatcaagaagtatctgaccaggaactctggcaggccttggagattgcgcaagctaaggattttgtcagtgaaaaggaaggactcttggatgctctagttgaggcaggggggcgaaatttctcaggtggacaaaaacaaagattgtctatcgcccgagcagtcttgcgccaagctccgtttctcatcctagatgatgcaacctcggcactggataccattacagagtccaagctcttgaaagctattagagaaaattttccaaacacgagcttaattttgatctctcaacgaacctcaactttacagatggcggaccagattctcctcttggaaaaaggtgagttgctagctgttggcaagcacgatgacttgatgaaatccagccaagtctattgtgaaatcaatgcatcccaacatggaaaggaggactag

SEQ ID NO: 950 - DNA (genomic), 954 bp, Streptococcus pneumoniae; double-stranded, circular
  misc_feature (B) LOCATION 1...954
  hypothetical: NO
  anti-sense: NO
gatatgacaaaagaatttcatcatgtaacggtcttactccacgaaacgattgatatgcttgacgtaaaacctgacggtatctacgttgatgcgactttgggtggagcaggccatagcgagtatttattaagtaaattaagtgaaaaaggccatctctatgcctttgaccaggatcagaatgccattgacaatgcgcaaaaacgcttggcaccttacattgagaagggagtggtgacctttatcaaggataacttccgtcatttacaggcacgtttgcgcgaagctggtgttcaggaaattgatggaatttgttatgacttgggagtgtctagtcctcaattggaccagcgtgagcgtggtttttcttataaaaaggatgcgccactggacatgcggatgaatcaggatgctagtctgacagcctatgaagtggttaatcattatgactatcatgatttggttcgtattttcttcaaatacggtgaggataaattctctaaacagattgcgcgtaagattgagcaagcgcgtgaagtgaagccgattgagacaacgactgagttagcagagattatcaagttggtcaaacctgccaaggaactcaagaagaagggtcatcctgctaagcagattttccaggctattcgaattgaagtcaatgatgaactgggggcggcagatgagtccatccagcaggctatggatatgttggctctggatggtagaatttcagtgattacctttcattccttagaagaccgcttgaccaagcaattgttcaaggaagcttcaacagttgaagttccaaaaggcttgcctttcatcccagatgatctcaagcccaagatggaattggtgtcccgtaagccaatcttgccaagtgcggaagagttagaagccaataaccgctcgcactcagccaagttgcgcgtggtcagaaaaattcacaagtaa

SEQ ID NO: 951 - DNA (genomic), 570 bp, Streptococcus pneumoniae; double-stranded, circular
  misc_feature (B) LOCATION 1...570
  hypothetical: NO
  anti-sense: NO
tccgtgacaaattctcttaaaaatgataagataggagaaatatttgactatcaaattttcaaggagggaatcgtgtcgtattttgaacagtttatgcaagccaatcaggcttatgttgccctacatgggcagttaaatctgccacttaaacctaaaaccagagtagccattgtgacctgtatggactcacgtttgcacgttgcgcaagctctaggtttggcacttggggatgctcatattttgcggaatgcaggtggtcgagtgactgaagacatgattcgttcgctagttatttcccagcaacaaatggggacaagagagattgtggtattgcaccatacagactgtggtgctcagacctttgaaaatgaaccttttcaggagtatttaaaagaggaattaggtgtagatgtgtcagaccaggatttcttgcccttccaagatatagaagagagtgtacgcgaggatatgcaactgcttatcgagtctcccctaataccagacgatgtcattatctctggtgccatttacaatgttgatacaggaagtatgacagtcgtagaattataa

SEQ ID NO: 952 - DNA (genomic), 552 bp, Streptococcus pneumoniae; double-stranded, circular
  misc_feature (B) LOCATION 1...552
  hypothetical: NO
  anti-sense: NO
aaagcgacaaaacaactcattagaaagattcatatggaacaattacattttatcacaaaattactagacattaaagaccctaatatccagattttagacatcatcaataaggatacacacaaggaaatcatcgccaaactggactacgacgccccatcttgccctgagtgcggaaaccaattgaagaaatatgactttcaaaaaccttctaaaattccttatcttgaaacgactggtatgcctactagaattctccttagaaagcgtcgtttcaagtgctatcactgttcaaaaatgatggtcgctgaaacttctatcgtcaagaataatcaccaaatccctcgtatcatcaaccaaaagattgctcaaaagttaattgaaaagatttctatgactgatattgcccatcagctttccatctcaacttcaactgttattcgtaagctcaatgattttcactttaaacatgatttttcttgtcttcctgagattatgtcctgggacgttgaaacagtccggggagtgactgtttcaatcgggagatggagatga

SEQ ID NO: 953 - DNA (genomic), 513 bp, Streptococcus pneumoniae; double-stranded, circular
  misc_feature (B) LOCATION 1...513
  hypothetical: NO
  anti-sense: NO
aaagcgacaaaacaactcattagaaagaatcatatggaacaattacattttatcacaaaattactagacattaaagaccctaatgtccagattttaaacatcatcaataaggatacacacaaggaaatcatcgccaaactggactacgacgccccatcttgccctgagtgcggaaaccaattgaagaaatatgactttcaaaaaccttctaaaattccttatcttgaaacgactggtatacctactagaattctccttagaaagcgtcgattcaagtgctatcactgttcaaaaatgatggtcgctgaaacttctgatgacgtacagtcatatttattctctttttattatatcacagttttaaatctagctttactagattcaccgctactatctatttattcggaaaaaagacgaaaaaacctgagaatcatctcaggcttggtcattaaatttttttctcaatatcgaaaagtggagaaagtggtcgtttttcatgaatacgtacgatag

SEQ ID NO: 954 - DNA (genomic), 1263 bp, Streptococcus pneumoniae; double-stranded, circular
  misc_feature (B) LOCATION 1...1263
  hypothetical: NO
  anti-sense: NO
aaagcgacaaaacaactcattagaaagattcatatgggacaattacattttatcacaaaactactcgatatcaaagacacaaatatccaaattatagatgtcgtcaatagggattcacacaaagaaatcatcgccaaactggactacgacgccccatcttgccctgggtgcggaaaccaattgaagaaatatgactttcaaaaaccgtctaagattccttaccttgagacaactggtatgcctactagaatcctccttagaaagcgtcgctttaagtgctatcagtgctcaaaaatagcggtcgctgagacttccctcgtcaagaaaaatcaccaaatccctcgtatcatcaaccaaaagattgctcaaaagttgattgaaaagatttctatgactgatattgcccatcagctttccatctcaacttcaactgttattcgtaagctcaatgattttcactttaaacatgatttttcttgtcttcctgagattatgtcttgggatgagtatgcttttacaaagggaaagatgagcttcattgcgcaagattttaacaatctcaatatcatcactgttcttgagggtagaacacaagctatcattcgaaatcactttcttcgctacgatagagttgtccgatgtcgcgtcaaaattattactatggatatgtttagcccttactatggcttggctaaacagcttcgctttcacattgtacaacatcttagctgtgctatgagtcgtgtgcgtgttcaaatcatgaatcagtttcatcgaaaatcccatgaatacaaggctatcaagcgctactggaagctcatacaacaggatagccgtaaactgagtgataagcgattttatcgtcctacttttcgtatacatttaaccaataaagagattttagacaagcttttgagctattcacaagacttgaaacatcactatcagctctatcaactcttgctgtttcactttcagaataaggaaccggagaaatttttcggactcattgaggacaatcttaagcaggttcatcctatttttcagactgtctttaaaaccttcctcaaagataaagaaaagattgtcaacgcccttcaactacactattctaatgtcaaactggaagcgaccaataatctcatcaaacttatcaagcgcaatgcctttggttttcgaaactttgaaaacttcaaaaaacggattttcatcgctctgaatatcaaaaaagaaaggacaaaatttgtcctttctcgagcttag

SEQ ID NO: 955 - DNA (genomic), 552 bp, Streptococcus pneumoniae; double-stranded, circular
  misc_feature (B) LOCATION 1...552
  hypothetical: NO
  anti-sense: NO
aaagcgacaaaacaactcattagaaagaatcatatggaacaattacattttatcacaaaattactagacattaaagaccctaatatccagattttagacatcatcaataaggatacacacaaggaaatcatcgccaaactggactatgaagctccatcttgtcctgagtgcggaagtcaaatgaagaaatattactttcaaaaaccttctaaaattccttatcttgaaacaactggtatgcctactagaattctccttagaaagcgtcgtttcaagtgctatcattgttctaaaattatggttgctgaaacttctatcgtcaagaagaatcatcaaatccctcgtatcatcaaccaaaagattgctcaaaagttaattgaaaagatttctatgactgatattgcccatcagctttccatctcaacttcaactgtcattcgaaagctcaatgacttccactttgagtgtaattttagaaatctgcctaagattatgtcttgggacgttgaaacagtccggggagtgactgtttcaatcgggagatggagatga

SEQ ID NO: 956 - DNA (genomic), 186 bp, Streptococcus pneumoniae; double-stranded, circular
  misc_feature (B) LOCATION 1...186
  hypothetical: NO
  anti-sense: NO
aaagcgacaaaacaactcattagaaagaatcatatggaacaattacattttatcacaaaattactagacattaaagaacctcacatccccactttttacatcctccctccaggagggagaccccggaggaatcccccccccgggggacgaaaaacccccctgttcctcgttgtggagtttctttaa

SEQ ID NO: 957 - DNA (genomic), 552 bp, Streptococcus pneumoniae; double-stranded, circular
  misc_feature (B) LOCATION 1...552
  hypothetical: NO
  anti-sense: NO
aaagcgacaaaacaactcattagaaagaatcatatggaacaattacattttatcacaaaattactagacattaaagaccctaatatccagattttagacatcatcaataaggatacacacaaggaaatcatcgccaaactggactacgacgccccatcttgccctgagtgcggaaaccaattgaagaaatatgactttcaaaaaccgtctaagatcccttacctcgaaacaactggtatgccttctagaattctccttagaaaacgccgtttcaagtgctatcactgttcaaaaatgatggtcgctgaaacttctatcgtcaagaagaatcatcaaattcctcgtattatcaaccaaaaaattgcgcaaaagttgattgagaagatttctatgaccgatattgctcatcagctggccatttcaacttcaactgtcattcgcaagctcaatgattctcactttgagcatgatttttcgcgtcttcctgagattatgtcctgggacgttgaaacagtccggggagtgactgtttcaatcgggagatggagatga

SEQ ID NO: 958 - DNA (genomic), 552 bp, Streptococcus pneumoniae; double-stranded, circular
  misc_feature (B) LOCATION 1...552
  hypothetical: NO
  anti-sense: NO
aaagcgacaaaacaactcattagaaagaatcatatggaacaattacattttatcacaaaattactagacattaaagaccctaatatccagattttagacatcatcaataaggatacacacaaggaaatcatcgccaaactggactatgaagctccatcttgtcctgagtgcggaagtcaaatgaagaaatatgactttcaaaaaccttctaaaattccttatcttgaaacgattggtatgccttctagaattctccttagaaaacgccgtttcaagtgctatcactgttcaaaaatgatggttgctgagactcccctggtaaagaaaaatcaccaaatccctcgtatcatcaaccaaaaaattgctcaaaagttaattgaaaagatttctatgactgatattgcccatcagctttccatctcaacttcaactgtcattcgcaagctcaatgattctcactttgagcatgatttttcgcgtcttcctgagattatgtcctgggacgttgaaacagtccggggagtgactgtttcaatcgggagatggagatga

SEQ ID NO: 959 - DNA (genomic), 1290 bp, Streptococcus pneumoniae; double-stranded, circular
  misc_feature (B) LOCATION 1...1290
  hypothetical: NO
  anti-sense: NO
aaagcgacaaaacaactcattagaaagaatcatatggaacaattacattttatcacaaaattactagacattaaagaccctaatatccagattttagacatcatcaataaagatacacacaaggaaatcatcgccaaactggactacgacgccccatcttgccctgagtgcggaagtcaaatgaagaaatatgactttcaaaaaccttctaaaattccttatcttgaaacgactggtatgcctactagaattctccttagaaagcgtcgattcaagtgctatcagtgctcaaaaatagcggtcgctgagacttccctcgtcaagaaaaatcaccaaatccctcgtatcatcaaccaaaagattgctcaaaagttgattgaaaagatttctatgactgatattgcccatcagctttccatctcaacttcaactgttattcgtaagctcaatgattttcactttaaacatgatttttcttgtcttcctgagattatgtcttgggatgagtatgcttttacaaagggaaagatgagcttcattgcgcaagattttaacaatctcaatatcatcactgttcttgagggaagaacacaagctatcattcgaaatcactttcttaaatatgatagagccgtccgatgtcgcgtcaaaattattactatggatatgtttagcccttactatgacttagctagacaacttttcccgtgtgctaaaatcgtgttggatcgctttcacattgtacaacatcttagccgtgctatgagtcgtgtgcgtgttcaaatcatgaatcaattggatcgaaagtctcatgaatacaaggctatcaagcgctactggaaactcattcaacaggatagccgtaaactgagtgataagcgattttatcgtcctacttttcgtatacatttaaccaataaagagattttaaacaagcttttgagttattcggaagacttgaaacaccactatcagctctatcagctcttgctttttcacttccagaataaggaaccagagaaatttttcgggcttattgaggacaatctaaagcaggttcatcctctttttcagactgtctttaaaaccttcctcaaagataaagaaaagattgtcaacgcccttcaactacactattctaatgccaaactggaagcgaccaataatctcatcaaacttatcaagcgcaatgcctttggttttcgaaactttgaaaacttcaaaaaacggatttttatcgctttgaatatcaaaaaagaaaggacaaaatttgtcctttctcgagcttag

SEQ ID NO: 960 - DNA (genomic), 768 bp, Streptococcus pneumoniae; double-stranded, circular
  misc_feature (B) LOCATION 1...768
  hypothetical: NO
  anti-sense: NO
ccaaatgcaaacggaggatttgaaataatgacacaagcaatccttgaaattaaacacctcaaaaaatcctatggacaaaacgaagtgctaaaagacatttcactcactgtccacaagggagaggtcatctctatcatcggaagctctggaagcggaaaatcgaccttcctacgctccattaacctacttgaaacaccaactgatggacaaatcctttatcatggacaaaacgtcctcgaaaaaggctatgacctcacgcaataccgtgaaaagttggggatggttttccaatcctttaacctctttgaaaatctcaatgttcttgaaaacacaatcgtcgctcagacaactgtcctaaaacgcgaacgcacagaagctgaaaagattgccaaagaaaacctggaaaaggtcggcatgggagaacgctactggcaagccaaaccaaaacaactctcaggtggtcaaaaacaacgtgtggccatcgctcgtgccctctccatgaatccggacgctattctctttgatgaaccaacatcagctctcgatccagaaatggttggagaagtcctcaaaatcatgcaggacctggctcaggaaggcttgaccatgattgtcgtaacccatgaaatggaatttgcccgtgatgtctctcaccgtgttatctttatggataagggcgtgatcgctgaagaaggtaaaccagaagacctcttcaccaatcctaaagaagaccgaacaaaagagttccttcaacgctatctcaaataa

SEQ ID NO: 961 - DNA (genomic), 480 bp, Streptococcus pneumoniae; double-stranded, circular
  misc_feature (B) LOCATION 1...480
  hypothetical: NO
  anti-sense: NO
ggtatggcaaaagaaccgtggcaagaagatatttatgatcaagaagaatcaagagcagggcgtcggcatcgaaaccacggaggggctgataggatggctaatcgtattttgacgatcctagctagtattttctttgtaattgtggtggtgatggtcatcgttctcatctatctatcatcgggggggagtaatcgcacagcagccttaaaagactttcatgattctgatgcaagtgtagtacaaatctcatcttcaagcagttctcagcctgagcagagttcagagccagaatctacttctagtagttcagaagaagctgctaatcctgaaggaacgattaaagttctcgcaggagaaggggaagcagctattgccgctcgtgcaggaatctccattgctcagttagaggccttgaatcctgggcacatggctacaggatcttggtttgctaatccaggtgatgttataaaaataaaatag

SEQ ID NO: 962 - DNA (genomic), 486 bp, Streptococcus pneumoniae; double-stranded, circular
  misc_feature (B) LOCATION 1...486
  hypothetical: NO
  anti-sense: NO
ataatggcaaaaaaagttaaaatcaaaaaaacattggtggaacaaatcctatctaaagcagctatccctcatcaggggattcaaatcaatgccctagaaggagagcttcctcaaggttatgaacgagatcagattttcaaaaccttggcgcttttgggagacaagaccggaccgattatcggaattgtccctatcactcagcacttgtctgaaaagaaactagctaaaatttctggcaataaaaaagtgagcatgattccacaaaaggacttagaaaaaacaactggttacattcatggagccaataatcctgtcggaattcgtcagaaacacaattatcccatttttatcgataaaattgctctagatttggatcgaatgattgtctctgcaggcgaagtcggacacagcattatcgtcgcgccacaagacttggctagctttgtaaaggcagactttgtagatattttggaggacatcaagtaa

SEQ ID NO: 963 - DNA (genomic), 1419 bp, Streptococcus pneumoniae; double-stranded, circular
  misc_feature (B) LOCATION 1...1419
  hypothetical: NO
  anti-sense: NO
aagatggcaaataaagcagtaaatgactttatactagctatgaattacgataaaaagaaactcttgacccatcagggagaaagtattgaaaatcgtttcatcaaagagggtaatcagctacccgatgagtttgttgttatcgaaagaaagaagcggagcttgtcgacaaatacaagtgatatttctgtaacagctaccaacgacagtcgcctctatcctggagcacttctcgtagtggatgagaccttgttagagaataatcccactcttcttgcggtcgatcgtgctccgatgacttatagtattgatttgcctggtttggcaagtagcgatagctttctccaagtggaagaccccagcaattcaagtgttcgcggagcggtaaacgatttgttggctaagtggcatcaagattatggtcaggtcaataatgtcccagctagaatgcagtatgaaaaaatcacggctcacagcatggaacaactcaaggtcaagtttggttctgactttgaaaagacagggaattctcttgatattgattttaactctgtccattcaggcgaaaagcagattcagattgttaattttaaacagatttattatacagtcagcgtagacgctgttaaaaatccaggagatgtgtttcaagatactgtaacggtagaggatttaaaacagagaggaatttctgcagagcgtcctttggtctatatttcgagtgttgcttatgggcgccaagtctatctcaagttggaaaccacgagtaagagtgatgaagtagaggctgcttttgaagctttgataaaaggagtcaaggtagctcctcagacagagtggaaacagattttggacaatacagaagtgaaggcggttattttagggggcgacccaagttcgggtgcccgagttgtaacaggcaaggtggatatggtagaggacttgattcaagaaggcagtcgctttacagcagatcatccaggcttgccgatttcctatacaacttcttttttacgtgacaatgtagttgcgacctttcaaaatagtacagactatgttgagactaaggttacagcttacagaaacggagatttactgctggatcatagtggtgcctatgttgcccaatattatattacttggaatgaattatcctatgatcatcaaggtaaggaagtcttgactcctaaggcttgggacagaaatgggcaggatttaacggctcactttaccactagtattcctttaaaagggaatgttcgtaatctctctgtcaaaattagagagtgtaccgggcttgcctgggaatggtggcgtacggtttatgaaaaaaccgatttgccactagtgcgtaagcggacgatttctatttggggaacaactctctatcctcaggtagaagataaggtagaaaatgactag

SEQ ID NO: 964 - DNA (genomic), 2076 bp, Streptococcus pneumoniae; double-stranded, circular
  misc_feature (B) LOCATION 1...2076
  hypothetical: NO
  anti-sense: NO
atcgttccccttgtaagaaattacagggggaattttgtttacaaggagtctactatgaagaaactattcatattattatcaactttttttctcagcttcttccttgcttggattattgtcttacgtgcgccacaatatttatatgcaagctatgattccgtttctttacttcgtgtcaaaaaagatactcaggaaccgacgcgtgaggtatttgaacaggaattggagaattttgcaaactcagaacagagtttaatagctagaagaattgtagagccgagtaaggatgggacgactcactttacttatgcaacttatggtcagggaactttaccaaaagaattccaagaagctagccaagaaagtcgtgaacgtagtgatccgctaaatagttatctccttttgtcaggctccttgacgaaagaaaagcttgccgataaattaggagatttgggttataaagcaagtgctgaccgaaagataccgccctattttcttgcttttcgaatattactaaatccccttattttaattagtttagcaatatttggcttatctttctttgctttagtgattatcactcggattaaggaaatgagagcagcaggtataaaactcttttctggtcagactctcttatccatcatggggcattctttatctactgatatcaaatggctccttctatcagccctcctttccttcctaggtgggggagtcgttctttttagtcaaggtttgttttatcctatcttgttagccacctatggttttgggattagtttctatctgttgtttttattggcgatttcaattttactaatgcttctttatctaatgagtttgagttacaaagcattagttcccgttattaaggggagattaccccttaaacgcctgatgattttaaccctattgtgtcagttggttgctgtctttacagtaggctacgctgttaagacaggtttgatgtcttaccaacgattgaaagaacttgaaatttcaaaacaagcatggcaggatagagcagactattatcaaatttcttttggcttaggtgatagaggaaaagatacagaaaatcagagcaagtggtatgcctttgccaaggaagcaatcgaagaagaacaagctctttatgtaaaggataatctgctccattttgccaatccacaaggaaaaaatgaacagggagagacactggatacctatagtccagatgctaatacgctctatgttagtcccagttatttggacaaggaaaaggtcgtggtagatgctgagaccaaacagaagttagcccatctccaaaaaggtgagtttatcctcttgctcccagaacatttgcgctctcgagaagcagaacttaagaaagtttttgaagaaagattgagttattatggaaaatctggtgaggaggcaagtgctcctttggattatgagatgaaagcgcacgttagttatctttcaatgggagaaaagcggtttgtttataataacggtgagaatcccgtatctactcagtatttgactgatccgattttagttgtattcacgccgacttctacaggtgatagttttatatccttatctagttggtctatcaatgctggaaaacaactctttatcaaaggatatgagagtgggctagaactcttgaagaaagctggaatttatgagcaagtatcctatcttaaagaaggaagaagtgtttatctaactcgttataatgaagttcaaactgaaacagcaactttaatcttaggagctattgtggggatagctagttccttgttactattttattctgtcaatcttctatatttcgagcaattccgccgagatatcttgattaaacgaatttcaggtttacgattttttgaaacacatgctcagtatatggttagccaatttgccagttttgtatttggtgctagtctctttattttaagcagtcgagacttggtgattggcttgctcactttattagtctttctagctagtgcagttctgacgctttaccgtcaagcgcagaaagaatctcgtgtttctatgacaattatgaaaggaaaatag

SEQ ID NO: 965 - DNA (genomic), 1521 bp, Streptococcus pneumoniae; double-stranded, circular
  misc_feature (B) LOCATION 1...1521
  hypothetical: NO
  anti-sense: NO
cctcttcaaaatgacccaaatgcaaaccaattttggtttcaatatgctcgctatccaaaatggtataccgaaaattttgtctcttcgtcagattttggatgcttatatcgagcaccaaaaagaatggttgttcgtcgtacacgttttgataaggaaaaagcggaagcgcgcgctcatatcttagaaggtctcttgattgcgctagaccatatcgacgaagtgattcgtatcatccgtgctagtgaaacggatgcggaagctcaagctgagttgatgagcaagtttaagctttctgaacgtcaaagtcaagctatccttgatatgcgtcttcgtcgtttgacaggtttggaacgcgataagattcaatctgagtatgatgacctcttggctctgattgcggatttagcagatattcttgctaagcctgaacgtgtttctcaaattatcaaagacgaattggatgaagttaaacgtaaattttctgataaacgccgtacagagttgatggttggacagatcttgagtctcgaggatgaggacttgattgaagaatcggatgtcttgattaccctttctaacagaggctacattaagcgtttggatcaggacgagttcactgctcaaaaacgtgggggtcgtggtgtccaaggaacgggagtgaaagatgatgactttgttcgtgagttagtgtcaactagcacacatgatcatctgctcttcttcacaaacaagggacgtgtctatcgtcttaaaggttatgaaattcctgagtatggtcggactgccaaagggctaccagtagtcaatctcttgaaattggatgaagacgaaagtattcagacggttatcaatgttgagtctgatcgcagtgatgatgcttatctcttctttacaacccgtcacggtattgtgaagagaactagtgttaaggagtttgccaatattcgtcaaaatggtctcaaagcgctgaatttaaaggatgaagatgagttaatcaatgtcttgttggcagaaggagatatggatattatcattggtaccaagtttggttatgcagttcgctttaatcaatcagccgttcgtggtatgagccgtatcgccactggtgtgaaaggtgttaaccttcgtgaaggagacacagttgttggtgccagcttgattactgatcaagatgaggttcttattatcacagaaaaaggatatggtaagcgtacagtcgctactgaatacccaacaaaaggtcgtggtggtaagggaatgcagacagctaaaattaccgaaaaaaatggcttgctggccggtcttatgactgttcaaggggatgaggatttgatgattatcactgatacaggtgtcatgattcgaaccaatcttgccaatatttcacaaacaggacgtgcaactatgggagttaaagtaatgcgcctggatcaagatgctcagatagtgactttcacaacggttgcggtggcagaaaaagaagaagttgggacagaaaacgaaacagaaggtgaagcataa

SEQ ID NO: 966 - DNA (genomic), 219 bp, Streptococcus pneumoniae; double-stranded, circular
  misc_feature (B) LOCATION 1...219
  hypothetical: NO
  anti-sense: NO
aaacttcaaaaaacggattttcatcgctctgaacatcaaaaaagaaaggacaaaatttgtcctttctcgagcttagcttttcttcaacccactacagttgacaaagagccctttttattattcaagaacttgattagctcaatgcatccaaggcgtcatccattgaaagaacttcgtggaagacacgttgtgtcaattcagttttttgttctggagtga

SEQ ID NO: 967 - DNA (genomic), 237 bp, Streptococcus pneumoniae; double-stranded, circular
  misc_feature (B) LOCATION 1...237
  hypothetical: NO
  anti-sense: NO
aaacttcaaaaaacggatttttatcgctctgaacatcaaaaaagaaaggacgaaatttgtcctttctcaagcttagctgacttcaacccactacagttgacaaagagccaaaaaattctcttttcatactcatttaaaatcaaaaagggaatttatcgttttacggacatgtatattacagatttctataggtcgtgtatagacaggatatcatcgcttggaagttttcctttttga

SEQ ID NO: 968 - DNA (genomic), 390 bp, Streptococcus pneumoniae; double-stranded, circular
  misc_feature (B) LOCATION 1...390
  hypothetical: NO
  anti-sense: NO
cagtatcaaaacacagttgctagaatcaagactggcacccagattagaggaggaattctcatgacagatacagaccctatcaaaagagctcagactttgattactgacttaaacaaagcctatcaagcatgcaaacaggcaaccgctgacgacgtccgctttcaggagcaattaaactctattcttggttttctagccaaggctgaaacagtggataatcgattcttgattgaattggaaaaattttaccagacttccagtcttctcatgggactcagcgctcttgatccagatgctccaactcgcgccgcttggcgggcctatgaccgcttccactttgaccaagtcaagaccaagttaatactcaatgagaatcaaagagcaaactag

SEQ ID NO: 969 - DNA (genomic), 189 bp, Streptococcus pneumoniae; double-stranded, circular
  misc_feature (B) LOCATION 1...189
  hypothetical: NO
  anti-sense: NO
gttagtcaaaaagaaggaattcaagcaaaacaaattgttattaagattacagatcaaggttatgtaacttctcatggcgatcattatcgctactataatggtaaagttccttttgatgcgctctttagtgaagagctattaatgaaagcccccaactatcagccgaaagatcaagatatcgtcagttag

SEQ ID NO: 970 - DNA (genomic), 216 bp, Streptococcus pneumoniae; double-stranded, circular
  misc_feature (B) LOCATION 1...216
  hypothetical: NO
  anti-sense: NO
gttatccaaaatcacttttcccccaatggttttggtaatatttttcaactcaatcataagatgccccctttcaataactctactagacttcttttctccatcctagaagctaagcctagcacaaatagtatatccagacatgtaaaacctgcaaacagtagaagtggtaagaacgcatgggcaaagaaaatcaagactagaagagggaaactatag

SEQ ID NO: 971 - DNA (genomic), 1407 bp, Streptococcus pneumoniae; double-stranded, circular
  misc_feature (B) LOCATION 1...1407
  hypothetical: NO
  anti-sense: NO
ttaaaacaaaatctagaaagggaatctatgttacacaacgcatttgcctatgttacaaggaagtttttcaaatcgattgtcatcttcctgattattctcctcatggcgagcttgagtttggtcggcttgtcaatcaagggagctactgccaaggcttctcaggagacctttaaaaatatcaccaatagcttctccatgcaaatcaatcgtcgcgtcaaccaaggaacgcctcgcggtgctgggaatatcaagggtgaagacatcaaaaaaatcaccgaaaacaaggccattgagtcttatgtcaaacgtatcaacgctatcggagatttgactggatatgacctgattgaaacgccagaaaccaagaagaatctcactgctgatcgtgccaaacgttttggaagtagcttgatgattacaggtgtcaatgactcctctaaagaagacaagtttgtctctggttcttataaactagtcgaaggagagcacttaaccaacgacgacaaggataaaatcctcttgcacaaggacttggcagccaaacacggctggaaagtaggggacaaggttaaactggactctaatatctacgatgcagataatgaaaaaggagccaaggaaacagttgaagtgacaatcaagggactctttgatggtcataataagtcagcagtaacctactcacaagaactttacgaaaacacagctattacagacattcacactgctgcaaaactttatggatacacagaagacacagccatttatggggacgcaaccttctttgtaacagcagacaagaacttggatgatgttatgaaagagttgaatggcatcagtggtatcaactggaagagctacacactcgtcaagagctcctctaactacccagctcttgagcaatctatatctggtatgtacaagatggccaacctcctcttctggggtagtttgagcttctcagttctcctccttgccctcttgctcagcctttggatcaacgcccgtcgcaaggaagtgggaattctcctctctatcggcctcaagcaggcaagtatcttgggtcaattcatcaccgaatctatcttgattgctatccctgctctagtttctgcttacttcctagctaattacactgcccgtgcaattggaaacactgtccttgccaatgtgacttcaggtgttgccaaacaggctagtaaggcggctcaagcctctaaccttggtggtggtgcagaagtagatggctttagcaagaccttgtcgagcctagacatttctattcagacatcagactttatcatcatttttgtccttgccttggttctagtggttctcgttatggcgcttgcttcaagcaatctccttagaaaacaaccaaaagagctcttgctggatggtgaataa

SEQ ID NO: 972 - DNA (genomic), 804 bp, Streptococcus pneumoniae; double-stranded, circular
  misc_feature (B) LOCATION 1...804
  hypothetical: NO
  anti-sense: NO
aaaaaacaaaaaggagaaatactcatggcagtaatttcaatgaaacaacttcttgaggctggtgtacactttggtcaccaaactcgtcgctggaatcctaagatggctaagtacatctttactgaacgtaacggaatccacgttatcgacttgcaacaaactgtaaaatacgctgaccaagcatacgacttcatgcgtgatgcagcagctaacgatgcagttgtattgttcgttggtactaagaaacaagcagctgatgcagttgctgaagaagcagtacgttcaggtcaatacttcatcaaccaccgttggttgggtggaactcttacaaactggggaacaatccaaaaacgtatcgctcgtttgaaagaaattaaacgtatggaagaagatggaactttcgaagttcttcctaagaaagaagttgcacttcttaacaaacaacgtgcgcgtcttgaaaaattcttgggcggtatcgaagatatgcctcgtatcccagatgtgatgtacgtagttgacccacataaagagcaaatcgctgtcaaagaagctaaaaaattgggaatcccagttgtagcgatggttgacaccaatactgatccagatgatatcgatgtaatcatcccagctaacgatgacgctatccgtgctgttaaattgatcacagctaaattggctgacgctattatcgaaggacgtcaaggtgaggatgcagtagcagttgaagcagaatttgcagcttcagaaactcaagcagattcaattgaagaaatcgttgaagttgtagaaggtgacaacgcttaa

SEQ ID NO: 973 - DNA (genomic), 399 bp, Streptococcus pneumoniae; double-stranded, circular
  misc_feature (B) LOCATION 1...399
  hypothetical: NO
  anti-sense: NO
ttaagacaaaaggataagagaaaggagactaagatgtcctggacatttgacaacaaaaaacccatctatttacagattatggagaaaatcaagcttcagattgtttcccatacactggaacccaatcaacaacttccaaccgtgagggagctagctagcgaggctggtgtcaatcccaataccatccaaagagccttatcagaccttgaacgagaaggatttgtctacagcaagcgaacaactggacgatttgtgactaaggataaggagctaatcgctcagtcacgcaaacaattatcagaagaagaattggaacacttcgtttcctccatgacccattttggctatgaaaaagaagaactaccaggcgtagtcagtgattatattaaaggagtttaa

SEQ ID NO: 974 - DNA (genomic), 630 bp, Streptococcus pneumoniae; double-stranded, circular
  misc_feature (B) LOCATION 1...630
  hypothetical: NO
  anti-sense: NO
aaaagacaaaaatggcagaagaatttatttattaggaggactacaatggataataaaaaattaaaagtaaaagatttagtaagcatcggtgtttttggcgtaatttattttgccttcatgtttggagttggtatgatgggcttgattccaatattgttcttaatatacccgacagtattagccatagttgcaggaactgttgttatgttatttatggctaaggttcaaaagccatgggcactatttatatttggtatgatatcaccacttgtgatgtttgcagctggtcatacctacgtagttgtggttttatcacttatagtaatgataatagcagaattaattagaaagattggtaattataattcatttaaatacaatatgctttcttatgcaatcttcagcacatggatatgtagctctttaatgcaaatgcttttagcaaaagaaaaatatatggagtggtctttgatgactatgggaaaagattatgttgatgtattagaaaagttaataacttatcctcacatggctttagtagccttaggtgctttcttaggaggaattcttggagcatatataggcaaggctctattgaaaaaacactttgaaaaagcaggcatcgtataa

SEQ ID NO: 975 - DNA (genomic), 657 bp, Streptococcus pneumoniae; double-stranded, circular
  misc_feature (B) LOCATION 1...657
  hypothetical: NO
  anti-sense: NO
ctaatgcaaaatttaattataggtattcaaaaaagaaaaaatagaataacactattttcctcactatttttattaataataatcagtctatcatttttcattttacttatcggaaatgaaagttattctttttcaactttgattaaagtcttaaatagtgaaactgttcctggagctagtttttcgattatggaaattagattaccaaaattattagcaggaattatagctggctggtcttttggattggcaggatttatctttcaaactatgttaagaaatcctcttgcaagtcctgatataatcggtgtcacaagttcttcatctattgcagcggtcttttgcatattggtattaaaaacaaatagtttaactactggaattatttcaataacttgtggactaacatcatctttaatattatttttactagctaaaaaagatggtttttcagcagcaagactgataatattaggtattggttttcaagctgtcacaagagcaggcacctcatttttattgttgaaagtagcaagatatgaattacaagaagttatgagatggctcagtggctctttatcttttacaaagttagatgacatacctcttgttctaatnagtaagtattattgctactatattagttttattttttaa

SEQ ID NO: 976 - DNA (genomic), 624 bp, Streptococcus pneumoniae; double-stranded, circular
  misc_feature (B) LOCATION 1...624
  hypothetical: NO
  anti-sense: NO
gaaatgcaaaaaacagcttttatttgggatttagacgggactttattggactcttacgaagcgattttatcagggattgaggagacttttgctcagttttctattccttatgataaggagaaggtgagagagtttatcttcaagtattcggtgcaagatttgcttgtgcgggtggcagaagatagaaatctggatgttgaggtgctaaatcaggtgcgtgcccagagtctggctgagaagaatgctcaggtagttttgatgccaggtgcgcgtgaggtgctagcttgggcagacgaatcaggaattcagcagtttatatatactcataaggggaacaacgcttttaccattctcaaggacttgggggtggaatcctattttacagagattttaaccagtcagagtggctttgtgcggaagccaagtccagaagcggctacctatctgctagataagtatcagttgaattctgataatacttattatataggggatcggactctggatgtggaatttgcccagaatagtgggattcaaagcatcaactttttagagtctacttatgaagggaatcacaggattcaagcgttagcagatatttcccgtatttttgagactaagtga

SEQ ID NO: 977 - DNA (genomic), 267 bp, Streptococcus pneumoniae; double-stranded, circular
  misc_feature (B) LOCATION 1...267
  hypothetical: NO
  anti-sense: NO
gtttataaaaaagaaaaggagtatttgattatgttacaaaaaatttatgagcagatgactaatttctatgatagtattgaagaagagtatggtcctacatttggtgataattttgactgggaacatgttcattttaaatttttaatttattatttagtgagatatggcattggttgtcgtaaggattttatcgtttaccattatcgtgttgcttatcgtttgtatcttgaaaaattggtaatgaatcggggttttatttcttgttga

SEQ ID NO: 978 - DNA (genomic), 699 bp, Streptococcus pneumoniae; double-stranded, circular
  misc_feature (B) LOCATION 1...699
  hypothetical: NO
  anti-sense: NO
tgttataaaaataaaataggagccgatatgaaaacaattcaaattgctattgatggtcctgcttccagcggtaagagtacggtcgcaaagattattgctaaggattttggattcacctaccttgatacaggagctatgtatcgtgcagcgacctatatggctcttaagaaccaattaggagttgaagaagtcgaagcccttctagccttgttggaccagcatccaatcagctttggacgttcagaaactggagaccagcttgtttttgtaggagatgtggatattacccatcctatccgtgaaaatgaagtgaccaatcatgtttctgctattgcagcaattcctcaagtgcgtgagaaactggtttctctccaacaagaaattgcccagcaaggcgggattgtcatggatggtcgcgatattggaactgttgtattgccacaagcagaattgaaaattttcctagtagcttctgttgatgagagagcagagcgtcgttacaaggaaaatattgccaagggaattgaaacagaccttgaaaccctaaaaaaggaaattgctgcgcgtgactacaaggatagtcatcgtgagacttctcctctcaaacaagcagaggatgctgtctaccttgatacaactggtttgaacattcaagaagtagttgaaaaaatcaaagcagaagctgaaaaaagaatgtaa

SEQ ID NO: 979 - DNA (genomic), 234 bp, Streptococcus pneumoniae; double-stranded, circular
  misc_feature (B) LOCATION 1...234
  hypothetical: NO
  anti-sense: NO
aataataaaaaaggagaacttatcatgaaaaaaatgaaagtttggtctactgtacttgcaacgggagttgctcttactacacttgctgcttgctctggaggttcaaattctacgactgcttcttcatctgaagaaaaagctgataaaagtcaagaattagttatctattcgaactcagtctcaaatggtcgtggtgattggttaactgctaaagcaaaagaaagctggttttaa

SEQ ID NO: 980 - DNA (genomic), 450 bp, Streptococcus pneumoniae; double-stranded, circular
  misc_feature (B) LOCATION 1...450
  hypothetical: NO
  anti-sense: NO
atcaataaaaagagaggggaagaaatgctagagattcaagatttactgtatcaactccgcttgtctgagcaagcgagtacgcaattgtttgaaaaaaggcttgggattagtttgacacggtatcagattttactgtttttgctggagcattctccttgtaaccaaatggcggttcaggagcgtttgaaaattgatcaggctgctttgacacggcatttcaaaattttggaaacggaaggtttggtggagcgtcatcgtaatcctgaaaatcagcgggaagtgttggtagaggctgcgaagtatgccaaggagcagttagtggtgaatccccctctgcaacatatcagggttaaggaagagatagaaagtatcttaacagagtttgagagaacagaactcagccgtttattaaataaattggttttgggtattgaaaatatagaaatttaa

SEQ ID NO: 981 - DNA (genomic), 336 bp, Streptococcus pneumoniae; double-stranded, circular
  misc_feature (B) LOCATION 1...336
  hypothetical: NO
  anti-sense: NO
cctcgtaaaaaggagaagaggatgcaaattccaagtagatttaccattgcgactcatatgctgataatcattgccctcgaggggaaggaaagcaaggtgaccagtgattttctggctgctagtgtcggggtcaatcctgtcattatcagaaagatcttgtcccagttgaagaaggcagagctgatttcagtagcgcgtggaacgggcggaacagagattgtcaaggaccttaaggatattagtcttttagatgtttatcaaggcgggtcgaatgtcttggtaagacaggtcaactcttcagtttccatgacaatccgaatccaaattgccctgtag

SEQ ID NO: 982 - DNA (genomic), 573 bp, Streptococcus pneumoniae; double-stranded, circular
  misc_feature (B) LOCATION 1...573
  hypothetical: NO
  anti-sense: NO
agaggtaaaaacatgattgaagcaagtaaattaaaagctggtatgacctttgaaacagctgacggcaaattgattcgcgttttggaagctagtcaccacaaaccaggtaaaggaaacacgatcatgcgtatgaaattgcgtgatgtccgtactggttctacatttgacacaagctaccgtccagaggaaaaatttgaacaagctattatcgagactgtcccagctcaatacttgtacaaaatggatgacacagcatacttcatgaatacagaaacttacgaccagtacgaaatccctgtagtcaatgttgaaaacgaattgctttacatccttgaaaactctgatgtgaaaatccaattctacggaactgaagtgatcggtgtcaccgttcctactactgttgagttgacagttgctgaaactcaaccatctatcaaaggtgctactgttacaggttctggtaaaccagcaacgatggaaactggacttgtcgtaaacgttccagacttcatcgaagcaggacaaaaactcgttatcaacactgcagaaggaacttacgtttctcgtgcctaa

SEQ ID NO: 983 - DNA (genomic), 906 bp, Streptococcus pneumoniae; double-stranded, circular
  misc_feature (B) LOCATION 1...906
  hypothetical: NO
  anti-sense: NO
ttggtcaaaaaattaaagagattggggatagaaaaaggaattagtcgtccagatttttgtggagatgagcaagaactgacagttcgtcaactgtcgcgaattgaaagtggagcttcgcaaccgagtttgcccaagttagactatattgctcgccggctaggagttccagtttatagccttatgccggatttttcagctcttccttctgcttatttagaattgaaataccagattttacgtgaaccaatctatgataaagaagaggagtatgataagaaagaagcgtgtttggaagagatagaggatttattttatgagcaacttcctaatgaggagaaagtatggtttgaagctactagagcaacgatagatgttattcgaagcggacaaccagaatacggggaaaccgtactggacgattattttaaaacaatttatgataaggaattgtttttgataaatgaattagaagttatcaacttatattttgctatagtgcttacaaagataaaacaaggtcaaaatcagattgaagaaattaacagaattcattcgtttttagttcgtttgacaaatcatgtagaattaattgcaccagaatatctgtttgctttaagtaacactttgttttcgggtctagcctgtttggataatttgtcgtcttatgattcactaggagcttatatctttagccttaatcatataatggaaaaaacacaagatttccagaagaaaccaattatattaatgttggagtggaaattatctctaataataaacaatgattatgtttctgccgaacagttctatcagaaatcgaagctatttgctgatataatagaaaattcttatttagttactatgttagaaaaacaatggcaagaagatttaaaaaaatatttataa

SEQ ID NO: 984 - DNA (genomic), 321 bp, Streptococcus pneumoniae; double-stranded, circular
  misc_feature (B) LOCATION 1...321
  hypothetical: NO
  anti-sense: NO
ttttccaaaaagaatacaataaattttcaagtatctcaaagagggaggcataagatgtcagatgcatttacagatgtagccaagatgaaaaaaatcaaagaagaaatcaaggcacatgagggacaagtcgtagaaatgactttggagaatggtcgtaagcgccaaaaaaatagattgggtaagctaattgaagtttatccatccctatttattgtggagtttggggatgtggaaggagataaacaagttaatgtttacgttgaatcctttacttactcagatattcttacagaaaagaatttgattcattatcttgactaa

SEQ ID NO: 985 - DNA (genomic), 327 bp, Streptococcus pneumoniae; double-stranded, circular
  misc_feature (B) LOCATION 1...327
  hypothetical: NO
  anti-sense: NO
acaaacaaaaaaacttcagacactataaaccttgctggtaagggaagggctctttataccagtatttatttcttattagaagaaacgaatccttcacattttcaccgattgacagcagatgaaatctggtattttcatgcaggatccccacttactgttcacatgattacagcagatggtcactacgaagcagtcactttaggcctggacatatccaaagggcaacaacttcactactgtgttcctaagggcactatttggggatcaacagttgataaggattatgctctggtttcttgtcttgttgctcctggttttgaatgttga

SEQ ID NO: 986 - DNA (genomic), 306 bp, Streptococcus pneumoniae; double-stranded, circular
  misc_feature (B) LOCATION 1...306
  hypothetical: NO
  anti-sense: NO
attataaaaaaatttgaatttgatatgatggagaaagtagcttctcttggagttccgatgtgtaaaccaattagcattgaactctgcgatgacgaagtacattctttacacgaatggatagacggaagagatgcaatagatagcattttaacttattcagaaaaccaacaatacacatatggtgtagaagcaggaaagatacttagaaagattcatacaattcctgctacagaagtttgtgaagattgggaaatcttttttaatctaaaaattgatgataaaatctccaacgaaatgatatggtaa

SEQ ID NO: 987 - DNA (genomic), 1161 bp, Streptococcus pneumoniae; double-stranded, circular
  misc_feature (B) LOCATION 1...1161
  hypothetical: NO
  anti-sense: NO
aatataaaaaatttggagctttatcaaatctcaatgcttgtttcaactgtttttcaaaatcctaagacatatttttttaatgtcaatacgacattagaattattattttatttggaaaatatcggtcttgcaagagaagagatggacaggcgtttgaaggatatacttgagatattcccgataaaaaatcttttaaacagaaatatatttaatctatccggcggtgaaaaacaaattctttgcattgcagcttcttatatagcaggtacaaagattatagttatggatgagccttcatcgaatttagatattaaaagcataagtgttttggcaaagatgctaaagatattaaaagagaaaggcataagcataattgttgcagagcatagaatttattatttgatggacatagttgaccgtgtatttttaatagataaaggaaagcttaaaaaaacttatactagaagtgaatttttaaagctagataaaaatgaattaaatgctttaagtttaagagataaagaattaagtaaattaaaagttccttatttaaaagaaggtggagagtatcagataaaaaatcttagctacaaatttactgatgatgagtgtttaagcttaaaagatatttcattcaagcttgggaaaatttatggcataataggatccaacggacgaggaaaatcaacgcttttaagatgtttaataggtcttgagaaaaaatcaaaagaagaaatttattttaagggagagaagctatctaaaaaagaaagactcaaaaactcttcacttgttatgcaagatgtaaatcatcaattattcacagatgaagtattcaacgagcttagattaggagtaaagaattttgatgaagaaaaggcgaaaatcattttaaaagatttatgcctggacgaatttattgaaaggcatccgatgagtttatcaggagggcgaaagcaaaggcttgcaatagcatctgttatgtgcaagaattctccatttgtcttttttgacgaaccttcaagtggtatggattattccaatatgataaaaatatctgaactgattaataagtataaaaccatggataaaataatttttattgtttcccatgatatagaatttttaaatgaagtggcagatgaaatttttgaattgtaa

SEQ ID NO: 988 - DNA (genomic), 300 bp, Streptococcus pneumoniae; double-stranded, circular
  misc_feature (B) LOCATION 1...300
  hypothetical: NO
  anti-sense: NO
aattcaaaaaacgcatcatatcaggtgtacatgaactacaccccaaaagttagacagaaaaaatctaacttttggggtgtttttattatgaaattaacttatgatgataaagttcagatctatgaacttagaaaacaaggatatagcttagagaagctttcaaataaatttgggataaacaattctaatattaggtacatgattaaattgattgatcgttacggaatagagttcgtcaaaaaagggaaaaatcgttactattctcctgatttaaaacaagaaatgattaataaagtctga

SEQ ID NO: 989 - DNA (genomic), 681 bp, Streptococcus pneumoniae; double-stranded, circular
  misc_feature (B) LOCATION 1...681
  hypothetical: NO
  anti-sense: NO
aaatcaaaaaagggggaagttgttgtcatcctaggggcatctggttgtgggaaaagtaccctccttcgttgcctcaacggcttagaaagtattcaaggtggagatattcttctggatggtcagtctatcgttgaaaataaaaaagattttcacctagttcgccaaaagattggcatggtctttcaaagttatgaactctttccccatctggatgtcttacaaaacctcatcctaggccctatcaaagctcaaggaagggacaagaaagaagtaacggaagaagctttgcaattactagagcgtgtcggtttgctggataaacaacatagctttgcccgtcaattatctggtggacagaagcaacgtgttgcaattgtccgtgccctcctaatgcatccagaaatcatcctttttgacgaggtgactgcttcgctggatccagaaatggtgcgtgaggtgctggaacttatcaatgatttgacccaagaaggccgtaccatgattttagtaacccacgaaatgcagtttgcccaagccattactgaccggattatcttcctcgaccaagggaaaatcgctgaagaaggaacagctcaagccttctttaccaatccgcaaaccaaacgagcccaggaatttttaaacgtctttgactttagccaattcggctcatatctataa

SEQ ID NO: 990 - DNA (genomic), 471 bp, Streptococcus pneumoniae; double-stranded, circular
  misc_feature (B) LOCATION 1...471
  hypothetical: NO
  anti-sense: NO
aaagcaaaaaataatctactgtggcagtatggtctagggatgacgattttgtttgtggttatcagtgcttcctttctgtatatggtttctcttagcatgaaaccctatcaaacagctaaaagtgaaggagaaaaattagctcagcagtatgcaggattagagcaggccgatcaggttgatttatacaatggcttggaatcttattacagcgttcttggtcgtaataaacagcaagaagcacttgctgttctgattggaaaagatgatcataagatttacgtttatcagctaaatcagggtgtttcacaagaaaaagcagaaacggtttctaaggaaaagggagctggcgaaattgacaagattatctttggtcgttatcaagataagccaatctgggaagtcaagtcaggatctgatttttatctagtagattttgaaacaggagcattggtcaacaaggagggcctatga

SEQ ID NO: 991 - DNA (genomic), 210 bp, Streptococcus pneumoniae; double-stranded, circular
  misc_feature (B) LOCATION 1...210
  hypothetical: NO
  anti-sense: NO
acaagaaaaaaggaggaaagttcaatgacaaattttgacattcttgacaatcaatttttatccttatctgaaaatgaattatcagatattgatggcggtctcgctcccttggttatctttggagtagcagtatcttggaaggctattgcaggtggaacagcacttataggttctggtttggcagctggttattttttaggaggagattaa

SEQ ID NO: 992 - DNA (genomic), 252 bp, Streptococcus pneumoniae; double-stranded, circular
  misc_feature (B) LOCATION 1...252
  hypothetical: NO
  anti-sense: NO
aggagaaaaaacatggctcaacaacgtcgtggcggattcaaacgccgtaaaaaagttgattacatcgcagcaaacaaaattgaatatgttgattacaaagatactgagcttcttagccgtttcgtttcagaacgtgggaaaatccttcctcgtcgtgtaacaggaacttcagctaaaaaccaacgtaaagtaacaacagctatcaaacgcgctcgcgtaatggctttgatgcctttcgtaaacgaagattaa

SEQ ID NO: 993 - DNA (genomic), 549 bp, Streptococcus pneumoniae; double-stranded, circular
  misc_feature (B) LOCATION 1...549
  hypothetical: NO
  anti-sense: NO
gatggaaaaaaggagattacaggagacaagatgaactactttaatgttgggaaaatcgttaatacgcagggattacagggtgagatgcgagtcttgtctgtgacggattttgcagaagaacggtttaaaaaaggagctgagctggctttgtttgatgaaaaagatcagtttgtccaaacagtgaccatcgctagccaccgtaaacagaagaactttgacattattaaattcaaagatatgtaccatatcaatactatcgaaaagtacaagggatacagtctcaaggtcgctgaggaagatttgaatgacctagacgatggtgaattttactatcacgagattatcggtttggaagtctatgagggtgatagcttggttggaaccatcaaggaaatcctgcaaccaggtgctaatgatgtctgggtggtcaaacgaaaaggcaaacgtgatttgcttttaccttatatcccaccagtggttctcaatgttgatattccaaataaacgggtcgatgtggaaatcttagaagggttagacgatgaagattga

SEQ ID NO: 994 - DNA (genomic), 1038 bp, Streptococcus pneumoniae; double-stranded, circular
  misc_feature (B) LOCATION 1...1038
  hypothetical: NO
  anti-sense: NO
atcatgaaaaaatcagatgttcttgatttaataaagtatcattatgagggcagagagacagaatttagaaatcaatccatagcaattgctcggaacttcaataaacatggtgatacacaaatagcacaatatattatggggttaatgtctcaaagtgatagattcatgccacaaatagaaaatcctagtgagtatttgactcctgctaaactagatattggtcctctcccattgcctctttcaattatgaatgatttaaaaggaataataaacgctgtcaatcatcatattggaataaataaatttttatttgtgggatctacaggtactggaaaaactgaaagtgtaaagcaggtggctagacttattggcaaggaattacttgtagtagatttcagtcacttagtagatagtaagctagggcaaacagtcaaaaacttagcaactctttttaatgaaatcaataatcttcctttcaagcaaaattatatcatcctatttgatgaaattgattccatagtgttggatagggttaatcagaatgatttaagagaaatgggacgagtgacttctgcctttttaaaggagttggataggctgtcaccagaaattgtattaattgcaacaacaaatctttttgaaaatcttgataaagcagttacgagaagattcgatgccataattgactttgaccgttatactgatgaagataaagtagaagtagctactattattttaaatgagttattaaagcaatttaagaatgtagctagagatttaaaattatttaaaaaaattatcaatagtgccaatgtaataccgaatcctggtgatttgagaaactcaataagaacgtcattggcatttagtgatccatcagatccgcatgattaccaaaaacgcctgctaagaagtttgcataatggtagaaatttatctatttctaaattatcgaagctaggttttactgttagagaaattgagattttgacaggtgtttctaagagtagtgtatcacgagagttaagcgaggattaa

SEQ ID NO: 995 - DNA (genomic), 1047 bp, Streptococcus pneumoniae; double-stranded, circular
  misc_feature (B) LOCATION 1...1047
  hypothetical: NO
  anti-sense: NO
aaaatgaaaaatgaaatgttagctttgattcttgctggtgggcaaggaactcgtctcggtaaactcactcaaagcatcgcaaaaccagctgtgcaatttggggggcgctaccgtatcattgactttgccctatcaaactgtgccaactcagggattcataatgttggggtcgttacacagtatcaaccacttgctctcaacaaccatattgggaatggttcaagctggggactagacggtattaattcaggtgtctctattcttcaaccttattctgcaagtgaaggaaatcgttggtttgaggggactagtcacgctatttaccaaaatatcgactatatcgacagtgtcaatcctgagtatgtcttgattttgtctggggaccacatctacaaaatggactatgatgatatgctccagtctcataaggataataatgccagcttgacagtagcagttttagacgtccctcttaaagaagcaagccgttttggtatcatgaacacagatgctaacaatcgtattgttgaatttgaagaaaaaccagctcaacctaaatctacaaaagcttctatgggaatctacatttttgattggcaacgccttcgtaatatgttagtcgctgctgaaaagagcaaggttggcatgtcagactttggtaaaaatgtcattccaaattaccttgagtcaggtgaaagtgtttatgcttacgaatttagtggttattggaaagatgttggtactattgagtcactttgggaagcgaacatggagtatatttctccagaaaatgccttggatagtcgtaaccgtcaatggaagatttactcaagaaacttgatttcaccaccaaacttcctcggggcaaatgctcatgtggaagactcattagttgtagacggatgtttcgttgatggaactgttaaacattctatcctttcaacaggcgcgcaagttcgcgaaggagcggaagtccttgattcagttatcatgagtggagctatcattggtcaaggagctaagattaaacgtgccattattgagtga

SEQ ID NO: 996 - DNA (genomic), 720 bp, Streptococcus pneumoniae; double-stranded, circular
  misc_feature (B) LOCATION 1...720
  hypothetical: NO
  anti-sense: NO
agaatgaaaaaatattttattggcggtttgggaagcaatgcctatcatagcaaggattttcttcaagaactagattcgcaggtctattttctaaatccatatgaaaagcatcttcgagatgaaacagaattgaaatcatggtttaaaaatgagattgtagaggaagaatttatctgtctgataggtcattctcttggaggagatttagctcgttatctcgcatcggaatttgaagaagtaaagaaactgattcttttggatggtggctatctagatttagataagattttacctttggatacagagttagaggaaactaaaaattatatcaaatctcaaattgttttggacttagatgttcttacttctaaagaaaaatctgaagcaaagcattggtcagaaaatatggagaaagctgtaagacagtcctatcactggaatgttgagtataatagatatgagttggctataaattatgaaaatatagaagcgatactccgcctacggagaaaaatacaagcttttaagagagaagtgggagataccttgtttattagtcctcgctatcctaatgaagctacatggagagaggaagccctaaaagaattgccagactattttgatactatttttttagaaaactttggccatgagctttatactcaagcacctaaagaaatcgctagtctaatgaatgagtggctcgcttattttctatga

SEQ ID NO: 997 - DNA (genomic), 999 bp, Streptococcus pneumoniae; double-stranded, circular
  misc_feature (B) LOCATION 1...999
  hypothetical: NO
  anti-sense: NO
aggatgaaaaaacaagcctatgtcattattgctctcacctccttcctatttgtcttttttttctcccacagcttgctggaaatacttgattttgactggtctatctttttgcacgatgtcgaaaaaacagaaaaatttgtctttttattgttggttttcagcatgtccataacctgtctcttagccctgttttggcgagggatcgaagagctttctctaagaaaaatgcaggctaatctcaagcgtttattggcagggcaagaagtggttcaggttgcagatccagatttggatgccagtttcaagtccttatcaggtaaacttaaccttttgacagaagctcttcaaaaagctgaaaatcatagccttgctcaggaagaggaaatcatcgagaaagaacggaagcgaattgctcgggatttgcacgatacagtcagtcaggagttgtttgcggcccacatgattttatcgggtatcagtcagcaggctttgaaattggatagagaaaagatgcagatccagttgcagagtgtcacagctattttagaaactgcccagaaggatttgcgggttttgctcttgcatttgcgaccagttgaactggagcagaagagcttgatagaagggattcagattctcttaaaagagcttgaggacaagagtgatcttagggttagtctcaagcagaatatgacgaaattgcctaagaaaatcgaggagcatatcttccgtatcctgcaagagttgattagcaatacgctccgccatgcccaggcatcttgcctagatgtctacctctatcagacagatgttgaattgcaactgaaggtggtggacaatgggattggtttccggttagggagcttagacgacttgagttatggactgcgaaatatcaaggagagggttgaagatatggctggaacagttcaactcttgacagctcccaagcaagggctggcagttgatatccgtattcccctgttagataaggaatga

SEQ ID NO: 998 - DNA (genomic), 210 bp, Streptococcus pneumoniae; double-stranded, circular
  misc_feature (B) LOCATION 1...210
  hypothetical: NO
  anti-sense: NO
aaacagaaaaaggagtggggaggcgatgtgcttcactcactcctttttccattttgctactcttcgaaaatctcttcaaaccacgtcagcgtcgccttgccgtatgtatggttactgacttcgtcagtttcatctacaacctcaaaacagtgttttgagcaacctgcggctagtttcctagttttctctttgatttttattgagtattag

SEQ ID NO: 999 - DNA (genomic), 3363 bp, Streptococcus pneumoniae; double-stranded, circular
  misc_feature (B) LOCATION 1...3363
  hypothetical: NO
  anti-sense: NO
agtgagaaaaaaatgggaaattttagctttcttttaaaaaatgacgaatatgaatctttttcaaaaccttgcattgaagctgagaatatgattgctacatcaactgtggctactgcctttatggcgcgtcgtgctttagagcaggctgtccattggatatatagtcacgattcatatttagaagctccctatcgtgctactctatcttctttagtatgggatgatgattttagggatatcgtagattctgaactccacaagcagatagttctgttgattcggtggggaaaccatgctgctcatggtggtgaaattaaggaacgagaagcgattttagctttgcatcatttgtatcagtttgttaattttatcgattattgttacagcaatgagtttgtggagcgttattttgatgagaagtgcttaccactttcagcaaacatcaaataccgagaaactccacaatctatgataaagttacaagacagtttaccagaactgcctgattttcatgaacagatggctgctcagtccgtagaagttcaagagacttatactgaaaaacgtgagactgcagcgcaacggcaagatgtgcctttccatattgatcaattatctgaggcagagacaagaaagctctttattgatatcgatctccgtttagcaggatggatatttgaagaaaactgtcgtgttgagatagccgttgatggtctcaagcacggttcaggaattggttactgtgactatgtactttatggtaaaaatgggaaaattttagcgattgtagaggctaaaaaagcctctgtcaatccagaagtaggggaagtacaggtcaaagaatatgctgaagctcttgagaaacatatcggctatcagccaatttgctttattacaaatggcttgaagcactatatacttgatggtccgaaccgccgccagattgcaggcttttactctcaagaagaattgcaattagtgatggatagacgtcatcttcaaaaaccacttgaggatatttctagtaaaattagggacgatatttccgggcgtcactaccaaaaacacgccattgcaagcgtttgtgaagctttctctaatcatcgtagacaggcacttttggttatggcaactggggctgggaaaactcgtacagcagtttctctagttgatatcttatcacgtcataactgggtaaaaaacgttctcttcttagccgatagaacttccttggttaagcaagcctatgattcgtttagaaaattactcccagatctttccgtttgtaacttcttagaagataaagaaggagctcaatcaagtcgcatggtcttttcaacttatccgaccatgattggagcgattagtggtcaagaagaagtaaatcaacgccctttcactgttgggcattttgaccttatcataattgacgaatctcaccgttctatttatcagaaatacaagtccatttttgattattttgatgcaagaattgtaggcttaacagctactccgcgtcaagatttagataaaaacacctatggattctttaatttggagaatggggttccaacatatgcatatgatttggaagaggctgttaaagacggatatttagtagcctatcattctatcgaaaccaaactgaaactacctacggatggtctacattatgatgatttgtccgaagaagaaaaggaacattttgatagcaaatttgaagacgatagctgtgaaaaagatattgatgggagtgtatttaattcctttgttttcaataaaagtacagtagaaattgttttaaatgaactcatgacaagaggaattcagacagcctcgggtgatgaaattggtaaaactattatttttgctaaaaatcatgatcatgcggaatatatcagaggtatttttaacaaccgctatcctgaaaaagggagcgactatgctcaggtgattgattatagtattaagcattatcagaccttgattgatgattttaaaattaaggagaagtatcctcaaattgcgatttctgtcgatatgttagatacaggtattgatgtaccagaggttgttaatttagtcttcttcaagaaagtacgctctaaaactaagttttggcagatgattggtcgaggaacccgtctatgtaaagatttatttggacctgagcaggataaggaaaacttcttggtatttgattatggggataattttgattattttcgtgcagatccaagagatggagagggtcgtcacattgtttcgttgactcagcgtttatttaatatcaaagtggacttgattcgagaacttcagggactccaataccaagaagatcagtttgcgagagcataccgtcagcagcttgtctcggaacttcaaggtcgtatagagagcttaaatgagttggacttcagggttcgtatggttttagatacagtttatagctataggaaattggaaagttggcagaatctaactgctgttacaagtgaaaccattcaaaaaaatctctctccgcttttatttgatgaagataaagaagatgagatggcgaggagatttgatttgtggttgcttcatattcagttggggcaactgacagctaaatcttccactgttcatatttcccaagtgatgaagacggctagagctctttctgctattggcaatatcccgcaggtttttgagcaggctgaaattatcaggaaagtacaggagcctgaattttggaaagaagttaacttgtctgatttggaaaaaattcgtcttgctattcgagatttattacagtttttggataaaacagaccgtaaaccctactatgttaactttgaagatcgtatactctccactgttcacgagaccacagcatttttgcaggtcaacgatcttcggtcttacaatgaaaaagttgagcattatttgaaaactcatctggatgaggagtccatttctaagctataccataataaaaagttgacatctgatgatatgcttgcacttgaaaaattgctctgggaaaaattaggtagtaaagcagactaccaaagtcattatgaaaataaggcaattccgagattggttcgtgagattattggcttagatagagagtctgccaatcgtattttttctaaatttttgtcggatgagaatcttaatgccaggcagatttcatttgtaaaattgattgtagactacattgtagaaaatggttttttagagacgaaagtgttaacgcaagagccgtttaaatcttatggttctgttcaactactcttccaacaccaactaccagtacttcgtaatattgttcaaatcattgaacttatcaataatcgagctggagaagcggcttaa

SEQ ID NO: 1000 - DNA (genomic), 1173 bp, Streptococcus pneumoniae; double-stranded, circular
  misc_feature (B) LOCATION 1...1173
  hypothetical: NO
  anti-sense: NO
ggagagaaaaagatgaagaaaaaatttgccctatcgtttgtggcgcttgcaagtgtagcacttcttgcagcctgtggagaagtgaagtctggagcagtcaacactgctggtaactcagtagaggaaaagacaattaaaatcgggtttaactttgaagagacaggttctttanctgcatacggaacagctgaacaaaaaggtgcccaattggctgttgatgaaatcaatgccgcaggtggtatcgatggaaaacaaatcgaagtantcgataaagataataagtctgaaacagctgaggctgcttcagttacaactaaccttgtaacccaatctaaagtatcagcagtcgtaggacctgcgacatctggtgcgactgcagctgcggtagcgaacgctacaaaagcaggtgttccattgatctcaccaagtgcgactcaagatggattgactaaaggtcaagattacctctttattggaactttccaagatagcttccaaggaaaaattatctcaaactatgtttctgaaaaattaaatgctaagaaagttgttctttacactgacaatgccagtgactatgctaaagggattgccaaatctttccgcgagtcatacaagggtgaaatcgttgcagatgaaactttcgtagcaggtgacacagacttccaagcagcccttacaaaaatgaaagggaaagactttgatgctatcgttgttcctggttactataatgaggctggtaagattgtaaaccaagcgcgtggtatgggaattgacaaaccaatcgttggtggtgatggattcaacggtgaggagtttgtacaacaagcaactgctgaaaaagcatcaaacatctactttatctcaggcttctcaactactgtagaagtttcagctaaagctaaagccttccttgacgcttaccgtgctaagtacaatgaagagccttcaacatttgcagccttggcttatgattcagttcaccttgtagcaaacgcagcaaaaggtgctaaaaattcaggtgaaatcaagaataaccttgctaaaacaaaagattttgaaggtgtaactggtcaaacaagcttcgatgcagaccacaacacagtcaaaactgcttacatgatgaccatgaacaatggtaaagttgaagcagcagaagttgtaaaaccataa

SEQ ID NO: 1001 - DNA (genomic), 414 bp, Streptococcus pneumoniae; double-stranded, circular
  misc_feature (B) LOCATION 1...414
  hypothetical: NO
  anti-sense: NO
gaggagaaaaacaaaatggttatgactgacccaatcgcagacttcctaactcgtattcgtaatgctaaccaagctaaacacgaagtacttgaagtacctgcatcaaacatcaaaaaagggattgctgaaatccttaaacgcgaaggttttgtaaaaaacgttgaaatcatcgaagatgacaaacaaggcgtcatccgtgtatttcttaaatacggaccaaatggtgaaaaagttatcactaacttgaaacgtgtttctaaaccaggacttcgtgtctacaaaaaacgtgaagaccttccaaaagttcttaacggacttggaattgccatcctttcaacttctgaaggtttgcttactgataaagaagcacgccaaaagaatgttggtggtgaggttatcgcttacgtttggtaa

SEQ ID NO: 1002 - DNA (genomic), 894 bp, Streptococcus pneumoniae; double-stranded, circular
  misc_feature (B) LOCATION 1...894
  hypothetical: NO
  anti-sense: NO
gaaaggaaaaagatgagcaacatttcaactgatttgcaagatgtagaaaaaatcatcgtattggactatggtagccagtacaaccagctgatttcacgccgtatccgtgagattggtgttttttcagaactaaaaagccataaaatttcagctgctgaagttcgtgaagtcaatcctgtaggaattattctatcaggtggtccaaattctgtatatgaagatggttcatttgatattgacccagaaatcttcgaactcggaattccaattttgggaatctgttatggtatgcagttattgacccataaacttggaggaaaagttgttcctgcaggtgatgctggaaatcgtgaatacggtcaatcaaccctaactcacacaccatcagcgctttttgaatcaacacctgatgaacagactgttttgatgagccatggtgatgcggttactgagattcctgctgactttgttcgtacaggtacatcagctgactgcccatacgcagccatcgaaaacccagataaacacatttacggtatccaattccacccagaagttcgtcattctgtatacggaaatgatatccttcgtaactttgcccttaacatttgtaaggctaaaggtgactggtcaatggataatttcattgacatgcagatcaaaaaaattcgtgaaaccgtcggtgataaacgtgtccttcttggtctatcaggtggtgttgactcatctgtcgttggggttcttctccaaaaagcgattggcgatcaattgatctgtatcttcgtaaaccacggtcttcttcgtaaaggcgaagctgatcaagttatggacatgctcggtggtaatttgggtttgaatatcgtcaaagcagacgctgctaaacgttttccttga

SEQ ID NO: 1003 - DNA (genomic), 513 bp, Streptococcus pneumoniae; double-stranded, circular
  misc_feature (B) LOCATION 1...513
  hypothetical: NO
  anti-sense: NO
gaatttgaaaagatgattgaccaactatctaagtattacagttgtaggatactaactgaaaaggatattccaagtattttatctttatatgaaagtaatcctctgtattttcagcattgtccaccagagccaaattttgcaactgtaaaagaggacatgctttgtctacctgaaggtaaagctaaggctgataagttttttgttggattttggaatggctctgaccttgtggctgttatggattttgtctatgcatatcctgatgaggagactgtttttattggtttgtttatggttgatcaagcctatcagaggaaagggattggtagtcatattgtgacagaagcactagcttattttgctaagaactttcgaaaggcacgtttggcttatgttaagggaaatccgcaatctcagcatttttgggaaaagcagggctttaaatcaattggatgcgaggttaagcaagaactctatacggttgttatcgttgaacagagcctagatgattag

SEQ ID NO: 1004 - DNA (genomic), 2517 bp, Streptococcus pneumoniae; double-stranded, circular
  misc_feature (B) LOCATION 1...2517
  hypothetical: NO
  anti-sense: NO
aagcttgaaaatttctataaaaatcggtattatattttcgaaagaaataaaaatattttcgaaagaaaggtgcttacgatggtaaatacagaagtagcaagaacaacaatcaagacagaatattttggcagccttactgaaaggatgaacaaatatcgagaagatgttttaaataaaaaaccttatattgatgctgagagagcagttctagcaacacgcgcctatgaacgatacaaggaacaacctaatgtcctaaaacgtgcatatatgctgaaagaaattttggaaaatatgactatctatattgaagaagaatctatgattgcgggaaatcaagcttcttccaataaagatgctcctatttttccggaatatacgctagaatttgttctcaatgagttggatctttttgaaaagcgtgatggagatgttttctatattacagaagaaacaaaagaacaacttagaagtattgctccgttttgggaaaataataatttacgtgctagagctggtgccttattacctgaagaagtgtctgtttatatggaaacaggattcttcggtatggaaggtaagatgaattctggagatgctcacttagcagttaactatcagaaacttttgcaatttggtttaagaggttttgaagagcgggctcgtaaagcgaaagtagctctagatttaacagatccagcaagtattgataaatatcatttttacgactctatatttattgtaatcgatgctattaaagtatatgcaaagcgctttgttgctcttgctaaaagtttagccgaaaatgcaaatcctaaacgtaagaaagaattacttgagattgcagatatttgctctagagtcccatatgaaccggcaactacttttgcagaagctattcaatcagtttggtttattcaatgtattttacaaattgaatctaatggccactctctttcatatggccgttttgatcaatatatgtatccatatatgaaggctgatttagaaagtggtaaagaaacagaagatagcattgttgaacgtctgacaaatctttggattaagacaattacaatcaataaggttcgcagtcaatcacatacattttcttcagcaggaagtcctctatatcaaaatgttacaattggtggacagactcgagataagaaggatgctgttaacccattatcttatttggtattaaaatcagttgcacaaacccatctaccgcaacctaatctaactgtacgttaccatgcaggtttagatgctcgtttcatgaatgagtgtattgaagtgatgaaacttggttttggtatgcctgcatttaataatgatgagattattattccttcttttattgcaaaaggagtattggaagatgatgcttatgattacagtgccattggatgtgttgaaacggcagttccagggaaatggggctatcgttgcacaggtatgagttatatgaacttccctaaggttctacttatcacgatgaatgatggaattgatccggcttcgggtaaacggtttgcaccaagctttggtcattttaaggatatgaagaacttttctgaattagaaaatgcttgggataaaacactaagatatttgacacgaatgagtgttattgttgaaaattctattgatttatcattggaacgagaagttcctgatattctatgttcagcattgactgatgattgtattggtcgtggaaaacaccttaaagaaggtggagcagtatatgattatatatcaggattgcaagttggaattgcaaatttgtcggattcattagctgcaattaaaaaattggtgtttgaggaagaacgtataagcccaagtcagctttggcatgcactggaaacagattatgccggagaagaaggtaaggtcattcaagaaatgttgattcatgatgcacctaagtatggtaatgatgatgattatgctgacaaattggttactgctgcttatgacatttatgttgatgaaattgctaaatatcctaatacacgttatggaagagggcctattggaggaattcgttattcaggaacatcttctatatcagccaacgtagggcagggacgtggaacattagcaactccagatggacgcaacgcgggtacaccgttagcagagggttgttcaccatcacataatatggatcaacacggccctacatctgttttaaaatctgtttcaaaattaccaacagatgaaatcgtaggtggggttctcttaaatcagaaagtaaatcctcaaacgttagccaaagaagaagataaattaaaactaattgctttgttacgaacattctttaatcgtttacatgggtaccatattcaatacaatgttgtttccagagagacgctgattgacgctcagaaacatcctgaaaaacacagagacttaattgttcgtgttgcaggatactctgcattcttcaatgttctttctaaggcaacccaagatgacattataggacgtactgagcatactttgtaa

SEQ ID NO: 1005 - DNA (genomic), 579 bp, Streptococcus pneumoniae; double-stranded, circular
  misc_feature (B) LOCATION 1...579
  hypothetical: NO
  anti-sense: NO
tttcctgaaaaagaaggcagcagaatagagggcttgtatatgaaatcggaattacgcaagcaagtcttgcatgaaatgaaggctttatctcaagaacaaaaacaggctatagaccaagctttaaccgagcgaattttacaacaccccttttatcaagaagccaaggtcatcgcaacctacctctctttttctcatgagtttcaaacgcgggaactgattgagcaggcgctgaaggacggcaagaaggttttaatacccaaaacttatcccaaggggcgcatggactttgtagtctatgatccgcagcagttggtaaaaactgcctttgccttactggagccacagggagatttggaagtggtggatgtatctcagattgatttgattcatgttcctggcctggcttttacgacggatggatatcggattggatatggtggaggttattatgaccgctatctggaacatttttctggtcatactttgagtacggttcatccttgtcaaattcaggactttatacctgaaaaccatgatattcctgttcaggaggtattaattgatgaaggaaatctttga

SEQ ID NO: 1006 - DNA (genomic), 306 bp, Streptococcus pneumoniae; double-stranded, circular
  misc_feature (B) LOCATION 1...306
  hypothetical: NO
  anti-sense: NO
caatatgaaaactgttgttttcttgtatatcctatgatagggactttcgccgctgctcttgtagctgtactagcaagtttcatcgtccctattgaaattaccctaaatagtgccaatactgaaattgcaccaccagatgggattgggcaggtcctcagcaacctcttgctcaaactggttgacagcccagtcaacgccctgcttactgctaactatattggaatcttatcttgggcagtcatttttgatatcgctatgagagaagccaggaaaaatagtaaagaattggctaaaaactatcgctga

SEQ ID NO: 1007 - DNA (genomic), 2292 bp, Streptococcus pneumoniae; double-stranded, circular
  misc_feature (B) LOCATION 1...2292
  hypothetical: NO
  anti-sense: NO
aaaaatgaaaagattggaccgtttggtgcagtctttttctcttcccgaaatgcctgtgaaatatggtataatagaagaatggcaaacaagaatacaagtacaacaagacggagaccgtctaaagcagaactggaaagaaaagaagcgattcaacgaatgttgatttcgttaggaattgcgattttattgattttcgcagccttcaaattaggggctgcaggtataaccctttataatttaattcgcttgctagtgggtagcctagcttatctggcgatattcggcctattaatctatctcttctttttcaagtggatacgaaaacaggaaggactcttatctggctttttcaccatatttgctggcttactcttgatttttgaggcctacttggtttggaaatatggtttggacaagtccgttctaaaagggaccatggctcaggttgtgacagatctgactggttttcgaacgactagctttgctggagggggcttgatcggggtcgctctttatattccaacagcctttctcttttcaaatatcggaacttactttattggttctatcttgattttagtgggttctctcctagtcagcccttggtctgtttacgatattgctgaatttttcagtagaggctttgccaaatggtgggaagggcacgagcgtcgaaaagaggaacgctttgtcaaacaagaagaaaaagctcgccaaaaggctgagaaagaggctagattagaacaagaagagactgaaaaagccttactcgatttgcctcctgctgatatggaaacgggtgaaattctgacagaggaagctgttcaaaatcttccacctattccagaagaaaagtgggtggaaccagaaatcatcctgcctcaagctgaacttaaattccctgaacaggaagatgactcagatgaccaagatgttcaggtcgatttttcagccaaagaagcccttgaatacaaacttccaagcttacaactctttgcaccagataaaccaaaagatcagtctaaagagaagaaaattgtcagagaaaatatcaaaatcttagaagcaacctttgctagctttggtattaaggtaacagttgaacgggccgaaattgggccatcagtgaccaagtatgaagtcaagccggctgttggtgtaagggtcaaccgcatttccaatctatcagatgacctcgctctagccttggctgccaaagatgtccggattgaagcaccaatccctgggaaatccctaatcggaattgaagtgcccaactccgatattgcaactgtatctttccgagaactatgggaacaatcgcaaacgaaagcagaaaatttcttggaaattcctttagggaaggctgttaatggaaccgcaagagcttttgacctttctaaaatgccccacttgctagttgcaggttcaacgggttcagggaagtcagtagcagttaacggcattattgctagcattctcatgaaggcgagaccagatcaagttaaatttatgatggtcgatcccaagatggttgagttatctgtttacaatgatattccccacctcttgattccagtcgtgaccaatccacgcaaagccagcaaggctctgcaaaaggttgtggatgaaatggaaaaccgttatgaactctttgccaaggtgggagttcggaatattgcaggttttaatgccaaggtagaagagttcaattcccagtctgagtacaagcaaattccgctaccattcattgtcgtgattgtggatgagttggctgacctcatgatggtggccagcaaggaagtggaagatgctatcatccgtcttgggcagaaggcgcgtgctgcaggtatccacatgattcttgcaactcagcgtccatctgttgatgtcatctctggtttgattaaggccaatgttccatctcgtgtagcatttgcggtttcatcaggaacagactcccgtacgattttggatgaaaatggagcagaaaaacttcttggtcgaggagacatgctctttaaaccgattaatgaaaatcatccagttcgtctccaaggctcctttatctcggatgacgatgttgagcgcattgtgaacttcatcaagactcaggcagatgcagactacgatgagagttttgatccaggtgaggtttctgaaaatgaaggagaattttcggatggagatgctggtggtgatccgctttttgaagaagctaagtctttggttatcgaaatacagaaagcagttggaatccatgattcagcgtcgtttgtcagttggatttaa

SEQ ID NO: 1008 - DNA (genomic), 606 bp, Streptococcus pneumoniae; double-stranded, circular
  misc_feature (B) LOCATION 1...606
  hypothetical: NO
  anti-sense: NO
actagtgaaaatcaagctttgattggttggaaaagtatggaatcaatttttgtaaaacttgcccagtatccgtctatagaaacggagcgtttattgcttagacctgtaactttggatgatgcggaagcaatgtttgactatgcctcggacaagggtaatacacgttacacttttccaaccaatcaaagtttggaagaaaccaagaataacattgctcagttctatttggctaatcccttgggacgttggggaatagaactaaaaagcaatggtcagtttattggaaccattgacttgcacaagattgattctgttcttaagaaggcagctattggctacattatcaataaaaagtattggaatcaaggattaacgacagaagccaatcgtgctgtgattgagctagcttttgagaagatagggatgaataagttgactgcccttcacgataaggacaatcctgcgtcaggaaaggtcatggagaaatcaggcatgcgtttttcccatgcagaaccatatgcttgtatggaccagcatgaaaaaggccgaatcgtgacaagagttcattatgtcttgaccaaggaagactattttgcaaataaataa

SEQ ID NO: 1009 - DNA (genomic), 354 bp, Streptococcus pneumoniae; double-stranded, circular
  misc_feature (B) LOCATION 1...354
  hypothetical: NO
  anti-sense: NO
atgaacgaaaaagaattactagaactagtcgtgaaagcggctgatgagaaacgtgcggaggatatcctcgcacttgatgtacaagatttgactagtgtgacggactactttgtcatcactagctcaatgaatagccgtcagttggacgctatcgcagctaatatccgtgaaaaagtagctcaagcaggctttaaaggtagccatgtcgaaggcgatgcagctggaggctgggtcttactggacctcggtgctgttgtcgtgcatatcttttcagaagaaatgcgtgcccattataatctagagaagctatggcatgaggcgaattcagtagatatttcagaagctcttgcttag

SEQ ID NO: 1010 - DNA (genomic), 792 bp, Streptococcus pneumoniae; double-stranded, circular
  misc_feature (B) LOCATION 1...792
  hypothetical: NO
  anti-sense: NO
atggacgaaaaaaaacgaatgcaaattattgctgaaaatattacacactttagaaagcaacgtggcatcacccaaaaagatttggctaaagaagttggaattacagcaagtactatgacagactatatgaagttaagaagcgctccttcttttggtgttatccaaaaactggctgattatttcggtgttaaaaaatcagatatagatactacttttaaagaagaatccaccaactcactgccagacgctccagattcgctcacacagcagataatggataaggtagtgcaattaaccccacccaatcaaaaaatcgtgctacggacctctgaagagcttctggagagccaaaacgaagaagaaacgaagataaacgaagtatcggaagttatcagcttgtaccaagttgaggttgtatctgagacggcagcagcttctggatttaactatggatttgggtacgacgatacagacagagagactatagaggttgacgagcgaccaccacgccacgatattgcgaccaaggtcagtggagactccatgcaacccgactaccaagacggagacattctctatttagtagacaaaggactgactacctacaacggagatttagcaattatcgcatatggagaccgttcttacttcaagaagatatataccgaaaacggacgcttacgcctagtgtcactcaatgacaagtacgaagacatcatcctagacttcccaccagccgaagacacacacatcaagatttatgcagtagtcggggtgtatagaggggaataa

SEQ ID NO: 1011 - DNA (genomic), 339 bp, Streptococcus pneumoniae; double-stranded, circular
  misc_feature (B) LOCATION 1...339
  hypothetical: NO
  anti-sense: NO
aatttagaaaataggtacaagcaaatgatgttaaaaccctctattgataccttgctcgacaaggttccttcaaaatattcactcgtaatcttggaagcaaaacgtgcccacgaattggaagcaggtgccccagcaactcaaggtttcaagtctgaaaaatcaactcttcgcgctttagaagaaatcgaatcaggaaacgttacaattcacccagatccagaaggaaaacgtgaagcagtgcgtcgccgtatcgaagaagaaaaacgccgcaaagaagaagaagaaaagaaaatcaaagagcaaattgctaaagaaaaagaagatggtgaaaaaatttaa

SEQ ID NO: 1012 - DNA (genomic), 249 bp, Streptococcus pneumoniae; double-stranded, circular
  misc_feature (B) LOCATION 1...249
  hypothetical: NO
  anti-sense: NO
agcttagaaaaggggaataatatgatatttaaggcattcaagacaaaaaagcagagaaaaagacaagttgaactacttttgacagtttttttcgacagttttctgattgatttatttcttcacttatttgggattgtcccctttaagctggataagattctgattgtgagcttgattatatttcccattatttctacaagtatttatgcttatgaaaagctatttgaaaaagtgttcgataaggattga

SEQ ID NO: 1013 - DNA (genomic), 1413 bp, Streptococcus pneumoniae; double-stranded, circular
  misc_feature (B) LOCATION 1...1413
  hypothetical: NO
  anti-sense: NO
aaagaagaaaaaatgacagcaattgattttacagcagaagtagaaaaacgcaaagaagacctcttggctgacttgtttagccttttggaaatcaattcagaacgtgatgacagcaaggctgatgcccagcatccatttgggcctggtccagtaaaagccttggagaaattccttgaaatcgcagaccgcgatggctacccaactaagaatgttgataactatgcaggacattttgagtttggtgatggagaagaagttctcggaatctttgcccatatggatgtggtgcctgctggtagcggttgggacacagacccttacacaccaactatcaaagatggtcgcctttatgcgcgcggggcttcggacgataagggtcctacaacagcttgttactatggtttgaaaatcatcaaagaattgggtcttccaacttctaagaaagttcgcttcatcgttggaacagacgaagaatcaggctgggcagacatggactactactttgagcacgtaggacttgccaaaccagatttcggtttctcaccagatgctgaatttccaatcatcaatggtgaaaaaggaaatatcacggaatacctccactttgcaggagaaaatacaggtgttgcccgtcttcacagctttacaggtggtttacgtgaaaatatggtaccagaatcagcaacagcagtcgtttcaggtgacttggctgacttgcaagctaaactagatgcctttgttgcagaacacaaacttagaggagaactccaagaagaagctggcaaatacaaggtgacgatcattggtaaatcagcccacggtgctatgcctgcttcaggtgtcaatggcgcaacttaccttgccctcttcctcagccagtttggctttgctggtccagccaaagactaccttgacatcgcaggtaaaattctcttgaacgatcatgagggtgaaaatcttaagattgctcatgtggatgaaaagatgggtgctctttctatgaatgccggcgtcttccacttcgatgaaacaagtgctgataataccattgccctcaacatccgctatccaaaaggaacaagtccagaacaaatcaagtcaatccttgaaaacttgccagttgtttctgttagcctgtctgaacacggtcacacgcctcactatgtgccaatggaagatccacttgtgcaaaccttgttgaatatctatgaaaaacaaactggctttaaaggtcatgaacaagtcatcggtggtggaacctttggtcgcttgctagaacgcggagttgcctacggtgctatgttcccagactcgattgataccatgcaccaagccaatgaatttatcgccttggatgatcttttccgagcagcagcaatttatgccgaagctatttacgaattgatcaaataa

SEQ ID NO: 1014 - DNA (genomic), 408 bp, Streptococcus pneumoniae; double-stranded, circular
  misc_feature (B) LOCATION 1...408
  hypothetical: NO
  anti-sense: NO
gaggaagaaaatatgtataataaagttatcatgattgggcgtttaacgtctacaccagaattgcacaaaaccaacaatgacaagtcagtagcgcgagcaactatcgctgtcaaccgtcgttacaaagaccaaaacggtgaacgtgaagctgattttgtcaatatggttctatggggcagactagcagaaactttggcaacgtacgcaaccaaaggtagtctcatttccgttgatggagaattgcgtacccgtcgctttgagaaaaatggtcagatgaattatgtaaccgaagtccttgtgacaggattccaactcttggaaagtcgtgcccaacgtgctatgcgtgaaaataatgcaggccaagatttggcagatttggtcttggaagaggaagaattgccattttaa

SEQ ID NO: 1015 - DNA (genomic), 339 bp, Streptococcus pneumoniae; double-stranded, circular
  misc_feature (B) LOCATION 1...339
  hypothetical: NO
  anti-sense: NO
cttagagaaaataggaggactaatcgaatggaattaaaagattttacagaaaaagaacaggaaatgattaagaaaaggcttacaatgtctaatattagtgacaaagaaactactgagaagattctggcgctagtaccacaagacttgattaagcgaatcccgttttttgtcagaaaacatgctacaacacgtacgattaaacgcatttcaattgaacaccctgaactctacgctgtagctcaaacaagtggtgagattccagaaaaagaatgcgaagaattgcgtcagattatcacaactatctttgaacaaaagatgaataagcatagtattaagtag

SEQ ID NO: 1016 - DNA (genomic), 1257 bp, Streptococcus pneumoniae; double-stranded, circular
  misc_feature (B) LOCATION 1...1257
  hypothetical: NO
  anti-sense: NO
aaaagagaaaacaggatggttttaccaaattttaaagaaaatctagaaaaatatgcgaaattgttggttgcgaacggaattaacgtgcaacctggtcacactttggctctctctattgatgtggagcaacgtgaattggcacatctaatcgtgaaagaagcttatgccttgggtgcgcatgaggtcatcgttcagtggacagatgatgtgattaaccgtgagaaattcctccatgccccgatggagcgtttggacaatgtgccagaatacaagattgctgagatgaactatctcttggagaacaaggctagccgtcttggagttcgttcatctgatccaggtgccttgaacggagtggacgctgacaagctttcagcttctgctaaagctatgggacttgccatgaagccaatgcgaatcgcaactcaatctaacaaagttagctggactgtagcagctgcagcaggacttgagtgggctaagaaagtcttcccaaatgctgcgagcgacgaagaagcagttgatttcctttgggaccaaattttcaaaacttgccgtgtctacgaagcagatcctgttaaggcttgggaggaacatgcagccattctcaagagcaaggccgatatgcttaataaggagcaattttcagcccttcactacacagcgccaggaacagatttaacacttggtttgccaaagaaccacgtttgggaatcagctggtgctgtcaatgcacagggcgaagaattcttgccaaatatgccgacagaagaggtcttcacagcgcctgacttccgtcgtgcagatggttatgtcacttctacaaaaccgcttagctacaacggaaatatcattgaaggcattaaggtgacctttaaggatggacaaatcgtagatatcactgctgagaagggtgatcaggttatgaaagaccttgtctttgaaaatgcgggtgcgcgtgccttgggtgaatgtgccttggtaccagatccaagtccaatttctcagtcaggcattaccttctttaacacccttttcgatgaaaatgcgtcaaaccacttggctatcggtgcagcctatgcgactagcgttgttgatggagcggagatgagcgaagaggagcttgaagctgcagggcttaaccgttcagatgttcacgtagactttatgattggttctaaccaaatggatatcgatggtattcgtgaggatggaacgcgagtacctcttttccgtaatgggaattgggcaaattaa

SEQ ID NO: 1017 - DNA (genomic), 687 bp, Streptococcus pneumoniae; double-stranded, circular
  misc_feature (B) LOCATION 1...687
  hypothetical: NO
  anti-sense: NO
gatggagaaaagaagtctagtagagttattgaaagggggcatcttatgattgagttgaaaaatattaccaaaaccattgggggaaaagtgattttggataacttatctctcaggattgatcagggggatttggtagctattgttggtaagagtggtagtgggaagtcgaccttgttaaatttattgggtttgatagatggtgattatagcggacggtatgagatttttggtcagacaaatctagcggttaattctgctaagtcgcaaacaataatccgtgaacatatctcttatctgtttcaaaattttgccctgattgatgatgaaacggtcgagtacaatctcatgctggcgctgaaatatgtgaaattgcctaagaaagacaagctcaaaaaggtggaagagattttagagagagtaggtttgtcagctactttgcatcaaagggtctccgagttgtctgggggcgaacaacaacgaattgcagttgctagagccatcttaaaacccagccagctgattttagccgatgaacctacaggttcgctggatcctgaaaatagagatttggtcttgaagtttctcttagagatgaatcgagaagggaaaacagtcattattgtgacccacgatgcttatgtagcccaacaatgtcatcgtgtcattgaattgggcgagggaaaatga

SEQ ID NO: 1018 - DNA (genomic), 1839 bp, Streptococcus pneumoniae; double-stranded, circular
  misc_feature (B) LOCATION 1...1839
  hypothetical: NO
  anti-sense: NO
caaggagaaaaacacatgtctaaaattatcggtattgacttaggtacaacaaactcagcagttgcagttcttgaaggaactgaaagcaaaatcatcgcaaacccagaaggaaaccgcacaactccatctgtagtctcattcaaaaacggagaaatcatcgttggtgatgctgcaaaacgtcaagcagttacaaacccagatacagttatctctatcaaatctaagatgggaacttctgaaaaagtttctgcaaatggaaaagaatacactccacaagaaatctcagctatgatccttcaatacttgaaaggctacgctgaagactaccttggtgagaaagtaaccaaagctgttatcacagttccggcttacttcaacgacgctcaacgtcaagcaacaaaagacgctggtaaaattgctggtcttgaagtagaacgtattgttaacgaaccaactgcagcagctcttgcttatggtttggacaagactgacaaagaagaaaaaatcttggtatttgaccttggtggtggtacattcgacgtctctatccttgaattgggtgacggtgtcttcgacgtattgtcaactgcaggggacaacaaacttggtggtgacgactttgaccaaaaaatcattgaccacttggtagcagaattcaagaaagaaaacggtatcgacttgtctactgacaagatggcaatgcaacgtttgaaagatgcggctgaaaaagcgaagaaagacctttctggtgtaacttcaacacaaatcagcttgccatttatcactgcaggtgaggctggacctcttcacttggaaatgactttaactcgtgcgaaatttgatgatttgactcgtgaccttgttgaacgtacaaaagttccagttcgtcaagccctttcagatgcaggtttgagcttgtcagaaatcgacgaagttatccttgttggtggttcaactcgtatccctgccgttgttgaagctgttaaagctgaaactggtaaagaaccaaacaaatcagtaaaccctgatgaagtagttgctatgggtgcggctatccaaggtggtgtgattactggtgatgtcaaggatgttgtccttcttgatgtaacgccattgtcacttggtatcgaaacaatgggtggagtatttacaaaacttatcgatcgcaacactacaatcccaacatctaaatcacaagtcttctcaacagcagcagacaaccaaccagccgttgatatccacgttcttcaaggtgaacgcccaatggcagcagataacaagactcttggacgcttccaattgactgatatcccagctgcacctcgtggaattcctcaaatcgaagtaacatttgacatcgacaagaacggtatcgtgtctgttaaggccaaagaccttggaactcaaaaagaacaaactattgtcatccaatcgaactcaggtttgactgacgaagaaatcgaccgcatgatgaaagatgcagaagcaaacgctgaatccgataagaaacgtaaagaagaagtagaccttcgtaatgaagtggaccaagcaatctttgcgactgaaaagacaatcaaggaaactgaaggtaaaggcttcgacgcagaacgtgacgctgcccaagctgcccttgatgaccttaagaaagctcaagaagacaacaacttggacgacatgaaagcaaaacttgaagcattgaacgaaaaagctcaaggacttgctgttaaactctacgaacaagccgcagcagcgcaacaagctcaagaaggagcagaaggcgcacaagcaacaggaaacgcaggcgatgacgtcgtagacggagagtttacggaaaagtaa

SEQ ID NO: 1019 - DNA (genomic), 588 bp, Streptococcus pneumoniae; double-stranded, circular
  misc_feature (B) LOCATION 1...588
  hypothetical: NO
  anti-sense: NO
aaaggagaaaagttcatgaacaaattaatgaaatttatttcggtttttttgacgtcaattgtgttaattgtatcagcgattccaagtgtttcagctgtatacgcttctgaacaagtatcacaaattgaaacaaatatggaacttcaacctgtcacttctctaacagaagaacaaatcaatacacttgcaaacgaaatccaatcttttcatccagacgtctcacaacaatggatcaaagaagtaattaaccgacaattacaaggcgattatacaatcccacctacatactctccatttagagcagcttggcaaggtattacagttaatcaaatgggtgctctattagatactgcaatagctttagcattaggaggaactactgcaggccttgcaaatctaattaaagtaaaaggaaaacatgcagcaaaaagtgctattcgttcagcaatttctagatatctaggtagttggtttgtaaatgatgttgctttagaattcgctatgaatttattatcaccggggacttatttagcacaattatgggataaaaatgatgccattcctaacaacagaaggattaacttttaa

SEQ ID NO: 1020 - DNA (genomic), 264 bp, Streptococcus pneumoniae; double-stranded, circular
  misc_feature (B) LOCATION 1...264
  hypothetical: NO
  anti-sense: NO
agcttggaaaaaagaaatggaaacaagcaagaaaatgaggtcagcaggatgaacctactatcaagaatcaaaaactatttttcggaagaggtcaaagaaactaatctcgactggaaagaggtcgctttagacctcaatcaatcactaattgaaacacaggaaaaacttcaagaagcgaatcaagaaatcgcagacttgaagaaaatcgtagcaatctataaagaaaaggagaaagaaaaacgatggaatatatttacctggtaa

SEQ ID NO: 1021 - DNA (genomic), 306 bp, Streptococcus pneumoniae; double-stranded, circular
  misc_feature (B) LOCATION 1...306
  hypothetical: NO
  anti-sense: NO
gaaatggaaaaattaaacgcattaaggaaacaaaaaattagggcagtgattttactggaagcagtagtcgctctagctatctttgccagcattgcgaccctccttttgggacaaattcaaaaaaataggcaagaggaagcaaaaatcttgcaaaaggaagaagtcttgagggtagctaagatggccttgcagacggggcaaaatcaggtaagcatcaacggagttgagattcaggtattttctagtgaaaaaggattggaggtctaccatggttcagaacagttgttggcaatcaaagagccataa

SEQ ID NO: 1022 - DNA (genomic), 357 bp, Streptococcus pneumoniae; double-stranded, circular
  misc_feature (B) LOCATION 1...357
  hypothetical: NO
  anti-sense: NO
atgaaggaaaaagaatttcgccgaaatatggctgtttttcctatcggcagtgttatgaagttgaccgatctatcggcgcgtcagattcgttattatgaagatcaagagttgatcaagcccgatcgaaacgaaggaaatcgtcgcatgtattccttgaatgacatggatcgtctgcttgaaatcaaagattatatctctgaaggttataatatcgctgccattaagaaaaaatatgctgaacgtgaagcgaaatccaagaaagcggttagtcagactgaagtacgtcgtgcacttcacaatgaactcctccaacaggggcgttttgcttcagtacagtcaccttttggtcgcggttag

SEQ ID NO: 1023 - DNA (genomic), 2229 bp, Streptococcus pneumoniae; double-stranded, circular
  misc_feature (B) LOCATION 1...2229
  hypothetical: NO
  anti-sense: NO
aaggaggaaaacaaattgaaaatttttaagggagagttttatcgaatctctgtattaacagacaagctagtaaggttagaatactctcaaactggaagttttgaggatagaacgacacaacttatctataatagagattttggccaagtttcgttagattatatcgagacatcaaacgtactagatattatgacggactattttcatctgcactttaataaaggagaatttaacgccgaaaatttatttatagaattaaaaggaaattttgccgtatatggtagtcgctggtattttggtgaatctattgaaacgttaaaaggaacagctcggactctggataaggcagatggagcaatctcgttagaagatggaattattagccgaaatggtatagccttattggatgattctcaaggatttatttgggatgaacaatctggttatattgagagagaaaatcaaattgacctgtatttctttgcctatgggcatgattatagaggagcaatcagagatttttaccatttgactggttcaacacccttgttgccaagatatgctttaggcaattggtggagtagatattggccttatacgtcggatgaatacttggatttaatagacagatttgaaacagagaaaattccattatctatcggtgtgttagatatggattggcatataactgacattccagctcgctttggaagtggctggacaggatatagttggaatagaaacttaataccaaatccagaacagttattgcaacaacttcatgatagaaagctaaagctctccttaaatgtccatcctgctgatgggatacgggcttatgaagaagcttatcctcaaatcgcaaaacggttggggttaaatgtagaactagaagaacctgctatttttgatttttttaatccctcttttagggaagcctactttaaagatgttcattatgaactagaaaagcagggagtagatttttggtggattgactggcaacaagggacacaaggtatgctagatccactttggcttttaaaccattatcactatcaggatagttgtaaaaatgcagaaggtggtttgattttatcaagatatgcaggtcctggtagtcaccgctaccctgttggtttttcaggggacactattattagttggaattccttaagatttcaaccctattttacagcgacagcatctaatatcggttatagttggtggagtcatgatatcggtggacatatgttgggggattatgacgaagagctacaaactagatggctacagtttggtgtttttagtccgattactcgattacatagttctagaagtccttttaatagtaaagaaccttggttcttttcagaaacaacatctaagattatgaagaaataccttcgtttgagacatcagatgattccctatctatataccatgaatgtaaagacacatgaggaaggtgccccattaatcagtccaatctattatttctatccagagaatgatgagagctataatgttccaaaccaatacttttttggaacagaactgatggtggctcccattgtagaaaagatggatttgacattccaatctgcaaaagtagatgtatggttccctgaaggtgaatggtatgacttcttttcagagaaaaaatacacaggtggtgtgaagttaagtgtttatagggacatctcgactacgcctgtgtttgcaaaaagtggtgcaatcattcccttggttggttctgagataggtatgggtgttgatttacctgaagttgtagattggtatgtattcccaggaaaacaacattcttttgaaatgcttgaagatcaaaatggtcaaagatataaaacaagattatcaatcgattgggaaatgggaatggtagagttagcattacaaggagattctagtatcgttccaagcaatagaaaacatagaattcattttaaaggaacgaatgtgtctataattgaattgccaaataagaatgatacagctaaatttgaatggaaagataataaaaggacatctttaaatgacgaagtttttagactactaaagacagcttctcttccatatgaattaaaagatagattgttaaatcaattcatcaatgcgaaaaactctcatgacttaatgaatatcttgcatcatcaggataaggaattgagagggcgtttgttggaaatgatatttactagccaaaactaa

SEQ ID NO: 1024 - DNA (genomic), 285 bp, Streptococcus pneumoniae; double-stranded, circular
  misc_feature (B) LOCATION 1...285
  hypothetical: NO
  anti-sense: NO
ctttgggaaaactcttataaggaaattgttggtgaaattgatgatgaaacggacaaagcagcaatagatgttcatcagattggcgaagatacctacattgttcaaagaactatgaccctcaatgatttcaataattactttgatgttgaactgganagtgatgacgttgataccatcgctggttattatttgacaggagtgggaactattccaacgactgagaaactcagctatgaattggttagccaaaacaaacagtttatcttaaccaatgataaagtatag

SEQ ID NO: 1025 - DNA (genomic), 249 bp, Streptococcus pneumoniae; double-stranded, circular
  misc_feature (B) LOCATION 1...249
  hypothetical: NO
  anti-sense: NO
aancaacccctatataatacatttcttggagaaaaattaactgggtttggttttatccctgacggcctgagtgtcaagaggacacgaaatgtctttacagtggacaccaatttgaatctccgagtttttaggagtgattttccgaattactggtgccttattggagcactatcatctatttggtggtgtgagggagatatctcttttttcctccgcccaatcggggtgatatttattttcttcctaccc

SEQ ID NO: 1026 - DNA (genomic), 231 bp, Streptococcus pneumoniae; double-stranded, circular
  misc_feature (B) LOCATION 1...231
  hypothetical: NO
  anti-sense: NO
atggtacgaaataaaataggtgatttaactaacacgctcttcgctcaattagagactctggatgatagggatcttacagcagatgaattaaaagtagaattacagcgctcgaaacaaatggtcgcaatctcaggtcaaatcttacaagcaggtcaattggcgctagatgctgaaaaattcaaagacaaggtaggtgaagtcaatgccccgatcgctttgctggaaggatga

SEQ ID NO: 1027 - DNA (genomic), 1443 bp, Streptococcus pneumoniae; double-stranded, circular
  misc_feature (B) LOCATION 1...1443
  hypothetical: NO
  anti-sense: NO
attattagaaatgaagaaagaaaggatactatggctgaagaaagagtagaaccaaaaccaattgaccttggtgaatataaatttggtttccatgacgatgtagagcctgtcttatcgacaggaaaaggactcaacgaaggtgttattcgtgaattatctgctgctaagggtgagcctgagtggatgttggagttccgtttgaagtcttatgaaaccttcaaaaaaatgcccatgcaaacttggggagcagacttgtcagagattgactttgatgacttaatctactaccaaaaaccatctgacaaaccagcccgttcttgggatgatgtacctgaaaagattaaagaaacctttgaacgtatcgggattccagaagctgaacgtgcttatttagcaggggcttctgcccagtacgagtcagaagtggtttaccacaacatgaaggaagagttccaaaaattaggtattatctttacagatacagattccgcactcaaggaatacccagacttatttaaacaatactttgcgaagttggtaccgccgacagataacaagttggcagccctcaactcagcagtatggtcgggtggaacttttatctacgtgccaaaaggtgtcaaggtagatattccacttcaaacttatttccgtatcaataacgaaaatataggtcagttcgaacgtaccttgattatcgttgatgagggagcaagcgtccactacgtagaaggatgtacagcaccaacatattcaagcaatagcttacacgctgccattgtagaaatttttgctttggacggagcttatatgcgttatacaactatccaaaactggtctgataacgtctataacttggtaacaaagcgtgctaaggctcaaaaggatgccactgttgagtggattgatggaaacttgggtgccaaaacgactatgaaatatccatctgtttaccttgatggagaaggagcgcgtggtaccatgctctctatcgcctttgctaatgcagggcaacaccaagacacgggtgctaagatgattcacaatgctccacataccagctcgtctattgtgtctaaatccatcgctaaaggtggaggaaaggttgactaccgtggacaagtcacctttaacaagaactctaagaaatctgtttcccacattgaatgtgataccattatcatggatgacttgtcagcatcagatactattccatttaatgaaattcacaactcgcaagtggctttggaacacgaagccaaagtatctaagatttcagaagagcaattgtattatctcatgagccgtggattgtcagaatctgaggcaactgaaatgattgtcatgggatttgtagaaccctttacaaaagaacttccaatggaatacgcagttgagctgaaccgcttgattagctatgaaatggagggatcagttggataa

SEQ ID NO: 1028 - DNA (genomic), 948 bp, Streptococcus pneumoniae; double-stranded, circular
  misc_feature (B) LOCATION 1...948
  hypothetical: NO
  anti-sense: NO
ttaattagaaagtatcgaatggatattcaatttttaggaacgggggctggtcagccctctaaagcccgcaacgtttcaagtctcgccctgaaacttttggatgagattaacgaagtttggctctttgactgtggagaaggtacgcaaaatcgcattctggaaaccacaattcgaccacgtaaggtcagcaaaatctttattacccatctgcatggagaccacatttttggtttgccaggtttcctttctagccgtgcctttcaggccaatgaagagcagacagatttggaaatctacggacctcaaggaatcaagtcatttgtcttaaccagccttcgtgtgtcaggttctcgtctgccctaccgcattcatttccatgagtttgaccaagattctctaggtaaaattcttgaaatcgataaattcactgtgtatgcagaggagctggaccacactattttctgtgttggctatcgtgtcatgcaaaaggatctagaagggacgctggatgctgaaaaactcaaggctgctggtgttccgttcggcccgctttttggtaaaatcaaaaatggccaggatcttgttttggaagacggaactgaaatcaaggcagcagactatatctcagcgccacgtccaggtaagattatcactattttaggagacactcgaaaaacggatgccagtgtgcgtctggctgtcaatgcagatgtcctagttcatgagtccacttatggcaagggtgatgaaaaaattgctcgtaaccatggtcactcaactaatatgcaagctgcacaagtagcggtagaagcaggtgccaaacgcctcctactcaaccatatcagtgcccgtttcctctcaaaagatattagcaaactcaagaaagacgctgccacaatttttgaaaatgtccatgtggtcaaagacttggaagaagtggaaatctag

SEQ ID NO: 1029 - DNA (genomic), 789 bp, Streptococcus pneumoniae; double-stranded, circular
  misc_feature (B) LOCATION 1...789
  hypothetical: NO
  anti-sense: NO
ccaactagaaacaccgcgagaggtcaaagggtcttgtatgaattgcgagatcgtttgaagagaaatcagtttatactcaatgataccaatccggatattgtcatttccattggcggggatggtatgctcttgtcggcctttcataagtacgaaaatcagcttgacaaggtccgctttatcggtcttcatactggacatttgggcttctatacagattatcgtgattttgagttggacaagctagtgactaatttgcagctagatactggggcaagggtttcttaccctgttctgaatgtgaaggtctttcttgaaaatggtgaagttaagattttcagagcactcaacgaagccagcatccgcaggtctgatcgaaccatggtggcagatattgtaataaatggtgttccctttgaacgttttcgtggagacgggctaacagtttcgacaccgactggtagtactgcctataacaagtctcttggcggtgctgttttacaccctaccattgaagctttgcaattaacggaaattgccagccttaataatcgtgtctatcgaacactgggctcttccattattgtgcctaagaaggataagattgaacttattccaacaagaaacgattatcatactatttcggttgacaatagcgtttattctttccgtaatattgagcgtattgagtatcaaatcgaccatcataagattcactttgtcgcgactcctagccataccagtttctggaaccgtgttaaggatgcctttatcggtgaggtggatgaatga

SEQ ID NO: 1030 - DNA (genomic), 591 bp, Streptococcus pneumoniae; double-stranded, circular
  misc_feature (B) LOCATION 1...591
  hypothetical: NO
  anti-sense: NO
ttttatagaaaattggaggaacctgttatgacaaacacacgtcgactttcgaccattgcaattttatcagccatctcatttgtgctgatgtactttgactttccgcttttaccagcggcatctttcctcaagatcgaatttagtatcttgccagtccttgtgggtctggtggtcatggatttgcctgctgctctaggagtgctcttgcttcgctcactattgaaattgcttcttaacagccaaggagtgaatacttacattggtttgccgatgaatatcgtagctttgggagtttttgtcatcgtatttgctttgatttggaaaaaggaacggacaacccttcgtttcctactaggctctctagctggaactgttggtttaaccttggccatgttggttctcaactatgtttatgctgttcctttgtacgctaagtttgctaactttgatattggaaaaattttgggactttccaactacctaatgaccatggtattaccttttaacttgattgagggtgtaatcttttccgtttcattctggttgttgtacgtccttttgaaaccaaccttaaaacactatgaaagataa

SEQ ID NO: 1031 - DNA (genomic), 1383 bp, Streptococcus pneumoniae; double-stranded, circular
  misc_feature (B) LOCATION 1...1383
  hypothetical: NO
  anti-sense: NO
agatatagaaagaggtttgtcatcgcaaagaaaaaagcgacatttgtatgtcaaaattgtgggtataattcccctaaatatctgggacgttgccccaactgtgggtcttggtcttcttttgtggaagaggttgaggttgccgaggtcaagaatgcgcgtgtgtccttgacaggtgagaaaaccaagcccatgaaactagctgaggtgacttccatcaatgtcaatcgaaccaagacggagatggaggaattcaaccgtgtgcttggaggcggagtggtaccaggaagtctcgtcctcatcggtggggatcctgggattgggaaatcaactcttctcctacaagtctcaacccagttgtcccaagtggggacagttctctatgtcagtggggaggagtctgcccagcagattaaactacgtgcagagcgcttaggtgatattgatagtgagttttatctctatgcagagaccaatatgcagagtgttcgtgcagaagtggagcgtatccagccagactttctcattattgattccatccagaccatcatgtctcctgagatttcaggggtgcaggggtctgtttctcaggtacgtgaagtgaccgctgaactcatgcagttggccaagaccaataacattgccatctttatcgtaggtcatgtgaccaaagaaggaaccttggctgggcctcgtatgttggagcatatggtggatacggtgctttactttgaaggggagcgtcaccacacctttcgtattttgagagcggtcaaaaatcgttttggttccactaatgagattgggatttttgagatgcagtcgggcggcttggttgaggtactcaatccgagtcaagttttcctagaagagcgtttggatggggcgactggttcctccatcgttgtaaccatggaagggacgcgtccgattttggcggaggttcaggctttggtaacaccgaccatgtttggaaatgccaagcgtactacgacaggacttgattttaaccgtgctagcttgattatggctgttttggaaaaacgggcagggcttctcttgcaaaatcaggatgcctatctcaaatctgctggtggtgttaaattggatgaacctgccattgacttggctgttgcagttgctattgcttcgagctacaaagacaagccaactaatcctcaggaatgttttgtcggagaactgggcttgacaggagagattcggcgcgtgaatcgtattgagcaacgcatcaacgaagctgctaaactgggctttactaagatttatgtacctcagaattccttgacaggaatcactctgcctaaggaaattcaggtcattggcgtgacaacgattcaggaagtcttgaaaaaggtctttgcataa

SEQ ID NO: 1032 - DNA (genomic), 2331 bp, Streptococcus pneumoniae; double-stranded, circular
  misc_feature (B) LOCATION 1...2331
  hypothetical: NO
  anti-sense: NO
tataatagaaatattgacttcaagagtaaggaagagaagatgaacgcattattaaatggaatgaatgaccgtcaggctgaggcggtgcaaacgacagaaggtcccttgctaatcatggcaggggctggttctggaaagactcgtgttttaacccaccgtatcgcttatttgattgatgaaaagctggtcaatccttggaatatcttggccattacctttaccaacaaggctgcgcgtgagatgaaagagcgtgcttatagcctcaatccagctactcaggactgtctgattgcgaccttccactccatgtgtgtgcgtattttgcgtcgcgatgcggaccatattggctacaatcgtaattttacaattgtggatcctggtgaacagcgaacgctcatgaaacgtattctcaaacagttgaacttggatcctaaaaaatggaatgaacgaactattttggggaccatttccaatgctaagaataatttgattgatgatgttgcttatgctgcccaagctggcgatatgtatacgcaaattgtggtccagtgttatacagcctatcaaaaagaacttcgtcagtctgaatccgttgactttgatgatttgattatgctgaccttgcgtctctttgatcaaaatcctgatgttttgacctactaccagcaaaaattccaatacatccacgttgatgagtaccaagataccaaccacgctcagtaccaattggtcaaactcttggcttcccgttttaaaaatatctgtgtggttggggatgcggaccagtctatctacggttggcgtggtgctgatatgcagaatatcttggactttgaaaaggattaccccaaagccaaggttgtcttgctggaggaaaattaccgctcaaccaaaaccattctccaagcggccaacgaggttattaaaaataataaaaatcgccgtcctaaaaatctctggactcaaaacgctgatggggagcaaatcgtttactatcgtgccgatgatgagctggatgaggctgtatttgtagccagaaccatcgatgaacttagtcgcagtcaaaacttccttcataaggattttgcagttctctatcggactaatgcccagtcccgtacaattgaggaagccctgctcaagtctaacattccttataccatggttggcggaaccaaattctacagccgtaaggaaattcgcgatattattgcttatctcaaccttattgctaatttgagtgacaatattagttttgagcgtattatcaacgagcctaaacgtggaattggtccaggtacagttgagaaaatccgtgattttgcaaatttgcaaaatatgtctatgctggatgcttctgctaatattatgttgtctggtatcaagggtaaggcagcccaatctatctgggattttgccaatatgatgcttgatttgcgggagcagctagaccacttaagcattacagagttggttgagtccgtcctagaaaaaacaggttatgtcgatattcttaacgcccaagcgactctagaaagcaaggcacgggttgaaaatatcgaagagtttctttctgttacgaagaactttgatgacaccacggatgtgacagaagaggaaactggtctggacaaactgagtcgtttcttaaatgacttggctttgattgccgacacagattcaggtagtcaggagacatcagaagtgaccttgatgaccctgcatgctgccaaaggtctcgaatttccagttgtctttttgattgggatggaagaaaatgtctttccacttagtcgtgcgactgaagatccagatgaattagaagaagagcgccgtctagcctatgtaggtatcacgcgtgcagagaaaattctctatctgaccaatgccaactcacgcttgctttttggtcgtaccaattataaccgtccgactcgttttattaacgaaatcagttcagacttgcttgagtatcaaggtctggctcgtcctgcaaatacaagctttaaggcatcatatagcagtggtagtatttcctttggtcaaggtatgagtttggctcaggctcttcaagaccgtaaacgcggtgctgccccaaaatcaatccagtcaagcggtcttccatttggtcaatttacagctggcgcaaaaccagcatctagcgaggcaaattggtccattggtgatattgctctccacaagaaatggggagagggaaccgttctggaagtttcaggtagcggtgctaggcaggaattgaaaatcaatttcccagaagtaggtttgaaaaaacttttagccagtgtggctccaattgagaaaaaaatctaa

SEQ ID NO: 1033 - DNA (genomic), 1356 bp, Streptococcus pneumoniae; double-stranded, circular
  misc_feature (B) LOCATION 1...1356
  hypothetical: NO
  anti-sense: NO
tataatagaaacatgaacttaaaaactactttgggccttcttgctggacgttcttcccacttcgttttaagccgtcttggacgtggaagtacgctcccagggaaagtcgcccttcaatttgataaagatattttacaaaacctagctaagaactacgagattgtcgttgtcactggaacaaatggaaaaaccctgacaactgccctcactgtcggcattttaaaagaggtctatggtcaagttctaaccaatccaagcggtgccaacatgattacagggattgcaacaaccttcctaacagccaaatcttctaaaactgggaaaaatattgccgtcctcgaaattgacgaagccagtctatctcgtatctgtgactatatccagcctagtctttttgtcattactaatatcttccgtgaccagatggaccgtttcggtgaaatctatactacctataacatgatattggatgccattcggaaagttccaactgctactgttctccttaacggagacagtccacttttctacaagccaactattccaaaccctatagagtattttggttttgacttggaaaaaggaccagcccaactggctcactacaataccgaagggattctctgtcctgactgccaaggcatcctcaaatatgagcataatacctatgcaaacttgggtgcctatatctgtgagggttgtggatgtaaacgtcctgatctcgactatcgtttgacaaaactggttgagttgaccaacaatcgctctcgctttgtcatagacggccaagaatacggtatccaaatcggcgggctctataatatctataacgccctagctgctgtggccatcgcccgtttcctcggcgcagattcccaactcatcaaacagggatttgacaagagccgtgctgtctttggacgccaagaaacctttcatatcggtgacaaggaatgtacccttgtcttgattaaaaatccagtcggtgcaacccaagctatcgaaatgatcaaactagcaccttatccatttagcctatctgtcctccttaatgccaactatgcagatggaattgacactagctggatctgggatgcagactttgagcaaatcactgacatggacattcctgaaatcaacgctggcggtgttcgtcattctgaaatcgctcgtcgcctccgagtgactggctatccagctgagaaaatcactgaaacgagtaatctggagcaagttctcaagaccattgagaatcaagactgcaagcatgcctatattctggcaacttatactgccatgctggaatttcgtgaactgctggctagtcgtcagattgttagaaaggagatgaactaa

SEQ ID NO: 1034 - DNA (genomic), 702 bp, Streptococcus pneumoniae; double-stranded, circular
  misc_feature (B) LOCATION 1...702
  hypothetical: NO
  anti-sense: NO
aattgtagaaatcatctcctaaatggagggaaaaccgaaatgaaattaaataaatatatagatcatacgctaggcaaacaagatgcacagaaaaaacaaattgatagtttgttgtctgaggctagagaatatgactttgccagtgtttgcgttaatccgacctgggttgaacatgctaaaaaaggacttgaaggcacagatgttaaggtttgcacagtagtaggtttccctttgggagcaacaacttcagccgtgaaagcatttgagacaaaagaagctatccaaaatggtgcagatgagattgatatggtgatcaatgttggagctctcaaatcaggtaatttagccttggttgagtcagatattcgcgcagtagtggaagcaagtggtgataagttagtgaaagtcattattgaagcttgccttctgacagaccaagaaaaaattgttgtttgccaattggcccaaaaagctggggctgactttgttaaaacatctactggcttttcaactggtggtgctacgatagcagatgttagattaatgcgtgaaacagttggatctgatatgggagtcaaggctgctggtggagctcgttcttatgcagatgctcttgcctttgtcgaagcaggtgcgacccgtatcggaacgtcagctggggtagctattttaaaaggagaattggcagatggcgactactga

SEQ ID NO: 1035 - DNA (genomic), 1029 bp, Streptococcus pneumoniae; double-stranded, circular
  misc_feature (B) LOCATION 1...1029
  hypothetical: NO
  anti-sense: NO
gttagtagaaatatggttaaaaaaattattggaatggtgctagctttactttctgtaactgtagtaggagtaggtgtttttgcttatactatttatcaacaagggacagaaaccttagctaaaacctataaaaaaatcggtgaagaaaccaaggttattgaagcgactgaacctctaaccattctgttaatgggagtggacaccggaaatgttgaacgaactgaaacttgggtcggtagaagtgatagcatgatcttgatgacagtgaatcctaaaacgaaaaaaacaacaatgatgagtttagagcgggatattctgacgcgcattgaatcagggaatggtcaggctcatgaagcgaaactgaactcagcatatgcagatggtggagcagagcttgctatagaaaccattcaaaaaatgatgaatatccatattgatcgctatgtgatggtcaatatgagagggttgcaaaaattagtggatgcagtaggaggtattacagtcaataatatcctaggtttcccaatttctatcagtgaccaagaagaatttaataccatttctatcggtgttggggagcaacatattgggggagaagaagccctagtctatgcacgaatgcgttaccaagatcctgagggggattatggtcgtcaaaaacgtcaacgtgaagttattcaaaaagtcatggaaaaagctctcagtttaaatagcgttggtcattatcaagagattctaaaagctttgagtgacaatatgcagaccaatattgatttgtctgcaaaaagtatccctaacttgctaggctataaagattcatttaaaaccattgaaactcagcagttgcagggtgaaggagagatacttcaaggtgtttcttaccagattgtttcgagagcacatatgttggaaatgcaaaatatactccgacgttctttgggacaagaagaagttactcagcttgaaaccaatgcggttttatttgaagatttatttggcagagcacctgttggtgatgaagataattaa

SEQ ID NO: 1036 - DNA (genomic), 738 bp, Streptococcus pneumoniae; double-stranded, circular
  misc_feature (B) LOCATION 1...738
  hypothetical: NO
  anti-sense: NO
attttcagaaaggaaaacctcaaattgttctacaaatttctactcttcgacctcgaccacactcttcttgattttgatgctgctgagaatgtggctttgacccaacttctaaaagaagaaggagttgcggatattcaggcttataaagattattacgttcctatgaacaaggctctctggaaagacttggagctgaagaaaatcagtaaacaagagctggttaacacgcgcttttctcgtttatttgctcattttggacaggaaaaagacggtagttttcttgcccagcgttaccaattttacctcgcccagcagggacaaacactatcgggcgctcatgatctcttggacagcctcattgagcgtgattataacttgtatgctgcgacaaatggcattactgccattcagacaggacgtttggctcaatctggtctagcaccttatttcaatcaagtctttatctcagaacagttgcaaactcaaaagccggatgctcttttttatgaaaagattggccagcaaattgctggatttagtaaagaaaagacgctgatgattggagattctctaaccgccgacattcaaggtggcaataatgcggggattgacactatctggtataatcctcatcacctcgaaaatcacacacaagcccagccgacttacgaagtctattcttaccaagacttgctggattgtttagataaaaatattcttgaaaagatcacattttaa

SEQ ID NO: 1037 - DNA (genomic), 660 bp, Streptococcus pneumoniae; double-stranded, circular
  misc_feature (B) LOCATION 1...660
  hypothetical: NO
  anti-sense: NO
tcagtcagaaacatccaacggaagtgcaagttcgactaccttataaggagagaaactaagatgaaagtattagtcgcagaagatcaaagtatgttgcgagatgccatgtgtcaattgctcacgcttcaaccagatgtggagtctgtccttcaagccaagaatgggcaagaagcaatccaactattagaaaaggagtctgtagatatcgccatccttgacgtagaaatgcctgttaagacaggtcttgaagtcttggagtggatacgatcagaaaagcttgaaacaaaggtggttgtggtgacgaccttcaagcgtgctgggtattttgaacgtgcggtcaaggctggagtggatgcttatgtattaaaggaacgaagcattgcagacctcatgcaaaccttgcacaccgtcctcgaaggacgcaaggagtattcgcctgaattgatggaaatggtgatgacccgtcccaatccgttgacagaacaagagattgctgtcttaaagggaatcgcccggggcttatccaaccaagaaatcgcagatcagctttacctctcaaacggaactattcgaaactatgtcaccaatattctttcaaaactggatgctggtaatcgaacagaggcagctaatatcgcaaaagaatctggttggttatga

SEQ ID NO: 1038 - DNA (genomic), 1296 bp, Streptococcus pneumoniae; double-stranded, circular
  misc_feature (B) LOCATION 1...1296
  hypothetical: NO
  anti-sense: NO
ggatccagaaacaataattttaaaaaggagaaaagacacatgcacatttttgatgagctaaaagatcgtggtttgatatttcaaacgactgatgaagaagctttgcgtaaagccctagaagaaggtcaagtttcttattatactggctacgatccaactgctgacagccttcacctaggccaccttgtcgcaatcttgacaagtcgtcgcttgcaactagcaggtcacaaaccttatgcgctcgttggcggtgctacaggtctcatcggagatccgtccttcaaagatgctgaacgtagtctccaaacaaaagacacagtagatggctgggtcaagtctatccaaggacaactttctcgttttcttgactttgaaaatggcgaaaacaaggctgtcatggtcaacaactacgactggtttggcagcatcagcttcattgacttcctccgtgatattggaaaatacttcacggtcaactacatgatgagtaaggaatctgttaaaaaacggatcgaaacaggaatttcttacactgagttcgcttaccaaatcatgcaagggtatgacttcttcgtccttaaccaagaccataatgtcactcttcaaatcggtggttctgaccagtggggaaatatgacagctggtaccgaattgcttcgtcgtaaggcggacaagactggtcacgttatcactgttccactaatcacagatgcaactggtaagaaatttggtaaatcagaaggaaatgccgtctggctcaatcccgaaaagacttctccatacgaaatgtaccaattctggatgaacgtgatggacgctgacgctgttcgcttcttgaaaatctttactttcttgtcacttgatgagattgaagatattcgtaaacaatttgaagcagcgccacacgaacgcttggctcaaaaagtcttggctcgtgaagttgttacacttgttcacggagaagaagcctacaaagaagcacttaacatcactgagcaactctttgcaggaaacatcaaaaacctttctgtcaaagagctcaaacaaggacttcgtggtgtgccaaactaccaagtacaggcagacgaaaacaacaatatcgtggaactgctcgtctcatctggtatagttaactcaaaacgccaagcccgtgaagacgtccaaaacggagccatctacgtaaacggcgaccgcatccaagagcttgactatgtcttgagtgacgctgataagttagagaatgaactgactgttatccgtcgtgggaagaaaaaatactttgtattgacttactaa

SEQ ID NO: 1039 - DNA (genomic), 264 bp, Streptococcus pneumoniae; double-stranded, circular
  misc_feature (B) LOCATION 1...264
  hypothetical: NO
  anti-sense: NO
ccttacagaaagcggcaacaaataatgaaaatgtctacttttttcaaaaaaagtttctggccaacctttatgattgttaaccaaactgttatactattccatctaaaggatggcttggatcgacaatacctaacaactgagtccatatattgggtgataggcacctttatatttggaaatattctagtagctgtgtttagtaatatgaaaatttgggataaaaagaaaaacggcagtaagaaaaaatatatcctgaaaaagtaa

SEQ ID NO: 1040 - DNA (genomic), 408 bp, Streptococcus pneumoniae; double-stranded, circular
  misc_feature (B) LOCATION 1...408
  hypothetical: NO
  anti-sense: NO
actttaagaaatcttctcactgataagattttagcattagacttcctgcgaaacaaaatatggtatagtagttctatgaattatgaagcaagtaaacaactaactgatgcacgatttaaatgtcttgttggtgttcagcgcaccacttttgaagagatattagctgtattaaaaactgcttatcaacttaaacacacaaaaggggggcgagaacctaaattaagcctagaagaccttcttatggccactcttcaatatgtgcgagaataccgcacttatgaacaaattgcggctgtttttggtatccacgaaagcaacttactccgtcggagccaatgggttgaagtaactcttgttcaaagtattttacaatttcaagaactcctctcagttctgaggacacggtaa

SEQ ID NO: 1041 - DNA (genomic), 912 bp, Streptococcus pneumoniae; double-stranded, circular
  misc_feature (B) LOCATION 1...912
  hypothetical: NO
  anti-sense: NO
tttctaagaaatcagtctttgcccagcaggttggactcaaggaagtcgcaaattactctgggtgagattttcaagcgtgttggagctgaagtggagattgatgagagctatacagcgccctttgtcatggcacatttcaagagttcgcgtccagatgccaagaccttgattttctataaccactatgacactgtgccagcggatggggatcaggtctggacagaggatccttttacgctttcggtccgcaatggcttcatgtatgggcgtggggttgatgacgacaagggtcatatcacagctcgcttgagtgctttgagaaaatatatgcagcaccatgatgatttacctgtcaatatcagctttatcatggagggagcggaggaatcggcttcaacagacctagataagtatttggaaaagcatgcagacaaactccatggggcggatttgttggtctgggaacaagggaccaaaaatgccttggaacaactggaaatttctggtggcaataaggggattgtgacctttgatgccaaggtaaaaagcgctgatgtggatatccactcgagttatggtggcgttgtggaatcagctccttggtatctcctccaagccttacagtctcttcgtgctgcggatggccgtatcttggttgaaggcttgtacgaagaagtacatgagcccaatgaacgagaaatggccttgctagaaacttatggtcaacgaaacccagaggaagttagtcggatttatggattggagttgcctctcttacaggaggagcggatggcctttctaaaacgtttctttttcgagccagcgcttaatatcgaaggaatccagtctggttatcaaggtcagggtgttaagactattgtgcctgcagaagccagtgccaagctagaggtt

SEQ ID NO: 1042 - DNA (genomic), 447 bp, Streptococcus pneumoniae; double-stranded, circular
  misc_feature (B) LOCATION 1...447
  hypothetical: NO
  anti-sense: NO
aataaaagaaagaagctgacaaaggagacgggtatggaacacacattctttatcatcaaaccagatggtgtaaaaagagggctagtgggtgaagtgttaaagcgcatcgaacaacgtggatttacaatcgaaaaattggagtttcgttcacaggtttcagaagagttgattgaccagcactatcaggacttggttggtcagagtttttacccaccgattcgtgaattcatgacttcaggtccagttcttgtgggtgtcatttctggtcccaaagtaatcgaaacttggcggaccatgatgggtgcaactcgtccagaagaagctttaccaggcactattcgaggtgattttgcaaaagctgctggagaaaatgagattatccaaaatgttgtacatggttcagattcagaagagtcagctaagcgagaaattgctctttggttttaa

SEQ ID NO: 1043 - DNA (genomic), 546 bp, Streptococcus pneumoniae; double-stranded, circular
  misc_feature (B) LOCATION 1...546
  hypothetical: NO
  anti-sense: NO
caaaaaagaaaacagtttacaaagaaaaatgatggaggagcaaacatggcacaaaaaggagtaagccttatcaaggcagcatttgatacagataactttctcatgcgttttagtgagaaagtcttggacatcgtgacagccaatcttctttttgtcgtctcttgtttgcccatcgtgacgattggagtggctaaaatcagcctctacgagaccatgttcgaagttaagaagagcagacgggtgcctgtttttaaaatctatctaagatctttcaagcaaaatctgaaactaggtcttcagctgggtttaatggagttaggaattgtgtttcttaccctttcagatctctatcttttctggggtcaaacagctctgcccttccaattgctgaaagccatttgtttaggtattctgatttttcttactatcgtgatgctggctagttaccctatcgcggcacgttatgacctatcttggaaagaaattcttcaaaaaggattgatgttggctagttttaactatcccgctcttcaccacgaatggaac

SEQ ID NO: 1044 - DNA (genomic), 456 bp, Streptococcus pneumoniae; double-stranded, circular
  misc_feature (B) LOCATION 1...456
  hypothetical: NO
  anti-sense: NO
aaaaaaagaaagatttggccagccaggttcttgataataatggcaatcagaaccagcttcttaatcaagtgcatatccttcttgagggaggtaggcaagatgacagagattaactggaaggataatctgcgtattgcctggtttggtaattttctgacaggagccagtatttctttggttgtaccttttatgcccatcttcgtggaaaatctatgtgtagggagtcagcaagtcgctttttatgcaggcttagcaatttctgtctctgctatttccgcggcgctcttttctcctatttggggtattcttgctgacaaatacggccgaaaacccatgatgattctgggcaggtcttgctatgactatcactatgggaggcttggcctttgtcccaaatatctattggttaatctttcttcgtttactaaacggtgtatttgcaggttttgttcctaa

SEQ ID NO: 1045 - DNA (genomic), 585 bp, Streptococcus pneumoniae; double-stranded, circular
  misc_feature (B) LOCATION 1...585
  hypothetical: NO
  anti-sense: NO
tatcgaagaaaaggaataagaaagaatatggctaacgtaattattgaaaaagctaaagagagaatgacccagtctcaccaatcacttgctcgtgaatttggtggtatccgtgctggtcgtgccaatgcaagcttgcttgaccgtgtacatgtagaatactatggagtcgaaactcctcttaaccaaatcgcttcaattacgattccagaagcgcgtgttttgttggtaacaccatttgacaagtcttcattgaaagacatcgaacgtgccttgaacgcttctgatcttggtatcacaccggctaatgacggttctgtgattcgcttggttatcccagctcttacagaagaaactcgtcgtgaccttgctaaagaagtgaagaaggtcggcgaaaatgctaaagtggctgtccgcaatatccgtcgcgatgctatggacgaagctaagaaacaagaaaaagcacaagaaatcactgaagacgaattgaagactcttgaaaaagatattcaaaaagtaacagacgatgctgttaaacacatcgacgacatgactgctaacaaagagaaagaacttttggaagtctaa

SEQ ID NO: 1046 - DNA (genomic), 357 bp, Streptococcus pneumoniae; double-stranded, circular
  misc_feature (B) LOCATION 1...357
  hypothetical: NO
  anti-sense: NO
ggaggaagaaagatgaaatcaaaagaagaaataaatatgcttggttttacaattgtcgcttacgcaggagatgcaaggtcagatttgatggatgctttggcgtttgcgagagatggatattttgaacaggcaagagaattggttgagtctgcaaacgactcaatagtgtctgcccatcgagaacagactaatttattagcggaggaggcatctggagataattttgaagtgagttttatcatgattcatggtcaagatactttgatgacaacgatgctattgtatgatcaggtcaagttttttattgatgaatatgaacgaattcgaaagattgaagaacatattggtttgcaatga

SEQ ID NO: 1047 - DNA (genomic), 849 bp, Streptococcus pneumoniae; double-stranded, circular
  misc_feature (B) LOCATION 1...849
  hypothetical: NO
  anti-sense: NO
aataagagaaagaactctatcaaggaggaaatcatggaaaaacaaaccgtcgccgtcttggggcctggttcttggggaaccgccctttcacaagtcttaaatgacaatggacacgaggtacgtatttggggaaatcttcccgagcaaatcaatgaaattaatacacaccatactaataagcactactttaaagatgtcgttctagacgaaaatatcattgcctacaccgacttagcagaaacattgaaagatgtggatgcgattttgtttgttgtcccaacaaaagtgacacgacttgttgcccaacaagttgcacaaaccttggaccataaggttatcatcatgcacgcatcaaagggattagaacctgatagccataaacgattatcaaccattcttgaagaagaaattcctgaacatctccgtagtgatatcgtcgttgtttcagggcctagtcatgcagaagagaccattgtgcgtgacctaactttaataactgctgcttctaaagatttacaaacagctcaatacgttcaggagctatttagtaatcactacttccgactttataccaatacggatgttatcggggttgaaactgctggtgctcttaaaaatattattgctgtcggtgctggagctttacatggtcttggatttggtgataatgctaaggcagccatcatcgctcgaggtttagcagaaatcacccgcctaggggtagcactcggggccagtccattgacctatagcggcttatctggtgtgggagatttgatcgtaacgggaacttccatccactctcgtaactggagagctggagatgctctcggacgaggagaatcctag

SEQ ID NO: 1048 - DNA (genomic), 273 bp, Streptococcus pneumoniae; double-stranded, circular
  misc_feature (B) LOCATION 1...273
  hypothetical: NO
  anti-sense: NO
gaaaagagaaaagagatgtattatacgcttgaagaaaaagaagtctttatgagggaggctttgagagaggctgagattgctcttgaacacgatgaaattccaattggttgtgtgattgtcaaagatggggaaatcattggtcgtgggcataatgcgcgtgaggaattacagcgagcggttatgcatgcggaaattatggctatagaggatgcgaacttgagtgaggagagctggcgcttgctggattgcacactttttgtgaccgtccaacac

SEQ ID NO: 1049 - DNA (genomic), 267 bp, Streptococcus pneumoniae; double-stranded, circular
  misc_feature (B) LOCATION 1...267
  hypothetical: NO
  anti-sense: NO
aaagagagaaagatggtctatttagtcctaggaattttactgctcctactctatgtatttgcgacaccagaaagcattaaagggacagtcaatatcgtcgctatggtatgtattttagtggcactcttgattttattggttctatcttttctgaaaatttttcaattaccaacagaaatattcctagcaatagccatgttgatcctagcttactttagtgttagagacattacactcatgccagtcaaaaaaagtaaaagaagataa

SEQ ID NO: 1050 - DNA (genomic), 606 bp, Streptococcus pneumoniae; double-stranded, circular
  misc_feature (B) LOCATION 1...606
  hypothetical: NO
  anti-sense: NO
gcaaggagaaaattgactacgaacaagaactcccgtatccaggcagagaaagaacgcaagaagagggataaaatcgccaagcaatatgcagacaatctggttctagccatgggacccgcagagcgtgcttatcaagattactttggctttacagagaccctgactcaagaagaacgcaagtgggaaaaaattctttttggtaaaaatagagcagaacgggctatcaaggccaaacaataccaaaaagagctggaaaaagaccaacgaattgccagtcaggatccaattgaaagaaaacagaaacagacttggctcctcaattcctattttcgtgagcttcctgaagaaaaagctcgattttctaggctcttattagaatatcgaaaaaatggtgaagtacccttttcaactgaatacctgtcagatcatctcatcgactttttctataaaatgaaagcctttgaatttgaaatcgcaccagaacaagtccgagattttctaaaaaaaagcctgcaggaagactatcgctcatcagcacaaggaagctggatagaaggaattctcctcaactgcctcaaaccatttttagaacgattagtgatatga

SEQ ID NO: 1051 - DNA (genomic), 297 bp, Streptococcus pneumoniae; double-stranded, circular
  misc_feature (B) LOCATION 1...297
  hypothetical: NO
  anti-sense: NO
aaaaggagaaataaaatggttaaagtattagcagcgtgcggaaatggaatgggttcatcaatggttatcaagatgaaggttgaaaatgctctccgtaagcttaatcaaacagattttacagtcaattcatgcagtgtcggtgaagctaaaggtttagcagtaggatatgacatcgtaatcgcttctcttcatttgattcaagaattggaagggcgaactaatgggaagttaattgggcttgataacttgatggatgataaagaaatcaccgaaaaactcagtcaagcactacagtaa

SEQ ID NO: 1052 - DNA (genomic), 682 bp, Streptococcus pneumoniae; double-stranded, circular
  misc_feature (B) LOCATION 1...682
  hypothetical: NO
  anti-sense: NO
aaggagaaagaaaatgaaaaaatttgttgctgagttaatcggtacgttcatgcttgtattcgtcgggacaggagctgttgtttttggaaatggtcttgatggccttggtcaccttggaatcgcctttgcctttggtttggcaatcgtggtggcagcctactcaatcggaactgtttcaggtgctcacttgaacccggctgtttcgattgctatgtttgtaaacaaacgtttgtcatcttcagaacttgtaaactacatccttggtcaggttgttggagctttcatcgcttctggcgctgtcttcttcctcttggctaactcaggtatgtcaactgctagtcttggtgaaaatgccttggcaaacggtgtcactgtctttggtggtttcttgtttgaagtcatcgcaactttcttgtttgtattggttatcatgactgtgacttcagaaagcaagggcaatggcgcgattgctggtttggtaatcggtttgtcattgatggcgatgattcttgtcggattgaagattactggactttcagtaaacccagctcgtagcttggcaccagctgtcttggtaggcggcgcagcccttcaacaagtttggattttcatccttgcaccaatcgctggtggagttcttgcagcccttgttgcaaaaaatttccttggaacagaagaataa

SEQ ID NO: 1053 - DNA (genomic), 1260 bp, Streptococcus pneumoniae; double-stranded, circular
  misc_feature (B) LOCATION 1...1260
  hypothetical: NO
  anti-sense: NO
tacaatggaaaaaataaattcaaaaggagtttttttatgacttatccaaatctcttggaccgcttcttaacctatgttaaggtcaacacgcgctctgatgaacactctactactactccaagtacacagagtcaggttgacttcgcaacaaatgtcctaattcctgaaatgaaacgtgttggactgcaaaatgtttactatctaccgaatggttttgctattggaaccttgccagccaacgatccgtctttaacacgtaagattggttttatatcgcacatggatactgctgattttaatgctgaaggagtcaatccacaggtaattgaaaactacgatggtggtgtgattgaactagggaattctggtttcaaactcgatccagctgacttcaagagtcttgaaaaatatccaggacaaacgctcatcacaacagatggaacaaccttgctaggtgctgatgacaagtcaggaattgctgaaattatgacagccattgaatatctaactgctcatcctgaaattaagcactgtgagattcgtgttggttttggtccagatgaagaaatcggtgttggtgccaataaatttgatgcagaagattttgatgtggattttgcctacactgttgatggtggtccactaggtgaacttcagtacgagactttctcagccgctggtgctgaattgcatttccaaggccgtaatgtccaccctggtactgccaaagggcagatggtcaatgcccttcagctagcaattgattttcataatcaacttccagaaaatgaccgacctgagttaactgaaggttaccaaggtttttaccatctaatggatgtgacaggtagtgttgaggaggcgcgtgcaagctacatcattcgtgattttgaaaaagatgcctttgaagcgcgtaaagcatccatgcaatctatcgctgataagatgaatgaagaacttgggagcaaccgtgtcactctcaacttgacagaccagtactacaatatgaaagaagtcattgaaaaagatatgactccaattaccgttgctaaagccgttatggaagatctaggtatcacgcctattatcgaaccaatccggggtggaacagacggctctaagatttcctttatgggaatcccaactccgaatatctttgcaggtggcgaaaatatgcacggacgttttgaatacgttagccttcagactatggaacgtgcagttgataccatcattggcatcgtagcttataaaggctaa

SEQ ID NO: 1054 - DNA (genomic), 792 bp, Streptococcus pneumoniae; double-stranded, circular
  misc_feature (B) LOCATION 1...792
  hypothetical: NO
  anti-sense: NO
gaggatggaaacatgaaaaaaaatagtttatatatcatatcctcactcttttttgcttgtgtcttatttgtctatgctacggcgacgaattttcaaaacagtaccagtgctaggcaggtaaaaacggaaacctatactaatacagtaacaaatgtccctattgacatacgctataatagtgataagtattttattagcggttttgcttcagaagtatcagtggtcttgactggtgcaaatcgcctatcgctagctagtgaaatgcaagaaagtacacgtaaattcaaggttactgctgacctaacagatgccggtgttggaacgattgaagttcctttgagcattgaagatttacccaatgggctgaccgctgtggcgactccgcaaaaaattacagtcaagattggtaagaaggctcagaaggataaggtaaagattgtaccagagattgaccctagtcaaattgatagtcgggtacaaattgaaaatgtcatggtgtcagataaagaagtgtcgattacgagtgaccaagagacattggatagaattgataagattatcgctgtcttgccaactagcgaacgtataacaggtaattacagtggttcagtacctttgcaggcaatcgaccgcaatggtgttgtcttaccggcagttatcactccgtttgatacaataatgaaggtgactacaaaaccagtagcaccaagttcaagcacatcaaattcaagtacaagcagttcatcggagacatcttcgtcaacgaaagcaactagttcaaaaacgaattaa

SEQ ID NO: 1055 - DNA (genomic), 477 bp, Streptococcus pneumoniae; double-stranded, circular
  misc_feature (B) LOCATION 1...477
  hypothetical: NO
  anti-sense: NO
aataaaggaaaaggagaaagaagaatgaaagtaatctttttagcagatgttaaaggaaaaggtaaaaaaggcgaaattaaggaagtaccaacagggtatgcgcaaaactttcttatcaaaaagaatctagccaaagaagcgactgctcaagctgtaggtgaacttcgtggtaaacaaaaatcggaagaaaaagctcacgctgagatgattgcagaaggaaaagcaattaaagcacaacttgaagcagaagaaactgttgtagaatttgttgaaaaagttggtccagatggtcgtacctttggttctattaccaataagaagattgcagaagaattgcaaaagcaatttggaattaagattgataaacgtcatattcaagtacaagctccgattcgagcggttggtttgattgatgtgccagtgaaaatctatcaagatatcacaagtgtaatcaatcttcgtgtgaaagaaggataa

SEQ ID NO: 1056 - DNA (genomic), 1566 bp, Streptococcus pneumoniae; double-stranded, circular
  misc_feature (B) LOCATION 1...1566
  hypothetical: NO
  anti-sense: NO
ttgaaaggaaataccatggaggaacagtcggaaatagtccgttctaagaaagaattcgcctttgcatctagcactatactatcccaagttggtcgaggaatcattgtcggcctcatcgttggaattatcgtcggatcctttcgtttcttaattgaaaagggattccacctgatacaaggagtttatcaagatcaagggtacttagtgcgcaatctttttgtactggttttgttttatatactcatctgttggctcagtgccaaactaacacggtcagaaaaagatattaaaggctcaggaattcctcaagtcgaagccgaactgaaaggcctcatgtccctcaactggtggggcattctttggaaaaaatatgtgctaggtattcttgctattgccagtggactcatgctgggtcgagaaggacccagtattcaacttggagcagttggtggtaaaggaattgccaagtggctcaaatccagtccagtagaggaacgttccttgattgccagtggagctgcagcaggtttagccgcagcctttaatgctcctattgcagcacttctctttgttgtagaagaagtctatcaccatttttcgcgctttttctgggtctcaactctagcagccagcatcgtagcaaactttgtgtctctactcatgttcggtttgacaccagtattggatatgccagataacattcctcccatgaccctagatcagtattggatatatctcgtcatgggaattttccttggattttcaggttttctctatgagaaagctgtattaaacgttggaagagtttatgacttgattggtcaaaaaatccatttggatagggcttattatcccatcttggcttttatccttatcataccagtcggaatcttcttacctcaaatccttggtggcggaaatcagcttgtcctttctttaactgaacaaaattttagttttcaagttttattagcttactttttgatccgctttatttggagtatgattagctatggaagtggactgccaggaggaattttcctccccattttagctcttggttctttgcttggtgccttagttggtgttatctgtgtcaatcttggacttgtcagtcaagagcaattccctatatttgtcattctaggaatgagtggctattttggatccatatcaaaagctcccttaaccgctatgatcctcgtaactgagatggtaggagatattcgcaacctcatgccacttggtcttgtcactcttgtttcttatattatcatggatttgctcaaaggtacgccagtctatgaagccatgctggaaaaaatgcttccagaagaagtatctagcgaaggagaagttacacttatcgaaataccagtttctgataaaattgctgggaaacaagttcatgaactcaacttaccacacaacgtcctcatcacaactcaagtccataatggcaagagccaaacagttaacggctcaaccagaatgtatctgggtgatatgattcacctggttattccaaaaagtgaaattggaaaagtcaaagatttgttgttgtag

SEQ ID NO: 1057 - DNA (genomic), 1269 bp, Streptococcus pneumoniae; double-stranded, circular
  misc_feature (B) LOCATION 1...1269
  hypothetical: NO
  anti-sense: NO
gtaggaggaaacatgaaagcagaaatcattgctgttggaacagagattttgacaggacagattgtcaacaccaatgcccagtttttgtcggaaaaactagctgagattggggtagatgtatattttcagacggctgtaggagacaatgaagttcgtctcttgtctttgcttgagattgccagtcaacgtagcagtctggtgattttgacaggcggtttggggccaactgaggacgacctaaccaaacaaaccctagctaaatttttagggaaagcattagtctttgatcctcaggctcaggagaagttggatatcttttttgccctgcgaccagactatgcccgaacaccgaataacgaaagacaagctcaaattgtagaaggagcgattccactgccaaacgaaacaggactggctgttggaggaaaattagaagtagacggagtgacctatgtcgtccttccaggtccgccaagtgaattgaaacccatggtcttaaaccaacttctacccaagttgatgacagggagcaagctgtattcccgagttcttcgtttctttgggattggcgagagccagctggttacgattttggctgatttaattgataatcagatcgatcctaccttggccccttatgccaagacaggagaagtcactctacgtctgtcaacaaaggctagcagtcaagaagaggcgaatcaagcgctggatatcttggaaaatcaaatcttggactgccagactttcgaaggaatttctttacgagacttttgctatggttatggggaagaaactagtttagccagcattgtggtagaagaactgaaaaggcaagggaaaaccatcgcggctgcagagagtttaacggcaggtcttttccaagctaccgtggcgaatttttctggagcttcaagtatatttaagggtggttttgtgacctatagcttggaggaaaaatcaaggatgttggatattcctgccaagaatttggaagaacatggtgtggtgtctgaatttacagctcagaagatggctgagcaggcacgaagcaagacccagtctgattttggaattagtttgaccggagtggcaggaccagatagcctagaaggacacccagttgggacagtcttcataggcttggcgcaagagcaaggaactgaggttatcaaggttaatattggaggcagaagccgagcagatgtacgtcatattgcggttatgcatgcctttaacctagttcgcaaggctttattaagtgactaa

SEQ ID NO: 1058 - DNA (genomic), 204 bp, Streptococcus pneumoniae; double-stranded, circular
  misc_feature (B) LOCATION 1...204
  hypothetical: NO
  anti-sense: NO
aagatgggaaaaaagaaggaaaatcaaatagagaaattgcctctctacttggaaaagctcctcaaactatccatactgaaatcaagtatgggacagtccgaaaatgtcttggaaaagggcgcttcaaagaggtttattctgccgactatgctcaacagtcttatgaaaataatcgcaagcactcggtcaagagatcaagcttga

SEQ ID NO: 1059 - DNA (genomic), 246 bp, Streptococcus pneumoniae; double-stranded, circular
  misc_feature (B) LOCATION 1...246
  hypothetical: NO
  anti-sense: NO
gttgggggaaagagtagagcctttatcctggcagaaggtacaagaatggggcatattcatctttccgtcaaggatagtcgaaagtccagccagttttatcaaaaggtgttagggctagagaataaattcagtgtgcctggcgctagttggattgcggctggagattaccatcatcatttagcagttaacgaatggggaggaaaaggtctggcttcgcgtaagcaaggcttaccaggtttagcctan

SEQ ID NO: 1060 - DNA (genomic), 270 bp, Streptococcus pneumoniae; double-stranded, circular
  misc_feature (B) LOCATION 1...270
  hypothetical: NO
  anti-sense: NO
aaacagtgttttgagcaacctgcggctagctgcctagtttgttctttgattttcattgagtttcactccactgtgacttatggtcagatgctgatacttttattcttttatgcaatatcaaattttaactggcctgctttgacaccaatcttaagtgtgctgcctgccactaaatctcccttaagaagaagttctgccaacttgtcctccacttctgtttgcagggttctgcgaagtgggcgagctcccatctctgggtcatatccttga

SEQ ID NO: 1061 - DNA (genomic), 660 bp, Streptococcus pneumoniae; double-stranded, circular
  misc_feature (B) LOCATION 1...660
  hypothetical: NO
  anti-sense: NO
ggagagtgtttgggtatcttgggaatcaacggtgctggcaaaacatccactttaaagatgatttactcactgacctcaatttcctcaggagagattgatatcttggggcaaaatattgaaaccaatcgtcgtaagagtaaatcttgtctgggtattgtagggcaggaggatatgctggacatgaccttgaatgtttatgataatctttttgctcacggtctatgttatggtatctcatctgtcgaacttaggaagagaatcgattctctcttggattttgttcaactgagcaaacatgcgcaaaagatggtgaatcagctgtcgagtgggatgcgacgacgtcttgtcttggcaagagctctcatcaatcgacctgatattatcattttagatgaaccgacagttggtttagacattcaatcccgcaatattatttgggataaacttttggagttgaaggaattaggtgtttccatcattattacttcccactatatgaatgagattgaatatttgacagatagggtgctgatgctccaccaagggactatcaaagaagaaggaactgtagaagacttgctcatcaagtatgatgctgacaaccttgagacgctttttttggggttgactgggacagagaaggaggacttgcatgtttaa

SEQ ID NO: 1062 - DNA (genomic), 393 bp, Streptococcus pneumoniae; double-stranded, circular
  misc_feature (B) LOCATION 1...393
  hypothetical: NO
  anti-sense: NO
agttctttgaaaatttttccatctttcaatattaatgcacgatcagttttcgaggccaattctatatcgtgcgttaccataattacacacttacccgcccctactaactctctcaataaatcaaaaattacttcacgagaaacgctgtctaaagcaccagttggctcatcagcaaatattatatcactatcagcaataaacgctctagctatagcaaccttctgttgttctccaccagacagagttccaacaaaatcgtttaagccagcattaaacttcattcttttgagtaagttttctacatttttaatagttaattttttttgtgataatcgcaaaggaagtgctatattttctattaccggcagggaaggtattaaattatatgcttga

SEQ ID NO: 1063 - DNA (genomic), 537 bp, Streptococcus pneumoniae; double-stranded, circular
  misc_feature (B) LOCATION 1...537
  hypothetical: NO
  anti-sense: NO
aaaactttgaaagaaagaaaaaagatgaatttaaaagattacattgcaacaattgaaaattatccaaaggaaggcattaccttccgtgatattagtcctttgatggctgatggaaatgcttatagctacgctgttcgtgaaatcgttcagtatgctactgacaagaaagtcgacatgatcgtgggacctgaagctcgtggatttatcgtgggttgtccagttgcctttgagttgggaattggttttgcgcctgttcgtaagccaggtaaattgccacgtgaagttatttctgctgactatgaaaaagagtacggtgtcgataccttgactatgcacgcggatgccattaagccaggtcaacgtgttcttattgtagatgaccttttggcgacaggtggaactgttaaggcaactatcgagatgattgaaaaacttggtggtgttatggcaggttgtgccttccttgttgaactggttgaattgaacggccgtgaaaaaattggtgactacgactacaaagttcttatgcattattaa

SEQ ID NO: 1064 - DNA (genomic), 192 bp, Streptococcus pneumoniae; double-stranded, circular
  misc_feature (B) LOCATION 1...192
  hypothetical: NO
  anti-sense: NO
cgaagtttgaattggattttcgcagagtgtaaattgttgaaactaggttgtcataccatgtataccacttgggctttagtagtagctaactgcactaaatataatataaggagggttttatggggaaaggccattggaatcggaaaagagtttatagcattcgtaagtttgctgtgggagcttgctcagtaa

SEQ ID NO: 1065 - DNA (genomic), 195 bp, Streptococcus pneumoniae; double-stranded, circular
  misc_feature (B) LOCATION 1...195
  hypothetical: NO
  anti-sense: NO
cgtggtttgaagagattttcgaagagtattagaagaaaaagaatgaaagaaatagcctttgacgcattttaccagctttaccaaaacgaccagctttctttagtggatgtgagagaagtggatgagtttgcagctcttcatttagaaggtgcccacaacctaccgcttagtcaattggctgatagttatgattaa

SEQ ID NO: 1066 - DNA (genomic), 528 bp, Streptococcus pneumoniae; double-stranded, circular
  misc_feature (B) LOCATION 1...528
  hypothetical: NO
  anti-sense: NO
cgtggtttgaagagatttttgaagagtattaataaaggtgtacaagaagtgagattaattttgtatgaaaaacaaggagagaaatttatgaaagtagaactacagattagtgagacttacgaggaggaaaagctgattgtccaagcacctcagccgacagataaagtccagaaagtcatcgagttcgcagaaaatctggaccaaagagaaaaaatcaaagggaaaagcgatgatcaggtctatctagttgagattggcaagattcagcgcttctatatcgagaatcggaaggttctagcagaaaccgcgagtcagacctacagcattgatttgcgactctatcaggttcctaaactcttgccaagcaattttatccaaatttcccaatcagaaatcatcaatatcgattccatctctcacctcaagctcacgccaaacggtctggtagaaattttcttgaaaaacgaaagcttcacctactcttcacgccgttatctaaaaaccatcaaggagaaattagaactatga

SEQ ID NO: 1067 - DNA (genomic), 420 bp, Streptococcus pneumoniae; double-stranded, circular
  misc_feature (B) LOCATION 1...420
  hypothetical: NO
  anti-sense: NO
cgcggtttgaagagattttcgaagagtataatactagactcaaatcaaaaagcattatacaatagtaatatgaaatcaactaaagaagaaatccaaaccatcaaaacacttttaaaagactctcgtacagctaaatatcataaacgccttcaaatcgttctatttcgtctgatgggcaaatcttataaagagattatagagcttttagactgtaatcaaacaacgatttggcgaaatgtaaaaaaatatgaggagttcggactcgactctctccttcaagaaacacgtggtggtcgtaaccatgcatatatgacagttgaggaagagaaagcctttcttgcccgccatttgaaggctacagaggcaggagaatttgttacaataccttatttcaggcttatatcgttcctacacacgtga

SEQ ID NO: 1068 - DNA (genomic), 687 bp, Streptococcus pneumoniae; double-stranded, circular
  misc_feature (B) LOCATION 1...687
  hypothetical: NO
  anti-sense: NO
cgcggtttgaagagattttcgaagagtattagtacattctttgagattggagctagtatgaaaatccataaaaccgtgaatcctgttgcctatgaaaatacctattatctagaaggcgaaaagcacctcatcgtcgtcgatcctggtagtcattgggaagccattcgtcagacaatcgagaagatcaacaaaccgatctgtgctattctcttgacccacgcccattatgaccatatcatgagtctggacttggttcgcgagacgtttggcaatcctcctgtctatatcgcagagagcgaagccagctggctctacactcctgtcgataatctctccggtctccctcgccacgatgatatggcagatgtggtcacaaaacctgcagaacacacctttgtctttcacgaagaataccaactagaggaatttcgttttaaggttctaccgaccccagggcactctatcggtggtgtttccctagtctttcctgatgctcacctagtcttgacgggagatgctctattccgcgaaactatcggacggaccgaccttccgactggtagcatggagcaactccttcatagtatccagacccaactcttcaccctaccaaactacgatgtctatccaggacatggtccagctactactatcgctcacgaaaaggccttcaatccctttttttag

SEQ ID NO: 1069 - DNA (genomic), 237 bp, Streptococcus pneumoniae; double-stranded, circular
  misc_feature (B) LOCATION 1...237
  hypothetical: NO
  anti-sense: NO
gttctcttgaagttttttgtaagccagatcaattgctggcagaggtgcatgagaaggggggcccatcagctattctttttggatattgagattcgacatgaggagatgaagggtctggatgtggctagaaagattcgggatcgggattcgtatgccctgattgtcttggtgacgagctcactcgaggtttatgcccctgtcctttcgctaccaagtgtctgctctggattatattga

SEQ ID NO: 1070 - DNA (genomic), 192 bp, Streptococcus pneumoniae; double-stranded, circular
  misc_feature (B) LOCATION 1...192
  hypothetical: NO
  anti-sense: NO
ttgctcttgaaatggaacggtgccagagaaaaattgagcacaaagactgttccaagattgaccaaaaaatcaaagagcagaaggagatatttgaatcctgttgtaaaaaagattaaggaggacgtgcgtggaattactgatttacctcatcctatttttactggttttgattgtctcaagtacaaccaataa

SEQ ID NO: 1071 - DNA (genomic), 192 bp, Streptococcus pneumoniae; double-stranded, circular
  misc_feature (B) LOCATION 1...192
  hypothetical: NO
  anti-sense: NO
ttttcattgaatannnnnnnnnnnnnnnnnnnnnnnnnnnnnnnnnnnnnntgggggnaannnaatannnnnaannnnnnnnnaaaaaaaaaaaaannnannnnnnnnaaaagggaaannaaaaaaaagagggaaannngaaggggggggagaaaanggggagggagggaaaggaggaagaaggnggggtga

SEQ ID NO: 1072 - DNA (genomic), 252 bp, Streptococcus pneumoniae; double-stranded, circular
  misc_feature (B) LOCATION 1...252
  hypothetical: NO
  anti-sense: NO
aacgcgctgaagaaattgctgcccttcgtggtatttcagtttctgatttggcataagaaaggggataaaatggctcaaattaaaattactttgactaagtctccaatcggacgcattccatcacaacgtaaaactgttgtagcacttggacttggcaaattgaacagctctgttattaaagaagataacgctgctatccgtggtatgattacagcagtatctcacttagtaacagttgaagaagtaaactaa

SEQ ID NO: 1073 - DNA (genomic), 5310 bp, Streptococcus pneumoniae; double-stranded, circular
  misc_feature (B) LOCATION 1...5310
  hypothetical: NO
  anti-sense: NO
aagtttatgaataaaggattatttgaaaaacgttgtaaatatagtattcggaaattttcattaggtgttgcttctgttatgattggagctgcattctttgggacaagtccggttcttgcagatagcgtgcagtctggttccacggcgaacttaccagctgatttagctactgctcttgcaacagcaaaagagaatgatgggcgtgattttgaagcgcctaaggtgggagaagaccaaggttctccagaagttacagatggacctaagacagaagaagaactattagcacttgaaaaagaaaaaccggctgaagaaaaaccaaaagaggataaacctgcagctgctaaacctgaaacgcctaagacggtaacccctgaatggcaaacggtagagaaaaaagaacaacagggaacagtcactatccgagaagaaaaaggtgtccgctacaaccaactatcctcaactgctcaaaatgataacgcaggtaaaccagctctgtttgaaaagaagggcttgaccgttgatgccaatggaaatgcaactgttgatttaaccttcaaagaagattctgaaaagggcaaatcacgctttggtgtcttcttgaaatttaaagataccaataataatgtttttgtcggttatgacaaggatggctggttctgggagtataaatctccaacaactagcacttggtatagaggtagtcgtgttgctgctcctgaaacaggatcaacaaaccgtctctctatcactctcaagtcagacggtcagctaaatgccagcaataacgatgtcaatctctttgacacagtgactctaccagctgcggtcaatgaccatcttaaaaatgagaagaagattcttctcaaggcgggctcttatgacgatgagcgaacagttgttagcgttaaaacggataaccaagagagggtaaaaacagaggatacccctgcccagaaagaaacaggtccggttgttgacgatagaaaggtgacttatgatacgatccagtctaaggtacttaaggcagtaattgaccaagccttccctcgtgtcaaggaatacaccttgaatggacatactttgccaggacaggtgcaacaattcaaccaagtctttatcaataaccaccgaatcacccctgaagtcacttataaaaaaatcaatgagacaacagcagagtacttgatgaagcttcgcgatgatgctcacttaatcaatgcggaaatgacagtacgcttgcaagttgtggacaatcaattgcactttgatgtgaccaagattgtcaaccacaatcaagtcactccaggtcaaaagattgatgacgaaagaaaactactttcttctattagtttcctcggcaatgctttagtctctgtttctagtgatcaaactggtgctaagtttgatggggcaaccatgtcaaacaatacgcatgtcagcggagatgatcatatcgatgtaaccaatccaatgaaggatttggctaagggttacatgtatggatttgtttctacagataagcttgctgctggtgtttggagtaactctcaaaatagctatggtggtggttcgaatgactggactcgtttgacagcttataaagaaacagtcggaaatgccaactatgtaggaatccacagctctgaatggcaatgggaaaaagcttataagggcattgttttcccagaatacacgaaggaacttccaagtgctaaggttgttatcactgaagatgccaatgcagacaagaaagttgattggcaagatggtgccattgcttatcgtagcattatgaacaaccctcaaggttgggaaaaagttaaggatatcacagcttaccgtatcgcgatgaactttggttctcaagcacaaaacccattccttatgaccttggatggtatcaagaaaatcaatctccacacagatggtcttgggcaaggtgttctccttaaaggatatggtagcgaaggccatgactctggtcacttgaactatgctgatattggtaagcgtatcggtggtgtcgaagacttcaagaccctaattgagaaggctaagaaatatggagctcatctaggtatccacgttaacgcttcagaaacttatcctgagtctaaatacttcaatgaaaaaattctccgtaagaatccagatggaagctatagctatggttggaactggctagatcaaggtatcaacattgatgctgcctatgacctagctcatggtcgtttggcacgttgggaagatttgaagaaaaaacttggtgacggtctcgactttatctatgtggacgtttggggtaatggtcaatcaggtgataacggtgcctgggctacccacgttcttgctaaagaaattaacaaacaaggctggcgctttgcgatcgagtggggccatggtggtgagtacgactctaccttccatcactgggcagctgacttgacctacggtggctacaccaataaaggtatcaacagtgccatcacccgctttatccgtaaccaccaaaaagatgcttgggttggggactacagaagttatggtggtgcagccaactatccactgctaggtggctacagcatgaaagactttgaaggctggcaaggaagaagtgattacaatggctatgtaaccaacttatttgcccatgacgtcatgactaagtacttccaacacttcactgtaagtaaatgggaaaatggtacaccggtgactatgaccgataacggtagcacctataaatggactccagaaatgcgagtggaattggtagatgctgacaataataaagtagttgtaactcgtaagtcaaatgatgtcaatagcccactataccgtgaacgtacagtaacgctcaacggacgtgtcatccaagatggttcagcttacttgactccttggaactgggatgcaaatggtaagaaactttctactgataaggaaaagatgtactacttcaatacgcaggccggtgcaacaacttggacccttccaagcgattgggcaaagagcaaggtttacctttacaagctaactgaccaaggtaagacagaagagcaagaactaactgtaaaagatggtaaaattaccctagatcttctagcaaatcaaccatacgttctctatcgttcgaaacaaaccaatcctgaaatgtcatggagtgaaggcatgcacatctatgatcaaggatttaatagcggtactttgaaacattggaccatttcaggcgatgcttctaaggcagaaattgtcaagtctcaaggggcaaacgatatgcttcgtattcaaggaaacaaagaaaaagttagtctcactcagaaattaactggcttgaaaccaaataccaagtatgccgtttatgtcggtgtcgataaccgtagtaatgccaaggcaagtatcactgtgaatactggtgaaaaagaagtgactacttataccaataagtctctcgccctcaactatgtaaaagcctacgcccacaatacacgtcgtaacaatgctacagttgacgatacaagttacttccaaaacatgtacgccttctttacaactggatcggacgtctcaaatgttactctgacattgagtcgtgaagctggtgatcaagcaacttactttgatgaaattcgtacctttgaaaacaattcaagcatgtacggagacaagcatgatacaggtaaaggcaccttcaagcaagactttgaaaatgttgctcagggtatcttcccatttgtagtgggtggtgtcgaaggtgtcgaagacaaccgcactcacttgtctgaaaaacacgatccatatacacaacgtggttggaacggtaagaaagttgatgatgttatcgaaggaaattggtcactcaagacaaatggactagtgagccgtcgtaacttggtttaccaaactattccgcaaaacttccgttttgaagcaggtaagacctaccgtgtaacctttgaatacgaagcaggttcagacaatacctatgcttttgtagtcggtaagggagaattccagtcaggtcgtcgtggtactcaagcaagcaacttggaaatgcatgaattgccaaatacttggacagattctaagaaagccaagaaggcaaccttcctcgtgacaggtgcagaaacaggggatacttgggtaggtatctactcaactggaaatgcaagtaatactcgtggtgattctggtggaaatgccaacttccgtggttataacgacttcatgatggataatcttcaaatcgaagaaattaccctaacaggtaagatgttgacagaaaatgctctgaagaactacttgccaacggttgccatgactaactacaccaaagagtctatggatgctttgaaagaggcggtctttaacctcagtcaggccgatgatgatatcagtgtggaagaagcgcgtgcagagattgccaagattgaagccttgaagaatgctttggttcagaagaaaacggctttggtagcagatgactttgaaagtttggatgcgccagctcaaccaggtgaaggcctagagaatgcttttgatggcaatgtgtctagtctatggcatacatcttggaatggtggagatgtaggcaagcctgcaaccatggtcttgaaagaaccaactgaaatcactggacttcgttacgttccacgtggatcgggttcaaatggtaacttgcgtgatgtgaaacttgttgtgacagatgagtctggcaaggagcatacctttactgcaactgattggccagataacaataagccaaaagacattgattttggtaagacaattaaggctaagaaaattgtccttacaggtactaagacttacggagatggtggcgataaataccaatctgcagcggaacttatctttactcgtccacaggtagcagaaacacctcttgacttgttaggctatgaagcagctttggctaaggctcagaaattaacagacaaagacaatcaagaggaagtagctagcgttcaggcaagcatgaaatatgcgacggataaccatctcttgacggaaagaatggtggaatactttgcagattatctcaaccaattaaaagattctgctacgaaaccagatgctccaactgtagagaaacctgagtttaaacttagctctttagcttccgagcaaggtaagacgccagattataagcaagaaatagctagaccagaaacacctgaacaaatcttgccagcaacaggtgagagtcaatctgacacagccctcttcctagcaggtgttagcctagccctatctgctctctttgtagtaaaaacgaagaaagactag

SEQ ID NO: 1074 - DNA (genomic), 1857 bp, Streptococcus pneumoniae; double-stranded, circular
  misc_feature (B) LOCATION 1...1857
  hypothetical: NO
  anti-sense: NO
atttctatgaataaaaaactaacagattatgtgattgatctggtggaaattttaaataaacaacaaaagcaggttttctggggaatatttgatattttcagtatggtggtttccatcattgtatcttatattttattttatgggctgattaatccagcacctgttgactacattatctatacgagtttggccttcttgttctatcaattgatgattggtttttgggggttgaacgcgagcattagtcgttacagcaagattacggatttcatgaaaatcttttttggtgtgactgctagcagtgtcttgtcatatagtatctgttatgccttcttgccactcttctccatccgtttcatcattctctttatcttgttgagtaccttcttgattttattgccacggattacttggcagttaatctactccagacgcaaaaaaggtagtggtgatggagaacaccgtcggaccttcttgattggtgccggtgatggtggggctctctttatggatagttaccaacatccaaccagtgaattagaactggtcggtattttggataaggattctaagaaaaagggtcaaaaacttggtggtattcctgttttgggctcttatgacaatctgcctgaattagccaaacgccatcaaatcgagcgtgtcatcgttgcgattccgtcgctggatccgtcagaatatgagcgtatcttgcagatgtgtaataagctgggtgtcaaatgttacaagatgcctaaggttgaaactgttgttcagggccttcaccaagcaggtactggcttccaaaaaattgatattacggaccttttgggtcgtcaggaaatccgtcttgacgaatcgcgtctgggtgcagaactgacaggtaagaccatcttagtcacaggagctggaggttcaatcggttctgaaatctgtcgtcaagttagtcgcttcaatcctgaacgcattgtcttgctcggtcatggggaaaactcaatctaccttgtttatcatgaattgattcgtaagttccaagggattgattatgtacctgtgattgcggacattcaagactatgatcgtttgttgcaagtctttgagcagtacaaacctgctattgtttatcatgcggcagcccacaagcatgttcctatgatggagcgcaatccaaaagaagccttcaaaaacaatatccgtggaacttacaatgttgctagagccgttgatgaagctaaagtgtctaagatggttatgatttcgacagataaggcagtcaatccaccaaatgttatgggagcaaccaagcgcgtggcggagttgattgtcactggctttaaccaacgtagccaatcaacctactgtgcagttcgttttgggaatgttcttggtagccgtggtagtgtcattccagtctttgaacgtcagattgctgaaggtgggcctgtaacggtgacagacttccgcatgacccgttactttatgaccattccagaagctagtcgtctggttatccatgctggtgcttatgccaaagatggggaagtctttatccttgatatgggcaaaccagtcaagatttatgacttggccaagaagatggtgcttctaagtggccacactgaaagtgaaattccaatcgttgaagttggaatccgcccaggtgaaaaactctacgaagaactcttggtatcaaccgaactcgttgataatcaagttatggataagattttcgttggtaaggttaatgtcatgcctttagaatccatcaatcaaaagattggagagttccgcactctcagtggagatgagttgaagcaagctattatcgcctttgctaatcaaacaacccacattgaataa

SEQ ID NO: 1075 - DNA (genomic), 1314 bp, Streptococcus pneumoniae; double-stranded, circular
  misc_feature (B) LOCATION 1...1314
  hypothetical: NO
  anti-sense: NO
tatcctatgaaaggagttaatatggaaaagcaacaacctagtaaagcagccctgctgtctatcattcctgggttaggacagatttacaataaacaaaaagccaaaggttttatcttccttggtgtaaccatcgtatttgtcctttacttcctagcacttgcaacccctgaattgagcaacctcatcactcttggtgacaaaccaggtcgtgataattccctctttatgctgattcgtggtgccttccatctaatctttgtaatcgtttatgtactcttttatttctcaaatatcaaagatgcacatacgattgcaaaacgcattaacaatggaattccagttccacgcacactcaaagacatgatcaaagggatttatgaaaatggcttcccttacctcttgatcattccatcttatgttgccatgaccttcgcgattatcttcccagttatcgtaaccttgatgatcgcctttaccaactacgacttccaacacttgccaccaaacaagttgttggactgggttggtttgaccaactttacaaacatttggagcttgagtaccttccgttctgcctttggttctgttctttcttggactatcatttgggctttggcagcttctactttacaaatcgtaattggtatcttcacagctatcattgctaaccaaccatttatcaaaggaaaacgtatctttggtgttattttccttcttccttgggctgtcccagccttcatcactatcttgacattctcaaacatgtttaacgatagtgtcggtgctatcaacactcaagtattgccaatcttggctaaattccttcctttccttgatggagctcttattccttggaaaacagacccaacttggactaagattgccttgattatgatgcaaggttggctcggattcccatacatctacgttctgaccttgggtatcttgcaatctattcctaacgacctttacgaagcagcttatattgacggtgccaacgcttggcaaaaattccgcaacatcactttcccaatgattttggctgttgcggcacctactttgattagccaatacaccttcaactttaacaacttctctatcatgtacctcttcaatggtggaggacctggtagtgtcggaggtggagctggttcaaccgatatcttgatctcatggatctaccgtttgacaacaggtacatctcctcaatactcaatggcggcagctgttaccttgattatctctatcattgtcatctcaatctctatggttgcattcaagaaactacacgcatttgatatggaggacgtctaa

SEQ ID NO: 1076 - DNA (genomic), 657 bp, Streptococcus pneumoniae; double-stranded, circular
  misc_feature (B) LOCATION 1...657
  hypothetical: NO
  anti-sense: NO
aacactatgaaagataaacaaacatttttaatgaagggcagttttgcccttttacttttcgttattcttggctatatggtcaaattttaccctgaaatgttggtcaattttgaccaatcgattcagactgccattcgaggaaacttaccaaattatttgactattctttttcgatccctcacacgtctgattgatatcccagtgattatcacttgggttgtcattacagcttttgtcttttatcgtaagcgatggaaaataaaaagtttcttcatgctgggaaatctggctttggcaggtcttttaatcgtgacctttaaaaatatctaccagcgcccacaaccagctatcttacatctggtggaggagaagggattttccttcccaagtgggcattctctggctgtaaccttgatggtaggtactttgattgttattcttagtcagcggattaaagatccagtctggagaaaaatcgtacaaatcgtccttggcctctacctagtcagtgtgctggtatcaagagtctatctgggagttcattacccatcagacgtccttgccagtctctgtgtgggcttgggagtcctgtttatcgagtttcccttctatgacaagctccgcttccaatggcgatttaaaggcaaacagaagtga

SEQ ID NO: 1077 - DNA (genomic), 363 bp, Streptococcus pneumoniae; double-stranded, circular
  misc_feature (B) LOCATION 1...363
  hypothetical: NO
  anti-sense: NO
aatcatatgaatattaccaatttgttttctatcaagacaggatgtgatgaaactgataggcaactgcaaaaactattttttcagttggatttacaattgggagaattgacagatcaactaagaaaattagattctaattttgttcctcgtagtcaatttgtagacacgttggatttgaatgatgtagaatataaagaaattttaaactattttatcttccatcgtaatgatagtgaagaaagtttggtagaatggttatatgattggatttccacaaatcgttatgaacttcctaaagagttttcgattcgtatggctcataaataccatgaaagtgttactgaagttttcggagatgaataa

SEQ ID NO: 1078 - DNA (genomic), 246 bp, Streptococcus pneumoniae; double-stranded, circular
  misc_feature (B) LOCATION 1...246
  hypothetical: NO
  anti-sense: NO
accaatatgaaacgtattgctgtcttgactagtggcggagacgcacctggtatgaacgctgccatccgtgcagttgttcgtcaagcaatttcagaaggaatggaagtgtttggtatctatgacggatatgctggtatggttgccggtgaaaattcatcccctaaatgcagcttcagtaggggacatcatttctcgtggtggtacttttcttcactcagctcgttatccaaatttcgctcaacttga

SEQ ID NO: 1079 - DNA (genomic), 468 bp, Streptococcus pneumoniae; double-stranded, circular
  misc_feature (B) LOCATION 1...468
  hypothetical: NO
  anti-sense: NO
gacaatatgaagcaaacaaaaacaactaaaatcgcccttgtatccctattaaccgccctttctgtggttctaggttatttcttaaaattcccaacacctacaggaattctaactcttttagatgctggtgtcttctttgcggccttttactttggtagtcgtgaaggagcggtagtcggaggactagcaagtttcttgattgacctcttatcaggctaccctcagtggatgttctttagcttggtcaaccatggcttgcagggatttttcgcaggatttaaaggaaaaagtcagtggttaggccttattttagcaactattgccatggtaggaggctacgccttgggttctactttgatgaatggctgggcagcagccctcccagaaattctaccgaattttatgcaaaatatggtagggatgattgtaggatttattcttagtcaaagtatcaagaagattaagtaa

SEQ ID NO: 1080 - DNA (genomic), 492 bp, Streptococcus pneumoniae; double-stranded, circular
  misc_feature (B) LOCATION 1...492
  hypothetical: NO
  anti-sense: NO
ataagtatgaatttaaacgatattaaagacttgatgactcaatttgaccagtcaagtttgagagaattttcttataaaaatgggacggatgagttgcagtttagcaagaatgaagcgagacctgtgcctgaagttgcaactcaagtcgctccagcacccgttctagcaacaccgagtccagtagctcctacatctgctccagcagagactgtagcagaagaagttccagctccagctgaagcaagtgtggctagtgagggaaatcttgtagagagtccacttgttggagtggtttacttggctgctggaccagataaacctgccttcgttacagttggtgatagtgtcaaaaaaggtcaaacattggtaattatcgaagccatgaaagtcatgaatgaaatcccagctcctaaggatggtgtggtaacggaaattctcgtctctaacgaagaaatggttgagtttggtaaaggattggtacgtatcaaatga

SEQ ID NO: 1081 - DNA (genomic), 1305 bp, Streptococcus pneumoniae; double-stranded, circular
  misc_feature (B) LOCATION 1...1305
  hypothetical: NO
  anti-sense: NO
agaagtatgaaagtaaatttagattatctcggtcgtttatttactgagaatgaattaacagaagaagaacgtcagttggcggagaaacttccagcaatgagaaaggagaaggggaaacttttctgtcaacgttgtaatagtactattctagaagaatggtatttgcccatcggtgcttactattgtcgagagtgcttgctgatgaagcgagtcagaagtgatcaaactttatactattttccgcaggaggattttccgaagcaagatgttctcaaatggcgcggccaattaactccttttcaagagaaggtgtcagagggactgcttcaagcagtagacaagcaaaagccaaccttagttcatgcggtaacaggagctggaaagacagaaatgatttatcaagtagtggctaaagtgatcaatgcgggtggtgcagtgtgtttggctagtcctcgcatagatgtttgtttggagctgtacaagcgcctgcaacaggatttttcttgcgggatagctttgctacatggagaatcggaaccttattttcgaacaccactagttgttgcaacaacccatcagttattgaagttttatcaagcttttgatttgctgatagtggatgaagtagatgcttttccttatgttgataatcccatgctttaccacgctgtcaagaatagtgtaaaggagaatggattgagaatctttttaacagcgacttcgaccaatgagttagataaaaaggtccgtttaggagaactaaaaagactgaatttaccgagacggtttcatggaaatccgttgattattccaaaaccaatttggttatcggattttaatcgctacttagacaagaatcgtttgtcaccaaagttaaagtcctatattgagaagcagagaaagacagcttatccgttactcatttttgcttcagaaattaagaaaggggagcagttagcagaaatcttacaggagcaatttccaaatgagaaaattggctttgtatcttctgtaacagaggatcgattagagcaagtacaagcttttcgagatggagaactgacaatacttatcagtacgacaatcttggagcgtggagttaccttcccttgtgtggatgttttcgtagtagaggccaatcatcgtttgtttaccaagtctagtttgattcagattggtggacgagttggacgaagcatggatagaccgacaggagatttgcttttcttccatgatgggttaaatgcttcaatcaagaaggcgattaaggaaattcagatgatgaataaggaggctggtctatga

SEQ ID NO: 1082 - DNA (genomic), 942 bp, Streptococcus pneumoniae; double-stranded, circular
  misc_feature (B) LOCATION 1...942
  hypothetical: NO
  anti-sense: NO
agaagtatgaagtggaccaagattattaaaaaaatagaagaacaaatcgaggcaggaatttatcccggagcctcttttgcgtattttaaggacaatcaatggacagagttctatttaggccagagtgacccagagcatggcttgcagactgaggcaggactagtttatgacctagctagtgtcagcaaggttgttggggttggcacagtttgtaccttcttgtgggaaataggtcaattagatattgatagactggtaatagattttttacctgagagtgattatccagacatcactattcgccagctcttgactcatgcaacagaccttgatccttttattcctaatcgtgatcttttaacagcccctgaattaaaggaagcgatgtttcatctcaacagacgaagtcagccagcctttctttattcggatgtccattttttgctgttgggctttattttggaaagaatttttaatcaagatttggatgtgattttaaaggatcaagtctggaaaccttggggaatgacggaaaccaagtttgggccagttgagcttgctgttccaacagttagaggtgtagaggcaggcatagtgcatgatcccaaggctcgtctcctgggtagacatgctgggagtgctggtttattttcgactataaaggatttacaaatctttttagaacactatttagcagatgattttgcaagagacttaaatcaaaatttttctcctttggatgacaaggaacgttctttagcatggaatttggaaggagattggctagaccatacgggctatacaggtacctttatcatgtggaatcgtcagaagcaagaagccactattttcctatcgaatcgtacctatgaaaaggacgagagagctcaatggatattagaccgcaatcaagtgatgaacttgattcgtaaagaagagtaa

SEQ ID NO: 1083 - DNA (genomic), 483 bp, Streptococcus pneumoniae; double-stranded, circular
  misc_feature (B) LOCATION 1...483
  hypothetical: NO
  anti-sense: NO
ctgctcatgaagtggaccgcgctgcccgtgaggtcatcgaaaaagctggttatggtgagtacttcaaccaccgtctcgggcatggtatcggtatggatgtccatgaattcccatctatcatggaaggaaacgacatggtcatcgaagaaggcatgtgcttctctgttgaaccaggtatctatatccctggtaaagtcggtgttcgtattgaagactgcggtgttgttaccaaggatggcttcgacctctttacaagcaccagcaaagatttgctttattttgattaaactatatagcccctatgctttcctttcaaaatatctaggggctattttattgtcatttttctgctattatgctaaagaaattggctgcaataatctaaccctaagtgtctggaatgataacgagggtgctctccgcttttatcaaagacaagggatgaaaccccaagaaacaacaatggaaatgataattgattaa

SEQ ID NO: 1084 - DNA (genomic), 1965 bp, Streptococcus pneumoniae; double-stranded, circular
  misc_feature (B) LOCATION 1...1965
  hypothetical: NO
  anti-sense: NO
tctttaatgaaaaaacaaaataatggtttaattaaaaatccttttctatggttattatttatctttttccttgtgacaggattccagtatttctattctgggaataactcaggaggaagtcagcaaatcaactatactgagttggtacaagaaattaccgatggtaatgtaaaagaattaacttaccaaccaaatggtagtgttatcgaagtttctggtgtctataaaaatcctaaaacaagtaaagaaggaacaggtattcagtttttcacgccatctgttactaaggtagagaaatttaccagcactattcttcctgcagatactaccgtatcagaattgcaaaaacttgctactgaccataaagcagaagtaactgttaagcatgaaagttcaagtggtatatggattaatctactcgtatccattgtgccatttggaattctattcttcttcctattctctatgatgggaaatatgggaggaggcaatggccgtaatccaatgagttttggacgtagtaaggctaaagcagcaaataaagaagatattaaagtaagattttcagatgttgctggagctgaggaagaaaaacaagaactagttgaagttgttgagttcttaaaagatccaaaacgattcacaaaacttggagcccgtattccagcaggtgttcttttggagggacctccggggacaggtaagactttgcttgctaaggcagtcgctggagaagcaggtgttccattctttagtatctcaggttctgactttgtagaaatgtttgtcggagttggagctagtcgtgttcgctctctttttgaggatgccaaaaaagcagcaccagctatcatctttatcgatgaaattgatgctgttggacgtcaacgtggagtcggtctcggcggaggtaatgacgaacgtgaacaaaccttgaaccaacttttgattgagatggatggttttgagggaaatgaagggattatcgtcatcgctgcgacaaaccgttcagatgtacttgatcctgcccttttgcgtccaggacgttttgatagaaaagtattggttggccgtcctgatgttaaaggtcgtgaagcaatcttgaaagttcacgctaagaacaagcctttagcagaagatgttgatttgaaattagtggctcaacaaactccaggctttgttggtgctgatttagagaatgtcttgaatgaagcagctttagttgctgctcgtcgcaataaatcgataattgatgcttcagatattgatgaagcagaagatagagttattgctggaccttctaagaaagataagacagtttcacaaaaagaacgagaattggttgcttaccatgaggcaggacataccattgttggtctagtcttgtcgaatgctcgcgttgtccataaggttacaattgtaccacgcggccgtgcaggcggatacatgattgcacttcctaaagaggatcaaatgcttctatctaaagaagatatgaaagagcaattggctggcttaatgggtggacgtgtagctgaagaaattatctttaatgtccaaactacaggagcttcaaacgactttgaacaagcgacacaaatggcacgtgcaatggttacagagtacggtatgagtgaaaaacttggcccagtacaatatgaaggaaaccatgctatgcttggtgcacagagtcctcaaaaatcaatttcagaacaaacagcttatgaaattgatgaagaggttcgttcattattaaatgaggcacgaaataaagctgctgaaattattcagtcaaatcgtgaaactcataagttaattgcagaagcattattgaaatacgaaacattggatagtacacaaattaaagctctttacgaaacaggaaagatgcctgaagcagtagaagaggaatctcatgcactatcctatgatgaagtaaagtcaaaaatgaatgacgaaaaataa

SEQ ID NO: 1085 - DNA (genomic), 645 bp, Streptococcus pneumoniae; double-stranded, circular
  misc_feature (B) LOCATION 1...645
  hypothetical: NO
  anti-sense: NO
caactaatgaactttgaaacagtcatcggacttgaagtccacgtagagctcaacaccaattcaaaaatcttctcacctacttctgcccacttcggaaatgatcaaaatgccaacactaacgtgattgactggtctttcccaggagttctgccagttctcaataaaggggttgttgatgccggtatcaaggctgctcttgccctcaacatggacatccacaaaaaaatgcactttgaccgcaagaactacttctaccctgataatcccaaagcctaccaaatttctcagtttgatgagccaatcggttataacggctggattgaagtcgagctagaagacggtacgaccaagaaaattggtatcgaacgcgcccacttagaggaagacgctggtaaaaacacccacggtacagacggctactcttacgttgaccttaaccgccaaggggtacctttgattgagattgtatctgaagccgatatgcgttcgccagaggaggcctatgcttatctgacagcactcaaggaagttatccagtatgctggcatttctgacgttaagatggaggaaggttcgatgcgtgtggatgccaacatctccctcgtccttatggtcaagagaaattcggtaccaagactgaattga

SEQ ID NO: 1086 - DNA (genomic), 1299 bp, Streptococcus pneumoniae; double-stranded, circular
  misc_feature (B) LOCATION 1...1299
  hypothetical: NO
  anti-sense: NO
cctataatgaaaagcgacaaaaccatcattagaaagattcatatggaacaattacattttatcacaaaactgctcgatattaaagacccaaacatcaagattctagatatcatcaatatggatacccacaaagaaattatcgctaagctggattatgaggctccatcttgccctgattgtggaagtctaatgaagaaatatgactttcaaaaaccgtctaagatcccttacctcgaaacaactggtatgccttctagaattctccttagaaaacgccgtttcaagtgctatcactgttcaaaaatgatggttgctgagactcccctggtaaagaaaaatcaccaaatccctcgtatcatcaaccaaaaaattgctcaaaagttaattgaaaaaatttctatgactgatattgcccatcagctggccatttcaacttcaactgtcattcgcaagctcaatgactttcactttgagcatgatttttctcggcttccaaagattatgtcttgggatgagtatgccttcactaagggaaagatgagtttcattgcgcaagattttgataatcttaatattatcactgttcttgaaggcagaacacaagctgtcatccgaaatcactttcttcgctacgatagagccgttcgttgtcaagtgaaaatcattacgatggatatgtttagtccttactatgacttggctaaacagctttttccgtgtgctaaaatcgttctagatcgtttccatattatccaacatctcagccgtgccatgagtcgttttcgtgttcaaattatgaatcagtttgaacgaaaatctcatgaatacaaggctatcaaacgttactggaaactcatccaacaggatagtcgtaaattgagcgataaacgtttttatcgccctacttttcgcatgcacttaacaaataaagaaattcttgacaagattttaagctattcagaagacttgaaacaccactatcagatctatcaactcttactttttcactttcagaacaaagaccctgagaaatttttcggactcattgaggacactctgaagcaggttcatcctatttttcagactgtctttaaaacctttctaaagaacaaagaaaaaatcgtcaacgctcttcaattaccttattccaacgcaaaattggaagcgaccaataatctcatcaaacttatcaaacgaaacgcctttggatttcggaactttgaaaacttcaaaaaaaggatttttatcgctctgaacatcaaaaaagaaaggacgaattttgtcctttctcgagcttag

SEQ ID NO: 1087 - DNA (genomic), 1281 bp, Streptococcus pneumoniae; double-stranded, circular
  misc_feature (B) LOCATION 1...1281
  hypothetical: NO
  anti-sense: NO
aaaataatgaagataagttggaatggattttctaaaaaatcataccaagagcgcctcgagctgctaaaagctcaggcgctccttagtcctgagagacaagctagtctggagaaggatgaacagatgagtgtgactgtggcagaccagctgagtgagaatgtggtgggaactttttctctgccttattcgctggttccggaggtacttgtcaacggtcaggaatacaccgttccctatgtgacagaagaaccctctgtggttgcggcggccagctatgccagcaaaatcatcaagcgtgcaggtggttttactgcacaagtccatcagcgccagatgattgggcaggtagccctttatcaaattgctaatcctaaactagcgcaagagaagattgccagcaagaaagcggagctcttggagcttgccaatcaagcctatccttctatcgttaaacgtgggggtggggcgcgtgatctgcatgtcgagcagataaaaggcgaaccagactttctcgttgtttatattcatgtcgatacccaggaagccatgggtgccaatatgctcaacaccatgctggaagccttgaaaccagtcttagaagaactcagtcagggacagagtctcatgggaatcctgtccaactacgcgactgattctctggtgactgcaagctgtcgcatcgcctttcgctacttgagccgccaaaaggatcaaggacgagagattgcggagaaaattgcgttggctagtcagtttgcgcaggctgatccttaccgagctgctactcataataaaggaatttttaatggtattgatgcgattttgattgccactggtaatgactggcgtgccatcgaagctggggcccatgcctttgccagtcgagatggacgctatcaaggtcttagctgctggacgctggaccttgaaagagaagaattggtcggtgagatgaccctgcccatgcctgtagcgactaagggtggctctatcggcctcaacccacgtgtagctctcagtcatgatctactaggaaatccttctgccagagaattagcccagattatcgtgtccatcggtcttgctcaaaattttgcagccctcaaagccttggtaagtacgggcatccagcaaggccacatgaaactacaggccaaatccctagctctcctagctggggctagtgaatctgaagttgctcccctagtagagcgcctcatctcagataaaacctttaacctagagacagcccagcgctatctcgaaaatttaagatcataa

SEQ ID NO: 1088 - DNA (genomic), 840 bp, Streptococcus pneumoniae; double-stranded, circular
  misc_feature (B) LOCATION 1...840
  hypothetical: NO
  anti-sense: NO
aaaataatgaagaagaaatccagtatttatttagatattctctcacatgtactcttagttggtgcgaccattgttgcaattttcccattggtatggattatcatatcttctgtcaaagggaagggggaattaactcagtatccaacacgattttggcctgaacaatttacattagattatttcactcatgttatcaacgatttgcacttcattgataacattcgaaacagtttaatcattgccttggctacaacccttattgcgattattatttctgctatggcagcctatggtattgttcgattctttcctaaattgggagcaatcatgtcgagactactcgtcattacctacattttcccaccaattttgttagcaattccctattcaattgccattgctaaagttgggttaacaaatagtttatttggcttgatgatggtttatctatcttttagtgttccatatgcagtttggctcttagttggatttttccaaacagttccaattggaattgaagaagcggctagaattgatggtgcaaataaatttgttacgttttataaagttgtgctaccgattgtagcaccaggtattgtagcaacagctatttatacatttatcaatgcttggaatgaattcctgtatgccttgattttgattaacaatacaggaaagatgacagtagcagtagcccttcgttcacttaatggttcagaaatactagactggggagatatgatggcagcgtctgttattgtagttcttccatcaattattttcttctctatcatccaaaataagattgcaagtggattatcagaaggatctgtgaagtag

SEQ ID NO: 1089 - DNA (genomic), 249 bp, Streptococcus pneumoniae; double-stranded, circular
  misc_feature (B) LOCATION 1...249
  hypothetical: NO
  anti-sense: NO
gaaataatgaaacgaattttaatagcgcctgtgcgcttttaccaacgttttatctcaccagtctttccaccctcttgtcgctttgagctgacttgttccaactacatgattcaggctattgaaaaacatggttttaagggggtattgatgggcttggctcggattttacgttgtcatccctggtcgaaaacaggtaaggaccccgttccagaccacttttcccttaaacgaaatcaagaaggggaatga

SEQ ID NO: 1090 - DNA (genomic), 264 bp, Streptococcus pneumoniae; double-stranded, circular
  misc_feature (B) LOCATION 1...264
  hypothetical: NO
  anti-sense: NO
tactcaatgaaaatcaaagagcaaactaggaagttagccgcaggttgctcaaaacagtgttttgaggttgtagatgaaactgacgaagtcagctcaaaacagtgttttgaggttgtagatgaaactgacgaagtcagtaaccatacctacggcaaggcgaaactgacgtggtttgaagagattttcgaagagtataaaatgatggggaaggctgggcaactagtctttttcgatgtttatagattagttaggcaagtaagctag

SEQ ID NO: 1091 - DNA (genomic), 246 bp, Streptococcus pneumoniae; double-stranded, circular
  misc_feature (B) LOCATION 1...246
  hypothetical: NO
  anti-sense: NO
tactcaatgaaaatcaaagagcaaactaggaaactagccgcaggttgctcaaaacaccgttttgaggttgcagatagaactgatgaagtcagctcaaaacactgttttgaggttgtggatagaactgacgaagtcagctcaaaacaccgttttgaggttgtggatagaactgacgaagtcagtaaccatacctacggcaaggtgaagctgacgtggtttgaagagagtttcgaagagtataagtag

SEQ ID NO: 1092 - DNA (genomic), 183 bp, Streptococcus pneumoniae; double-stranded, circular
  misc_feature (B) LOCATION 1...183
  hypothetical: NO
  anti-sense: NO
tactcaatgaaaatccaagagcaaactaggaaactagccgcaagctgttcaaagcactgctttgaggttgtagataagactgacaaagtcagtcacatatatacggtaaggcgacgttggcgcggtttgaagagatttttgaagagtataaaaatcctcaagatactttcttctatcctttag

SEQ ID NO: 1093 - DNA (genomic), 339 bp, Streptococcus pneumoniae; double-stranded, circular
  misc_feature (B) LOCATION 1...339
  hypothetical: NO
  anti-sense: NO
tactcaatgaaaatcaaagagcaaactaggaagctagccgcaggttgttcaaaacacagttttgaggttgtagatgaaactgacgaagtcagctcaaaacatggttttgaggttgtagatgaaactgacgaagtcagctcaaaacatggttctgaggttgtagatgaaactgacgaagtcagctcaaaacatggttttgaggttgtagatgaaactgacgaagtcagctcaaaacatggttttgagattgtagatgaaactgacgaagtcagtaaccatacatacggtaaggcgacgctgacgtggtttgaagagattttcgaagagtataaaaactaa

SEQ ID NO: 1094 - DNA (genomic), 369 bp, Streptococcus pneumoniae; double-stranded, circular
  misc_feature (B) LOCATION 1...369
  hypothetical: NO
  anti-sense: NO
tactcaatgaaaatcaaagtgcaaactaggaagttagccgcaggctgctcaaaacactgttttaaggttgtggatggaactgacgaagtcagctcaaaacactgttttgaggttgtggatagaactgacgaagtcagtaaccatatctacggcaaggtgaagctgacgtggtttgaagagattttcgaagagtataagtctctacataataaaacgcatattaccaaggttcttatgaactgcaccccaaaagttagacagaaaaaatctaacttttgggggtcagtacattcaacacctgatactatgcgtttttttaattttaaagattttttacaacttcttttgactcacattaaactattctaa

SEQ ID NO: 1095 - DNA (genomic), 213 bp, Streptococcus pneumoniae; double-stranded, circular
  misc_feature (B) LOCATION 1...213
  hypothetical: NO
  anti-sense: NO
tactcaatgaaaatcaaagagcaaactaggaaactagccgcaggctgctcaaaacactgttttgaggttgcagatagaactgacgaagtcagctcaaaacactgttttgaggttgcagatagaactgacgaagtcagtaaccatacctacgataaggcgacgttgacgcggtttgaagagattttcgaagagtataaaggtgtaccgagatga

SEQ ID NO: 1096 - DNA (genomic), 456 bp, Streptococcus pneumoniae; double-stranded, circular
  misc_feature (B) LOCATION 1...456
  hypothetical: NO
  anti-sense: NO
ctccaaatgaaactgactgattacgtcaagcaggtttcactagaagacttcggcagaccttttatccatcatgtccagtggaataggcgtctacgttcgacaggtgggcgatttttccccaaagatgggcatttggattttaatcccaaggtttatcaggaactggggttggacgtttttaggaaaattgtccgacatgaactctgtcattatcacctttatttccaagggaagggctatcaacacaaggatcgggattttaaggaacttttgaaagcagtggatggattacggtttgtaccatccttgcccaatagtaactccaaaccactcaagctctatcgttgccaatcctgccagcaaacttatcagcgcaagcgtaggattgataccaaacgctatcgctgtggactttgtcgaggtaaattgcttctgataaatcagcctgaggactga

SEQ ID NO: 1097 - DNA (genomic), 1986 bp, Streptococcus pneumoniae; double-stranded, circular
  misc_feature (B) LOCATION 1...1986
  hypothetical: NO
  anti-sense: NO
gagggaatgaatgtgttaaacattaaagagaaagatatccttcaatttttaataaaaaataaggaacgttttgttacaagcaaagaactagcagaatatttatcctgttcagatagaactgtccgtaatgtactgaaattaattgagaagacaatgattattcaaggagtccggttgatttcaaaacaaggtcaagggtatcaaatattttttgagaatcaaggcgcttaccaggagtttagacaaacttatgaactggaagaagactatacgaaaactgcggtttcaaaaggtgatgatcgtttagtatttatcttaaataaattattatttgagcaagttccagttctttttgatgatttagctgatgaactttacgttagtcgttcaacattatctcatgatttcagaaagatacgagtgatgttatcagagtataatttgtccattgagagtagggcgaataaaggagtttatgtctcaggcgaggaacgtgataaacgacgttttatcataaattatttcctagagaatcaattttttaaaacaatacattgctatgtaaaatttaacttttttgatcaaactgttccattagaagaatttgctagaattgttttggatgaatgccaagaggccaacctaaaactatctgattttgtactacagaatttagtagttcacatagcattgtctgtgattcgtttaaaatccggatttgaaataaaaaatatagactgtcagatgactgatgatgcaacagagagaaaggttgcccaaagaattctttctaaagtaagagaagtaacaaatcaggaatttccagttcaggaaatagactacattactttgcatttgttagctaagagtcaacaatgtcaaaaaaatcagaagaatatttctgaagaagttttaaaaaaatctttatttaaaacatttcagaatttaggattagatgatatgtataacttttcttcagatttccaactaattgaaggattgataactcatctaatgacactacaagtacgtttagaaagccggattaccttaaataaccctttagtagatgaaattaaacagaattatagtgatatattctttatgactagagaaattcttgcaaatatggacaagttcttggagtggacaatatcagatgatgaagtagcatatgtaagtcttcactttttagctgctatggaacgtagcaaagagagtactaagtttaatattcttgctatttgtgcaacaggatttggtgcagcccaaatgttaagaaatcgtttggaaacggagtttgggaagcgagtagaagttgttgatgtaataggctattatgaattgaatcaagaaaaacttaaaggaatagattttatagtgtcagctgttgatttatcaaatctatattttcaaatcccagtttttaaagttagtgtgtttcttaagagtgatgagatggaaatgattagaaaagctatggatcagatgcaagtttctagttatgtaccatcatcaaagattaacaaatttgaaaacaacggctttagacagtattttagtaaagaaaattttttaatatgtactgaatcagacaaggtaaatttacttgaaaagatggttgagggtttatctgttggtgaatcaaatgagtttgaacaatctttactttatggaattaaacagcgcgaagaattaagttcagttgttttttctgaaaaaattgcagttccgcatcctattcagccctttggtacagagggaaaggtttcggttgcaatctgtaaagattcgttactctgggataatcaaagttcatatgtccagctagtatttcttctatctccatcaatatatgggaacgaaggtttggcaactgtgactaaaaagatagtctctctgacagagaatgatgagttgcaaaatcagctaatatcttgcaataactttgaagattttattaacatatttgagaagataaaatag

SEQ ID NO: 1098 - DNA (genomic), 708 bp, Streptococcus pneumoniae; double-stranded, circular
  misc_feature (B) LOCATION 1...708
  hypothetical: NO
  anti-sense: NO
aggctgatgaagcaactaattagtctaaaaaatatcttcagaagttaccgtaatggtgaccaagaactgcaggttctcaaaaatatcaatctagaagtgaatgagggtgaatttgtagccatcatgggaccatctgggtctggtaagtccactctgatgaatacgattggcatgttggatacaccaaccagtggagaatattatcttgaaggtcaagaagtggctgggcttggtgaaaaacaactagctaaggtccgtaaccaacaaatcggttttgtctttcagcagttctttcttctatcgaagctcaatgctctgcaaaatgtagaattgcccttgatttacgcaggagtttcgtcttcaaaacgtcgcaagttggctgaggaatatttagacaaggttgaattgacagaacgtagtcaccatttaccttcagaattatctggtggtcaaaagcaacgtgtagccattgcgcgtgccttggtaaacaatccttctattatcctagcggatgaaccgacaggagccttggataccaaaacaggtaaccaaattatgcaattattggttgatttgaataaagaaggaaaaaccattatcatggtaacgcatgagcctgagattgctgcctatgccaaacgtcagattgtcattcgggatggggtcatttcgtctgacagtgctcagttaggaaaggaggaaaactaa

SEQ ID NO: 1099 - DNA (genomic), 1113 bp, Streptococcus pneumoniae; double-stranded, circular
  misc_feature (B) LOCATION 1...1113
  hypothetical: NO
  anti-sense: NO
gtgccgatgaatataattctaatcgccaaacttttgagagagaatacaaatacaaaagcaaatgcccttaataatggttgggctagatctggttctgaagagttcaaaaagttctcccactttgtaggggtagacaaagggattgtgcgaacgaatgtactgactggtaaaaaactatctgataagattaggaaagaagtgggctctggagatagcaaactaggaaaaggcggctatttctctactggggatgttctattaggaaaagatgttgtttcttataccgtacaagtattttcagagaataatgaaagagtaggagtaaacactcaaagtcaccgtgttcagtataatctcccaattctagctgacttttcagtcatccaagatactgtggaaccatcacgaaccgttgttgaaaaaatcattccaaaactaaatattcccgaagaagagaaagggaaaataaccgaagaaatcaagaaaaagaaaaaaacctcagaattggcagaactaatctcagaaaatgtgaaagttcgctatgttgatgaacaagggcgtttgctatcattgaaaaatgatactggaattggagaaaaagaaagtgacggaacctacattaccaataaaaaacaactgattggtaccagctacaatgtcacagataaaaaactcagtagcatgactactactgacggaaaatattatacttttaaagaagcagatacaaattctgcaagtttaactgggaatattgtaagcgaaggtagaacagtgaccttagtttatagagaaagcgaagcgccaaccactgctacagtaacagccaattactataaagaaggtagccaagagaagttggcagagtctgttataaaagctgatttagcgataggttctgagtataccacagaatcaaaaactattgaagggaaaacaacaactgaggacaaagaagaccgagttatcacaaggaaaacaacatacaccttggtagcaactcctgcaaatgcgtaccagaagacggtgcaacagttgactattactaccgtgagaatgttgaggaaacagtggttcccaaaacagcaacctctactgagacgaagactataa

SEQ ID NO: 1100 - DNA (genomic), 1149 bp, Streptococcus pneumoniae; double-stranded, circular
  misc_feature (B) LOCATION 1...1149
  hypothetical: NO
  anti-sense: NO
caacagatgaagattgataaatattctgccattttaggaaactaccacgttggttttcacaatatgtcgacattgacggaccaccgtccagtagcaagtttgccatttggtgggaaatatcgtttgattgacttcccactttcaagccttgctaatgcaggtgttcgtagtgtctttggtattttccagcaggataatatcagctcagtatttgaccatattcgttcaggacgcgagtggggcttatcaacccttcttagtcattactatctaggaatttacaatacccgtgtagaaagtagtacagttggaaaagaatactaccaacagcttcttacttatttgaaacgttctggctcaaaccaaacggttgccctcaactgcgatgttcttattaacattgatttgaaccaagttttccacctacatagtacaacaaaagagcctatcactgtagtttataaaaaactagctaagaaagatatttcagaagtaaatgcaatcttggatgtagatgaaacagaccatgttctttctcataaactctttgatagcaagtcaacagctgaaacgttcaatatgtctacagatatctttgtcgttgatacaccttggttgattgaacacttggaagaagaagctaaaaaagaacatccagagaaattgcgctatgttttacgggatttggctgtaaaagagggagctttcgcctacgagtacacgggctatctagccaatattcactctgttaaatcttattatcaagcgaatatcgatatgcttgaatcacaaaaattctattctcttttctcaccaaaccaaaagatttatacaaaggtcaaaaacgaagagccaacttactatgctaatacatctaaggtaagcacttctcagtttgcctctggtagtattattgaaggtcaagtagctaattctgttctatcacgtaatattcatgtccataaggatagcttggttaaagatagcctgctcttccctcgtgttgttattggagaaggggctcaggtcgaatatgctatcttggacaaaggggttgaagttgagcctggtgttgtgattcgaggaactgcagaacatccagttgtggttaagaaaggtgctaaagtaacagaggatattcattcatga

SEQ ID NO: 1101 - DNA (genomic), 711 bp, Streptococcus pneumoniae; double-stranded, circular
  misc_feature (B) LOCATION 1...711
  hypothetical: NO
  anti-sense: NO
tgtaagatgaatcaagtaatcaatgctatgcgtaaacgagtctgtgatgccaatcaatcattgccaaaacatggacttgtcaaatttacctgggggaatgtatctgaagtcaatcgcgaactcggtgtcattgttatcaaaccatcaggcgtggattatgacgaattgacacctgaaaacatggtagtgactgatctagatggtaagatcctagaaggggatttaagaccatcttccgacctcccaactcatgtgcaattatataaggcttggtcagaaattggtagtgtggttcacacccattcgacagaagctgttggttgggctcaggcaggtcgtgatattcctttctacggaacaacccatgcagattatttctacggttcaatcccttgcgcccgtagtttgaccaaggacgaagtagaagtggcctatgaaaaagatactggcctggttatcgtagaagagtttgaacatcgcggacttaacccggttgaagtaccaggaattgttgtacgcaatcacggtccattcacctggggcaaaaatccagaggatgctgtttatcactctgtcgtactagaggaagtatcaaagatgaatcgctttacagaacaaatcaattcaagagttgaacctgctccccagtacatactagagaaacactaccaacgtaaacatggaccaaatgcttattatggtcaaaagtaa

SEQ ID NO: 1102 - DNA (genomic), 2166 bp, Streptococcus pneumoniae; double-stranded, circular
  misc_feature (B) LOCATION 1...2166
  hypothetical: NO
  anti-sense: NO
aacaagatgaacaaaccaacgattctgcgcctaatcaagtatctgagcattagcttcttaagcttggttatcgcagccattgtcttaggcggaggagtttttttctactacgttagcaaggctcctagcctatccgagagtaaactagttgcaacaacttctagtaaaatctacgacaataaaaatcaactcattgctgacttgggttctgaacgccgcgtcaatgcccaagctaatgatattcccacagatttggttaaggcaatcgtttctatcgaagaccatcgcttcttcgaccacagggggattgataccatccgtatcctgggagctttcttgcgcaatctgcaaagcaattccctccaaggtggatcaactctcactcaacagttgattaagttgacttacttttcaacttcgacttccgaccagactatttctcgtaaggctcaggaagcttggttagcgattcagttagaacaaaaagcaaccaagcaagaaatcttgacctactatataaataaggtctacatgtctaatgggaactatggaatgcagacagcagctcaaaactactatggtaaagacctcaataatttaagtttacctcagttagccttgctggctggaatgcctcaggcaccaaaccaatatgacccctattcacatccagaagcagcccaagaccgccgaaacttggtcttatctgaaatgaaaaatcaaggctacatctctgctgaacagtatgagaaagcagtcaatacaccaattactgatgggctacaaagtctcaaatcagcaagtaattaccctgcttacatggataattacctcaaggaagtcatcaatcaagttgaagaagaaacaggctataacctactcacaactgggatggatgtctacacaaatgtagaccaagaagctcaaaaacatctgtgggatatttacaatacagacgaatacgttgcctatccagacgatgaattgcaagtcgcttctaccattgttgatgtttctaacggtaaagtcattgcccagctaggagcacgccatcagtcaagtaatgtttccttcggaattaaccaagcagtagaaacaaaccgcgactggggatcaactatgaaaccgatcacagactatgctcctgccttggagtacggtatctacgattcaactgctactatcgttcacgatgagccctataactaccctgggacaaatacccctgtttataactgggataggggctactttggcaacatcaccttgcaatacgccctgcaacaatcgcgaaacgtcccagccgtggaaactctaaacaaggtcggactcaaccgcgccaagactttcctaaatggtctcggaatcgactacccaagtattcactactcaaatgccatttcaagtaacacaaccgaatcagacaaaaaatatggagcaagtagtgaaaagatggctgctgcttacgctgcctttgcaaatggtggaacttactataaaccaatgtatatccataaagtcgtctttagtgatgggagtgaaaaagagttctctaatgtcggaactcgtgccatgaaggaaacgacagcctatatgatgaccgacatgatgaaaacagtcttgacttatggaactggacgaaatgcctatcttgcttggctccctcaggctggtaaaacaggaacctctaactatacagacgaggaaattgaaaaccacatcaagacctctcaatttgtagcacctgatgaactatttgctggctatacgcgtaaatattcaatggctgtatggacaggctattctaaccgtctgacaccacttgtaggcaatggccttacggtcgctgccaaagtttaccgctctatgatgacctatctgtctgaaggaagcaatccagaggattggaatataccagaggggctctacagaaatggagaattcgtatttaaaaatggtgctcgttctacgtggaactcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatcaacaaaatcagaatcctcaaccagcacaaccataa

SEQ ID NO: 1103 - DNA (genomic), 948 bp, Streptococcus pneumoniae; double-stranded, circular
  misc_feature (B) LOCATION 1...948
  hypothetical: NO
  anti-sense: NO
aagaagatgaaacaaacaaaacgaattaagcggtggcgctattatctgcgccgctttgcttatcagataaaaattttacgtgtcttacaaagtatctctcgagaaaagtatgatgagaagatttcggcctctctggtctatggttttttatcagcagtagcagttaatttctttttccaaccagggcatgtgtattcgagtggtgcaacaggtctggcacagattatctctgccttgagtaatcactggtttggttttcatattccgatttcgctaaccttctacgccattaacttccctttgatggtcttagcttggtatcagattggccataagttcaccgtctttacctttatcacggtatctatgagttccttctttatccagtttgtccctgtggcaaccttgacggaggatcccattatcaatgccctttttggtggtgttgttatgggtttggggattggttttgctcttcgaaacaatatctccagtggtgggacggatatcgtcagcctgactattcgcaagaaaacgggtaagaatgtcggtagtatttctttcttggtaaatggaactatcatgctgatagcaggtttgacctttggttggaaatacgctctttattctatgattaccatctttgtctctagccgtgtgacagacgcagtctttactaagcaaaagcgtatgcaggccatgattgtgacaaatcatccagagaaggtaattgaaaaaatccataaaaaattgcaccgcggagcaaccatgatccacgatgcagaaggaacctataatcacgagagaaaggcagttttaatcactgtcattacacgtgcagagtttaatgaatttaaacagattatgacacaagtggatccaagctcctttgtctctgtctcggaaaatgttcatattctaggaagatttgtggagatagataattag

SEQ ID NO: 1104 - DNA (genomic), 933 bp, Streptococcus pneumoniae; double-stranded, circular
  misc_feature (B) LOCATION 1...933
  hypothetical: NO
  anti-sense: NO
aaaacagtgaaatctattaaacgttttgcactctcggctatgggagtggctatgttgcttgtcttgactggctgtgtcaatgtcgataaaaccacaggtcagccaacaggatttatttggaatacgatcggagcgcctatggctgaagccatcaagtacttcgctactgataaaggtctaggctttggtgtcgctatcattatcgtaaccattatcgtacgcttgattatcttaccacttggtatctaccaatcatggaaggcaacgcttcactctgaaaagatgaacgccctcaagcacgtccttgagccacaccaaacgcgtctcaaagaagcgactactcaagaagaaaaactcgaagcccaacaagctctctttgctgctcaaaaagagcacggtatcagcatgtttggcggtgtaggatgtttccctatcctccttcaaatgcctttcttctctgctatctactttgctgcccaacatactgaaggggttgctcaagcaagctacctaggcattcctctaggttctccaagtatgattttggttgcctgtgctggtgtcctttactatcttcaatcgctcctttcacttcacggagtaaaagatgaaatgcaaagagaacaaatcaagaaaatgatttacatgagcccactcatgatcgtcgtcttctccctcttctcaccagctagtgtcacactttactgggttgtcggtggtttcatgatgattctccaacagtttatcgtcaactatatcgttcgtccaaaacttcgcaaaaaagtccgtgaagaactagccaagaacccaccaaaagcaagtgctttctctaaaccaagtggacgaaaagacgttacccctgaacaaccaactgctatcacaagcaagaaaaaacacaaaaatcgtaacgctggaaaacaacgttcgagataa

SEQ ID NO: 1105 - DNA (genomic), 921 bp, Streptococcus pneumoniae; double-stranded, circular
  misc_feature (B) LOCATION 1...921
  hypothetical: NO
  anti-sense: NO
ataatggtgaaggaatttaaggagggaagtatgaaaaattcgattatggatacaaaatttgatagacgtatcttactcttaaataaaatcattattgtctttatcgttttgatgactttgcttcctttactttatatcgtcgtagcatcctttatggatcctaaggttctggttagtagagggattagctttaatccagccgattggactgtagaaggttatcagcgtgtattcagtgaccaatctattctaagaggttttatcaattctctactatactcttttggatttgcagctttaacagtcttgctatctgtgtttacagcttatcctctttctaagaaagacttggttggacgtcgttggattaactacttcttgattgtaactatgttctttggtggtggtttagtcccaacttacttgctcgtaaaagaattgggaatgctcaatactccatgggcaatcattgttccaggtgctgtcaatgtttggaatattattcttgctagggcctatttccaaggattgcctgaagaattagttgaagctgctgtcattgatggtgcaaatgatttacagattttcttcaaaatcatgcttcctcttgcaaaaccaattatgtttgttctcttcctctatgcttttgtaggacagtggaactcatactttgatgcaatgatttatatcaaggatccaaacttggaaccattgcaacttgtacttcgtaaaattctcattcagagccaaccaggtcaagacatgattggagcacaagcggctatgaatgaaatgaaacgtttagctgaattgattaaatacgcaactattgtcatttccagcttgccattgattgttatgtatccattcttccaaaaatactttgataaaggaattatggctggttcacttaaaggataa

SEQ ID NO: 1106 - DNA (genomic), 639 bp, Streptococcus pneumoniae; double-stranded, circular
  misc_feature (B) LOCATION 1...639
  hypothetical: NO
  anti-sense: NO
ctcgtggtgaagataatccaaaaaggaatatttatcatgtcgcaagctatttccttaaatcaatcaacctgggcaagcaagctaaaagcaatgggacctggaatcctaatggcaactgccgctgttggaggttcccacattgtatcctcaactcaagctggcggttcttacggttggtctctacttctcttggtcatcttagccaatgtctttaaatatccatttttccgttttggtgctgaatacacagctgatactggaaagactttggttgaaggttatgccgaaaaaggaaaactctatctctggattttctttatcctcaatgtcttttcggctatggtcaacacggctggtgttgccattctgtgctcagctatcatcgccagtgccttcccaatgattggacttagcattactcagtggtccctcattctcgttgcaatcatttgggctatgctactctttggaggctacaaacttttagacggcatggtcaaatggattatgtctgccttaaccattgcgactgttcttgcagttatcattgcggcggtcaagcatccagaatacagttctgattttgtcgagaagacaccttggcaaatggcagctctgccttcatcgtctccctcctag

SEQ ID NO: 1107 - DNA (genomic), 246 bp, Streptococcus pneumoniae; double-stranded, circular
  misc_feature (B) LOCATION 1...246
  hypothetical: NO
  anti-sense: NO
tactcttcgaaaatctcttcaaaccacgtcagcgtcgccctaccgtatgtatggttactgacttcgtcagtttcatctacaacctcaaagcagtgctttgagctgacttcgtcagtttcatctacaacctcaaaaacatgttttgagctgacttcgtcagttctatctacaacctcaaagcagtgctttgagcaacccgcggctagcttcctagtttgctctttgattttcattgagtataaataa

SEQ ID NO: 1108 - DNA (genomic), 201 bp, Streptococcus pneumoniae; double-stranded, circular
  misc_feature (B) LOCATION 1...201
  hypothetical: NO
  anti-sense: NO
tactcttcgaaaatctcttcaaaccacgtcagcgtcacattaccgtatatatggttactgacttcgtcagttctatccacaacctcaaaacagtgttttgagcagcctgcggctagcttcctagtttgctctttgatttccattgagtatgagaagaaatatagtggatactctttaacattaaccactccacctgactag

SEQ ID NO: 1109 - DNA (genomic), 1461 bp, Streptococcus pneumoniae; double-stranded, circular
  misc_feature (B) LOCATION 1...1461
  hypothetical: NO
  anti-sense: NO
cttttatcgaaaattggattaacaactaccctaaaaaatgcttggactacaagtcgccaagtgaatttcttttgggtggctaacttcaacttgaaatttgggataccgacactatatacattaagtagtggaagagttctatcaagtattgatgcacgttatggtgggactcatgattctaaaagtaagattaatattgccacttcttatagtgatgataatgggaaaacgtggagtgagccaatttttgctatgaagtttaatgactatgaggagcagttagtttactggccacgagataataaattaaagaatagtcaaattagtggaagtgcttcattcatagattcatccattgttgaagataaaaaatctgggaaaacgatattactagctgatgttatgcctgcgggtattggaaataataatgcaaataaagccgactcaggttttaaagaaataaatggtcattattatttaaaactaaagaagaatggagataacgatttccgttatacagttagagaaaagggtgtcgtttatgatgaaacaactaataaacctacaaattatactataaatgataagtatgaagttttggagggaggaaagtctttaacagtcgaacaatattcggttgattttgatagtggctctttaagagaaaggcataatggaaaacaggttcctatgaatgttttctacaaagattcgttatttaaagtgactcctactaattatatagcaatgacaactagtcagaatagaggagagagttgggaacaatttaagttgttgcctccgttcttaggagaaaaacataatggaacttacttatgtcccggacaaggtttagcattaaaatcaagtaacagattgatttttgcaacatatactagtggagaactaacctatctcatttctgatgatagtggtcaaacatggaagaaatcctcagcttcaattccgtttgaaaatgcaacagcagaagcacaaatggttgaactgagagatggtgtgattagaacattctttagaaccactacaggtaagatagcttatatgactagtagagattctggagaaacatggtcgaaagtttcgtatattgatggaattcaacaaacttcatatggcacacaagtatctgcaattaaatactctcaattaattgatggaaaagaagcagtaattttgagtacaccaaattctagaagtggccgtaagggaggccaattagttgtcggtttggtcaataaagaagatgatagtattgattggagataccactatgatattgatttgccttcgtatggttatgcctattctgcgattacagaattgccaaatcatcacataggtgtactgtttgaaaaatatgattcgtggtcgagaaatgaattgcatttaagcaatgtagttcagtatatagatttggaaattaatgatttaacaaaataa

SEQ ID NO: 1110 - DNA (genomic), 1071 bp, Streptococcus pneumoniae; double-stranded, circular
  misc_feature (B) LOCATION 1...1071
  hypothetical: NO
  anti-sense: NO
attaaatcgaaaaatctgaagaaaggagagacgatgctagccattgaagaaagtcagaagttgactttatcaaatttaccgagcctgagcctatttacagggacagatcagggtcagtttgaagtgatgaagagtcaagtgttgaaacagattgggtatgattctgctgacctcaactttgcctactttgatatgaaagaagtagtttacaaggatgtggaactggagttggtcagccttcctttctttgcggatgagaaaatcgtgatattagattattttatggatatcacgactgctaagaaacgctttttgacagatgatgagcttaagtcatttgaggaataccttgacaattcttctccaacaaccaagttgataatctttgcagaaggaaagctggatagcaaaagacggttagtcaaattacttaagcgtgatgccaaggtcttcgatgcagtagaagtaaaagaacaagaattgcgccagtatttccaaaagtggagtcagaaacaaggtctgcagtttaccaatcattcttttgaaaatctcctcatcaagtcggggtttcaatttagcgaaatccagaaaaatcttctctttttacagtcctataaggcgaattctgttattgaggaagaggatattgttaacgcaattcccaagaccttgcaggacaatatttttgatttaactcagtttattctgactaaaaagatggatcaggcgcgcgatttggtgagagacttgaccttgcaaggggaagatgaaatcaaactgattgcagtcatgctgggacaatttcggacttttactcaggtgaagattttggcggagtctggccaaacagaatcgcagattgcaagtagtttaggtagttatctgggacgtaacccaaatccttatcaaatcaagtttgcattaagagattcgagaggactttctttgagctttttgaagcaagctatttcctatttgattgagacagactatcagattaagacaggtctttatgaaaaaggtttcctttttgaaaaggcactcttacagattgctagtcaggtcaattga

SEQ ID NO: 1111 - DNA (genomic), 354 bp, Streptococcus pneumoniae; double-stranded, circular
  misc_feature (B) LOCATION 1...354
  hypothetical: NO
  anti-sense: NO
caatttccgaaaggatctaaccacagctttttgtttcaattggtcatgagtttgataacgcataaacgttttatctcgtgtaatgaaaacatcaaacattacaagaggctcattgacaaggcggaaacatgtgtcaatgacttgatggctgagttcaactcgatcataacgacggttactgggattgggaatcgtttaggggcggtcattttagccgagattcgaaatattcatgcctttgataatcctgctcaattacaagctttcgctggactggattcttctatttatcagtcaggtcagattgatttagctggaagaatggtcaaacggggttcccctcatctgcggtag

SEQ ID NO: 1112 - DNA (genomic), 456 bp, Streptococcus pneumoniae; double-stranded, circular
  misc_feature (B) LOCATION 1...456
  hypothetical: NO
  anti-sense: NO
atgtatacgaaaagtaggacgataaaatcgcttatcactcagtttacggctatcctgttgtatgagcttccagtagcgcttgatagccttgtattcatgggattttcgatgaaactgattcatgatttgaacacgcacacgactcatagcacagctaagatgttgtacaatgtgaaagcgaagctgtttagccaagccatagtaagggctaaacatatccatagtaataattttgacgcgacatcggacaactctatcgtagcgaagaaagtgatttcgaatgatagcttgtgttctaccctcaagaacagtgatgatattgagattgttaaaatcttgcgcaatgaagctcatctttccctttgtaaaagcatactcatcccaagacataatctcaggaagacaagaaaaatcatgtttaaagtgaaaatcattgagcttacgaataacagttga

SEQ ID NO: 1113 - DNA (genomic), 570 bp, Streptococcus pneumoniae; double-stranded, circular
  misc_feature (B) LOCATION 1...570
  hypothetical: NO
  anti-sense: NO
ttaatcacgaaggaaaggagaagtataatggcaaatcgtttaaaagaaaaatatcttaatgaagtagttcctgctttgacagaacaattcaactactcatcagtgatggctgtgcctaaagtagataagattgttttgaacatgggtgttggtgaagctgtatcaaacgctaaaagccttgaaaaagctgctgaagaattggcacttatctcaggtcaaaaaccacttatcactaaagctaaaaaatcaatcgccggcttccgtcttcgtgaaggtgttgcgatcggtgcaaaagttacccttcgtggtgaacgtatgtacgaattcttggataaattggtatcagtttcacttccacgtgtacgtgacttccacggtgttccaacaaaatcatttgatggacgcgggaactacacacttggtgtgaaagaacaattaatcttcccagaaatcaacttcgatgacgttgacaaaactcgtggtcttgacatcgttatcgtaacaactgctaacactgacgaagagtcacgtgcattgcttacaggccttggaatgccttttgcaaaataa

SEQ ID NO: 1114 - DNA (genomic), 609 bp, Streptococcus pneumoniae; double-stranded, circular
  misc_feature (B) LOCATION 1...609
  hypothetical: NO
  anti-sense: NO
gagagaacgaacactatgtacgcatatttaaaaggaatcattaccaaaattactgccaaatacattgttcttgaaaccaatggtattggttatatcctgcatgtggccaatccttatgcctattcaggtcaggttaatcaggaggctcagatttatgtgcatcaggttgtgcgtgaggacgcccatttgctttatggatttcgctcagaggatgagaaaaagctctttcttagtctaatttcggtctctgggattggtcctgtatcagctcttgctattatcgctgctgatgacaatgctggcttggttcaagccattgaaaccaagaacatcacctacttgaccaagttccctaaaattggcaagaaaacagcccagcagatggtgctggacttggaaggcaaggtagtagttgcaggagatgaccttcctgccaaggtcgcagtgcaagcaagtgctgaaaaccaagaattggaagaagctatggaagccatgttggctctgggctacaaggcaacagagctcaagaaaatcaagaaattctttgaaggaacgacagatacagctgagaactatatcaagtcggcccttaaaatgttggtcaaatag

SEQ ID NO: 1115 - DNA (genomic), 1005 bp, Streptococcus pneumoniae; double-stranded, circular
  misc_feature (B) LOCATION 1...1005
  hypothetical: NO
  anti-sense: NO
tggatgacgaaaatattactgtttggagaaccattaattcgaatctcaccattagatgccaccagtatcggcgatcatgttgccagttcgacttattttggcggatcagaaattaacatcgcttgtaatttgcaagccctgggtatctcaacgaaagtctttaccgcactccctgccaacgagattggagatcgttttctcacattcttgaaacagcaccaaatcgataccagttcaatctgtcggcttggcgatcgaatcggcctctactatttggagaacggctttggttgtcgtcaaagtgaagttttctacgatcgtaagcatacgagtatcagccagattcggccaaacatgctagatatggattctctctttcaggggattagccattttcattttagtggaatcaccgtagctatcggtcaagaggtccgtgcgatccttctcctactcttggaagaagccaagcgccgaggaattgtcgtttcaatggatctcaatctgagaacaaagatgatttcagtcctagaagccaagtatgaattttctaagtttgcacgttttactgactattgcttcggtattgatcctctcatgattgatgaccaaaatctagagatgtttccaagagacagtgctagcctagaagaggtggaaaatcgcatgcgacttttaaaagaagcctatggtttcaaggccattttccataccctccgatctagtgatgagcaagacaaaaatgtctatcaagcctatgctctggaagaacgatttgaagagtctgtccaactaaaaactgcagtctatcaacgaattggtagcggggatgcctttatatctggtgccctttaccaactactccatcattcctccctaaaaactaccattgactttgcagttgcgagcgcaactctcaaatgcactcttccaggagaccatctctccacttccgcaactagtattgaaaatttactggcaaatgcacaagatatcattcgttag

SEQ ID NO: 1116 - DNA (genomic), 975 bp, Streptococcus pneumoniae; double-stranded, circular
  misc_feature (B) LOCATION 1...975
  hypothetical: NO
  anti-sense: NO
ctctttgcgaatagtataggtgaggaggtaagtatggttcaagaaattgcacaagaaatcattcgttcagctcggaaaaaagggacgcaggatatctattttgtccctaagttagacgcctatgagcttcatatgagggtaggagacgagcgctgtaaaattggtagctatgattttgaaaagtttgcagccgttatcagtcactttaagtttgtggcgggtatgaatgtgggagaaaaaagacgtagtcaactgggttcctgtgattatgcctatgaccataagatagcgtctctacgtttatctactgtaggcgattatcgggggcatgagagtttggttatccgtttgttgcacgatgaggagcaggacctgcatttttggtttcaggatattgaagaattaggcaagcagtacaggcaacggggactctatctttttgctggtccggttgggagtggtaagacgaccttgatgcatgaattgtccaagtcactctttaaaggacagcaagttatgtccatcgaagatcctgtcgaaatcaagcaggacgacatgcttcagttgcagttgaacgaagcaatcggcctaacctatgaaaatctaatcaaactttccttgcgtcatcgaccagatctcttgattatcggagaaattcgtgacagcgagacggcgcgtgcagtggtcagagctagtttgacaggtgcgacagtcttttcaaccattcacgccaagagtatccgaggtgtttatgagcgtctgctggagttgggtgtgagtgaagaagaattggcagttgttctgcaaggagtctgctaccagagattaatcgggggaggaggaatcgttgactttgcaagcagagattatcaagaacaccaagcagccaagtggaatgagcaaattgaccagcttcttaaagatggacatatcacaagtcttcaggctgagacggaaaaaattagctacagctaa

SEQ ID NO: 1117 - DNA (genomic), 1341 bp, Streptococcus pneumoniae; double-stranded, circular
  misc_feature (B) LOCATION 1...1341
  hypothetical: NO
  anti-sense: NO
attggagcgaaaatgaaacgaacaggtttatttgcaaagatatttatctataccttctcgatatttagtgttctggttatctgccttcatttagctatttattttctttttccttcgacttatctgagtcatcgtcaggaaaccattggtcaaaaggcaacagccattgcccagtccctagaagggaaagataggcagagtatcgagcaagtgttagacttgtattcccagactagtgatatcaaggggaccgtcaaaggtgagatgaccgaggacaagttagaggtcaaggacagtcttcctctggacacagaccgccagacaacctctctctttattgaggagcgcgaggtgaaaacgcaagacggtggtactatgattctccagtttctagcttccatggatttacaaaaggaagcggagcaaatcagtctccagtttcttccctataccttgctggcctcctttctgatttccctcttggtggcctacatctacgctcggactattgttgcaccgattttggaaatcaagcgggtgacccgtcggatgatggacctggattcccaagtgcgattgcgcgtggattctaaggatgagataggtaatctcaaggaacaaatcaatagcctttaccagcatctcttgactgttattgcggacttgcatgaaaagaatgaagccattctccagctggagaagatgaaggtcgaattcctacgaggagcttctcatgaattgaaaacaccgctggctagtttgaaaatcctaatcgaaaatatgagagagaatatcggtcgttataaggatagagaccagtatctgggagttgccttggggattgtggatgaactcaatcaccatgttctgcagatactttccctctcttctgtgcaggaattgcgagatgatagggaaacaattgacctcctccagatgacgcaaaatctggtcaaagattatgccttgctagccaaggaaagagagctccagatagacaatagtttgacccatcagcaggcttatctaaacccatcagttatgaagttgattctttctaatctcatcagcaatgccattaagcactctgttccaggtggcttagttcgaattggagaaagagaaggagaactttttatcgaaaatagctgtagctcagaggaacaagaaaaactagcccagtctttttctgacaatgctagtcgcaaggtcaaggggtctggtatggggctctttgtggttaagagtctattagaacatgaaaaattagcttatcgtttcgagatggaggagaatcgtttaaccttctttatagattttccaaaagtcgcccaagactag

SEQ ID NO: 1118 - DNA (genomic), 1560 bp, Streptococcus pneumoniae; double-stranded, circular
  misc_feature (B) LOCATION 1...1560
  hypothetical: NO
  anti-sense: NO
agatcggcgaataccagaaaggccaggacagcgaagccgaccaggccatcgagaagatcgcggcgatccgccagtggctgcgccagggtacccacgaaaccagcgattacgcacaggcctgcgcgcagttgcggagcctctgcgcatgagcctggcgctgctgttgcgcgtccgacgcctgcgcctggaccgggccgagcgcgcccagggccgccaattgctacgggttcgcgccgcggcgcaggaacacaccgagcgccaggcggcgcaacgggactaccgcgactggcgactggccgaagagcaacggctgtttctcgcctgccaggcggccatgctcgaccgccggcgcctggaagcctggcagcagcaggtaggactgctgcgggaaaaggaagccggcctggaacaggactgcgccgagaccgcgcagcgcctcgaaggggagcgcgagcgcctgcggcagtgccggcgagaactgctggaacgccagcggcaactggagaagttcgccgaactggagcgccacgtcgacgccgagcgccaggggctgcgcgaacgcagcgaggaaggcgaactggaagaattcacccgccacgagacctggccatgctcaagctgaacgccgtggatacggctccgctcgtgtcgtccgacacccctgccccccttccgccgctgcgcgcgcagcagatcgccttcgaacaggccctgcccgcgcaccgaccgccggcgcccaggccaccgttcgacaagggcgacgaaacgacagaggccgaagagcccgccgcgaacagcgacgcgccgacctcgacgcctctcgccgaccagcccgcggcgcctgccgccgaccggccgccgaccaatnggcaagcccccgtgccagttgccgcggaagcaacgccaacgccaacgccaacgccaacgccaacgccaacgccaacgccaacgccaacagtgttgccgtccggatcggtagcacggcaagcgccggcggtttccgcgcgcgtcgcggcgtccacgcaagcccgggagccggccagcgtttcggcgcctccggtcgacgaaccgccgctggtgccggtgtcctcccacccgcaaatcgcaggtcggacgcatgagcggccacagcccggccccggcttcccggcgaaaaccgcagccgaggtcgcgtccacggcgcaggccagtgtccaggtctcgccgcccgcgccgacagcgggcggcgaaggccgcggagaggagcgtcggcaacccggagaaaccgatccatccgcactgccccccgacgaccaagcgcctgtgccattgcctgccatgcaaacccccggcgaccgcctgctggcacgcctgctggcatcgagcgggagccggccactgccgctggccgatctcgcgcgcctgctagatgccgtgcaggggcgcatccaggtcgccagcgcagccgaaagccatgcggcgcgcctgcaggtgcgactgccccagctcggcgccgtggaggtgcaggtcctgcatggccatggccagttgcaggtcgtcttcaccacgagccgggaggtc

SEQ ID NO: 1119 - DNA (genomic), 1386 bp, Streptococcus pneumoniae; double-stranded, circular
  misc_feature (B) LOCATION 1...1386
  hypothetical: NO
  anti-sense: NO
ataaatcagaatagaaagagaagtatgtataagacaaagtgtttacgagagaagttagtattatttttaaaaattttcttcccaatcctgatctaccaatttgccaattattctgcctcttttgttgatactgcaatgacaggtcaatacaacactatggacttggctggtgtatctatggcaaccagtatctggaatcctttctttacatttctaacagggattgtgtcagccttggtgcctatcattggtcaccatcttggtcgaggcaaaaaggaagaagttgcgtctgatttttaccaatttatttatttggccttgggcctatctgtggtcttgctggggatggtacttttcttggcaccaacaatcttgaatcatattgggttagaagcagcagtagcggcagtagcggttcgctatctttggtttttatctatcgggattatccccttgttgctctttagcgtcattcgttccttgctggattcgctgggcttgaccaaactgtccatgtacctcatgcttttgttactccctctcaatagcggatttaactatctcttgatttacggtgcctttggtgttccagaactgggaggggctggtgctggtttaggaacatccttggcctactgggtcttgcttgggatttctgttctggttttatttaaacaggagaagctcaaagccttacaccttgagaaacgaattccacttaatatggataaaattaaggaaggagttcgtttaggtctgcctattgggggaactgtcttcgcggaagtggctgtcttttcagtggttggcttgattatggctaagttttcgtccttgattatagctagtcaccagtcagctatgaacttttcaagtcttatgtacgcctttcctatgagtatctcatcggctatggctattgtcgtttcctatgaagtgggagccaagcgatttgatgatgcgaaaacctatattggtctaggaagatggactgccctcatttttgcggccttcaccttaaccttcctttacatttttaggggaaatgtggccagtctttatggtaacgacccaaaatttatcgatttgacagcgcgttttttaacttatagtcttttcttccagttagcagatacctttgcggcgccgcttcagggaattttgcgggggtataaggatacagttattcctttttaccttggtttgcttggttattggggcgtagcaatccctgtggctacgctatttgattccctaacagattttggagcttattcttactggatcggcttgattattagtttgattgtgagcggggcgctctaccgttggcgtttaactgtgattatgaagagatttgaatctttagcaaaatccaaacgctaa

SEQ ID NO: 1120 - DNA (genomic), 1029 bp, Streptococcus pneumoniae; double-stranded, circular
  misc_feature (B) LOCATION 1...1029
  hypothetical: NO
  anti-sense: NO
aagtaccagaaaacgagacggtcagccaacgcgtctgtgaagatggtcctgttttccgcacaggaacagttgtattataaggagaaaattatgactacaaatcgattacaagtttctctacctggtttggatttgaaaaatccgattattccagcatcaggctgttttggctttggacaaaagtatgccaagtactatgatttagaccttttaggttctattatgatcaaggcgacaacccttgaaccacgttttgggaatccaactccaagagtggcagagacgcctgctggtatgctcaatgcaattggcttgcaaaatcctggtttagaggttgttttggctgaaaagctaccttggctggaaagagaatatccaaatcttcctattattgccaatgtagctggtttttcaaaacaagagtatgcagctgtttctcatgggatttccaaggcaactaatgtaaaagctatcgagctcaatatttcttgtcccaatgttgaccactgtaatcatggacttttgattggtcaagatccagatttggcttatgatgtggtgaaagcagctgtggaagcctcagaagtgccagtttatgtcaaattaaccccgagtgtgaccgatatcgttactgtcgcaaaagctgcagaagatgcgggagcaagtggcttgaccatgatcaatactctggttggaatgcgctttgacctcaaaaccagaaaaccaatcttggccaatggaacaggtggaatgtcaggtccagcagtctttccagtagccctcaaactcatccgccaagtagcccaaacaacagacctgcctatcattggaatggggggagtggattcgactgaagctgccctagaaatgtatctggctggggcatctgctatcggagttggaacagctaactttaccaatccttatgcctgccctgacatcatcgaaaatttaccaaaagtcatggataaatacggtattagcagtctggaagaactccgtcaggaagtaaaagagtctctgaggtaa

SEQ ID NO: 1121 - DNA (genomic), 219 bp, Streptococcus pneumoniae; double-stranded, circular
  misc_feature (B) LOCATION 1...219
  hypothetical: NO
  anti-sense: NO
tttnnccagaaaagtgtggatacggcatcacgaaatccgcttattggcctggacaatgcaatatggcataattcaagtaccttaaatattccgactaatattgatttgacctctattcctccatacacaccagagatgaacccattgaacaagtgtggaaagagattcgtaaacgtggatttaagaataaagcctttcgaactttggaagatatcatga

SEQ ID NO: 1122 - DNA (genomic), 1305 bp, Streptococcus pneumoniae; double-stranded, circular
  misc_feature (B) LOCATION 1...1305
  hypothetical: NO
  anti-sense: NO
tggttacagaagtctagaaagaagaatgtaatgaacgaaatcaaatgttccaactgtgggggagtctntacagtaaatgaaagccagtattctgaacttttgtcccaagtgagaacggcagagtttgataaggaactacacgataggatgaggcaggaactggccttggctgagcaaaaggctatgaatgagcaacagactaaactggctcagaaggatcaagaaattgcgcaattgcagagtcaaatccaaaactttgatacagaaaaagaattggccaagaaagaagttgaacagacaagccatcaggccttattggctaaggacaaggaagtacaggccttggaaaaccagttggcgaccttgcgtttggagcatgaaaatcaattgcaaaagaccctttctgacctagaaaaagaacgcaatcaggtcaaaaatcagctcctactgcaagaaaaggaaaatgagttgtctttggcttctgttaagcaaaactacgaagcccagctcaaagcagccagtgaacaagtcgagttttataagaattttaaggctcaacaatctacaaaagcgattggggaaagcctagaacagtatgcagagagtgagtttaacaaggttcgtagtttcgcctttccaaatgcttactttgagaaggataacaaggtctcttcgcgtgggtctaaaggggactttatcttccgtgagtgtgatgaaaatggagttgaaatcatttctatcatgtttgagatgaaaaacgaagcggacggaacagagaagaagcacaagaatgcagatttttacaaggaattggacaaggaccgtcgggagaagaactgtgagtatgccgttttggtgaccatgcttgaggctgataatgactactttaacacagggattgttgacgtcagtcacgagtatgaaaaaatgtatgttgttcgtcctcaattctttatccaattgattggtctcttacgtaatgcggcgctaaattccctaaaatacaagcaggagttggccttggttcgcgagcaaaatattgacattacgcattttgaggaagacttggatgcctttaagctagcttttgctaagaactataattcagcttcgactaactttggaaaagctattgatgaaatcgacaaggccatcaaacgcatggaagaggttaagaaattcctgactacatctgaaaaccaactccgtctagctaacaacaaattggaagatgtctctgttaaaaaattgacccggaaaaatccaacaatgaaagcgaagttcgaagcactgaagggggagtag

SEQ ID NO: 1123 - DNA (genomic), 660 bp, Streptococcus pneumoniae; double-stranded, circular
  misc_feature (B) LOCATION 1...660
  hypothetical: NO
  anti-sense: NO
aaaaataagaagatagttgcaataaataacggaattaatgtatcaaatagcgatttagatgtagtaggtgttcaagactttaaaaaagaattttgtattccaaataacaaaaaaatcatttgttatgttggaaggttggatccagaaaaaaggccggatagattccttgaatttgcagaaaaattatttttagtcagagaagatgtgatttttattatggctggaaatggtagtatgtgggctgctttgaaagaaaaaatttgccatttgaaatgtagagataatttcaggttacttggtgaaatctatccagctactatagtttaccaaatatcggatttattgtatattccttatgatacagaaggaatacctatgtgtgttttagagtcaatgtcacaaggaactccggttttagctagtaatgttggcgggttaagtgaaattattgaacatagggttgatggatttttatttgagaaggaagatgttgagggagtgtgtgcttgtgctaattttttactcaatgattctgagtatttgaaatatataggtgagaatagtaaatcaaaaataagaaaacatttttctgtgcaaaaaatgtttgtagaaaccatgagagtatatgatgaattattagagaagagtagtcatggatag

SEQ ID NO: 1124 - DNA (genomic), 309 bp, Streptococcus pneumoniae; double-stranded, circular
  misc_feature (B) LOCATION 1...309
  hypothetical: NO
  anti-sense: NO
atgaataagaaaaaaatgattttaacaagtctagccagcgtcgctatcttaggggctggttttgttacgtctcagcctactgttgtaagagcagaagaatctcccgtagccagtcagtctaaagctgagaaagactatgatgcagcagtgaaaaatgctacagctgcaaaaaaagcagcagaagatgctcaaagagctttagatgaagcaaaagctgcgcagaaaaaatatgacgaggatcaaaagaaaactgaggagaaagcgaaagaagtaaaaaaagcttcggaagagaacaagctgcaaatctga

SEQ ID NO: 1125 - DNA (genomic), 6372 bp, Streptococcus pneumoniae; double-stranded, circular
  misc_feature (B) LOCATION 1...6372
  hypothetical: NO
  anti-sense: NO
agaggtaagaaaatggacgctttaactagacgacaatttgacagagccatgtttgccaaggaaaggacgctggctattcgtgttggtgaatatgcttcacgggatatcaaagaggctagttttgagtatggctacatcaagggcgatacttataagcctggtggaacctgcgctggtagcggtaaaattacctttaccagtatcattaccacgttcaataagctggataccctgcaccctgagattggtctactggttggggatacctaccagtgggtcaagatgggggaatacttcatcaacgatattgagattgaccgaaaccgcaacacaaccacacttgaacttatggacggtatgtttaagctcaatcgtgagtacgtgacggatttgcatttcccagctgaagtacgagaggttattcaggaaatctgcctgaaaacaggcattgagttagcgaatgactatttcggaatcagcgctatgcgttaccatatcgagcaagttcctgaaggtaagaaactttcgttcagggatatgctgagcgctatgactcagatgattgggatgtcttgcttcttcaaccgagaaggaaagatggaaatccgtgatttgaccgagtccaacatcacgattaacgctgacagttacttcttgcatggattgaccaagagtgaaatcgagtatcagatagctggtatcacttgtaagacggataagaagtctctgacggtcggtatgacaacaggtcggtctttggaacttgataatgtcttcataacccagagcgctttaaatgacttgtattacaaactgaaaaacctaacttactatccgtataatctcaactaccaaggacatttgttacttgaggttgggcagtgggtaaccattcagaccaacaagaaagagacttttaaagttcctgtcttaagtcagagctttatctttaaaggtggtctgagaggtcgtatcagtgcagatagtaaggctggaaacgatacccagtattcttacgagggtacgattaccaagcagattaagcaacaagatggctttgaagcgaaaatccaagcgcagattgaagcagcagataaagattttgaccaaaaggtcgacaaaatcaaaaaagactttaacgatcaagtagaactggccaaagccagagctgaagaagtcaagagagaactgtctgacactatcaatcagcgctttaatagctttgacaacgggccattgaaagaagctaagcgcaaggctgaggaagctttgcgaaatgctggcgcaagtagttctcttgctcaggaatccaagcggattgggctggattctgttgctagacttgaagcgtttaagtcgcagactacgagcgcacaaacggctctgtcgggtgacttggatgttctaaaacgaactatcgcaaacgatattcgaccgaagcaagcacaggctgaagctgagattgccaagcaagttgaagcacttagccggactaaaaatgaactggatggcgcaagtaccctgcttgcacaggaagctaagcggattgagctggattctgttgctagacttgaagcgtttaagtcgcagactacgagcgcacaaacggctctgtcaggtgacttggatgttctaaaacgaactatcgcaaacgatattcgaccgaagcaagcacaggctgaagctgagattgccaagcaagttgaagcacttagccggactaaaaatgaactggctggcgtgaagtcagcgcaagcgacgtatgaggagacgacgactcgtagactgtcagaactgaccaacttggccaatggtaaagccagcaagtcagaactcacgcaaacagctgaggagctggctagtcggattgcgagtgtgcaggcaggtagttcacggaattacttcagaaattcacgttcaagaacgttcacaacaggaggtcaagcggtatacgactatcgaacattcatagttcctgatttctggaagaacagtgacaggttcaagcgtgattatgttcgcatatcttttgatgtgactttccctgtcgccctagtaaatgacatgcctgctatggtgcattttagtgctcatccatggtatgcctacagaaacttaatttttaaaggtggaactgtcgaacgccaacattttgagtttacgattgacttgtctagttcttctgagacctatcagactaataatgtgttcattcgttttggcactaattatggatttcctgctggtctgcaggtcgtcattgagaacgctatgttatcggttggtaattattttccagcctatcaaccagcgtacgaagaccaagacgaacgtgtctcagcggtcgaatccaactttaaacagcgtgctgattcacttgacgctggtgtaagccgtctgactgaaggccttagaaccaaagtggatatcagctcactcaatgtgactgctgaaaatatccggcaatctgtgaagagtcttgagacagacacgcagaacaaactaaatcagaagttgagtcaggctgaatttgaggtgcgagctggctctatccgtcaggaaatcctgaacgcaaccaaagataaagccagcaagtcagaactcacgcagacagctgaggagctagctagtaagatagcgagtgtgcacttagggcgcagaaatctgctgaaaggcacaaaagagcttgcgagatacaagccggttagtgaatataatggttttaaagttatcagaacagtcgcaggagcaactagatatcaggatagctatgtggaaagaaccgttataccaacggctgggacagagtatatagctatcttttatgcacgagccagtgaaaatgactatcctgtgcgctgtcatttttacaatcctaacacggttgtatcatcagaaaacagcagcggatataagtcaaggtcgtcagatggcttgtctattatccgtctctcgacagactggcagttgtgctgggttaaatggacccaaaccgcaacagatcaagccaagacggtcatcattggccgccatggccctcaagtaggcggtaaagagggggtatgggttgaaatctgcgcccctgccatttttgagggaaatcttgcaggtgactggtcaccagcatacgaagaccaagacgaacgtgtctcagtagtcgaatccaactttaagcagcgtgctgattcacttgacgctggtgtaagccgtctgactgaaggccttagaaccaaagccgatatcagctcactcaatgtgactgctgaaaatatccggcaatctgtgaagagtcttgagacagacacgcagaacaaactaaatcagaagttgagtcaggctgaatttgaggtgcgagctggctctatccgtcaggaaatcctgaacgcaaccaaggataaagcagataagactcttgtcgtgactgaagctgggaaattgcgagaagaattttcaaaaatgaaggtgggaggccggaatctatggataaaatccaagacggttggagctgtaattgaaaaattacctgaaaaccacgtcacaggtcaaaaagaatgctataggctagagaacaactctactttaacgttcaaccttgaaccagatttcagctcaaggttgtaccaaaaagttacttttagcgcttggatcaagtacgaaaatgtagtccaaggtcgaaatttttggaatgtatttaattgcttcaaacattatctttttagaaaaaatagtgagaccggagtacagagtggtccagattatgctacgcttggtatgtataaaggttcggcagattggaaatatattacattcacttatgactactctgaaaaaacaaattttgatcaattgaagacatcattgcgattcaatcttgaaggtgctacaagcggtacagcttgggtaacaggaatcaaggttgaaatcggtagtgtggcgacggactggaatcctgcgcctgaggacgctgatggtctcatcactgaggctaaggctacctttgagcggacagctcagggcttgcgaaccgacttatcagctattcaggaatatgtaaataaagacggtcagcgacaggaagccctacagcgctatactcgtgaggagagcgcgagacaagcgacagcagtccgtgagctggtcaatcgtgatttcgttggtaaggctacttatcaagaagatgttaagggtatcaatcagaggattgaagctgttaaaactagtgcgaataaagacatcgctagtcaaatcgctagctatcgtcaatctgtagatggtaagttcacggatatttcaagtcagataactacttataagcaagatgtgggcggtcaaatcagtggtctatcaaatagacttacaagcagtgagcaaggaaccactactcagatttcaaatctttcaaatcggataaacagtaataaacaaggcacagataatcagatttcaaatttaaagactcaggtcgctacaaacaaggataatgctgaacgacaaatgggtagaatatctgatcaggtttctgcaaacaaagcgaatgctgatagtcaatttgcgaatgtgaccaatcaactagcgcgaaaagtagagactactgacttccagcgtgttaaggaaaccagtaaactttacgagcggattttgggcaatactgaaaatggaattgcggataaggttgctcgcatggctctgactaatcaactgtttcaggttgaggttgggaaatatagtgtaagcggccctaacctcattaagaatagtgattttaaaaatgctacgaatgaatggggctcaactcaaaatttaggaagattggttaagcatagcttttatcacaacgggcagaaagaccttatgcgtttaagtaatgcaactaaaaacgaaaactttttgtatagtcaccgttttaatcttgaacgaaatactgactatgtactgaattttagaggatttaacaacagtgctctcgcaagctatgatgtttatattttgggacgaagagcaggcgagagcgatggattcacaatcgttaagaaagttgttagcagcaagaaactatctacctctagatgcgaagatgtctcagtaacttttaattccggagaaatggataatgcttacattcgttttgataacaatggctcatcatcaggaacagctgatttgtatattacagaagttgacttgtacaaaggttataaacctagaacatggcaaccacatccagaagatgcagtcgcagatgcgaataagaagcttgaagcaacgcaaacaaaaatgactcaactagctggctcatgggtagttgaaaacatcaactcggctggagatatcatctctggaatcaatcttggcgccaatggacataaccgcttagttgggaaattgacccacatcactggagagaccctgattgacagagcagtcatcaagtctgccatggttgataagctcaaaacggccaattttgaagctggttcggtcacgactacgatattagaagctgaagcggtaactgctgagaagttgaaagttgacaatgcgcttattaaaaaattaactgcaactgatgcttttattgaccaactgatatctaaacgtatcttctctactaaggttgagtccgtcatttctagctcaaccttcctagaagcctatcaaggccgaatcggtggattcacacttggtcaatttgaccagggtggcggtcgctggatttcaggtgtcaatcagttctctgttggtatggggaatggtgccgggtatggagtccggacagccttctgggcgaactggggaaataattggaactatgccggacctaaagcatggaacgtcaatactgatgggaaaatgtactgtaggaatgaagtcggtttttatgatcaagtggatttttcgaattcatcgagagcaaacttctatgggaatactactttttctcgttctcctgtgttttcaaatggtatcgaacttggaagtaaagatgtgcttggtgatggttggaatcccaaaggcggaaggaatgcggttgtttggtggaatcaggtcggtagcggtagcttgaagtattggatggaacaaaaatcagatagacgcttaaaagagaacatcacagatacagctgtgaaagccttggacaaaatcaacagattaagaatggttgcatttgatttcatcgaaaataagaaacatgaggagattggtctaatagctcaagaggctgaaaccatcgttccaaaaattgtctcacgagatcctgagaatccagatggctatctgcatatcgactataccgctttagttccttacttaatcaaggctattcaagaattaaatcaaaaaatagaaaaaatggagaaaacaatagcatga

SEQ ID NO: 1126 - DNA (genomic), 981 bp, Streptococcus pneumoniae; double-stranded, circular
  misc_feature (B) LOCATION 1...981
  hypothetical: NO
  anti-sense: NO
aaaggcaagaagatgtcaactttagataaaaatcttttgctagaaatgttccgtaagatggaagaaatccgtcgcatggacttaaaaattgcacaattagtaaagaaagggaaagtgccaggaatgacgcacttttctgttggtgaagaggcagctaacgtgggggctatgttagctctcaatccagatgatctgattacctcaaaccaccgtggacacgggcaagctattgctaaagggattgacctcaacggaatgatggctgaaatccttggtaaatacactggaacctgtaaagggaaaggtggatctatgcatatcgctgaccttgatgctgggaaccttggtgccaatggtatcgtaggtggtggtatggggatcgctgtcggtgcagccctcagtcagcaaatgcaaaataccggtaaaatcgttgtttgcttctttggagatggtgcgaccaatgaaggtgttttccacgaagcagtgaacatggcttctatctggaacctgccagtcattttctattgcattaacaacggttacggtatctctgcggatatcaagaaaatgaccaatatagaacatatccatcaacgtagcgccgcttatggaattcctggaatgttcatcgaagacggtaacaatgtcatcgatgtctatgaaggatttcagaaagctgtagaccatgttcgcagtggcaatggtccagtcttgattgaaagtgtaacttatcgctggcttggtcactcatcatctgaccctggtaaatatcgtacgcgtgaagaagtggaattgtggaaacaaaaagatccaatcgaaaacctccgcaattaccttattgaaaataacattgcaagtgccgaagaattggaagaaatccaagcgcaagtaaaggaagcagtagaagcttctgttaaatttgcagaggaaagcccattcccatcgcttgaatcagcctttgaagatatttacgcagactaa

SEQ ID NO: 1127 - DNA (genomic), 951 bp, Streptococcus pneumoniae; double-stranded, circular
  misc_feature (B) LOCATION 1...951
  hypothetical: NO
  anti-sense: NO
atgggcaagaaaagatgggcaagaaatggatctgagtcaaacgatgcttcttatgctcaagtagtgagtctttatgatgatacaagtatctctgttagtaataatgagacggacaaagtgttgactggatccctctatactgaaacaaatgaacagggattaacgattccaagcagtttactaaaaaattggaatgaacagacaggaaaaaatttgacaactaatgatcttattggcaaatcagtctcagccagcattgtagaaagtgctgccgaaactagtaagattgctcaatttcaaacgaagattgtacgtgtaatcaatgatgaagatgacatggaggacagcaacagtttcatgctgtctcatcaaatggaaacgattttgaaagaggctggatttacgaaagctgtatcttattttatcttggaactcaaagatccatcacagacaaaagtagtaacagaagaattacagaaaaataagaagtatactgtgctttctcaacagagagttcttgatattgtgattacctttattcgtgttattcagggattattgattgtgctttcatcacaagctattgtggtagcagcggttatgattggtatcattatttacatcaatatcatgcaacgttccaaggaaataggtgtcatgaaagcagttggttatcagaatcgtggtgtcaaaggaatttttatttacgaggctatctggattgtaggcatcgccttgctgctggcatttttggttgcacaaggggtgggaagtttggcgaatgcgattgtaagtcacttttacccatccatcactaaggtttttgaattaaatcttttatctgttttaggaactctagttttcgctctattacttggttatgtctcagcctacttcccggcgcgtaagattagtaaaatggatcctgtagaatcgttacgctatgaataa

SEQ ID NO: 1128 - DNA (genomic), 387 bp, Streptococcus pneumoniae; double-stranded, circular
  misc_feature (B) LOCATION 1...387
  hypothetical: NO
  anti-sense: NO
cctctaaagaaaacaactggaacttgccatttgcagatatcgcatctatctggcgtgatggctgtatcatcccgtcctcgtttcttgcaaaagattacagatgcctacaaccgcgatgcagatcttgcccaccttcttttggacgagtacttcttggatgttactgctaagtatcaacaagcagtgcgtgatatcgtagctcttgcggttcaagctggtgtgccagtgccaactttctcagcagctattacttactttgatagctaccgttcagctgaccttccggctaacttgatccaagcacaacgtgactactttggtgctcacacttaccaacgtaaagacaaagaaggaaccttccactactcttggtatgacgaaaaataa

SEQ ID NO: 1129 - DNA (genomic), 1515 bp, Streptococcus pneumoniae; double-stranded, circular
  misc_feature (B) LOCATION 1...1515
  hypothetical: NO
  anti-sense: NO
aaactaaagaaaagggaagatatgattacaggcgaattaaaaaataaaatcgatcagctgtgggaaattctttggacagaaggaaacgcaaatcctttaacaaatattgaacagttgacttatctcttatttatgaaagatttggatagtgtcgagcttggacgtgaaagtgatgctgaatttctagggattccttatgagggagtttttccaaaagataaacctgaataccgttggtcaacttttaaaaatataggagatgctcaggaagtttatcgtttaatgactcaggagatttttccgtttattaaaaatctcaagggggatacagatgatacagccttttcacgatatatgcgagaagctatttttcaaataaataaacctgctacgcttcaaaaggcaatttctatcttagatgtttttccaactaggggattagatgtagattttgataatgacaaacaaagtattactgatatcggagatatctatgaatatctgttatcaaaattgtcgaccgcaggtaaaaatggacagttccgtacacctcgtcacatcatcgatatgatggttgagttgatgcaaccgactatcaaagatatcatctcagatcccgctatgggttctgctggcttcttagtatctgctagccgttacttaaagcgtaagaaagatgaatgggaaaccaatacagataatatcaatcattttcataatcagatgtttcatggaaatgatacggatacgactatgttgagacttggggcgatgaacatgatgctacatggagtagaaaatccacaaatcagttaccttgactcgctgtctcaagataatgaagaagctgataaatatactttggttttagcaaatcctccttttaagggctcacttgactacaattcaacctctaatgaccttcttgcaaccgtaaaaaccaaaaaaacagaattactctttctttctcttttcttgcgaactttaaaaccaggtggacgagcagcagttatcgtacctgatggtgtcctttttggttcgtctaaagctcataaaggaattcgtcaggaaattgtagagaatcataagcttgatgctgtaatctcaatgcctagtggtgtgttcaagccttatgctggagtttcaactgccattctcatctttacaaaaactggtaatggtggtactgacaaagtctggttttacgatatgaaagcggatggtttaagtttggatgataagcgacaaccgattagagacaatgatattccagatattatcgaacgctttcatcatcttgaaaaagaagcagaacgtcagagaacggatcaatctttctttgttccagttgctgagataaaggaaaatgattatgatttgtctatcaataaatataaagagattgagtatgaaaaagttgagtatgaaccaacagaagtcatattaaagaaaatcaatgatttagaaaaagaaattcaagctggcttggctgaattggaaaaattactcaagtag

SEQ ID NO: 1130 - DNA (genomic), 2145 bp, Streptococcus pneumoniae; double-stranded, circular
  misc_feature (B) LOCATION 1...2145
  hypothetical: NO
  anti-sense: NO
ttgctaaagaaaactgtcgaaaaagccgttgcagacaacgttaaagacagtatcgatgttccagcagcctacctagaaaaagccaagggtgaaggtccattcacagcaggtgtcaaccatgtgattccatacgaactcttcgcaggtgatggcatgttgactcgtctcttgctcaaggcatctgacaaggcaccatggtcagataacggcgacgctaaaaacccagccctatctccactaggtgaaaacgtgaagaccaaaggtcaatacttctatcaagtagccttggacggaaatgtagctggcaaagaaaaacaagcgctcattgaccagttccgagcaaacggtactcaaacttacagcgctacagtcaatgtctatggtaacaaagacggtaaaccagacttggacaacatcgtagcaactaaaaaagtcactattaacataaacggtttaatttctaaagaaacagttcaaaaagccgttgcagacaacgttaaggacagtatcgatgttccagcagcctacttagaaaaagccaagggtgaaggtccattcacagcaggtgtcaaccatgtgattccatacgaactcttcgcaggtgatggtatgttgactcgtctcttgctcaaggcatctgacaaggcaccatggtcagataacggtgacgctaaaaacccagctctatctccactaggtgaaaacgtgaagaccaaaggtcaatacttctatcaagtagccttggacggaaatgtagctggcaaagaaaaacaagcgctcattgaccagttccgagcaaacggtactcaaacttacagcgctacagtcaatgtctatggtaacaaagacggtaaaccagatttggacaacatcgtagcaactaaaaaagtcactattaacataaacggtttaatttctaaagaaacagttcaaaaagccgttgcagacaacgttaaggacagtatcgatgttccagcagcctacctagaaaaggccaagggtgaaggtccattcacagcaggtgtcaaccatgtgattccatacgaactcttcgcaggtgatggtatgttgactcgtctcttgctcaaggcatctgacaaggcaccatggtcagataacggcgacgctaaaaacccagccctatctccactaggtgaaaacgtgaagaccaaaggtcaatacttctatcaagtagccttggacggaaatgtagctggcaaagaaaaacaagcgctcattgaccagttccgagcaaacggtactcaaacttacagcgctacagtcaatgtctatggtaacaaagacggtaaaccagacttggacaacatcgtagcaactaaaaaagtcactattaacataaacggtttaatttctaaagaaacagttcaaaaagccgttgcagacaacgttaaagacagtattgatgttccagcagcctacctagaaaaagccaagggtgaaggtccattcacagcaggtgtcaaccatgtgattccatacgaactcttcgcaggtgatggcatgttgactcgtctcttgctcaaggcatctgacaaggcaccatggtcagataacggcgacgctaaaaacccagccctatctccactaggtgaaaacgtgaagaccaaaggtcaatacttctatcaattagccttggacggaaatgtagctggcaaagaaaaacaagcgctcattgaccagttccgagcaaatggtactcaaacttacagcgctacagtcaatgtctatggtaacaaagacggtaaaccagacttggacaacatcgtagcaactaaaaaagtcactattaagataaatgttaaagaaacatcagacacagcaaatggttcattatcaccttctaactctggttctggcgtgactccgatgaatcacaatcatgctacaggtactacagatagcatgcctgctgacaccatgacaagttctaccaacacgatggcaggtgaaaacatggctgcttctgctaacaagatgtctgatacgatgatgtcagaggataaagctatgctaccaaatactggtgagactcaaacatcaatggcaagtattggtttccttgggcttgcgcttgcaggtttactcggtggtctaggtttgaaaaacaaaaaagaagaaaactaa

SEQ ID NO: 1131 - DNA (genomic), 393 bp, Streptococcus pneumoniae; double-stranded, circular
  misc_feature (B) LOCATION 1...393
  hypothetical: NO
  anti-sense: NO
agttcaaagaatacttcaacaagtaatgatgagaagacagtagcaacatccaatagttcaaaagaaacaatcactttcgatacaccggttgtaacagacgatgcgattgaatcaatacgcacttatgcagattatatagatctttataaaaatatttttgatgattattttactaaagctgaggaaggtttcaaaggcacagctatggaaaataatgactcgtttactaaactaaaagagtcaactcaaaaattattcgatgcgcagaaaaaaaggttaaataatgaagatagaatagaaacaaccaaaaacaatgtgattgccaaacattgtcaaacagtcctttcctttttggttttgactagcttttttgtgaaaaattgtgtaaaatag

SEQ ID NO: 1132 - DNA (genomic), 477 bp, Streptococcus pneumoniae; double-stranded, circular
  misc_feature (B) LOCATION 1...477
  hypothetical: NO
  anti-sense: NO
acacaaaagaaaagtttttggtataataagagtatgtacacaaaaaatgaagaagagttgcaagccttaggggagcgtttgggccatctattagcaaagaatgatgttttaatcttaactggagaactgggtgcaggtaaaacgacctttactaaaggacttgcaaaaggattacagatttctcaaatgattaaaagtcccacctatactatcgtgagagagtatgaaggtcgacttccactttatcacctagatgtttatcgtattgaaggagatgctgattctatcgacttggatgagtttatctttggtggcggcgtgactgttattgagtggggaaatctcttaggagatgccttgccagatgcttatttagaattggaaattctaaaagaagcagatggacgccgtttaaattttcaggcaaagggtttgcgtgctgagaaattgttagaggagcttcaatatggagtatga

SEQ ID NO: 1133 - DNA (genomic), 1722 bp, Streptococcus pneumoniae; double-stranded, circular
  misc_feature (B) LOCATION 1...1722
  hypothetical: NO
  anti-sense: NO
aataaaaagaattgctgtgatatcaatagatttgggggattttttaatatggtactggataaggcaagttgtgatttgcttcaatatttgatggatcaagaaacgtccaaaacgattatggcgatttcgaaagatttgaaagagtcaagaaggaaaatttattatcacattgacaaaatcaatgctgctctggttgacgaggcgcttcacatcattagtattccacgaattggtattcacttaacggaagagcagagagatgcttgttgtaaactattatcggaagtagattcgtacgattatatcatgagtgcgcatgaacgtatgatgataatgttactatggataggtatttctaaagaacgtattacgattgaaaaattgatagagttaacagaggtatctaggaatactgttctcaatgatttgaatagcattcgttatcaactaactttggaacaatatcaggtgaccttgcaagtgagcaagtcacagggataccaccttcatgcccaccctcttaataaaattcagtatcttcaatcgcttctatatcatatttttatggaagaaaatgccacttttgtatctattttagaagataagatgaaagagaggttagatgatgagtgtttgctttctgttgaaatgaaccaattttttaaggaacaggttcctttagttgaacaagatttagggaagaaaataaaccatcatgaaataacttttatgttgcaggttctaccttatttgctgttaagctgtcataatgttgaacagtatcaagaaagacatcaggatatagagaaagaattttctttgataagaaaaagaatagagtatcaggtgtctaagaaattaggagaacggttgtttcaaaagtttgaaatttctttgtcaggacttgaagtttctcttgtagctgttctcctcctctcctatcgtaaagatttggatattcatgcagaaagtgatgattttcgtcaattaaaacttgctttagaagaatttatctggtattttgaatcacaaatccgaatggagattgagaacaaggatgatttgttacgaaatttgatgatccactgtaaagccttgttatttagaaagacttacggtattttttctaaaaatcctctaacaaaacaaattcgatccaagtatggagaattatttttagtcactagaaaatctgcggaaattttagaaggagcatggtttattcggctaacagacgatgatattgcctatttgacgattcatattggaggatttttaaagtatacaccatcgtctcaaaaaaatatgaaaaaagtttatctcgtttgtgatgaaggtgttgcggtttcgagacttttgctgaaacaatgcaaactttattttccaaatgagcaaattgacactgtatttacaacagaacaatttaagagtgtggaagatattgcacaagttgatgtagtgattactactaatgatgatttggatagcagatttccgattttaagggttaatcctatccttgaagcagaagatattttgaaaatgctagactatcttaaacacaatatatttcgtaataagagcaaaagtttcagtgaaaatctttctagtcttatttcgtcttatattgtagacagcaagttggctagtaagttccaagaagaggttcaaacacttataaatcaagaaatagtagttcaagcttttttggaagatatttga

SEQ ID NO: 1134 - DNA (genomic), 282 bp, Streptococcus pneumoniae; double-stranded, circular
  misc_feature (B) LOCATION 1...282
  hypothetical: NO
  anti-sense: NO
agtaaaaagaatttcagtgatagcttgcgatactatccttatagaagcctaaaagaaaggaacagaaaaatggaagaatggaaagaaagatttaaaaaagaatactacgaattgaaagaacgattccagaagttagatatgatgattgggaaatacgaaaaagggcaactagagtttgaatctaaatgtccgattgattcgttaaaaggtcagcgttcaaccatgtggaattatttaagaattctagaacaacgtgcaaaaattgaagaaattaaactataa

SEQ ID NO: 1135 - DNA (genomic), 912 bp, Streptococcus pneumoniae; double-stranded, circular
  misc_feature (B) LOCATION 1...912
  hypothetical: NO
  anti-sense: NO
ttacgaaagaaagaggaaagaaaaattatgcgcgctaagaaattagataaacttgcaacagctgtcctctatacgattgctagcatcattgtgacaatcttggcttccttgattctctatatcttggttcggggcttgccccatatctcttggtctttcttgactggaaggtcttctgcttttcaagcaggtggtgggattggcattcagctttacaattcctttttcctattggtcattaccttgattatttctgtacctctttctatgggagctgggatttacttggctgaatatgctaaaaaaggtcctgttaccaactttgtgcggacttgtattgaaatcttgtcctctttaccatcagtggtggtgggtctctttggttacttgatctttgtagtccagtttgagtatggattttcaatcatttcaggtgccttggccttgacagtctttaacttgcctcagatgacgcgtaatgtagaggatagtttgaaacacgttcaccatacccaacgtgaggctggtctggctcttgggatttctcgctgggagacagtggttcatgttgttattccagaagcgcttccaggtattgtaacgggtgtcgtcttggcatctggtcgtatctttggcgaagctgcagctctgatctatacagcagggcaatcggcgccagctcttgactggtctaactggaatatcctcagtgtgactagccccatctctatcttccgtcaagcagaaaccttggctgtccatatctggaaagtcaatagtgaaggcactattccagatggaaccattgtatcagcaggttctgccgctgtgctcctgatctttatcctgatttttaactttggagctcgtaagttcggaagctatctacacaagaaattaaccgctgcctaa

SEQ ID NO: 1136 - DNA (genomic), 375 bp, Streptococcus pneumoniae; double-stranded, circular
  misc_feature (B) LOCATION 1...375
  hypothetical: NO
  anti-sense: NO
gttttgaagaaaaactttcgtgtaaaaagagagaaagattttaaggcgattttcaaggaggggacaagttttgctaatcgcaaatttgtgatctaccaattagaaaaccagaaaaaccattttcgagtaggtctatcagttagcaaaaaactggggaatgccgtcactagaaatcaaattaagcgacggattcggcatattatccagaatgcaaaagggagtctggtagaagatgtcgactttgttgtcattgctcgaaaaggagtcgaagccttgggatacgcagagatggagaaaaatctactccacgtattaaaattatcaaagatttaccaggaaggaaatgggagtgaaaaagaaactaaagttgactag

SEQ ID NO: 1137 - DNA (genomic), 750 bp, Streptococcus pneumoniae; double-stranded, circular
  misc_feature (B) LOCATION 1...750
  hypothetical: NO
  anti-sense: NO
ctgttgaagaagagattgatttgtcagatattgaaattttgtaagagggtaacgatgtcaagaattgaattttcaccatctttgatgaccatggatttggacaaattcaaagagcagattacttttttgaatgataaagtagcatcttatcatatcgatattatggatggccattttgttcccaatattaccttgtctccttggttcattcaagaagttcaaaaaattagtgacacacctttatcagttcatctgatggtcacagacccaaccttttgggtagatcaagttctcgatttacaatgtgagtatatttgtattcatgctgaagttctgaatggtcttgcttttcgtttgattgataaaattcatgatgcaggtctaaaggctggtgttgtccttaatcctgaaacacctgtttctacaatctttccctacattgatttacttgacaaagtaactattatgactgtagatccaggttttgcaggacaacgctttttggagtctaccttgtataaaatccaagaactccgtcagcttagagttcagaatggttatcactacatcattgagatggatggttcttcgagtcgtaagactttcaaacaaattgatgtggcaggaccagatatttatgttataggtcgcagtggattatttggtttggatgacgatattgccaaagcctgggatatctgttctagagattacgaagaaatgaccggaaaaacaatgccaatcaaataa

SEQ ID NO: 1138 - DNA (genomic), 465 bp, Streptococcus pneumoniae; double-stranded, circular
  misc_feature (B) LOCATION 1...465
  hypothetical: NO
  anti-sense: NO
accatgaagaaaatgaagtattacgaagaaacaagcgctttgctacatgagttttctgaggagaatcaaaagtattttgaggagttgtgggaaagttttaatcttgctggatttctctatgatgaagactatctcagagagcagatctatttgatgatgctagatttctcagaagcagaacgagatggcatgagtgcagaggattatctaggtaagaatcctaaaaaaataatgaaagagattctcaagggagcacctcgcagttctatcaaagagtcccttttgacgccaattcttgtcctggtggtattacgttattatcaactactaagtgatttttctaaaggtcctctcttaacagtcaatttgctcacatttttagggcaacttcttatttttctgattggatttggacttgtggccacaattttacgaagaagtttagtcaagattctcctaaaatga

SEQ ID NO: 1139 - DNA (genomic), 297 bp, Streptococcus pneumoniae; double-stranded, circular
  misc_feature (B) LOCATION 1...297
  hypothetical: NO
  anti-sense: NO
gagatgaagaaaacaagctctaaactctttgtagtgccctacatgctttggattgccctctttgtattggcacccttggtcttgattttcggacaatcctttttcaacattgaaggccagtttagtttagaaaattataaatcttactttgcgtcacaacacttgacctacctcataaatgagtttcaactcagtgctttatgcagggattgtgacctttgtgacctgtcttatcagctatccaacagccctctttttgacccgtctcaagcacgcgtcaactctggctcatgctga

SEQ ID NO: 1140 - DNA (genomic), 1407 bp, Streptococcus pneumoniae; double-stranded, circular
  misc_feature (B) LOCATION 1...1407
  hypothetical: NO
  anti-sense: NO
aggatgaagaatcaggagtattgggcgaagaggaaagccaatctgatttaccagcagatggacaaggccgaaaagcaggcagaccagttcgataaggtctatcaggaagctaagacttacttggataaggaaatcaataagattttcgataaattccaacgtgattatggtctaagtcaggtagaagctagacaagtcttgaagaacatgaaagacaagaaaaatctgaatgaacttcgtaaagtacttgaagcgagaccgaatgacccgaacatccaaagattactagctgacttagacagcccagcttattctttccgcatgaagcgcctagagcgtttgagcgacgatttagatcgtatgcgtgaatctatctatcattcggagaagacaggctcagatgccttttatagcgacctgatgaaggatagttactacaaggctacctttgacctacaacagcagacaggactagcatatggcttttctgggcttcctgagaacgagattaaacatctacagtcttttagttgggtaggagatggaagtacgtactcaacagacatctggaagaatacaggaaaacttacttccagcataaaagatgaactcctcattagcctcatgacaggcagagatacacgagaaactgcacaagcaattgctgagaggttcaatgtaggtcagaacgatgcaaggcgtttggttcgaacagaatccgccttttttcataaccagatggagctactcagctatgaagaagcagacatagaaaagtatatctttgtggccgtcttagacaagcgtacatcacgcatttgtcaggagcatgacaatcaggtctatgatagggataaggctgtccctggtgtcaattgtccgcctatgcacccttggtgtaggtctactactgtcggatacgatgaggacgcagactacagcaagttgaagcgcagagcaaggaatccagagacaggtaaagttgagtacgtgcctgccgatatgacttataaagagtggtatagcaagtatgtggatggtaatagagagtctataaaacgtaaagcgtttgataaaactattaaagatggtataatagtaagtgtatcagggactacaattggacacactccgcctggcaaaataggtttgcctaatagtgtagttcagcataatgctacaaacggagatgtccttggtagaacttactatgatgctagaggttttaaaacgaaagatgttcattttacaaaccataaacaaccggcacgtcatccttatggaaaaatcggagaacatgctcatgattttgtatttgatgatgaaggtaagttcgttagtaggagtactagggaattaacagacgatgaaagaaaggagaatcaagatatattatggcgatattag

SEQ ID NO: 1141 - DNA (genomic), 231 bp, Streptococcus pneumoniae; double-stranded, circular
  misc_feature (B) LOCATION 1...231
  hypothetical: NO
  anti-sense: NO
aatcagaagaagttggaaaggattcctctatctattctcactttttatatcccaaaagttccctcttactctattaaagaaaaacaaagcaagtggttacaatccggctataaatctatcaaaacagacaaagctattctttcgtcttctcccatccagactatactgtcggttgtggaatctcaccacatcagcttgcgctcgcggacttctttaaagagaaggaaatag

SEQ ID NO: 1142 - DNA (genomic), 894 bp, Streptococcus pneumoniae; double-stranded, circular
  misc_feature (B) LOCATION 1...894
  hypothetical: NO
  anti-sense: NO
agggagaagaagatgcagaataaacaagaacaatggactgtattgaagcgcttgatgtcctatctcaagccttatggactccttacctttttggcactcagttttctcctagcgacgacggtcattaaaagtgtcattccccttgtggcttcccactttatcgaccagtatctcagcaatcttaaccaactagccgtgaccgttttgctggtctactatggtctctacatcctacaaactgtagttcagtatgtcggcaatcttctctttgcgcgcgtgtcttacagtattgttagggatattcgtcgggatgcctttgccaatatggagaaactgggcatgtcttactttgacaagacgccagcaggttctatcgtttctcgtttgaccaacgataccgagacgattagtgatatgttttctgggattttatccagctttatctcagcagtttttatctttctgacaaccctttataccatgttggtgctggattttcgtttgacagcattagtcttgctctttctccccttgattttccttttggtcaatctctatcgaaaaaagtcagtgaaaatcatcgagaaaaccagaagtctcttgtcagatatcaatagtaagctggcagagaatatcgagggaatcaggattattcaggcttttaatcaagagaagcgcctgcaggcagaatttgatgaaatcaaccaagagcacttggcctatgccaaccgttctgtagccttggatgccctctttttgagacctgccatgagtttgttgaaacttctaggttatgctgtcttgatgacctattttggctatcgtggtctttctatcgggataacggccgggaccatgtatgcttttatccagtacatcaaccgccctctttga

SEQ ID NO: 1143 - DNA (genomic), 249 bp, Streptococcus pneumoniae; double-stranded, circular
  misc_feature (B) LOCATION 1...249
  hypothetical: NO
  anti-sense: NO
atatttgagaagaccttacgtccttcttccactgcgacgataatagtcgcaaagttatcatctgcaagaatcatatcagaagcccccttagaaacctctgtaccagtgattcccataccgataccgatgtctgctgttttcagagctggggcatcattgacaccgtcacctgtcatggcaacgaccttaccttgtttttgccaagccttgacgatacgaaccttgtgctctggagacacacgggcataa

SEQ ID NO: 1144 - DNA (genomic), 1215 bp, Streptococcus pneumoniae; double-stranded, circular
  misc_feature (B) LOCATION 1...1215
  hypothetical: NO
  anti-sense: NO
tttggagagaaaggattcattttgaaatcaataggctttattgaaaagctgaaggggttgtctagtaaagagctgattttattgggaattatcctgagtatctttttacccttttatctttttgtagttgtactctgtttatatattatcagtttgatttttacaggagacatgaaaagtattcttcagaaaatgggggagcatccgatgctgcttctttttcttagctatagtactgttatatccattcttgcacaaaattggatgggtcttgtggcttcagtaggaatgtttctatttactattttctttttgcactatcagtcgattttatcccataaattctttcgattgattttgcagttcgtcttgtttggtagtgtcttgtcagctgtttttgccagtttagaacatttccaaattgtgaagaaatttaactatgcttttctttcacccaatatgcaggtgtggcatcagaaccgggcagaagtgaccttctttaatcctaattattatggaattatttgttgtttctgtattatgattgctttctatctgtttacaacgaccaagttgaattggttgaaagtattctgtgtgattgcaggctttgttaatctctttggtttgaactttactcaaaatcgaactgcctttcctgctattatcgctggagcaattatctatctctttacgactattaaaaactggaaggccttttggcttagtattggggtcttcgcgattggtttgagtttcctcttttctagtgatttgggagttcgaatgggtactttagactcttctatggaagaacgcatttctatctgggatgctgggatggccttgtttaagcaaaatcctttttggggtgaagggccattgacctatatgcactcttatcctcggatacatgctccttatcatgaacatgcccacagtctttatattgatacgattctgagttacggaattgtgggtaccattttattagttttgtcttctgttgctcctgttcgcttgatgatggatatgagtcaggagtcggggaaacgtccgattatcggcctttatctatctttccttacagtggttgctgtgcacggaatttttgacttggctctcttctggattcagtcaggctttattttcttgctagttatgtgcagtattccattggagcatcgaatgttggtatcggacatgacggattaa

SEQ ID NO: 1145 - DNA (genomic), 696 bp, Streptococcus pneumoniae; double-stranded, circular
  misc_feature (B) LOCATION 1...696
  hypothetical: NO
  anti-sense: NO
aatttggagaaaatttttatggaaccagatattttcatcatcacaaaactcttatcagacccttctcggatgcacattttagatattctaatggatggaaaagctcacacggttaacgaaattgccagctttaccaaaatcaagcaacatactgtcagctatcacctcaaattacttaccgaagcgcaggtaaccactctacaaacctatggacgttttcattattattctttaaaaagtgctgccattgcagaaatgctggaatttctcagcttctactctcctcagcgtgatgtcaaaagttataaacaacacattcacaaaaaggaattaaaggtcgctcgcacctgctatgaccatattgctggtgagcttggcatttccattaccaattatctcttgcaagaaaatctcctcagcgaatcagaaaaagacttccaactcactgaagctgggaagtcttatttccaaagaaaattacacattgatacggatgaattgaaaaagaaaaaacggaaattttgccctaaatgtttggattggagcgaacgtaaaaatcatgtcggcggagctctcggcaatgctcttttagaatttttcagtgaaaaacaattggtcatccctgcacaaacgccacgttcacttaccattacagagaagggcaaagaattcctcgaaaaggaatgggggatttaa

SEQ ID NO: 1146 - DNA (genomic), 861 bp, Streptococcus pneumoniae; double-stranded, circular
  misc_feature (B) LOCATION 1...861
  hypothetical: NO
  anti-sense: NO
tataaggagaaatatatgtatcttattgaaattttaaaatctatcttcttcgggattgttgaaggaattacggaatggttgccgatttccagtacaggtcatttgattttagcagaggagtttatccaataccaaaatcaaaatgaagcctttatgtccatgtttaatgtcgtgattcagcttggtgctattttagcagttatggtgatttattttaacaagctcaatccttttaaaccgactaaggacaaacaggaagttcgtaagacttggagactatggttgaaggtcttgattgctactttacctttacttggtgtctttaaatttgatgattggtttgatacccacttccataacatggtttcagttgctctcatgttgattatctacggggttgccttcatctatttggaaaagcgcaataaagcgcgtgctatcgagccaagtgtaacagagttggacaagcttccttatacgaccgctttctatatcggactcttccaagttcttgctcttttaccagggactagccgttcaggtgcaacgattgtcggtggtttgttaaatggaaccagtcgttcagttgtgacagaatttaccttctatcttgggattcccgttatgtttggagctagtgccttaaagattttcaaatttgtgaaagccggagaactcttgagctttgggcaattgtttttgctcttggtcgcgatgggagtagcttttgcggtcagcatggtggctattcgcttcttgaccagctatgtgaaaaaacacgacttcaccctttttggtaaataccgtatcgtgcttggtagtgttttgctactttacagttttgtccgtttatttgtataa

SEQ ID NO: 1147 - DNA (genomic), 906 bp, Streptococcus pneumoniae; double-stranded, circular
  misc_feature (B) LOCATION 1...906
  hypothetical: NO
  anti-sense: NO
tataaggagaaaaagatgacaaagaaacaacttcacttggtgattgtgacagggatgagtggcgcagggaaaactgtagccattcagtccttcgaggatctaggttatttcaccattgataatatgccgccagctctcttgcctaagtttttgcagctggttgaaattaaggaagacaatcctaagttggccttggtagtggatatgcgtagccgttctttcttttcagagattcaagctgttttggatgagttggaaaatcaagatggtttggatttcaaaatcctctttttggatgcggctgataaggaattggtcgctcgttacaaggaaaccagacggagtcacccactagcagcagacggtcgtattttagatggaatcaagttggaacgtgaactcttggcacctttgaaaaatatgagccaaaatgtggtggatacgactgaactcactccacgtgagctgcgcaaaacccttgcagagcagttttcagaccaagaacaagcccagtctttccgtatcgaagtcatgtctttcggatttaagtatggaatcccgattgatgcggacttggtctttgatgtccgtttcttgccaaatccctattatttaccagaactgagaaaccaaacgggtgtggatgaacctgtttatgattatgtcatgaaccatcctgagtcagaagacttttatcaacatttattggccttgattgagccgattctgccaagttaccaaaaggaaggtaagtccgttttgaccattgccatgggatgtacgggtggacaacaccgtagtgtggcatttgctaaacgcttggtgcaggacttatccaagaattggtctgttaatgaagggcatcgcgacaaagaccgcagaaaggaaacggtaaaccgttcatga

SEQ ID NO: 1148 - DNA (genomic), 711 bp, Streptococcus pneumoniae; double-stranded, circular
  misc_feature (B) LOCATION 1...711
  hypothetical: NO
  anti-sense: NO
aacaaggagaaagctatgccagtaaatgaatatggtcagatgattggtgagtcaatggaaggttatacacccggtgcactgccttctattgatttcttagaagggcgttatgctaggatagaggctctctcggtagaaaaacatgcggaggatttgctagctgtttatggcccggatactcctcgggagatgtggacctatctttttcaggagccagtagcagatatgggggagctggttagccttttaaatcagatgttggctcgtaaggaccgtttttactatgcaatcatagacaaggcgactggtaaggctttgggaactttttctctcatgcgcattgaccagaataaccgagtaatagaagtcggagcagtcactttttctccagagctaaggggtacacggataggaactgaggctcagtatctcctagctcgctatatttttgaggagctaaactatcgtcgctacgagtggaaatgcgatgccttaaatctgccatccagacgagttgcggagcgtttgggatttgtctatgaaggaaccttccgccaggcggtggtttataaggggcgtacgagagatacggattggttgtctatgattgatatggactggcctcaagtcaaagatcgtttggaaacatggctgcgtcctgaaaattttgataaaaatggacagcagtacaagagcttgagagaactttaa

SEQ ID NO: 1149 - DNA (genomic), 1053 bp, Streptococcus pneumoniae; double-stranded, circular
  misc_feature (B) LOCATION 1...1053
  hypothetical: NO
  anti-sense: NO
acaaaggagaaaaaaatcatgtttgaacattattcagtagctgatttgtttgcaaatctttataaaaagcgaaaagcaaatattttagctctcatcgctttatttgctctcattgctgtaccatttacaattaaagcagttaggaataaaaacactgtcaaagatacaacaagttattcaacttatcttatctataaaatcactcctccaaaagagtcggccaaaacgattttgaatcatcaaattggtggttatagtgatttttatgggaaattgattgatggtaatttgaatggagcttatcttttcaatgatgtagaacccagtgagttgaaaaaaattgccagtgaattagacacgacagaaacaaccttgaaaaattcaacgaatgactattggtggaaaaaattgaccgtctactatatgattgacgatgcaggggttggtgtgaaaattttgacatcaagtaaagatgccaatgacttgttagagaaaaaaattgatgggttgattgagaaatttaaacatgcttatgcaaatgtgaaaattgaaaaactggaaaccatcaactctaaagaattgaacgcaaatggtgaaacagcgcttggcttaaatgtgaaaaatctgattcttcgtttagttgttattggagtggtttgtgtgattttggttgtgatgggaaatgtgttagtttatctctttaatccaacaatcaatagagtaggtgatttttctcagtatcaaattgattttgtaacagagattacaacaattgctaacctagcagatgttttgtcatacaaaaatactggacaggaattgaccatcgttagctcaaataaagctatcctagataaattgaaacagagtcaagaagctttaaaaggaatgcattttgtagatttacaggatgtatcatctcttttggaaagagatacagtccttcttgttgaagagtacggagtgactcgttataagaaatttgagcaaagtcttcaaattctcagaaacttaaatcgttctatcctcggtgtagcaacctttaaattataa

SEQ ID NO: 1150 - DNA (genomic), 546 bp, Streptococcus pneumoniae; double-stranded, circular
  misc_feature (B) LOCATION 1...546
  hypothetical: NO
  anti-sense: NO
aaaaaggagaagaatagaaacatgagaaagcaccaactacaagttcacaaattgaccattttatctatgatgattgcccttgatgtagtccttacacctatctttcggattgagggaatggcaccgatgtccagtgtagtcaatattctagcgggaatcatgatgggacctgtttatgccttggctatggctacagtgacagcctttatccgtatgacgactcaagggattccgcctttagctctcacaggagcgacttttggagcccttctagcaggtctcttttataagtacggtcgaaaattttacttttctgccttgggagaaattgtgggaacaggtattattggttctattgtttcctatcctgttatggtgctctttacaggatcggctgctaagcttagttggtttatctacacgcctcgatttttcggagcaaccttgattggtacagcgatttcctttattgcatttcgatttttaatcaagcaggaattctttaaaaaagtgcaaggatatttctttgctgaaaggatagaatga

SEQ ID NO: 1151 - DNA (genomic), 651 bp, Streptococcus pneumoniae; double-stranded, circular
  misc_feature (B) LOCATION 1...651
  hypothetical: NO
  anti-sense: NO
aaaaaggagaatgaagtggtagtacagttattagaaaattggctcctaaaggaacaagaaaaaattcaaaccaaatatcgtcacctaaatcacatttctgttgtagaaccaaacattctttttattggggattccattgtcgagtattatcctctacaggagctatttgggacttcaaagacgattgtcaatcgaggaattcgtggctatcagacaggactgttactagagaaccttgatgctcatctatatggtggagcagtagataaaatttttcttctgattgggacaaatgatatcggaaaggatgttcctgtgaatgaggttctcaataatctcgaagctatcattcaatccgttgctcgcgattatccattgacagagattaaattgctttccattttgcctgtcaatgagggagagaagtaccagcaggcagtctatatccgctcgaatgaaaaaattcagaattggaatcaagcctatcaagagcttgcatctgcctatatgcaggtggaatttgtgccagtatttgattgtttgacagaccaagcaggccaactcaaaaaagaatatacaactgatggactgcacctcagtattgctggttatcaggctttgtcaaaatccttgaaagactatctttactaa

SEQ ID NO: 1152 - DNA (genomic), 633 bp, Streptococcus pneumoniae; double-stranded, circular
  misc_feature (B) LOCATION 1...633
  hypothetical: NO
  anti-sense: NO
gaaaaggagaaatgtatggggtggtggcgcgaaaccattgatatcgtaaaagaaaatgatccagcggcccgcaccactttggaggttttgctgacttatccaggtgtcaaggccttggcggcccaccgtctctcgcattttctctggaagtacgacttcaaactcttagctcgtatgcacagtcagttttggcgcttttggactcagattgagattcatccaggagcccagattgattcaggtgtctttattgaccatggttctggtctggtgattggagagacagcgattgttgaaaaaggcgttcttctctatcacggagtgactctcgggggaacagggaaagactgtggcaaacgccatccgactgtacgaaagggagccctcatatcagcccatgcccaagttatcgggcctgtggaaattggtgaaaatgccaaggtcggtgctgcagcagttgtcgtagcagatgtacctagtgatgtgacggttgtcggtattccggccaagattgtccgtcttcatggtaagaaagatgagcctgttattcacgaagtcgaagaaaaacgggagtattatgtcaataaactcgagcaggctaaagatgccagtcacagatcgtctggtttgtag

SEQ ID NO: 1153 - DNA (genomic), 798 bp, Streptococcus pneumoniae; double-stranded, circular
  misc_feature (B) LOCATION 1...798
  hypothetical: NO
  anti-sense: NO
atacattggaagacctcgatggcaacgattaaagaaatcaaagaactccttgtgacagtcaaggagttagaaagccctatttttttagatcttgaaaaggataatcgctcaggagttcaaaaagaaatcagcaagcgtaaaagagccattcaagctgaattagatgaaaatttgcgcttggaatccatgctttcttatgaaaaagaactttataagcaaggattgaccttaattgcaggtattgatgaggttggtcgtggtcctcttgctggtcctgtagtcgctgcggccgttattttacctaaaaattgtaagattaaaggtctcaacgacagcaagaaaattcctaaaaagaaacatctggagattttccaagccgttcaagaccaagccttgtcgattggaattggtatcatagataatcaggtcatcgaccaagtcaatatctatgaagcaaccaaactagccatgcaagaagcaatctcccagctcagccctcaaccagagcatcttttgattgatgccatgaaactggacttgcccatttcacaaacctccattatcaaaggagatgccaactccctctctatcgcagcagcatctatagtagccaaggtaacacgtgatgaattgatgaaagaatacgatcagcagttccctggctatgatttcgctactaatgcaggatatggcacagctaaacatctggaaggcctcacaaaactaggagttaccccaattcatcgaaccagctttgaacccgttaaatcactggttttaggtaaaaaagaaagttaa

SEQ ID NO: 1154 - DNA (genomic), 391 bp, Streptococcus pneumoniae; double-stranded, circular
  misc_feature (B) LOCATION 1...391
  hypothetical: NO
  anti-sense: NO
cttngttggaatntcnttggtgaggctggaccncggtggtgcgttggtgggtcggggtggcttggttttctctccctgtggggggcngggggtcgcggggcgggggcccgggggtcccgtgcggggcgggggtggctcgtcgccttgctgtctgtgctgggctgcgtggcgcgctctgggttgtggcgggtgggcgngggccggggcgggggggggtgcgtgtgtggtggccngctgcnccgtttggttgccgcggatctggggaggctgcggccggctgcgctggggggtgcggcgggtcgcgcccctcgcgccagagtggggacgggggaggtggggaggagtacaggactagaggatggcgtgcttatgttgtccggcgcccccgccc

SEQ ID NO: 1155 - DNA (genomic), 360 bp, Streptococcus pneumoniae; double-stranded, circular
  misc_feature (B) LOCATION 1...360
  hypothetical: NO
  anti-sense: NO
ggaagatggaaccagcgtcacagttcgagcttaagaaaggaaaaggaaatgatagaggcacagggtttcttagtggataagcaaacaagatgcattcattaccatagcaagctggatattattgctttacaatgctatgattgtaaaaagtattatgcttgttatcggtgtcatgattcattagaaaatcacccttttgagccgtatcccttatctttgatacaggataagcctattttatgtggtgtttgtctaaaactactaacatataagcaatataaagaaagtttaagttgccccttttgtttttctcgctttaatccaggttgccaaaatcataaggaacgctattttaaatag

SEQ ID NO: 1156 - DNA (genomic), 189 bp, Streptococcus pneumoniae; double-stranded, circular
  misc_feature (B) LOCATION 1...189
  hypothetical: NO
  anti-sense: NO
tccgtgtggaaatttcatcagactcacacccattctacactggacgtcaaaagttcactcaagcagatggacgcgtggatcgtttcaacaaaaaatacggtctcaaataatgataagagaacagtttcggctgttcttttttgtttcttgaaatcaactgctgttttcatgttccaaactcatctgtag

SEQ ID NO: 1157 - DNA (genomic), 747 bp, Streptococcus pneumoniae; double-stranded, circular
  misc_feature (B) LOCATION 1...747
  hypothetical: NO
  anti-sense: NO
tttagacggaacatttataaggggaaagaccgaatccctgctggagagacttttgttcatgaattgcaaaagcgggacattcctattctgtttgtnaccaacaatacaacccgcactccagagagtgttaaggagatgttggctcagaattttaatatcgatacgcccntatcgactgtctacacagcgactttggcaaccatcgactatatgaatgatttggggcttgaaaagaccgtctatgtcgtcggagaagcaggactcaaggaagccatcaaggcggctggttatgtggaagacaaggaaaaacctgcctacgtggtagttggtctggattggcaagtcgactatgaaaaatttgccacagcaactcttgctattcaaaagggtgcccattttatcggaaccaatcctgacctcaacatcccgacggaacgcggtcttttgccaggtgctggctcactgattacgctgcttgaagtagcgacacgagtgaagccggtttatatcggaaaaccaaatgccatcattatggacaaggcggttgagcacttaggtttggaacgtgaagagttaatcatggttggggacaattatttgactgatattcgggctgggattgacaatggcattccaacgctcttggtgacgacaggttttactaaggcagaagaagtagctggcctgccaatcgcaccgacacatgtggtttctagcattgcggagtgggattttgatgaaaactaa

SEQ ID NO: 1158 - DNA (genomic), 216 bp, Streptococcus pneumoniae; double-stranded, circular
  misc_feature (B) LOCATION 1...216
  hypothetical: NO
  anti-sense: NO
caaactaggaaactagctgcgggctgctctaaacactgttttaaggttgtagatggaactgacgaagtcagctcaaaacactgttttgaggttgtggatagaactgacgaagtcagtaaccatacctacggcaaggcgacgttgacgtggtttgaagagattttcgaagagtataagtctctacataataaaacgcatattaccaaggttgtgtaa

SEQ ID NO: 1159 - DNA (genomic), 975 bp, Streptococcus pneumoniae; double-stranded, circular
  misc_feature (B) LOCATION 1...975
  hypothetical: NO
  anti-sense: NO
ggaagtaggaaaagtatgtatccagatgatagtttgacattgcacacggacttgtaccagatcaacatgatgcaggtttactttgaccaagggattcacaataagaaggcggtctttgaggtgtatttccgccaacagccttttaagaacggctatgcggtttttgcaggtttggaaagaattgtgaactatcttgaagacttgcgtttttcagatagtgatatagcctatttggagtcgcttggttatcatggggcgttcttggattaccttcgcaatttcaagttggagttgaccgttcgttctgcccaagaaggggatttggtttttgctaatgaaccgattgtgcaggtggaaggacctctagcccaatgtcagttggtcgaaacggctcttttgaacatcgtcaactaccagaccttggtggcgacgaaggcagctcgtattcgttcggttatcgaagatgaacccttgatggagtttgggacacgtcgggctcaagaaacggatgcggccatctggggaacacgcgcagcggtgattggtggcgccaatggaaccagcaacgtgcgtgcgggtaagctctttgacattcctgttttgggaacccatgcccatgccttggtacaggtttatggcaatgactatgaggctttcaaggcttacgctgcgacccacaaaaattgtgtctttcttgtggatacctatgatacccttcgcatcggtgtaccagctgccattcaggtggcgcgtgagctgggtgatcagattaactttatgggtgtgcggattgactctggggatattgcctacatttctaagaaagtccgtcagcaactggacgaggctggatttacagaggctaagatttatgcttctaatgatttggacgaaaatactatcctcaatctcaagatgcaaaaggccaagattgatgtctggggtgtgggtaccacagctgattacagcctatga

SEQ ID NO: 1160 - DNA (genomic), 2250 bp, Streptococcus pneumoniae; double-stranded, circular
  misc_feature (B) LOCATION 1...2250
  hypothetical: NO
  anti-sense: NO
aatggtaggaagaattggagagtagagatgccgaaagaagtgaatttaacaggcgaagaagttgtcgctttaaccaaagaatatttaacggaagaggatgttcattttgtccataaggccttggtctatgctgttgaatgccacagtggtcaatatcgcaaatcaggcgagccttatatcattcaccctatccaagtggcaggtattttagctaagctaaagctggatgctgtaacagtagcttgtggattcttgcatgatgtggtggaagatacagatgcgaccttggacgatttggaaagagagtttggtcctgatgtgcgggtgattgttgacggagttaccaagcttggcaaggtcgagtacaaatcgatcgaggagcaattagcggaaaatcatcgcaagatgctcatggccatgtctgaggacatccgcgttattttggtcaaactgtctgaccgcttgcacaatatgcggaccctgaaacatcttcgaaaagacaagcaggagcgtatttccaaagaaaccatggaaatctatgccccacttgcccatcgtttggggatttccagtgtcaaatgggaattagaagacttgtctttccgttatctcaatccaacggagttttacaagattacccatatgatgaaggaaaagcgcagggagcgtgaggccttggtggatgaggtagtcacaaaattagaggagtatacgacagaacgtcacttgaaagggaagatttatggtcgtcccaagcatatttactcaattttccgcaaaatgcaggacaagagaaaacggtttgaggaaatctatgatctgattgctattcgttgtattttagatacccaaagtgatgtttatgccatgcttggttacgtgcatgaattttggaaaccgatgccaggtcgcttcaaagactatattgccaaccgcaaggccaatggttatcagtctatccatacgactgtttatggaccaaaagggccgattgaattccagattcgaaccaaggaaatgcacgaggtggctgagtacggggttgcggctcactgggcttataagaaaggtataaaggggcaagttaacagcaaggaatcagctattggaatgaactggatcaaggagatgatggagctccaagaccaggctgatgatgctaaggaatttgtggactctgttaaggaaaactatctggctgaggagatttacgtttttaccccagatggagctgtccgttcccttcccaaagattcaggaccgattgattttgcctacgaaatccataccaaggtcggtgaaaaagcaactggtgccaaggtcaatggccgcatggttccactgacaaccaagttaaagacaggggatcaggttgaaattatcgccaacccgaactcctttggacctagccgtgactggctcaatatggtcaagactagcaaggcgcgcaataagattcgccagttctttaaaaaccaagataaggaattgtctgtcaacaagggtcgtgagatgctgatggctcagttccaagaaaatggctatgtggcaaataaatttatggacaagcgccacatggatcaagttctgcaaaagaccagttacaagacagaagactccctctttgcggccattggttttggggaaatcggtgcgattaccgtctttaaccgtctgactgaaaaggaacgccgtgaggaagagcgtgccaaggccaaggctgaggcagaggagcttgtcaaaggtggcgaggtcaaggttgaaaataaagaaactctcaaggtcaagcatgaggggggagtggttattgaaggtgcttctggtctcctagtgcggattgctaagtgttgtaaccccgtgcctggtgacgatattgttggctacattaccaagggtcgtggtgtggctattcaccgtgtggactgtatgaacctgcgtgcccaagaaaactacgagcaacgtctccttgatgtggaatgggaagaccagtactctagctcaaataaggagtatctggcccatatcgatatctacggtctcaaccgtacaggactgttgaacgatgtactgcaagttctttcaaatacaaccaagaatatttcaacggtcaatgcccaaccaaccaaggatatgaagtttgctaatatccatgtgtccttcggtattgccaacctctctacactgaccacggttgtcgataaaattaagagtgtgccagaagtttactctgtcaaacggaccaacggctag

SEQ ID NO: 1161 - DNA (genomic), 564 bp, Streptococcus pneumoniae; double-stranded, circular
  misc_feature (B) LOCATION 1...564
  hypothetical: NO
  anti-sense: NO
atttacaggaaattaggctggagaaccagcctttttctaaagataaggagaaatatgaacaaaaaaacaagacagacactaatcggactgctagtgttattgcttttgtctacagggagctattatatcaagcagatgccgtcggcacctaatagtcccaaaaccaatcttagtcagaaaaaacaagcgtctgaagctcctagtcaagcattggcagagagtgtcttaacagacgcagtcaagagtcaaataaaggggagtctggagtggaatggctcaggtgcttttatcgtcaatggtaataaaacaaatctagatgccaaggtttcaagtaagccctacgctgacaataaaacaaagacagtgggcaaggaaactgttccaaccgtagctaatgccctcttgtctaaggccactcgtcagtacaagaatcgtaaagaaactgggaatggttcaacttcttggactcctccaggttggcatcaggtcaagaatctaaagggctcttatacccatgcagtcgatagagtcatttggcagtcttcaccacgagtagtagacggt

SEQ ID NO: 1162 - DNA (genomic), 513 bp, Streptococcus pneumoniae; double-stranded, circular
  misc_feature (B) LOCATION 1...513
  hypothetical: NO
  anti-sense: NO
ttttgcaggaagtctaataaagaaactagcaaggtcatgccttactttattggtggacatccaggatttaattgtcctctacttgatgatggagtctatgaagattattatctagagtctgagaaagaagagacttgctctgttccacgtcctttcccagaaacaggtatgttggatttccaagatagaagtccatggctagagggacaaaaagaaatagatcttagttatgatcttttcagcacagatgcagtgactttggatgaattgcaatctcgaacaattgcccttcgttctcttaaacatgataagggattgaaagtgcattttgcagaatttccaaacctcatcatctggtcaactttgaacaagggacctttcattacctttgaaccatggtctggcttgtcaacattccttgaagaaggagatcatttagaagataagaagaatgtttgtctcttagaagccaatcaggttgaagaattagggtttgagatagaagttttataa

SEQ ID NO: 1163 - DNA (genomic), 1410 bp, Streptococcus pneumoniae; double-stranded, circular
  misc_feature (B) LOCATION 1...1410
  hypothetical: NO
  anti-sense: NO
gctagcaggaactcctatggacaagattgtacgcacactggaagcgaatggctacgaagtgattggattagactaatgacagatgaacggattcatgtcctacgggatattttgttagaattgcacaatggcgcctctcctgagtcggttcaagatcgctttgatgcgacctttacgggcgtgtcagccatcgagatttcccttatggagcacgagctgatgaactcggattcgggcgtcacttttgaagatgttatggaactctgtgatgtccatgccaatctttttaaaaatgctatcaaaggtgtcgaagtttcagatactgagcatccaggtcacccagttcgtgtcttcaaagaagaaaatctggctctccgtgcggccttgattcgcattcgtagattgttagatacctatgagtctatggaagacgaggaaatgctggcggagatgcgtaagggtttggtgcgtcagatgggacttgtgggtcaatttgacatccattaccaacgtaaggaagaactcttctttcctatcatggagcgctatggacacgattcacctcccaaagttatgtggggagtggatgatcagattagggaactctttcaaacagctctaacgacagccaagtcactaccagaagtgtcaattagcagtgtaaaggaagcttttgaagcttttgcgacagagtttgaaagtatgattttcaaggaagagtccatcctgctcatgattctccttgagtcttttactcaggatgactggcttcagattgcggaggagagtgatgcctatggctatgccatcatccgtccgtcagagaaatgggtgccagaacgacagatctttattgaggaaaagattgcagaggagcctgtacagctagatacggcagaaggtcaagttcaacaagtcatagatacgccagaaggccattttaccattacctttacccctaaggaaaaggaagctgtgctggaccgccatagtcaacaggcttttggtaatggctatctttcagtcgagcaggccaatctcatcctcaatcatctccctatggagattacctttgtcaataaagaagatattttccagtattacaatgacaatacgccagctgatgagatgattttcaaacggacgccgtcccaagtcgggcgcaatgtcgaactctgtcatccgcctaagtatttggacaaggtcaaggctatcatgaagggacttcgtgaggggaccaaggacaagtatgaaatgtggttcaagtctgagtcgcgaggaaagtttgtccacatcacctatgctgcagtacacgatgaaaacggagaattccaaggtgtactggaatacgttcaggatatccagccctaccgtgagattgatacggactatttccgtggattagaataa

SEQ ID NO: 1164 - DNA (genomic), 495 bp, Streptococcus pneumoniae; double-stranded, circular
  misc_feature (B) LOCATION 1...495
  hypothetical: NO
  anti-sense: NO
aggacaaggaatgtggctttctacggactgacctcggtctcaaactggtctctgagctctaacataagcacacgcttgattgaagtatttctaattcatcatttacactatacaagtgaccagattcacgaggaagctgacgtcttggataacactgtctctgacctgttcgtggaaagactagataaactgctaggtttccctaaaacctgcccccacggaggaactattcctgccaagggagaactactcgttgaaatcaataacctcccactagctgatatcaaggaagctggcgcctaccgcctgactcgggtgcacgatagttttgacattctccattatctggacaagcactcacttcacatctgtgaccagctccaagtcaagcagtttgatggcttcagcaatacctccactatcctcagtaacgacgaggatttacnagtgaatatggacattgcaaaacaactctatgtcgagaaaatcaactaa

SEQ ID NO: 1165 - DNA (genomic), 324 bp, Streptococcus pneumoniae; double-stranded, circular
  misc_feature (B) LOCATION 1...324
  hypothetical: NO
  anti-sense: NO
gatgaaaggaactttagaaatcttatgatgaacatgcaaaacatgatgcgtcaagcacaaaaacttcaaaaacaaatggaacaaagccaagctgaacttgctgctatgcaatttgttggcaaatctgctcaagatcttgtccaagcgaccttaactggcgataagaaagttgtcagcattgatttcaatccagctgtcgttgacccagaggaccttgagactctttctgatatgaccgttcaagccatcaactctgctcttgaacaaatcgatgaaactaccaagaaaaaactgggtgctttcgctgggaaattacctttctaa

SEQ ID NO: 1166 - DNA (genomic), 249 bp, Streptococcus pneumoniae; double-stranded, circular
  misc_feature (B) LOCATION 1...249
  hypothetical: NO
  anti-sense: NO
atagaaaggaactatatgatttacaaagttttttatcaagaaacaaaagaacgtagcccacgccgtgaaacaacacgcgcgctttacctagacatcgataccagctcagaacttgagggccgtatcactgctcgccaacttgtcgaagaaaatcgcccagagtacaatatcgaatatatcgaactcttgtctgacaaattgctcgattacgaaaaagaaactggcgccttcgaaattacggagttctaa

SEQ ID NO: 1167 - DNA (genomic), 1158 bp, Streptococcus pneumoniae; double-stranded, circular
  misc_feature (B) LOCATION 1...1158
  hypothetical: NO
  anti-sense: NO
aaaagaaggaatttataccaattgaaaaaaccaattatcgaattcaaaaacgtctctaaagtttttgaagacagcaacaccaaggttctcaaagacatcaactttgagttggaagaagggaaattctacacccttctaggtgcatctggttcggggaaatcaactatcctaaacattattgcaggtttactggatgcgacgacaggagatatcatgctagacggtgttcgtatcaatgatattccaaccaacaagcgcgacgtacataccgtcttccaatcctatgccttgttcccacatatgaatgtgtttgaaaatgttgcctttccacttcgcttgcgtaaaattgataagaaagaaatcgagcagcgtgtagcggaagttctcaagatggttcagttggaaggttatgaaaaacgttccatccgcaaactttctggaggacaacgtcagcgtgtggccatcgcccgtgctatcatcaaccaaccccgtgtggtcttgttggacgagcctttatcagcgctggacttgaaattgagaacagacatgcagtacgaattgcgtgaattacaacaacgattgggcattacctttgtctttgtcactcacgatcaggaagaagctcttgccatgagtgactggattttcgttatgaatgatggcgagattgtccagtctggaacccctgtggacatctacgatgagccaatcaaccactttgttgccacctttatcggggagtcaaacatcttgccaggtagcatgattgaggactacttggtcgaatttaacggcaaacgctttgaagcggttgatggtgggatgaagccaaatgaacctgttgaggtcgttattcgtccagaggacttgcgcattacccttcctgaagaaggcaagctccaagttaaggtcgatacccagctcttccgtggggtgcattatgaaattatcgcctatgacgaacttggaaatgaatggatgatccactcaacccgtaaggccatcgtgggtgaggaaatcggtctggactttgaaccagaagacatccacatcatgcgtctcaatgaaaccgaagaagagttcgatgctcgtattgaggagtacgtagaaatcgaagagcaagaagcaggtttgatcaatgcacactcgaggagttaa

SEQ ID NO: 1168 - DNA (genomic), 996 bp, Streptococcus pneumoniae; double-stranded, circular
  misc_feature (B) LOCATION 1...996
  hypothetical: NO
  anti-sense: NO
agggtgaggaagtcaagagtgaacaatagtcaacagatgttacaggctttggaggagcaagatttaactaaggctgagcattatttcgccaaagctttagaaaatgattcaagtgatcttctgtatgaattggcaacttatcttgaagggattggtttctatcctcaggccaaggaaatttacctgaaaattgtagaggattttccagaggttcatcttaatctagctgcaattgctagcgaggatggtcaaatagaagaagcctttacctatcttgaggaaatccaagctgacagtgactggtatgtctcgtctttggctctgaaggcagacctttaccagctggaaggtttgacagatgtggcacgtgagaaattattggaggccttgacctactcagaggattctctcttgatattgggtttggcagagttggatagtgagttggaaaattaccaagcggctattcaagcctatgcccagttagataatcgctcgatttatgagcaaacgggcatttccacctatcaacgaattggctttgcctatgctcagttagggaaatttgaaacggctactgagtttttagaaaaagccctggagttagaatacgatgacttaacagcttttgagttggccagtctttattttgatcaagaagaatatcaaaaagccaccctctactttaagcagcttgataccatttctcctgactttgaaggctatgagtatgggtacagtcaggctttacataaggaacatcaagttcaagaagccctgcgtatcgctaagcaaggattagagaaaaatccctttgaaactcgcctcttgctagctgcttcacaattttcttatgaattgcatgatgctagtggtgcagaaaattatctccttactgcaaaagaagacgctgaggatacagaagaaatcttgcttcgtttagccactatttatctggagcaggagcgttatgaggatattctagaattgcagagt

SEQ ID NO: 1169 - DNA (genomic), 1182 bp, Streptococcus pneumoniae; double-stranded, circular
  misc_feature (B) LOCATION 1...1182
  hypothetical: NO
  anti-sense: NO
aaaaagaggaactcaatgctacattatacaaaagaagacttgctcgaattgggtgcagaaatcactacgcgtgaaatctaccaacaacctgatgtatggagagaagcttttgaattttatcaagcaaaacgtgaagaaattgcagccttcctacaagaaatcgctgataaacatgactatattaaggttatcttgacaggtgctgggacttctgcttatgtgggagacaccttgctaccttactttaaggaagtctatgacgaacgcaaatggaatttcaatgctattgcgacaacagatatcgttgccaatccagcaacctatttgaaaaaagatgtggcaactgtccttgtgtcttttgctcgtagtgggaactcgcctgaaagtgtggcgactgttgatttggccaaatccttggtggatgagctttatcaagtgacgattacttgtgcagcagatggtaaattggctcttcaagctcacggtgatgaccgtaatctcttgctcttgcaaccagctgtctctaatgatgctggatttgccatgacttctagctttacgtctatgatgttgacaactctcttggtctttgatcctacagaatttgctgttaagtctgaacgttttgaagttgtatctagtcttgcccgtaaagttttagacaaggcagaagatgtcaaagagctcgttgatttagactttaaccgtgtcatctatctaggcgctggtcctttctttggacttgctcatgaagctcagctcaagattttggaattaactgctggtcaagttgcgaccatgtatgaaagcccagttggcttccgtcacggtccaaaatctcttatcaacgaaaatacagttgttttggtctttggtacaaggacagactacactcgtaagtacgacttggacttggttcgtgaagttgctggtgaccagattgctcgtcgtgttgtgcttttgagtgatcaagcttttggtcttgaaaatgtcaaagaagtggcccttggttgtggcggtgtcttgaatgatatttaccgtgtcttcccttacatcgtttatgcccaactctttgccctattgacttcactcaaggtagaaaataaaccagatacaccgtctcctacaggtacagtaaaccgtgtagtacaaggtgtcataattcacgaatatcaaaagtaa

SEQ ID NO: 1170 - DNA (genomic), 186 bp, Streptococcus pneumoniae; double-stranded, circular
  misc_feature (B) LOCATION 1...186
  hypothetical: NO
  anti-sense: NO
ttttggaggaagattttgtctctattatttattattttaaatttatttattttgtataagatctattctttgaggcgggaaaaatcgaaatacttgatttatacggcctatatcatatttggggtaaatgtagtatatggtattcaatggttattaaaagaactgatttcaactatttccccttaa

SEQ ID NO: 1171 - DNA (genomic), 1005 bp, Streptococcus pneumoniae; double-stranded, circular
  misc_feature (B) LOCATION 1...1005
  hypothetical: NO
  anti-sense: NO
ataaggaggaatctggtaatggtagtatttacaggttcaactgttgaagaagcaatccagaaaggattgaaagaattagatattccaagaatgaaggctcatatcaaagtcatttctagggagaaaaaaggctttcttggtctatttggtaaaaaaccagcccaagtggatattgaagcgattagtgaaacgactgttgtcaaagcaaatcaacaggtagtaaaaggcgttccgaaaaaaatcaatgatttgaacgagcctgtgaagacggttagtgaagaaaccgttgaccttggtcatgtggttaatgctattaaaaaaatagaggaagaaggtcaaggtatttctgatgaagtcaaggctgaaatcttaaaacatgaaagacatgccagcactatcttagaagaaactggtcacattgagattttaaatgaacttcaaatcgaggaagcgatgagggaagaagcaggcgctgatgaccttgaaactgagcaagatcaaactgaaaatcaagacttgaaagagatgggcttgaaggtcgagcaaagttatgatattgcccaggtggctacggatgtgactgcctatgttcaagcgattgtggatgacatggatgttgaagctacactttcaaatgattataaccgtcgtagcatcaatctacaaattgacaccaacgaaccaggtcgtattatcggctaccatggtaaagtcttgaaggccttgcaactgttggctcaaaattatctttacaaccgctattccaaaaccttctacgttacaatcaatgtcaatgattatgtcgaacaccgtgcagaagtcttgcagacctatgcgcaaaaattggcgaatcgtgttttggaagaaggtcgcagtcataaaacagatccaatgtcaaatagcgaacgcaagattatccatcgtattatttcacgtatggatggcgtgactagttactctgaaggtgatgagccaaatcgctatgttgttgtagatacagaataa

SEQ ID NO: 1172 - DNA (genomic), 870 bp, Streptococcus pneumoniae; double-stranded, circular
  misc_feature (B) LOCATION 1...870
  hypothetical: NO
  anti-sense: NO
acaaggaggaatctgatgcttggagcaattattggagatattgtcggttctgtttacgaatggaacaatatcaaaacaaaggactttcctttatttcggaaggactgcttttttacagatgacacggttatgacctgtgctgttgcagaagcaattatgaatggtggacaaaaagacgatttcattgacgcgatgaagaaatatggcagaatgtatccgaatgctgattacggtgctcggtttaatgcatggctaaacagcgataaccgtgagccttataatagctttgggaatggatcagctatgcgtatttctccatgtgcttggatcatggactgtggtttttatgcgaaaactggtatgtggccatcatctagaggacttacgagtctttctgcagaggtaactcataatcatccagaaggtgtcaaaggcgctatggctacagctgatgctatctttctatgtcgtttttactttggtggttattgtagagagtacgagcaatcaattaacgacaatcctacagagtgtaaaagacgaattaaggattatatagaaaaagaatacgattacaatctatctcaaactttagatgaaatccgtcctaactatcgttttaacgaaacatgtcaggaaactgtccctcaagccattatcgcctttcttgaaagtagagacttcgaagatgcgataagaaatgccatctcacttggtggcgacagtgatactctcgcagcaatcacttgtagcatagcagaggcagcttacggtattcctgattggatcaaggataaggcctattcttacttggatgaacccttaaaggatgtagttaggcgatgggaaaatagaataaaagcgtattaa

SEQ ID NO: 1173 - DNA (genomic), 1278 bp, Streptococcus pneumoniae; double-stranded, circular
  misc_feature (B) LOCATION 1...1278
  hypothetical: NO
  anti-sense: NO
gaaaggaggaaaactaagatgcagaatctgaaatttgccttttcatctatcatggctcacaagatgcgttctttgcttactatgattgggattattatcggtgtttcatcagttgttgtgattatggctttgggtgattccctatctcgtcaagtcaataaagatatgactaaatctcagaaaaatattagcgtctttttctctcctaaaaaaagtaaagatgggtcttttactcagaaacaatcagcttttacggtttctggaaaggaagaggaagttcctgttgaaccgccaaaaccgcaagaatcctgggtccaagaggcagctaaactgaagggagtggatagttactatgtaaccaattcaacgaatgccatcttgacctatcaagataaaaaggttgagaatgctaatttgacaggtggaaacagaacttacatggacgctgttaagaatgaaattattgcaggtcgtagtctgagagagcaagatttcaaagagtttgcaagtgtcattttgctagatgaggaattgtccattagtttatttgaatctcctcaagaggctattaacaaggttgtagaagtcaatggatttagttaccgggtcattggggtttatactagtccggaggctaaaaggtcaaaaatatatgggtttggtggcttgcctattactaccaatatctcccttgctgcgaattttaatgtagatgaaatagctaatattgtctttcgagtgaatgataccagtttaaccccaactctgggtccagaactggcacgaaaaatgacagagcttgcaggcttacaacagggagaataccaggtggcagatgagtccgttgtatttgcagaaattcaacaatcgtttagttttatgacgacgattattagttccatcgcagggatttctctctttgttggaggaactggtgtcatgaacatcatgctggtttcggtgacagagcgcactagtgagattggtcttcgtaaggctttgggtgcacaacgtgccaatattttaattcagtttttgattgaatccatgattttgaccttgttaggtggcttaattggcttgacaattgcaagtggtttaactgccttagcaggtttgttactgcaaggtttaatagaaggtatagaagttggagtatcaatcccagttgccctatttagtcttgcagtttcggctagtgttggtatgatttttggagtcttgccagccaacaaggcatcgaaacttgatccaattgaagcccttcgttatgaatga

SEQ ID NO: 1174 - DNA (genomic), 363 bp, Streptococcus pneumoniae; double-stranded, circular
  misc_feature (B) LOCATION 1...363
  hypothetical: NO
  anti-sense: NO
ttccttgggaacggtaaccaatgtctttgttccaggttcggttgtcaaggcggcgaccatcagctcaggttgggaaaatggagtcttgtcaggaaaccagaccttgacagaccagtccattgtcttccaaggttcagctcccatcaattcttggtatactcaggcttacggttcattccctatcacagcggtccaagctctggagtattcatcaaatacctatatggtccaaacagccttaggtcttatggggcaaacctatcaacccaatatgtttgtcggcaccagcaatctagagtctgctatggagaaactgcgttcaacctttggcgaatatggcttgggtactgcgacaggaattga

SEQ ID NO: 1175 - DNA (genomic), 516 bp, Streptococcus pneumoniae; double-stranded, circular
  misc_feature (B) LOCATION 1...516
  hypothetical: NO
  anti-sense: NO
ttatcagggaatactacagctctcagtcaatctttgtcggtgacaccgaataatggtgtttctgcagcagatgatggttatgtctttaaccctaatgatattgtcagagatacaggtgatgcttatatagtaagacacggggatcactatcattatattcctaagtcatctcttaacaatcccccatcacactctaacacggaagaggcaggaagttcttctagttctgtattaagtaatccgtcactacatgtccaccatgaggaagaagatggtcatggttttgatgccaatcgaattataagtgaagattcagaaggttttgtgattcctcatggcgaccacaatcactacatcaaggttcaaactaagggatatgaagcggctttgaaaaacaagattccatccctgcaatccaactatcaacctggaacttttgatgagaaggcagtcttggcaaaagtagatcaacttctagctgatagcagaagcatctacaaagacagattgagttag

SEQ ID NO: 1176 - DNA (genomic), 645 bp, Streptococcus pneumoniae; double-stranded, circular
  misc_feature (B) LOCATION 1...645
  hypothetical: NO
  anti-sense: NO
agaaaggggaaatcagtcacaatggcaaacgtaacattatttgaccaaactggtaaagaagctggccaagttgttcttagcgatgcagtatttggtatcgaaccaaatgaatcagttgtgtttgatgtaatcatcagccaacgcgcaagccttcgtcaaggaacacacgctgttaaaaaccgctctgcagtatcaggtggtggacgcaaaccatggcgtcaaaaaggaactggacgtgctcgtcaaggttctatccgctcaccacaatggcgtggtggtggtgttgtcttcggaccaactccacgttcatacggctacaaacttccacaaaaagttcgtcgcctagctcttaaatcagtttactctgaaaaagttgctgaaaacaaattcgtagctgtagacgctctttcatttacagctccaaaaactgctgaatttgcaaaagttcttgcagcattgagcatcgattctaaagttcttgttatccttgaagaaagaaatgaattcgcagctctttcagctcgtaaccttccaaacgtgaaaattgcaactgctacaactgcaagttttcctgacatcgcaaatagcgacaaacttcttgtcacacaagcagctatctctaaaatcgaagaagtacttgcataa

SEQ ID NO: 1177 - DNA (genomic), 195 bp, Streptococcus pneumoniae; double-stranded, circular
  misc_feature (B) LOCATION 1...195
  hypothetical: NO
  anti-sense: NO
atgaaggggaaagagtatgaaaacagaactgtttcttttgctattagttcaaaaggagaaaaaatgaaagtagaaaatatttcgtatagggtggatcatcgtatattgtttgataatatttcttttgatacttcgagttcaggcgtgacattaattactggtaaaaatggtacaggaaagtcaactttactatag

SEQ ID NO: 1178 - DNA (genomic), 249 bp, Streptococcus pneumoniae; double-stranded, circular
  misc_feature (B) LOCATION 1...249
  hypothetical: NO
  anti-sense: NO
attaccaacctactcatcttctcaccagagggcggtattaactttgatcataaaatcggatactccctctatccagaaaatatgctcagaatgattgtctctaaacaatacctgctcttttacctcattcatgaaaaagaagtccataccctgagaattatcaactcacgcaccgactacctaaaccaactcgaccacctctttcgtacatgtaggaaactattttcctcacaaataatctcattataa

SEQ ID NO: 1179 - DNA (genomic), 288 bp, Streptococcus pneumoniae; double-stranded, circular
  misc_feature (B) LOCATION 1...288
  hypothetical: NO
  anti-sense: NO
gagccaaacctaaaaactagcttaatactcttcgaaaatctcttcaaaccacgtcagcgtcgccttaccgtatatatgttactgacttcgtcagttctatctgccacctcaaaacggtgttttgagctgacttcgtcagtttcatctacaacctcaaaaccatgttttgagctgacttcgtcagtttcatccacaacctcaaaacagtgttttgagcaacctgcggttagcttcctagtttgctctttgattttcattgagtataagttttccttagagaaagcttaa

SEQ ID NO: 1180 - DNA (genomic), 321 bp, Streptococcus pneumoniae; double-stranded, circular
  misc_feature (B) LOCATION 1...321
  hypothetical: NO
  anti-sense: NO
ctccaaaaccttatcaacgatttgctccacagaagaagcattgatagctccatgtccgttgatacagtaaggcgtccccacacgtgcgtagaggagacgcagatagtcattgatttcagtcgtcgttcccaccgtcgagcgaggatttttactagtcgttttctggtcgatggaaatagctgggctgagaccatcaatggcatctacatctggtttttccatatttcccaagaactgacgagcgtaggcggacaaactctctacatagcgacgttgtccctccgcatagagagtatcaaaagccagactggacttccctga

SEQ ID NO: 1181 - DNA (genomic), 192 bp, Streptococcus pneumoniae; double-stranded, circular
  misc_feature (B) LOCATION 1...192
  hypothetical: NO
  anti-sense: NO
ttcgtttttgaactagttgctttcgttgacgaagatgtctccgatgaactgcttgtacttgaatttgatgtgcttgaacttggtgctactggttttgtagtcaccttcattattgtatcaaacggagtgataactgccggtaagacaacaccattgcggtcgattgcctgcaaaggtactgaaccactgtaa

SEQ ID NO: 1182 - DNA (genomic), 666 bp, Streptococcus pneumoniae; double-stranded, circular
  misc_feature (B) LOCATION 1...666
  hypothetical: NO
  anti-sense: NO
attggttttgaggagttagaaatgaaagtattagtgacaggttttgagccctttggaggggaaaagggcaatccagctttggaggccattaaaggtttaccagctgaaatccatggtgctgaggtccgttggctagaggtgccgacagtttttcacaaatctgctcaagtattggaagaagagatgaatcgttatcaacctgactttgtcctttgtattgggcaagctggtggaagaactagtttgacacctgaacgagtgaccattaatcaagacgatgcatgcatttctgataacgaagataatcaaccgattgaccgtcccattcgcccagatggtgcttcggcctactttagtagtttgccgattaaagcgatggttcaagctataaaaaaagagggcttaccggcctctgtttccaatacggcagggacttttgtctgcagccatttgatgtatcaggctctctatttggtagaaaagaaatctccatatgttaaggcaggttttatgcatattccttatatgatggaacaggtggtgaacagaccgactactccagctatgagtttagtggatattcggcgagggatagaagcagcaatcggcgctataatagaacatggagatcaggaactcaagttggtaggcggagaaactcattga

SEQ ID NO: 1183 - DNA (genomic), 411 bp, Streptococcus pneumoniae; double-stranded, circular
  misc_feature (B) LOCATION 1...411
  hypothetical: NO
  anti-sense: NO
aattcatttgaaaagtatgtccaagagcataaaatacttcttagtatttttgatttggatgagacagttactgactattatggaaagctagagagtttcttggaagaaaattcttctatagatggaatttttacaatcaacgattttacagctttggatgtgattgaaatactagaaaaaaatggtaaacgtattcctcatgatgtccaaattattggatacgatggaattaaaatggctggagatagagattatctactttcaactattgaacaaccattggaagaaatggcaaaagaagcggttcgtattttgtttgatataattgatggaaagactgttaatttgcagacaatcctaccagtaaaatttgttgaaggaaaaacaacaaaaaatgaaaataagtcttga

SEQ ID NO: 1184 - DNA (genomic), 303 bp, Streptococcus pneumoniae; double-stranded, circular
  misc_feature (B) LOCATION 1...303
  hypothetical: NO
  anti-sense: NO
ataaaatttgataaacggactttatcttattacagaggagaagaaatggatccgaaaaaaattgctcgtatcaatgagcttgctaaaaagaaaaaaacagaaggcttaacaccagaagaaaaagtggaacaagccaaactacgtgaggagtacatcgaaggttatcgccgcgctgttcgtcaccacattgaaggaatcaaaattgtggacgaagaaagaaacgatgttacaccagaaaaactacgccaagtacaacgtgaaaaaggattacatggccgtagtcttgatgatccaaattcataa

SEQ ID NO: 1185 - DNA (genomic), 1536 bp, Streptococcus pneumoniae; double-stranded, circular
  misc_feature (B) LOCATION 1...1536
  hypothetical: NO
  anti-sense: NO
agaaaatttgaaatagaaagtggtgttcttttggcaattaacgcacaagaaatcagcgctttaattaagcaacaaattgaaaatttcaaacccaattttgatgtgactgaaacaggtgttgtaacctatatcggggatggtatcgcgcgtgctcacggccttgaaaatgccatgagtggagagttgttgaattttgaaaacggctcttatggtatggctcaaaacttggagtcaacagacgttggtattatcatcctaggtgactttacagatatccgtgaaggcgatacaatccgccgtacagggaaaatcatggaagtccctgtaggtgaaagtctgattggtcgtgttgtggatccgcttggtcgtccagttgacggtcttggagaaatccacactgataaaactcgtccagttgaggcaccagctcctggtgttatgcaacgtaagtctgtttcagaaccattgcaaactggtttgaaagctattgacgcccttgtaccgattggtcgtggtcaacgtgagttgattatcggtgaccgtcagacagggaaaacaaccattgcgattgatacaatcttgaaccaaaaagatcaagatatgatctgtatctacgtcgcgattggacaaaaagaatcaacagttcgtacgcaagtagaaacacttcgtcagtacggtgccttggactacacaatcgttgtgacagcctctgcttcacaaccatctccattgctcttcctagctccttatgctggggttgctatggcggaagaatttatgtatcaaggtaagcatgttttgattgtatatgatgatctatcaaaacaagcggtagcttatcgtgaactgtcgctcttgcttcgtcgtcctccaggtcgtgaagccttcccaggggatgttttctatctccacagccgtttgcttgagcgctcagctaaagtttctgatgaacttggtggtggatcaattacagccctaccatttatcgagacacaagcaggagatatctcagcctatatcgcaaccaacgtgatttctatcactgatggacaaatcttccttggcgatggcctcttcaatgcaggtattcgtccagccatcgatgcgggttcatctgtatctcgtgtaggtggttctgcacaaatcaaagccatgaagaaggttgctggtacacttcgtatcgaccttgcttcataccgtgagttggaagcctttactaagtttggttctgacttggacgcagcaacacaggctaagttgaaccgtggacgtcgtaccgttgaggtcttgaaacaacctgttcacaaaccattacctgttgagaaacaagtaaccattctttatgctttgacacatggtttcttggatactgttccagtagatgatattgttcgtttcgaggaagagttccatgccttctttgatgctcaacatccagagattttggaaaccattcgtgatacaaaagacttgccagaagaagcagtcttggatgctgcgattacagagtttctcaatcaatctagcttccaataa

SEQ ID NO: 1186 - DNA (genomic), 237 bp, Streptococcus pneumoniae; double-stranded, circular
  misc_feature (B) LOCATION 1...237
  hypothetical: NO
  anti-sense: NO
gtaagatttgaagatattctaagttcttttattctttttccaacatcacatacatttatcacatacatttatcatattcatacacctctcataaaaagaatagcacactcttgtcataattttttaaataaaaaaattatgacaaaacaaggaagcaatttattgatgctgcttaaaaatctaaaattgatgagttcctatcaaaaatcgtatcttcaacctcaaaacagtacttaa

SEQ ID NO: 1187 - DNA (genomic), 897 bp, Streptococcus pneumoniae; double-stranded, circular
  misc_feature (B) LOCATION 1...897
  hypothetical: NO
  anti-sense: NO
atgaggtttgaatttatcgcagatgaacatgtcaaggttaagaccttcttaaaaaagcacgaggtttctaagggattgctggccaagattaagtttcgaggtggagctattctggtcaataatcaaccgcaaaatgcaacgtatctattggacgttggagactacgttaccattgacattcccgctgagaaaggctttgaaaccttggaggctattgagcttccattagatattctctatgaggatgaccactttctagtcttgaataaaccctatggagtggcttctattcctagtgtcaatcactctaataccattgccaattttatcaagggttactatgtcaagcaaaattatgaaaatcagcaggttcacattgttaccagactagatagggacacttctggcttgatgctctttgccaagcacggttatgcccatgcacgattagacaagcagttgcagaagaaatctatcgagaaacgctactttgctttggttaagggagatggacatttggagccagaaggggaaattattgctccgattgcgcgtgatgaagattccattattaccagacgagtggctaaaggcggaaagtatgcccatacttcatacaagattgtagcttcttatggaaatattcacttggtctatattcacctgcacactggtcgaacccatcaaatccgagtccatttttctcatatcggttttcctttgctgggagatgatttgtatggtggtagtctggaagatggtattcaacgtcaggctctgcattgccattacctatccttttatcatccatttttagagcaagacttgcagttagaaagtcccttgccggatgatttcagtaaccttattacccagttatcaactaatactctataa

SEQ ID NO: 1188 - DNA (genomic), 321 bp, Streptococcus pneumoniae; double-stranded, circular
  misc_feature (B) LOCATION 1...321
  hypothetical: NO
  anti-sense: NO
ctttttcttgataaaggaagaaatagtggagaggaagttagaatgaaaaaattcgacaattatattattgagaagccttgcgattctaattcagataaactgcaaaaaatcttaataattgaaaatttggtagatgatattttgcaattttctctcagaatcaataatagtgtaggagagattttcctcctacaaccgtttcaaaagaaaactatctttattccatgttattttgaggaagatattgtgaaagtcaaagatgatgataaagttgagtggaatttgttagaatttcaaaaatttagagcatttttggcttag

SEQ ID NO: 1189 - DNA (genomic), 774 bp, Streptococcus pneumoniae; double-stranded, circular
  misc_feature (B) LOCATION 1...774
  hypothetical: NO
  anti-sense: NO
agaagacttgacagacaaaggcttcaccaacgaatttgtgaaataatgacagaaattagactagagcacgtcagttatgcctatggtcaggagaggattttagaggatatcaacctacaggtgacttcaggcgaagtggtttccatcctaggcccaagtggtgttggaaagaccaccctctttaatctaatcgctgggattttagaagttcagtcagggagaattgtccttgatggtgaagaaaatcccaaggggcgcgtgagttatatgttgcaaaaggatctgctcttggagcacaagacggtgcttggaaatatcattctgcccctcttgattcaaaaggtggataaggcagaagctatttcccgagcggataaaattcttgcgaccttccagctgacagctgtaagagacaagtatcctcatgaacttagcggtgggatgcgccagcgtgtagccttactccggacctacctttttgggcacaagctctttctcttagatgaggcctttagcgccttggatgagatgacaaagatggaactccacgcttggtatcttgagattcacaagcagttgcagctaacaaccctgatcatcacgcatagtattgaggaggccctcaatctcagcgaccgcatctatatcttgaaaaatcgccctgggcagattgtttcagaaattaaactagattggtctgaagatgaggacaaggaagtccaaaagattgcctacaaacgtcaaattttggcggaattaggcttagataagtag

SEQ ID NO: 1190 - DNA (genomic), 978 bp, Streptococcus pneumoniae; double-stranded, circular
  misc_feature (B) LOCATION 1...978
  hypothetical: NO
  anti-sense: NO
agcatgcttgattggaaacaattttttctagcctatctgcgctcccgtagtcgtctttttatctatctgctttctttggcatttcttgtcttactctttcagtttttatttgccagtctaggaatttacttcctctactttttcttcttgtgttgctttgtaaccatattatttttcacttgggacatattggtggaaacgcaggtctatcgccaggaacttctctatggagagagggaagccaagtctcctttggaaatagctttagcagaaaaattagaagcgcgtgagatggaactctatcagcagaggtcaaaagcagaaagaaaactgacggatttgctggattactataccttgtgggtccatcagataaagacccccattgcagccagtcaactcttagttgcagaagtggtcgaccgccaactgaagcagcagctagaacaggaaattttcaaaatcgactcctataccaacctagttttacagtacctgcgtttagaaagtttccatgatgatttgctcttaaagcaggttcaaattgaggacttggtcaaggaaataattcgtaaatatgctcttttctttattcaaaaaggcttaaatgtcaatctacatgaccttgataaagaaatcgtgacggataaaaagtggctgctagtggttattgagcaaatcatctcaaacagtctcaagtacaccaaggaaggtggtctggagatttatatggatgaccaagagctttgtatcaaagatacgggaatcgggataaaaaacagtgatgtcctccgagtatttgaacgtggcttttcaggatacaatggccgtttgacccagcagtcctctggacttggcctttatctatctaagaaaatttctgaagaactggggcaccagattcgtatcgagtctgaggtcggaaaaggaacgacagtgcggattcagtttgctcaagtgaacttagtccttgagtaa

SEQ ID NO: 1191 - DNA (genomic), 1068 bp, Streptococcus pneumoniae; double-stranded, circular
  misc_feature (B) LOCATION 1...1068
  hypothetical: NO
  anti-sense: NO
gtgctaattgatcagacagagaggagtgatgagatggttacagagcgtcagcaggatattttaaatctgattattgacatctttaccaaaacgcacgaacctgtcggatcaaaagccttgcaagagtctattaactctagcagtgcaaccattcgtaatgacatggcggaactagaaaaacaagggttgcttgagaaggctcatacttcaagcggtcggatgccaagtgttgctggttttcagtactatgtgaaacactcactggattttgaccggctggctgaaaatgaggtatatgagattgtcaaagcctttgatcaggaattcttcaaattggaggatattctgcaagaggctgctaacttgctaacagacctgagtggctgtacggtagtggcactggatgttgagccgagcaggcaacgtttgacagcctttgatatcgttgttttggggcaacatacagccttggcggtatttaccctagacgagtcgcgaacggttactagtcagtttctgattccaaggaacttcttgcaggaggatttgctgaaactgaagagcatcattcaggaacgtttcctcggtcacaccgttttagatattcactacaagattcggacggagattccgcagattatccagcgttactttacaacaacggataatgtcatcgatctctttgaacacatctttaaggaaatgttcaacgaaaacattgtgatggcgggcaaggtcaatctcttgaattttgccaatctagcagcctatcagttctttgaccaaccgcaaaaggtggccttggagattcgtgaggggttgcgtgaggatcagatgcaaaatgttcgtgttgcagacggtcaagagtcctgtttagctgacctagcggtgattagtagtaagttcctcattccttatcggggagttggaattctagccattaccggtccagttaatctggattaccaacagctaatcaatcaagtcaatgtggtcaaccgtgttttgaccatgaagttgacagatttttaccgctacctcagcagtaatcattatgaagtacattaa

SEQ ID NO: 1192 - DNA (genomic), 801 bp, Streptococcus pneumoniae; double-stranded, circular
  misc_feature (B) LOCATION 1...801
  hypothetical: NO
  anti-sense: NO
ttctcaattgagcagttttctttaaaaggaaaaattgctctcatcaccggcgcttcttatggaattggatttgctattgccaaatcctacgctgaagccggcgctactattgtctttaacgatatcaatcaagatctggtcaataaagggattgaagcttatcgtgaagttggcatcgaagcccatggatatgtctgtgacgtgacagacgaggacggtatccaagccatggtcaagcaaatcgaacaagaggttggtgtcattgacatcctcgttaataacgctggtattatccgccgagttccaatgtgcgaaatgagcgccgctgatttccgtaaggtcatcgatattgacttaaacgcaccatttatcgtttcaaaggcagttattccttctatgataaagaaagggcatggaaagattatcaatatttgttcgatgatgagcgaactgggacgtgaaacagttagcgcttatgctgctgctaaagggggcttgaaaatgttgacccgcaacattgcgtctgaatacggtggagccaatatccaatgtaacggaattggaccgggttatattgccactcctcaaacagcacctcttcgtgagttgcaagaagatggttctcgccacccatttgaccagttcatcattgcaaaaacacctgctgcacgttggggaaatcctgaagatttgatgggccctgctgtctttctcgctagtgatgccagcaattttgtcaatggccacatcctatatgtagatggcggtatcttagcctacatcggaaaacaacctgagtaa

SEQ ID NO: 1193 - DNA (genomic), 608 bp, Streptococcus pneumoniae; double-stranded, circular
  misc_feature (B) LOCATION 1...608
  hypothetical: NO
  anti-sense: NO
aagaaattgaaaaaaatgttcttccgggggaaaaattgtatgaaattggttccaaatataaccaaattttcccccggccagtgtttttttttgttttcaaaaaagaattcggtgggaacgaaaattttaggaaaacagggttatcaaaagttaaggggaaattattccaacaggatgttgttaaaggggggaataaacgtttttatcgccctacttttcgcatgcacttaacaaataaagaaattcttgacaagattttaagctattcagaagacttgaaacaccactatcagatctatcaactcttactttttcactttcagaacaaagaccctgagaaatttttcggactcattgaggacactctgaagcaggttcatcctatttttcagactgtctttaaaacctttctaaagaacaaagaaaaaatcgtcaacgctcttcaattaccttattccaacgcaaaattggaagcgaccaataatctcatcaaacttatcaaacgaaacgcctttggatttcggaactttgaaaacttcaaaaaaaggatttttatcgctctgaacatcaaaaaagaaaggacgaattttgtcctttctcgagcttag

SEQ ID NO: 1194 - DNA (genomic), 324 bp, Streptococcus pneumoniae; double-stranded, circular
  misc_feature (B) LOCATION 1...324
  hypothetical: NO
  anti-sense: NO
aagaggattgatatgtctatagagttgctgaagaaattaacaggcgaagaagatactcagcttctcatgttgctccaaacgagggctacaaatcttatcttgtcagagactaatcgcacatctttgacacctgctttaagtcttttaatacctgaggttgctatcgaactccacaaccgctcaggagcggaaggagagcattctagaaccgagggtggtatagcagtagtctacggagaaaacggcctgtctacggatcttctacagcgaatacgcatgcacaggctagcaagggtggcaggtcatgtttttgaagcagagtag

SEQ ID NO: 1195 - DNA (genomic), 327 bp, Streptococcus pneumoniae; double-stranded, circular
  misc_feature (B) LOCATION 1...327
  hypothetical: NO
  anti-sense: NO
acaactgaccttttgatcaacgaatcaatcgtgacaactgaagctcgtgctaaagaaatccgtaaaactgttgaaaaaatgattactctaggtaaacgtggtgatttgcatgcacgtcgtcaagcagctgctttcgtacgtaatgaaatcgcatctgaaaactatgatgaagcaactgataagtacacttctactacagcacttcaaaaattgttctcagaaatcgcacctcgttatgctgaacgtaacggtggatacactcgtatccttaaaactgaaccacgtcgtggtgatgcagcgccaatggcgatcatcgaattagtataa

SEQ ID NO: 1196 - DNA (genomic), 228 bp, Streptococcus pneumoniae; double-stranded, circular
  misc_feature (B) LOCATION 1...228
  hypothetical: NO
  anti-sense: NO
gtggtgtctgattatctttgttgcctatatggtagcaggatttattttctactttatcaagcaaatcaagagaaagtcatcctaatactcttcgaaaatctcttcaaaccacgtcagtttccatctgcaacctcaaaacactgttttgaacaacctgcggctagcttcctagtttgctctttgattttcattgagtataagatacaagggattcattttcgaatttaa

SEQ ID NO: 1197 - DNA (genomic), 903 bp, Streptococcus pneumoniae; double-stranded, circular
  misc_feature (B) LOCATION 1...903
  hypothetical: NO
  anti-sense: NO
ctattccctgatctagtcttccagtatgacccatgtaaaggagctttccctatggacaaaccagatatcgcaactatcattgattcacattttgaagaaatgacagacctagagcaagaaatcgctcgctattttttgcaagctgaaacgattacagatgatttatcttctcaacaagtcacccaaaaattacatatttctcaagctgctttgacccgctttgctaaaaagtgtggctttactggctaccgagaatttattttccaataccaacatcaggcagaaaatcaagccaaccaagtctccaagcatagtccactgaccaaacgagtcctcagaagttatagcaatatgagggaacaaacacaagacttgattgacgaaatccaactagagcgaattgcccagctaatcgaagatgctgagcgtatctacttctttggaacagggagttctggcctcgtcgcccgtgaaatgaaattacgttttatgcgactaggtgtggtctgcgaagctttgacagaccaagacggctttgcctggacaaccagcatcatggatgaaaattgtctagtactgggtttctcactttcaggctcaactccttctattttagatagtctattagatgccaaggagatgggggcaaagactgtactctttacaagtgttcccaataaagatagccagacctatacagagactgttcttgtagccacccacagccaaccctcctacatccaacgaatatccgctcaacttcctatgctcttctttatcgatttgatttatgcctactttttggaaatcaatcgcgaaagcaaggaaaaaatctttaatagctactgggaaaataaaaaactcaacggctatcgtagacaaaaacgtgtaagaaaatcctag

SEQ ID NO: 1198 - DNA (genomic), 342 bp, Streptococcus pneumoniae; double-stranded, circular
  misc_feature (B) LOCATION 1...342
  hypothetical: NO
  anti-sense: NO
aggcttactgagtctgcttcatgctgttctttagttttgatgtcgacaacgtttacgttgatttcaacaatttccaagtcagtcattttagcaacttctgaagatacgatttctctgatttctgaatataaagctggaacatttttttggtactcaacaataacgtttaagtcaactgcaacttgtgttttaccaacttctacgttaacaccacttgttacgtcatcgctgttaacgattttttctttaagatttgagaagaaaccaccatcgattcccaaaagacctgaaacgttttctagtgaaagaccaatgattttttggataactttatcttcgtaa

SEQ ID NO: 1199 - DNA (genomic), 930 bp, Streptococcus pneumoniae; double-stranded, circular
  misc_feature (B) LOCATION 1...930
  hypothetical: NO
  anti-sense: NO
gaaaggactgaaaacatcatgactgaaaaacttcaattaactaaatcagatcgtaaaaaagtttggtggcgttcaaccttcttacaagggtcttggaactttgaacggatgcaaaacttgggctgggcttatacactcattccagctatcaaaaaactctatactaaaaaagaagatcaaatcgctgctcttgagcgtcaccttgagttcttcaacactcatccatacgtagctgctccagtcatgggggttactcttgcgcttgaagaagaacgtgctaacggtgtggaaatcgatgacgctgctatccaaggggtcaaaatcggtatgatgggacctcttgctggtatcggtgacccagtattctggtttacagtacgcccaatccttggatctctcggtgcttcacttgcccttactggcaatatcttgggtccactcctcttctttgttgcatggaacttgattcgtatgtcattcttgtggtatgttcaagagattggatacaaggctggatcagaaatcactaaagatatgtctggtggtatccttcaagatatcactaaaggagcttctatccttgggatgttcattcttgctgtccttgttcaacgctgggtaaatattaaatttgctttcgatgtttctaaagttcaactagatgaaaaggcttatatccattgggataaattgccagaagggtctaaaggtatccaagaagcattcgcacaagtaggacaaggattgtctcaaactcctgaaaaagttactactttccaacaaaacttggatatgttgattcctggattatcaggactactccttactttactttgcatgtacttacttaagaaaaaagtatctccaatcactattatccttgccctcttcgcagtgggtattgtggcacatgttcttcacatcatgtaa

SEQ ID NO: 1200 - DNA (genomic), 696 bp, Streptococcus pneumoniae; double-stranded, circular
  misc_feature (B) LOCATION 1...696
  hypothetical: NO
  anti-sense: NO
tggaggactgaaatgaaaaatataaatgggaaaaaggtaactatttatgatattgcacgtttatcaggtttttctccaaaaacagtttcacgagttattaatggtggagtaaatgttaaagaagaaacttatcaagcgattcaaaaagttatagaggaattgtcgtatattccaaatgcgtatgcaaaaaatttaactaaaaaagaagctataaatatattgatttctgtaaaaaaaatcgactcttttcctttaatttggtttcatacgctgttagataaagtgttacggacgtgtaaagaatttggtgttaatgctatagttgagtactttggagaggaggatacaattagtaattcaattatatcaagcacaggtagcctagtagatggtgttattgttttttatgaaagtgtagatgatatcagaattcagtatttaaagaagaaccatatgccttttcttgttttcggtgaatctcaaacgtctggagtagtctatgtatctaataataattttcaagctacttatgatatgatgaaagctgtaactgaagaaaaatttaaaaatatgtggttgcttatgggaggagaatcccatgttaataaggatcgtgaaagaggtgtgcgttcttttctgaatgataaaaattactttatggatttaaaagtcattttatggcttatctacaattga

SEQ ID NO: 1201 - DNA (genomic), 1311 bp, Streptococcus pneumoniae; double-stranded, circular
  misc_feature (B) LOCATION 1...1311
  hypothetical: NO
  anti-sense: NO
actgaagctgatgagggtatgcaagctgcgcgtgcagccctgccagcatggcgagctttatcagcaattgaacgtgcggcttatttgcataaaacagcagctattttagaacgcgataaggaaaaaattggtactatccttgccaaagaaatagcaaaagggattaaagcagcaattggagaagtagtgcgtacagcagacttgattcgttatgctgctgaggaaggtctccgtatcactggacaagcaatggaaggtggtggttttgaggcagcaagtaaaaacaaactggctgttgtccgtcgtgaaccagttggtatcgtgctagcgattgctccttttaattatccagttaatttatctgcttctaaaattgcacctgccttgattgcagggaatgttgtcatgtttaagccaccaacacaaggttccatttctggactcttgttggctaaagcatttgaagaagcagggattccggcaggtgttttcaacaccattacaggtcgtggttcagaaattggggattatatcattgagcacaaagaagtcaacttcatcaactttacaggttcaactcctattggagaacgtattggtcgtttagctggtatgcgtcctatcatgttggaacttggtgggaaagatgcagctcttgtactagaagatgcagatttggaacatgctgccaagcaaattgttgcgggagcctttagctactcaggacaacgttgcacggccattaaacgtgtcattgttctcgaaagtgtagcagataaattagctactttgcttcaggaagaagtttctaaattaacagttggtgatccatttgacaatgctgatattacacctgttattgacaatgcttcagccgacttcatttggggcttgattgaggatgcacaagaaaaagaggctcaggctcttacaccaatcaaacgtgagggcaatctcctctggccagtgctttttgaccaagttacaaaagatatgaaagtggcatgggaagagccatttggtcctgttttaccaatcattcgtgtggctagtgtagaggaagctattgcctttgccaacgaatctgaattcggccttcaatcatcagtctttacaaatgatttcaaaaaagcctttgaaattgctgaaaaacttgaagtaggtacagtccacattaataataaaacccagcgtggtccagataatttcccattccttggtgtcaaaggttctggagctggagtgcaaggaattaaatatagcattgaagcgatgacaaatgtcaaatccattgtttttgatgtgaaataa

SEQ ID NO: 1202 - DNA (genomic), 621 bp, Streptococcus pneumoniae; double-stranded, circular
  misc_feature (B) LOCATION 1...621
  hypothetical: NO
  anti-sense: NO
gctcaggctgaaacagtctcccagactgtttcactcccgaatgctaaaatcgtgttggatcgctttcacattgtacaacatcttagccgtgctatgagtcgtgtgcgtgtccaaatcatgaatcagtttcatcgaaaatcccatgaatacaaggctatcaagcgctactggaagctcatacaacaggatagccgtaaactgagtgataagcgattttatcgtcctacttttcgtatgcacttaaccaataaagagattttagacaagcttttgagctattcacaagacttgaaacatcactatcagctctatcaactcttgctgtttcactttcagaataaggaaccagagaaatttttcgggcttattgaggacaatctaaagcaggttcatcctctttttcagactgtctttaaaacctttctaaaggacaaagagaaaatcgtcaacgcccttcaactacactattctaatgccaaactggaagcgaccaataatctcatcaaacttatcaagcgcaatgcctttggttttcggaactttgaaaacttcaaaaaacggattttcatcgctctgaacatcaaaaaagaaaggacgaaatttgtcctttctcgagcttag

SEQ ID NO: 1203 - DNA (genomic), 621 bp, Streptococcus pneumoniae; double-stranded, circular
  misc_feature (B) LOCATION 1...621
  hypothetical: NO
  anti-sense: NO
gctcaggctgaaacagtctcccagactgtttcactcccgaatgctaaaatcgttcttgatcgctttcacattgtgcaacatcttagccgtgctatgagtcgtgtgcgtgtccaaatcatgaatcagtttcatcgaaaatcccatgaatacaaggctatcaagcgctactggaaactcattcaacaggatagccgtaaactgagtgataaacgtttttatcgtcctacttttcgtatgcacttaaccaataaagagattttagacaagcttttgagctattcacaagacttgaaacaccactatcagctctatcaactcttgctgtttcactttcagaataaggaaccggagaaatttttcggactcattgaggacaatctaaagcaggttcatcctctttttcagactgtctttaaaacctttctaaaggacaaagagaaaatcgtcaacgcccttcaactacactattctaacgccaaattggaagcgaccaataatctcatcaaacttatcaaacgcaatgcctttggttttcggaactttgaaaacttcaaaaaacggattttcatcgccctgaacatcaaaaaagaaaggacgaaatttgtcctttctcaagcttag

SEQ ID NO: 1204 - DNA (genomic), 597 bp, Streptococcus pneumoniae; double-stranded, circular
  misc_feature (B) LOCATION 1...597
  hypothetical: NO
  anti-sense: NO
gctcaggctgaaacagtctcccagactgtttcactcccgaatgctaaaatcgttcttgatcgctttcacattgtacaacatcttagccgtgctatgagtcgtgtgcatgtccaaatcatgaatcagtttcatcgaaaatcccatgaatacaaggctatcaagcgctactggaaactcattcaacaggatagccgtaaactgagtgataaacgtttttatcgccctacttttcgtatgcatttaaccaataaagagattttaaacaagcttttgagctattcagaagacttgaaacaccactatcagctctataataaggaaccagagaaatttttcggacttattgaggacaatcttaagcaggttcatcctatttttcagactgtctttaaaacctttctaaaggacaaagagaaaatcgtcaacgcccttcaactaccctattcaaacgccaaattggaagcgaccaataatctcatcaaacttatcaaacgcaatgcctttggttttcgaaactttgaaaacttcaaaaaacggatttttatcgctctgaacatcaaaaaagaaaggacgaaatttgtcctttctcaagcttag

SEQ ID NO: 1205 - DNA (genomic), 255 bp, Streptococcus pneumoniae; double-stranded, circular
  misc_feature (B) LOCATION 1...255
  hypothetical: NO
  anti-sense: NO
gctcaggctgaaacagtctcccagactgtttcactcccgaatgctaaaatcgttcttgatcgctttcacattgtacaacatcttagccgtgctatgagtcgtgtgcgtgtccaaatcatgaatcagtttcatcgaaaatcccatgaatacaaggctatcaagcgctactggaaactcattcaacaggatagccgtaaactgagtgataaacgtttttatcgtcctacttttcgtatgcacttaaccaataaatag

SEQ ID NO: 1206 - DNA (genomic), 621 bp, Streptococcus pneumoniae; double-stranded, circular
  misc_feature (B) LOCATION 1...621
  hypothetical: NO
  anti-sense: NO
gctcaggctgaaacagtctcccagactgtttcactcccgaatgctaaaatcgttcttgatcgctttcacattgtgcaacatcttagccgtgctatgagtcgtgtgcgtgttcaaatcatgaatcagtttcatcgaaaatcccatgaatacaaggctatcaagcgctactggaagctcatacaacaggatagccgtaaactgagtgataagcgattttatcgtcctacttttcgtatgcatttaaccaataaagagattttaaacaagcttttgagttattcacaagacttgaaacaccactatcagctctatcagctcttgctttttcacttccagaataaggaaccagagaaatttttcgaacttatcgaggacaatcttaagcaggttcatcctatttttcagactgtctttaaaaccttcctcaaagataaagaaaagattatcaacgcccttcaactacactattctaatgccaaactggaagcgaccaataatctcatcaaacttatcaagcgcaatgcctttggttttcgaaactttgaaaacttcaaaaaacggatttttatcgctttgaacatcaaaaaagaaaggacgaaatttgtcctttctcgagcttag

SEQ ID NO: 1207 - DNA (genomic), 1230 bp, Streptococcus pneumoniae; double-stranded, circular
  misc_feature (B) LOCATION 1...1230
  hypothetical: NO
  anti-sense: NO
gttggggctgagaaattttctcaacctcattttttaaagtggacatatagaaaggtcttgcaagactgtaacatgaaaaaagaatttaatttaattgcaactgtggcagcagggcttgaggctgtcgttggtcgtgaagtgcgagagatgggctacgattgtcaggttgaaaatggacgtgttcgttttcaaggagacgtgagagctattatcgaaaccaacctttggcttcgggcagcagatcgtatcaaaattatcgtaggaacgttcccagctaagacttttgaagagctatttcagggagttttcgctttggattgggaaaattatttaccacttggagctcggttcccgatttcaaaagctaaatgtgttaagtccaaacttcacaatgagcccagtgttcaggctatttctaagaaagctgttgtcaagaaattgcagaaacactatgctcgcccagaaggggttcctctgatggagaatggcccagagtttaagattgaggtctctattctcaaagatgtggcaactgtcatgattgatacgaccgggtctagcctctttaaacgtggttatcgtaccgaaaaaggtggcgctcctatcaaggaaaatatggcagcagccattttacaactttctaattggtatccagacaagactttgattgatccgacctgtggttcggggactttctgtattgaggcagttatgattgctagaaagatggcgccaggtcttcgtcgctcttttgcatttgaggaatggaactggatcagcgatcgcttgattcaagaagtgcgcacagaagcggctaaaaaagtagaccgtgagcttgagctggatatcatgggctgtgatattgatgctcgcatggtggaaattgctaaggccaatgctcaggcagctggtgttgcaggagacattacttttaagcagatgcgcgtgcaggatttacgttccgataaaatcaatggagtaatcatttccaatccgccttatggtgaacgtttgtcagatgatgcaggggtgaccaagctctatgctgagatggggcaagtatttgcaccgctgaaaacttggagcaaatttatcctgactagtgatgaagcttttgaaagcaagtatggtagccaagcagataagaagcgtaagttatacaacggaaccttgaaagtggatctatatcaatattttggtcagcgtgtcaaacggcaagaggtaaaatag

SEQ ID NO: 1208 - DNA (genomic), 900 bp, Streptococcus pneumoniae; double-stranded, circular
  misc_feature (B) LOCATION 1...900
  hypothetical: NO
  anti-sense: NO
agagcttatgaagttttttgcgagaataacttaaatattactttttttgatacattttctgaaattaaaaataatattgattattatattattgcgcttccgacagattatgatgagaaaattggtagttttaatacatatgaaatcgaacaaacggtatcgaagattctgagggtaaaacctaatggaaagattattttaaagtcaacagttccgatcggcttttcaaacaaattaaaaaggctgtttgatacaaaaaatatcatttttgtccctgaatttttgagagaaggttgttctatatatgataatttatatccaagtcgcatagttgttggagatgagacagttgaaggaagaaaaattgcagagttgttcctttcgattagtactcatagtactgccaatattaaaaatgttatgttagtttctcctactgaagcagaagcaattaagcttttttctaacacattcttagctctccgtgttgctttttttaatgaactagattcttttgctgagaggagaagtttaaatgctgaagttgtaataaaaggtgtttgtttagatccaagaattggaaatttttataataatccttcttttggatttggaggatattgtcttcccaaagatactaaacaattaaaaaaagaatttatagaaataaatgccccagtgatagaagcgattgatatttcaaacacaaatagaaaacagttcatagttaaacaaatattggaacgaaagccaaagatagtaggaatatataaattggggatgaaatataattcagataattacaaagagtcagctattttaagtataattaatgaactattgattgtcggtataaaaattttagtatatgaaccaaatttaaacgttagttatagataa

SEQ ID NO: 1209 - DNA (genomic), 627 bp, Streptococcus pneumoniae; double-stranded, circular
  misc_feature (B) LOCATION 1...627
  hypothetical: NO
  anti-sense: NO
caaacatatgaaacacgtacagttatcgtagcaactggttctaaacaccgtcctttgggagtacctggagaagaagaactgaacagtcgtggtgtttcttactgtgctgtgtgtgatggtgctttcttccgtgaccaagatttattggtagttggtggtggagattcagctgttgaagaagccctcttcttgactcgttttgctaagactgttaccattgttcaccgtcgtgaccaacttcgtgcccaaaaggttttacaagatcgcgcctttgcgaatgaaaaaatcagctttatctgggattctgtagtaagggaaatcaagggtgaaaaccgagtagaatcagtcgtatttgaaaatgtgaaaacaggtcaagtgacagaacaagtcttcggtggtgtctttatctatgttggattggaccctcttagcgattttgttaaagaattgaatatccaagatcaggcaggatggattgtgacagataaccacatgaaaactgcagtcgacggtatctttgcagttggagatgttcgcttgaaagaccttcgccaagtaacaacagcggttggagatggagctatcgctggtcaagaagcctataaattcattacagaacatagttaa

SEQ ID NO: 1210 - DNA (genomic), 657 bp, Streptococcus pneumoniae; double-stranded, circular
  misc_feature (B) LOCATION 1...657
  hypothetical: NO
  anti-sense: NO
aaaggagacctcatgacacttccagttagaaaatccctgcacgatgcagttttacaggcttcgaaagcggatacttgggaacaagcgaccaaggaatggaatgaagtttcctttatttttaacggtatcggccgtagcaattgtgtctgtggaaatgccatcaaatacgcttatgaactctttaacggtgtcacaggccaacgcctctttccaattggtagcgactgtgttcgtcattttcatcgattgccccttgaccagcaattggaagaggaagaaaaactgctcagaaaggttgaaaatctaaccagaaaagctcagaaaaaggaaaaaatcaaggtcaataaaagtgactttgacgagcgacttctaaaatggctctgggaaaaaggtgttttcaaacccaatcgtggcaatcaatttgcgcctgagagagactaccagcttttcctagaagtctttcagggaggaagttggaccaaggcggaaccaaagaaaaaggctcggatggaagaagtccttgaaaagtgtatcaaaccctttttacttgggaaatcggatgaccaactctaccttgtcaagctaggcaaggagaaaattgactacgaacaagaactcccgtatccaggcagagaaagaacgcaagaagagggataa

SEQ ID NO: 1211 - DNA (genomic), 1377 bp, Streptococcus pneumoniae; double-stranded, circular
  misc_feature (B) LOCATION 1...1377
  hypothetical: NO
  anti-sense: NO
ttacatcatgaaaaagtaggttttattatgaaaattatccttgtcggagggggaaaagttggttttgccctctgtcgctccttggttgcagaaaagcatgatgttttgctgattgagcaagacgaagctgttctcaatcatattgtcagtcgctttgatatcattggtatccttggtaacggggccgattttgccattcttgagcaagccagcgtccaagattgtgatatctttatcgccctgactgagcacgatgaagtcaacatgattgcagcagttctagccaagaaaatgggagctaaagaaactatcgttcgggtgcggaaccctgaatattctaactcttatttcaaggaaaagaatattctcggtttttctcttatcgttaatcctgagctcttggctgcccgcgctatcgcgaatatcattgacttccccaacgccctgtctgtcgaacgctttgctggtggacgcgttagcctcatggaatttgtcgtcaagtccaccagcggtctttgccaaatgcccatttctgattttcgtaaaaaatttggtaatgtcattgtctgtgcgatagagagggagcatcaaattatcattccaagcggtgacatgactgtacaggataaagatagaatctttgtcactggtaaccgtgtcgatatgatactcttccataattattttaaatcacgcgccgtgaagagccttctcatcgttggggcaggtagaattgcctattatctacttggtattctcaaagatagtcgtatcgatacaaaagtcattgaaatcaatcctgaaatcgccagcttctttagcgagaaattcccaaatctctacatcgttcaaggagatggaaccgcaaaagatatcctgctggaagaaagtgctcaacactatgatgccgttgcgactctaacaggtgtcgatgaggaaaatctgattacatctatgttccttgacagggtaggtgtacagaaaaatattactaaggtcaatcgtaccagtctcctcgagattatcaatgcgcctgatttttcaagtatcatcacacctaaaagcatcgctgtagatacgattatgcactttattcgtggtcgagttaatgcccagtattcagaccttcaagccatgcaccatctagccaatggccaaatcgaaaccctgcaattccatatcaaggaagccaataaaatgactgccaaacctctttctcaactgaaattgaaaaaaggggttcttattgcagccattattcgaaagggcaagactattttcccaactggggaggatatgttggaagttggagacaagctcctagtaacaaccttgttgccaaacatcaccaagatttatgacttgattgcgaggtaa

SEQ ID NO: 1212 - DNA (genomic), 1290 bp, Streptococcus pneumoniae; double-stranded, circular
  misc_feature (B) LOCATION 1...1290
  hypothetical: NO
  anti-sense: NO
aagctggaccttcttcctttactggatcagcgtcctcaggatttgtcaggtggacaaaagcagcgagtcagtctagctggtgtcttgattgatgaaagtccgattctcttgtttgatgagccactcgccaatctagatcccaagtcaggtcaggatattatcgaattgattgaccagattcataaggaagaggggacgacgactctgattatcgagcaccgtttggaggacgttctgcatcgccctgtggatcggattatcttgataaacgatggtcgtatcctttttaatgggagccctgaccagttgcttgcgactgatttattgactcaaaatggaattcgagaacccctttatctaacgactctccgtcaattaggtgtggacttagtcaaggaagaacagttagcgaatctggataacatgtctatctcaaaaggtcaggttcagctgcagaatgaactggcaaaagaaactccagaattgcagtcactctttaaattagaggacgtgtctttctcttatgatgatagaccgattttaaaatccctacatttagatattaaaaagggtgaaaagattgctattgtcggaaaaaatggagcagggaaatcaactctagccaaggctataagtagctttattcagacggaaggacgctatctttgggaaaaacaggatataaaaggcgattctgttgcagagcgggcggaacgagtaggctatgtgctacaaaatcctaatcaaatgatttcaaccaatatgatttttgatgaggtggctctagggctccgtttgcgaggtgtggatgagaaggaaattganacgagagtctatgaaaccttgaaaatctgtggactttatgaattccgtaattggcctatttctgccctgtcatttggtcagaaaaaacgtgtcaccattgcttcaattttggtcttaggagctgaaattattttcctagatgaaccgactgcaggtcaagatcagaagaactatactgagattatggaatttctcgaagagttacatcaaaaagggcataccattgtcatgattacccatgatatgcaattgatgctggattattcagaccgggtccttgtcatggtggatggagaattgattgccgatactgttccagccagtctgttgagcgatcctgagctgttagtaaaagccaatctaaaagaaacctccatctttaacttggctaagaaactagatgtggatccactggatttaacggcattttacaaagaaaggagagagggatgcaagctaaattaa

SEQ ID NO: 1213 - DNA (genomic), 789 bp, Streptococcus pneumoniae; double-stranded, circular
  misc_feature (B) LOCATION 1...789
  hypothetical: NO
  anti-sense: NO
ggagtacatgagagaagcatgattcagtctatcacgagtcaaggcttggtgctttacaatcgcaattttcgtgaggatgacaagctcgtcaaaatttttacagagcaggttggcaaacgcatgttttttgtcaaacacgctggtcagtctaagctggcgcctgttattcagcccttggtgctggcacgatttctattgcgaatcaatgatgacggactcagttacatcgaagactatcatgaggtcatgacttttcccaagattaatagtgacctctttgtcatggcctatgcgacctatgtggcagctcttgcagatgctagtttgcaggacaatcagcaggatgctcccttgtttgcttttttgcaaaagactttggagttgatggaagcaggcttggattatcaggttttgaccaatatttttgaaattcaaattttgactcgatttggaatcagcctcaattttaatgagtgtgtcttctgccatcgggttggtcaggcttttgacttttctttcaaatatggagcctgcctctgtccagagcattatcatgaggataagagacgttgtcatctcaatcccaatatcccctatctgctcaatcaatttcaagctattgattttgagactttggagaccatttcgctcaagcctggaatcaagcaagagctacgccaatttatggatcaactatatgaagagtacgttgggattcacctaaaatcaaagaaatttattgattccctagcagactggggacaattactaaaagaggaaaagaaatga

SEQ ID NO: 1214 - DNA (genomic), 294 bp, Streptococcus pneumoniae; double-stranded, circular
  misc_feature (B) LOCATION 1...294
  hypothetical: NO
  anti-sense: NO
tttcttaatgagagggatataacttccagacatatcaacagtgacgactttaactttttttctagcttctttcgagtacttgaagaaatgatttcggatggttgtttgacgtctgttatcaagaatggtcatgattttcttagtgttgaaatcctgagcaatgaaagccaatttccccttctggtaggagaattcatcccaggagaggatttcaggcaaagtggtgtaatcctcttggaaatgaaattgcttgagcttacgatagacggtagaggtagaggtagagatggctaa

SEQ ID NO: 1215 - DNA (genomic), 294 bp, Streptococcus pneumoniae; double-stranded, circular
  misc_feature (B) LOCATION 1...294
  hypothetical: NO
  anti-sense: NO
agatataatgaagaaaaatcgagcaaggaaaaagaactgacaaattcaaagtatattacttgtttgaaacgttcagagggccagttgtgtgggattcaaaagatgattgaaggagatcgtgactgtgctgatattgtgacgcaactgacagcagtgaaatctagtgtagagcgcgtgattgagatgataattaccgaaaatcttactgaatgtatcaatcagcccctagatgattctgaagctcaaaaggaacgcctagaaaaggctatccgatacttgattaaacggaaataa

SEQ ID NO: 1216 - DNA (genomic), 1311 bp, Streptococcus pneumoniae; double-stranded, circular
  misc_feature (B) LOCATION 1...1311
  hypothetical: NO
  anti-sense: NO
cttgaaaatgaaggtgggggtttttgtnngngttttttnttnnttnntnntnntnnttttnnnnccccgcgnnnnnnnnnnnnnnnnnnnnnnnnnnnnnnnnnnnnctttttacaaaatagagccactatactggagtttctatatcgaaatccagcaacatcccgtacagatattgttaatgaaacaggacttactccagcaacaacgactaacatcataaaagaactaagcgaacagtccctcatatacgaaactggtgatgaatttagcgagttttccggatctggaagacgtagaaaaactatttctatcacagataatattccgtatgttgttggaggtattgaaataaacgtcctaggtatctttctcagtctatgtgacttacaagggaaaactcttttcgagacagaaattttgaatgaagattatcctatttcagaaatcaattccaccattaccaatatgataaaaacagctatagagtacgtccctttggaaacaaaattacttggatttggcttatcaatacctggacattattacaaagactccggaagtatcattacaaacaaccccatatgggaatcttttaatttattaaatgtaattaaaagattcaattttccttttattgtaaaaaataatatcgattgtatggctataggacaatacctttttaatccacacaatacccccgataactttattttcctacacgctggattaggtatttacacttcctttttcacaaaagaaaaaataggagcctctaaaaatccttatatcggagaaattggacacaccattgtcgaattgaatgggcaatattgtgaatgcggaaaaaaaggttgtttacaaacatatatttcggatgcttggttaatcaaacacgcccaattattatttaaaaattcccaactaactgtactaaaaagccttgtaaagactgaaaaagacattcatttagacacccttttaacggcttataatttaggcgactccgctttacgtcaacaaattgataaaggagtcaatttattagccacttctattgcaaatctcctcctcatcaatcctgctgataaaatctatatcaacagtcaattgcttaattatcaacctttcactcatgaagtcagggataaaatccaagaccagctccacttcgttccctttactcgtaatatagaaattgaaattttaccttacaacaaacatcgtggaagtataggagcttgtgcattagctatcgtcgcttttttcatagaacatagcaatgtattacaagatattatttcaccttaa

SEQ ID NO: 1217 - DNA (genomic), 657 bp, Streptococcus pneumoniae; double-stranded, circular
  misc_feature (B) LOCATION 1...657
  hypothetical: NO
  anti-sense: NO
aaaagaaatgagttagacatgtcaaaaggatttttagtctctcttgagggaccagagggagcaggcaagaccagtgttttagaggctctgctaccaattttagaggaaaaaggagtagaggtgttgacgacccgtgaacctggcggagtcttgattggggagaagattcgggaagtgattttggatccaagtcatactcagatggatgctaaaacagagctacttctctatattgccagtcgcagacagcatttggtggaaaaagttcttccagcccttgaagctggcaagttggtcatcatggatcgttttatcgatagttctgttgcctatcagggatttggtcgtggcttagatattgaagccattgactggctcaatcagtttgcgacagatggcctcaaacccgatttgacactctattttgacatcgaggtggaagaagggctggctcgtattgctgctaatagtgaccgcgaggttaatcgtttggatttggaagggttggacttgcataaaaaagttcgtcaaggctacctttctcttctggataaagagggaaatcgcattgtcaagattgatgctagtctccctttggagcaagttgtggaaactaccaaggctgtcttgtttgacggaatgggcttggccaaatga

SEQ ID NO: 1218 - DNA (genomic), 519 bp, Streptococcus pneumoniae; double-stranded, circular
  misc_feature (B) LOCATION 1...519
  hypothetical: NO
  anti-sense: NO
ggaggaaatgatatggataaaaaagaacgacaaaagattgaacaacaacgtcgagagatggctctaactaatactttttttaatcgatatcttcttctacgttattcaatagcactcttcttttttgggaatatttattggcttttgaatcagtttattaatccctcgcctattattattttccccattatgctcatagtattttctattttagcaactgttgaacaatttaaactctatggaaataggaaagaaaagttgggaataacactaatgtttgttagaatacaaatgcttatttcaataggattacttgttttaacttggacaagttggtttaagaatctttttccgatttttgaaaataaccaagtagcacgtttatttgtttttgtagttcttctattaggtttagttctgagtttgttagacattagaagaattaaaaaaatttataaacgaacagataaggtttatcaacaatttgtccaattggaaaagaactcacttagtttataa

SEQ ID NO: 1219 - DNA (genomic), 405 bp, Streptococcus pneumoniae; double-stranded, circular
  misc_feature (B) LOCATION 1...405
  hypothetical: NO
  anti-sense: NO
gaagcgaatgaagagagtaagatgaaagaagctataattgagtggaaggatttctctttccggtatgaaacacaacaagaaccgaccttgcaagggatagacttgaccatttacaagggagagaaagtcttaattgttggaccatctggatcaggtaaatctaccttgggtcagtgtttgaatgggattattcccaatatttacaagggtcagacatatggagaatttttgataaagggtcaaacagcctttgatatgagcatctatgataagtctcatctggttagcacagttttgcaggatacagatgggcagtttattggcttgtctgtggcagaagatttggcgtttgctctggaaaatgatgtgacagccctagatgagatgaaagggtcgtgtttataa

SEQ ID NO: 1220 - DNA (genomic), 1131 bp, Streptococcus pneumoniae; double-stranded, circular
  misc_feature (B) LOCATION 1...1131
  hypothetical: NO
  anti-sense: NO
tcttttgatgaaacgagcaaggcagataccaagaccttgccgaaggtttctcagagtaccttgacatctattcctaaggttcaagcgcagacagaacacaaatcaatcaaaaacccaagccaggctgtgacagaggaaacttaccaaccacaagcaccgaaaaaacatagatttaagatgcgttacctgattttgttggccagccttgtattggtggcagcttctcttatttggatactatccagaactcctgcaaccattgccattccagatgtggcaggtcagacagttgcagaggccaaggcaacgctcaaaaaagccaattttgagattggtgaggagaagacagaggctagtgaaaaggtggaagaagggcggattatccgtacagatcctggcgctggaactggtcgaaaagaaggaacgaaaatcaatctggttgtctcatcaggcaaacaatccttccaaattagtaattatgtcggccggaaatcttctgatgttatcgcggaattaaaagagaaaaaagttccagataatttgattaaaattgaggaagaagagtcgaatgagagtgaggctggaacggtcctgaagcaaagtctaccagaaggtacgacctatgacttgagcaaggcaactcaaattgttttgacagtagctaaaaaagctacgacgattcaattagggaactatattggacggaactctacagaagtaatctcagaactcaagcagaagaaggttcctgagaatttgattaagatagaggaagaagagtccagcgaaagcgaacaaggaacgattatgaaacaaagtccaggtgccggaacgacttatgatgtgagtaaacctactcaaattgtcttgacagtagctaaaaaagttacaagtgttgccatgccgagttacattggttccagcttggagtttactaagaacaatttgagtcaaattgttgggattaaggaagctaatatagaagttgtagaagtgacgacagcgcctgcaggtagtgtagaaggcatggttgttgaacaaagtcctagagcaggtgaaaaggtagacctaaataagactagagtcaagatttcaatctacaaacctaaaacaacttcagctactccttaa

SEQ ID NO: 1221 - DNA (genomic), 228 bp, Streptococcus pneumoniae; double-stranded, circular
  misc_feature (B) LOCATION 1...228
  hypothetical: NO
  anti-sense: NO
aaaggtgatgaagaacaaaccaagattcaagcaggaattcctactgataatgaagtaagttatgctcttatttatcagcaggaaactcttcctgcaacaggttcatcaacttctgcgcttacagctttaggcctattagctgttggtagtttagttcttttggttcggaacagttttttgctccctctgaaaagtcatcatttgatggcttttttctatatagggtaa

SEQ ID NO: 1222 - DNA (genomic), 189 bp, Streptococcus pneumoniae; double-stranded, circular
  misc_feature (B) LOCATION 1...189
  hypothetical: NO
  anti-sense: NO
tttgtcgatgacatcttcgatggcattccagttaatggctttgtagtaagtttccatttaaaatctctttctgtgtttagtattgcgaactcacaattatttctactttaccataattctataggagtatcgcacaaaaagtcggaagcccgacttttaaaatgttacataaattatgttatgacatag

SEQ ID NO: 1223 - DNA (genomic), 1059 bp, Streptococcus pneumoniae; double-stranded, circular
  misc_feature (B) LOCATION 1...1059
  hypothetical: NO
  anti-sense: NO
atgaaagatgatcagaaatatttattagcgggactttattcgcttctagttgcaatattttattttccattgattgagtccaaggggatttttgtaagtatattgatggcggttttacttttatatttaatatacttcattgcaacagtcattcatattgtgataattaagtttataagaaaaaaatcttttaagtatttggttctatatccatttacttacgatgggagctggagatttcaacctataaacttactctactttccagaaatggtgagagatgtcattccgattaatttagttcaagaatattgccaaggacaaccttacggactgttaaaaaagatgctgaaaagaattcgattgtcacgagagatatctttactcctggctaccattatcgtctatttttttacgcatagaattctacctctttcagtatttacgttcatattttcttacatattgctatttgtacaatcttatttgggtagcaataccgcttggattggaaatagaagattaataatagatgatgaatttgaaaaaatcttgctttcaaaaagttatataaaagaaatatcatctgcacgatactcagaatacttgacatgtgaatacaaaaaccttacaccaatcatattgatagctatttttgaaaatttgcttgactcctacttgcttcagaatcagagtgaggttgacttagatattttttataaagttttacctttgctttataaagaaaaatatactatgggattcaattactttgtaagtttaaattatttactatataaggttggatttttgggaatcatttacgataatgaagcattaagagatttgtcaaaacaatatttaaacaaaaatatttcggaattacaagatggttctttcgagggcggtatacaagatgctgttgcctctaaacaaatagtagttataaatgaatttatagcttgtttaaattccagatgcgtgccatcccaatatgatagatttttttataaagatagaccttatattttttccagaaagagtcctattaaggggtga

SEQ ID NO: 1224 - DNA (genomic), 798 bp, Streptococcus pneumoniae; double-stranded, circular
  misc_feature (B) LOCATION 1...798
  hypothetical: NO
  anti-sense: NO
aaaggagatgaactaatggtttatacttcactttcctcaaaagatggcaattacccctatcagctcaacattgcccacctctacggaaatctcatgaatacctacggggacaatggaaacatcctcatgctcaagtatgtggctgaaaaactgggagcccatgtgaccgttgacatcgtttctctccatgatgactttgatgaaaatcactacgacatcgcctttttcggtggtggtcaagactttgaacaaagtatcattgcagacgacctacctgctaaaaaagagagcattgacaactacatccaaaacgacggtgtagttctggctatctgcggtggtttccaactattgggtcaatattatgttgaagcttcaggaaaacgtatcgaagggctaggggtcatgggacactacacgctcaaccagaccaataaccgttttatcggtgacatcaagattcacaatgaagatttcgatgaaacctactatggatttgaaaatcaccaaggtcgtaccttcctctctgatgaccaaaaaccgctgggacaggttgtctatggaaatggaaacaacgaagaaaaggtcggtgaaggggttcattataagaatgtctttggttcctacttccacgggcctatcctctctcgtaatgccaatctggcttatcgcctagttactactgccctcaagaagaaatatggtcaggacatccaactccctgcctatgaggacattctcagccaagaaatcgctgaagagtacagtgacgtcaaaagcaaggctgacttttcttaa

SEQ ID NO: 1225 - DNA (genomic), 402 bp, Streptococcus pneumoniae; double-stranded, circular
  misc_feature (B) LOCATION 1...402
  hypothetical: NO
  anti-sense: NO
aaaaattgtgaggaaaagaaaatggcaaaaacaattcatacagataaggccccaaaggctatcgggccctatgttcaaggaaaaatcgttggcaaccttttgtttgctagcggtcaagttcccctatcccctgaaactggggaaattgtaggagagaatatccaagaacagacagagcaagtcttgaaaaacatcggtgctattttggcagaagcaggaacagactttgaccatgttgtcaaaacaacttgtttcttgagcgatatgaacgactttgttccttttaatgaggtttaccaaacggccttcaaagaggaattcccagctcgttcagctgtggaggtagctcgtcttcctcgtgatgtaaaagtcgaaattgaagtcatcgcagagattggataa

SEQ ID NO: 1226 - DNA (genomic), 657 bp, Streptococcus pneumoniae; double-stranded, circular
  misc_feature (B) LOCATION 1...657
  hypothetical: NO
  anti-sense: NO
aaaggttgtgattttgtgaaagataaacagtttgctattccaaaagctacagcaaaaagactctctctctactatcgaatttttaagagatttcatgcagaaaagattgaacgtgccaactctaagcaaattgcagaggccattgggattgattcagcgaccgtacgtcgtgatttttcctattttggtgaacttggtcgtcgtggttttggctatgatgtcaaaaaactaatgacattttttgccgatttgctcaatgacaactctattaccaatgtcatgctggttggtattggaaatatgggccatgcccttctccactaccgcttccacgaacgtaacaagatgaagattatcatggcctttgacctagacgaccatcctgaagtcggtacccaaactcctgacgggattcccatttacgggatttctcagatcaaggataaaatcaaggatgctgatgtgaagactgctatcctaactgttcccagcgtcaagtcacaagaggttgctaatctcttggttgatgctggtgtgaaaggaattctcagtttttcaccagtccatctgcatttaccaaaagacgtggtcgttcagtatgtcgatttgacaagtgaactccaaaccctcctctacttcatgcgaaaagaggattag

SEQ ID NO: 1227 - DNA (genomic), 216 bp, Streptococcus pneumoniae; double-stranded, circular
  misc_feature (B) LOCATION 1...216
  hypothetical: NO
  anti-sense: NO
gactgctgtgaaactatgagagttgcagccctaaactcgagtataattgggtcattcaggtctagagcgccacaggtggcagacggcggcactggcgctttaaatgtagtaaaccgtatagggagattggccagactgacaagtaatggagttctacatactagacatgctttgacggtaaatggccataatgcacaactgcggacatttgtataa

SEQ ID NO: 1228 - DNA (genomic), 528 bp, Streptococcus pneumoniae; double-stranded, circular
  misc_feature (B) LOCATION 1...528
  hypothetical: NO
  anti-sense: NO
tgtagatgtgatagaattagtggggaattcataatgagacagttgaagcgagttggagtatttttattgcttcctttctttgttctaattgacgcccatattagccagcttctgggctcatttttcccccatgtacatttggctagtcattttctttttctatttctcttatttgagacgatagaagtatcagagtatctctacctagtctattgttttgttataggcttggtttatgatgtttactttttccatctaatagggattacaactctcttatttatcttattgggagccttccttcataaattgaatagtgttattttgttgaatcgttggacaagaatgctagctatgattgtgctgacattcctgtttgaaatgggtagttatcttttggcttttatggtagggttgacagtagatagcatgtcgatttttatagtctatagcttggtaccgacgatgattttaaattttttatggattactgtttttcaatttatttttgaaaaatattatctataa

SEQ ID NO: 1229 - DNA (genomic), 2562 bp, Streptococcus pneumoniae; double-stranded, circular
  misc_feature (B) LOCATION 1...2562
  hypothetical: NO
  anti-sense: NO
atattgtgtgaaaaagataaattctcttgtgagtttgcttacttcaagaattttctattttcacttggtattttatgggctttgtatcttatgtctaacattcaaaacatgtccctggaggacatcatgggagagcgctttggtcgctactccaagtacattattcaagaccgggctttgccagatattcgtgatgggttgaagccggttcagcgccgtattctttattctatgaataaggatagcaatacttttgacaagagctaccgtaagtcggccaagtcagtcgggaacatcatggggaatttccacccacacggggattcttctatctatgatgccatggttcgtatgtcacagaactggaaaaatcgtgagattctagttgaaatgcacggtaataacggttctatggacggagatcctcctgcggctatgcgttatactgaggcacgtttgtctgaaattgcaggctaccttcttcaggatatcgagaaaaagacagttccttttgcatggaactttgacgatacggagaaagaaccaacggtcttgccagcagcctttccaaacctcttggtcaatggttcgactgggatttcggctggttatgccacagacattcctccccataatttagctgaggtcatagatgctgcagtttacatgattgaccacccaactgcaaagattgataaactcatggaattcttgcctggaccagacttccctacaggggctattattcagggtcgtgatgaaatcaagaaagcttatgagactgggaaagggcgcgtggttgttcgttccaagactgaaattgaaaagctaaaaggtggtaaggaacaaatcgttattactgagattccttatgaaatcaataaggccaatctagtcaagaaaatcgatgatgttcgtgttaataacaaggtagctgggattgctgaggttcgtgatgagtctgaccgtgatggtcttcgtatcgctatcgaacttaagaaagacgctaatactgagcttgttctcaactacttatttaagtacaccgacctacaaatcaactacaactttaatatggtggcgattgacaatttcacacctcgtcaggttgggattgttccaatcctgtctagctacatcgctcaccgtcgagaagtgattttggcgcgttcacgctttgacaaagaaaaggctgagaaacgtctccatatcgtcgaaggtttgattcgtgtgatttcgattttggatgaagtcattgctcttatccgtgcttctgagaataaggcggacgccaaggaaaacctcaaagttagctatgattttacggaagaacaggctgaggctatcgtaactttgcaactgtaccgtttgaccaataccgatgtggttgtcttgcaggaagaagaagcagagcttcgtgagaagattgctatgctggcggctattatcggtgatgaaaggactatgtacaatctcatgaagaaagaacttcgtgaggtcaagaagaaatttgcaactcctcgtttgagttctttagaagacactgcgaaagcaattgagattgatacagctagtcttatcgctgaggaagatacctacgtcagcgtgaccaaggcaggttacatcaagcgtaccagtccacgttcctttgcggcttccaccttggaagaaattggcaagcgtgatgatgaccgtttgatttttgttcaatctgccaagacaacccagcacctcttgatgttcacaagtcttggaaatgtcatctacagaccaatccatgagttggcagatattcgttggaaggacatcggagagcatctgagccaaaccatcacaaactttgaaacgaatgaagaaatcctttatgtggaagtactggatcagtttgacgatgcgacaacctactttgcagtgactcgccttggtcaaatcaaacgggtagagcgaaaagaattcactccatggcggacctatagatctaagtctgtcaagtatgctaagctcaaagacgatacagatcagattgtagcagtggctccgattaaactagatgatgttgtcttggttagtcaaaatggttatgccctgcgtttcaatatcgaagaggttccggttgtcggtgctaaggcagcaggtgtcaaggctatgaatttgaaagaagatgatgtcctccaatctggctttatctgtaatacttcgtccttctacctcttgacccagcgtggaagcttgaaacgtgtttctattgaggaaattctagcaaccagccgtgccaaacgaggattacaagtcttgcgtgagttgaaaaacaaaccgcatcgtgtcttcttggcaggagcagttgcagagcaaggatttgttggcgatttcttcagtacggaagtggatgtgaacgaccaaactctgcttgtccaatccaataaaggaacaatctatgaaagccgattgcaagacttgaacttgtcagaacgcactagcaatggaagcttcatttctgacacgatttcagatgaagaagtttttgacgcttatcttcaggaagtagttactgaagataaataa

SEQ ID NO: 1230 - DNA (genomic), 600 bp, Streptococcus pneumoniae; double-stranded, circular
  misc_feature (B) LOCATION 1...600
  hypothetical: NO
  anti-sense: NO
gggactcgtgataccagccgaaaggttctgtctctcctccaagatgaaggattgatcaaggggataccagggcaaggttctcaagtcgtcaaagaagaaaccgtctatttccctgtatccaacctaaccagctaccaagaactagttaaagaacttggactgcgctctaaaaccaacgtggtcagtctggacaagattattattgataaaaaatcctcgctgataaccggtttcccagagtttcggatggtttggaaggtggtccgccagcgtgtggtggatgatctggtatccgttctggatacagactatctggatatggaactaattccaaatctcactcgccaaattgctgagcagtctatctattcttatatagaaaatggcctcaaactccttattgattatgctcagaaggaaatcaccattgaccactcaagcgaccgagacaagattctcatggacattggcaaagacccttatgtcgtttcgattaaatcaaaagtctatctccaagacggacgccaatttcagtttaccgaaagtcgccataagttagaaaaatttagatttgtagattttgcaaaacgcaagaaataa

SEQ ID NO: 1231 - DNA (genomic), 729 bp, Streptococcus pneumoniae; double-stranded, circular
  misc_feature (B) LOCATION 1...729
  hypothetical: NO
  anti-sense: NO
agtatgcgtgatgccaaccgtggtggatgctctcagtcatgccgttggaagtacgacctttacgatatgccatttgggaaagaacgtaagagtttgcagggtgagattccagaagaattttcaatgtcagccgttgacatgtctatgattgaccacattccagatatgattgaaaatggtgtggacagtctaaaaatcgaaggacgtatggagtctattcactatgtattaacagtaaccaactgctacaaggcggctgtggatgcctatcttgaaagtcctgaaaagtttgaagctatcaaacaagacttggtggacgagatgtggaaggttgcccaacgtgaactggctacaggattttactatggtacaccatctgaaaatgagcagttgtttggtgctcgtcgtaaaattcctgagtacaagtttgtcgctgaagtggtttcttatgatgatgcggcacaaacagcaactattcgtcaacgaaatgtcattaacgaaggggaccaagttgagttttatggtccaggtttccgtcattttgaaacctatattgaagatttgcatgatgccaaaggcaataaaatcgaccgcgctccaaatccaatggaactattgactattaaggtgcctcaacccgttcaatcaggagacatggttcgtgcattaaaagaaggactcatcaatctttataaggaagatggaaccagcgtcacagttcgtgcttaa

SEQ ID NO: 1232 - DNA (genomic), 198 bp, Streptococcus pneumoniae; double-stranded, circular
  misc_feature (B) LOCATION 1...198
  hypothetical: NO
  anti-sense: NO
aaaatgcgtgagcatgagcatttacaaaatcgaaactccataaaatcacatctgctagttccgctaacgtttttgtttttggaatctatatatgtcggtagtaacctttttaatttgacggaaatgatccaagcttctacagatgctggcttttcagcttctatttcttgttttactaattttaactgtagcatttga

SEQ ID NO: 1233 - DNA (genomic), 381 bp, Streptococcus pneumoniae; double-stranded, circular
  misc_feature (B) LOCATION 1...381
  hypothetical: NO
  anti-sense: NO
acaaaaagtgattcagcggtttttgactgctttagtaggagaaatcaaataatgagatatattacggtagaggatttgtccttctattatgataaggagcctgttcttgaacatatcaattattgtgttgatagtggggaatttgttaccttgactggggaaaatggagcggctaagacgacgctcatcaaggctagtcttggaattctgcacccacgcattggaaaggtggctatttcaaagacaaatacgcaaggtaagaaattgagaatagcctatcttcctcaacatattgccagttttaatgctggttttcaagtacggtctatgaatttgtcaagtcgggtcgctatccgagaaatggctggttccgtcgtttga

SEQ ID NO: 1234 - DNA (genomic), 1149 bp, Streptococcus pneumoniae; double-stranded, circular
  misc_feature (B) LOCATION 1...1149
  hypothetical: NO
  anti-sense: NO
caaaaaagtgaggtaaacgcaatgtggatggaagaattgccaaatggcaaatttaaatattttgagcgatataaagatccatatactgagaaattaaaaaaagtttcagtaaccatggagaagaaaactccccaggcaagaaatcaagctgctatcttgttacaagagaagataaataaaaaactcagcacaaaacaagtagaaagcattacatttgaagaaatctataaccttttctataaatcatgggcgcaaacagtaaaggaatcaacaaaacataattgtaaatcagttgataagaagatgaaggaagtcataccatccgataccatacttgctaatcttgacaggcgttttcttcaagaggctattgaaaaaattattgaaagcaacggatatattacagctaaaaaagtacggcataggctcagaggtatctttaattacgctgttcaatactcttacattgaaaacaacgaggtcgattatactacgattcctcaaaaaccaaagactttagaagaactggaaaaaaagcgtaacaactttctcaccatgcaagaaataaaagcacttgtcgatgtccttaatcgtcgagaatatcaccaaaagtacgctgatatggttcttgtgctgacattaactggtatgagatatggtgagttaactgccttacaactgaagaatatagacttcgaaaacaacaaaattgagatcacaggtaattttgattcagtaaacaaaatcaagacgctaccaaagactacaaattcaatacggacaatcaaagtatcagagagtgtcatagaagctattcaaagacaaatagtacgacttagcgaacgtttccagccattgtcaagcgatgattatattttctgttttgaaaaatggaatcaacctacaacaatagcttgcttcatacagatattaaaaaaatatggaaaacaggccaaaatagaaaaaaacttatctagccatatttttaggcattctcatatttcgtttttagcagagtctggcctcccaataaaatcaataatggatcgagttgggcactcaaatgcaaaaatgactttggaaatctattcttcttttactgaggatatggaggataaactggtcaataaattagatactattttttaa

SEQ ID NO: 1235 - DNA (genomic), 774 bp, Streptococcus pneumoniae; double-stranded, circular
  misc_feature (B) LOCATION 1...774
  hypothetical: NO
  anti-sense: NO
tataggagtgatgaaatggttgtttatattagacaaagtaaattaccaagtgaggtttcaattaataaatacaatgctcaagtaggtgcctacttacaaggagaagaagctgttttatatcaatctttttctgaaataaaagagttaacaagtgaagatatagttgtagattatataatggagactagagcattactaaaaatgatgggcttaaacgttccggttcatgactatcctattgagcttaaagagttttatggtcgaaagatttatgctggtattttaggagagattgtgaatatacctgataattggggaaaatttattaagcctaaagctggttcaaaagtctttactggaagagttgttaatggaacccatgatttaataggtattggtctacctttcgactatcctatatggattagtgaggttgtagaattcatagctgaatggcgttgttttgtgttagatggtcgcgtattagatgttcgaccctatacaggtgattatcatgcacaatttgatgcaagtgtaattgatgaagcgatatcatgttggaaagatgcgccaatagcttatggactagatatcggtgttactcgcgatggcagaacacttgttgttgaagtaaatgatggttatgcattgggaaattatggcctatctcctttaaaatcaatcaattttcatagagctaggtggaaagaaatggtaaaaccctattttgaaaaaaatgaaatttttaaaatccaacaggatgttattttctaa

SEQ ID NO: 1236 - DNA (genomic), 744 bp, Streptococcus pneumoniae; double-stranded, circular
  misc_feature (B) LOCATION 1...744
  hypothetical: NO
  anti-sense: NO
gatactggtgatgcttatatcgttcctcatggagatcattaccattacattcctaagaatgagttatcagctagcgagttggctgctgcagaagccttcctatctggtcggggaaatctgtcaaattcaagaacctatcgccgacaaaatagcgataacacttcaagaacaaactgggtaccttctgtaagcaatccaggaactacaaatactaacacaagcaacaacagcaacactaacagtcaagcaagtcaaagtaatgaggatgttgatagccttctgaaacaactttatgccttgccactcagcaaacgacacgtagaatctgatggccttgtctttgatccagcacaaatcacaagtcgaacagctagaggtgttgcagtgccacacggagatcattaccacttcatcccttactctcaaatgtctgaattggaagaacgaatcgctcgtattattccccttcgttatcgttcaaaccattgggtaccggattcaagactagaacaaccaagtctacaaccgactccggaacctagtccaggcccgcaacctgcaccaaatcttaaaatagactcaaattcttctttggttagtcagctggtacgaaaagttggggaaggatatgtattcgaagaaaagggcatctctcgttatgtctttgcgaaagatttaccatctgaaactgttaaaaatcttgaaagcaagtcatcaaaacaagagagtgttcacacactttaa

SEQ ID NO: 1237 - DNA (genomic), 375 bp, Streptococcus pneumoniae; double-stranded, circular
  misc_feature (B) LOCATION 1...375
  hypothetical: NO
  anti-sense: NO
ggtaaaggtgaaaatatggctaaattgattccggggaaaattcgtatcgaaggtgttgccctttatgaaactggtaaggttgatatcatcaaggaaaaaaacaatcggctctacgctcgcgttgcagaagaagaactgcgccatagtttagaggatgatttggttttttgtgcctgtgatttttttcaaaagaggggttactgtgtgcatttggcagcgctagagcattttctgaaaaatgatgagcgtggtcaggaaatcttgtggagtctggaagaaggtcatgaagaaaaagaggctgttgaaaccaaggtgcaccttgggtggcaagtttttggatcgaattttatctccaaaatcagaatgcgcctatga

SEQ ID NO: 1238 - DNA (genomic), 453 bp, Streptococcus pneumoniae; double-stranded, circular
  misc_feature (B) LOCATION 1...453
  hypothetical: NO
  anti-sense: NO
aacgggggtgaccaagtgattgatgggaaacgattattatttagtttgaccatagtcagttatgccttgacgctagtaagtggagttgtgtatctgtttaataataataatgttagcttactttctactttattgttcttgttggttagtagcttaattgcttgttggaatgatatcaagtattacttaatccattttattttctatttaaccatttttgtatttctggtatcaagaccgaccattgattattttagggatggtgctttggatacctatcatccaatagcctatcgttttgcctttatagttgtcatggtttcgattctgggcttgaccacaggaggcattctggctcgttacttcatagctaggaagaaaataaaagtagcaaatataggaaattctctaaaagaggtttatatcaagcggttacgctttgtatcactatga

SEQ ID NO: 1239 - DNA (genomic), 1857 bp, Streptococcus pneumoniae; double-stranded, circular
  misc_feature (B) LOCATION 1...1857
  hypothetical: NO
  anti-sense: NO
ttgttttgccttcttccactctctgtttttgccattgatttcaagataaactcttatcaaggggatttgtatattcatgcagataatacggcagagtttagacagaagatagtttaccagtttgaggaggactttaagggccaaatcgtgggacttggacgtgctggtaagatgcctagcgggtttgacattgaccctcatccaaaggttcaggctgcgaaaaacggtgcagaactagcagatgtgactagcgaagtaacagaagaagcggatggttatactgtgagagtctataatccaggtcaggagggcgacatagttgaagttgacctcgtctggaacttaaaaaatttacttttcctttatgatgatatcgctgaattaaattggcaacctctgacagatagttcagagtctattgaaaagtttgaatttcatgtaaggggagacaagggggctgaaaaactctttttccatacagggaaactttttagagagggaacgattgaaaagagtaaccttgattatactatccgtttagacaatcttccggctaagcgtggagttgagttgcatgcctattggtctcggaccgattttgctagcgctagggatcagggcttgaaagggaatcgtttagaagagtttaataagatagaagactcgattgttagagaaaaagatcagagtaaacaactcgttacttgggtcctcccttcgatactttctatctccttgttattgagtgtctgcttctattttatttatagaagaaagaccactccttcagtcaaatatgccaaaaatcatcgtctctatgaaccaccaatggaattagagcctatggttttatcagaagcagtctactcgacctccttggaggaagtgagtcccttggtcaagggagctggaaaattcacctttgatcaacttattcaagctaccttgctagatgtgatagaccgtgggaatgtctctattatttcagaaggagatgcagttggcttgagattggtgaaagaagatggtttgtcaagatttgagagagactgtctaaatctagccttttcaggcaaaaaagaagccactctttccaatttgtttgcggattacaaggtatctgatagtctttatcgtagagccaaagtttctgatgaaaaacggattcaagcaagagggcttcaactcaaatcttcttttgaagaggtattgaaccagatgcaagaaggagtgagaaaacgagtttccttctgggggctcccagattactatcgtcctttaactggtttggaaaagactttgcaagtgggtatgggtgtcttgactatcttgcccctatttatcggatttggtttgttcttgtacagtttagacgttcatggctatctttacctccctttgccaatacttggttttctagggttagttttgtctgttttctattattggaagcttcgactagataatcgtgatggtgttctaaatgaagcgggagctgaggtctactatctctggaccagttttgaaaatatgttacgtgagattgcacgactggataaggctgaattggaaagtattgttgtttggaatcgtctcttggtctatgcaaccttatttggctatgcggacaaggttagtcatttgatgaaggttcatcagattcaagttgaaaatccagatatcaatctctatgtagcttatggctggcacagtatgttttatcattcaagcgcgcaaatgagccattatgctagtgtcgcaaatacagcaagtacctactccgtatcttctggaagtggaagttctggcggtggcttctctggaggcggaggtggcggcagtatcggagccttttaa

SEQ ID NO: 1240 - DNA (genomic), 213 bp, Streptococcus pneumoniae; double-stranded, circular
  misc_feature (B) LOCATION 1...213
  hypothetical: NO
  anti-sense: NO
acaaaaatcgaactatatataggagaaatcatgaacaaaacaacatttatggctaaaccaggccaagttgaacgtaaatggtacgtagttgacgcaactgatgtaccacttggacgtctttctgcagtagttgctagcgtacttcgcggaaaaaacgaccccacatttacacctcatacagcagcgtcgttctcaacaagttcgccccaccca

SEQ ID NO: 1241 - DNA (genomic), 474 bp, Streptococcus pneumoniae; double-stranded, circular
  misc_feature (B) LOCATION 1...474
  hypothetical: NO
  anti-sense: NO
tcnttcgtcgagatgttcgtcggcgtgggcgcttcccgtgtccgcgacatgttcgancaggccaagaagcatgcgccgtgcatcatcttcatcgacgagattgacgccgtcggccgccatcgcggcgccggcctgggcggtggtcacgacgagcgcgagcagaccctcaaccagttgctggtggagatggatggcttcgagatgaacgatggcatcatcgtcatcgctgccaccaaccgtccggacgttntggacccggcgctgctgcgtccgggccgcttcgaccgccaggtggtggtcggcttgccggatatccgcgggcgcgaacagatcctcaaggtgcacatgcgtaaggtgccgctgggcgaccatgtcgatcctgccgtcatcgcccgcggtacgcccggtttctccggcgctgatggccccnggtctntttttnnaantgccaannagctnaannnaaaagggccc

SEQ ID NO: 1242 - DNA (genomic), 300 bp, Streptococcus pneumoniae; double-stranded, circular
  misc_feature (B) LOCATION 1...300
  hypothetical: NO
  anti-sense: NO
caatacgtcgaagacaccgtcacccaattcaaggatagagacgtcgaatgtaccaccaccaaggtcaaataccaagattttttcttctttgtcagtcttgtccaaaccataagcaagagctgctgcagttggttcgttaacaatacgttctacttcaagaccagcaattttaccagcgtcttttgttgcttgacgttgagcgtcgttgaagtaagccggaactgtgataacagctttggttactttctcaccaaggtagtcttcagcgtagcctttcaagtattgaaggatcatagctga

SEQ ID NO: 1243 - DNA (genomic), 432 bp, Streptococcus pneumoniae; double-stranded, circular
  misc_feature (B) LOCATION 1...432
  hypothetical: NO
  anti-sense: NO
aaaatatgcctgctcacattcaggggaagtaaggtggatatgattttgtgtaatccaccctatttcaaggtgaatccttattctaatctgaacgagagtgaacattatctcttggctcgacacgaaatcacgactaatttggaagaaatctgtcgtagtgcccagagtattctcaagtctaatgggcgtttggccatggttcatcgtcctgatcgacttctggatattttggatacgttaaaacgacataatctagcccctaagcgcctgcagtttgtttatccaaaaagagaaaaggaagccaatatgcttttgattgaggcgatcaaggatggctcaacaagtggctttaaggtcttacctcctttgattgtccacaatgatgatggctcttatacgcccgaaatcgaagagatttattatggatcataa

SEQ ID NO: 1244 - DNA (genomic), 402 bp, Streptococcus pneumoniae; double-stranded, circular
  misc_feature (B) LOCATION 1...402
  hypothetical: NO
  anti-sense: NO
gtttttgccgatgtagagaaaacaaacgaatcaacgcaatcagagaatcaaagttttgacaagactactttttcagaagaatcgattacttctgaaactacagaatctcaaagtgaggcttctactaataaaaggcaagaagaaaataagacaagtgagacctcagaagtagctgaacaaacgtctgatagcagtgaagcggcactggcaagagctgtttcagcggatgggtacagcgaagctgccacaacagaagaactggcgcagcttctcgcagacgaatcagtaactaagatccgactgattcagcctttgactttagacagggaattagagatcaaacgagatatcgttattgattttggtggattcgctcacaatttcggcacacaccatatttat

SEQ ID NO: 1245 - DNA (genomic), 1137 bp, Streptococcus pneumoniae; double-stranded, circular
  misc_feature (B) LOCATION 1...1137
  hypothetical: NO
  anti-sense: NO
gaaggtgccgatctgtttgccttgaggaaaccagggaacatttatactcgtatcaccaatcctacaacagctgcccttgaaggtggtgttgaagcgctagcaacagcatcaggtatgactgcagtgacttatacgattttggcgcttgcccatgctggtgagcatgtagtggctgcttcgactatttacggtggaaccttcaatcttttgaaagaaccccttcctcgttatggtatcacaacaacctttgtcgatgttgataatttggaggaagtagaagcagctatcaaagacaataccaagcttgtcttgattgaaaccttgggtaaccccttgattaatattccagacctggaaaaactggcagagattgctcataaacatcaaatcccacttgtgtcagacaatacttttgcaacaccttatttgattaacgtcttctctcatggcgttgacattgccattcactctgcgactaagtttatcggtgggcatggtacaactattggaggaataattgtcgatagtggtcgttttgactggacggcttcagggaaattccctcaatttgttgacgagagtccaagctgccacaatttgagctatactcatgatgtgggtgcagcagcctttattatagctgttcgagttcaattgcgtcgtgatacaggtgcagccttgtcaccattcaatgctttcctcttgctacaaagacttgaaaccctttcacttcgtgtggaacgccatgtacaaaatgctgagacaattgttgattttcttgtcaaccatcctaaggtagaaaaggtaaattatccaaaacttgcagatagtccttattatgccttggctgagaaatacttgccaaaaggtgtcggttcaatctttaccttccacgtcaaaggtgacgaggaggaagcacgcaaggtcattgataatttagaaatcttttctgaccttgcaaacgcggcagatgctaaatcgcttgttgtccatccagcaacaatcactcacggtcaattgtcagaaaaagacctagaagcagcaggtgtcacaccaaatcaaatccacttgtctatcggtcttgaaaatgtagaagatttgattgaagacttacgcttggccttggaaaaaatttaa

SEQ ID NO: 1246 - DNA (genomic), 1953 bp, Streptococcus pneumoniae; double-stranded, circular
  misc_feature (B) LOCATION 1...1953
  hypothetical: NO
  anti-sense: NO
aagacttacgattatcttgaatgccttagggaaacatgctatactacttgtatgattattttacaagctaataaaattgaacgttcttttgcaggagaggttcttttcgataatatcaacctgcaggttgatgaacgagatcggattgcccttgttgggaaaaatggtgcaggtaagtctactcttttgaagattttagtaggagaagaggagccaactagtggagaaatcaataagaaaaaagatatttctctgtcttacctagctcaagatagccgttttgagtctgaaaataccatctatgatgagatgcttcatgtctttgatgacttacgtcggacagataaacaactgcgtcagatggagctggagatgggtgaaaagtctggtgaggatttggataaactgatgtcagattatgaccgcttatctgaaaattttcgccaagcaggtggctttacctatgaagctgatattcgagcgattttgaatggattcaagtttgacgagtctatgtggcagatgaaaattgctgagctttctggtggtcaaaatactcgtttggctctagctaaaatgctccttgaaaagcccaatctcttggtcttggacgagccaactaaccacttggatattgaaaccatctcctggctagagaattacttggtaaactatagcggtgccctcattatcgtcagccacgaccgttatttcttggacaaggttgcgacaattacgctagatttgaccaagcattccttggatcgctatgtggggaattactctcgttttgttgagttgaaggagcaaaagctagctactgaggcaaaaaactatgaaaagcaacagaaggaaatcgctgctctggaagactttgtcaatcgcaatctagttcgtgcttcaacgactaaacgtgctcaatctcgccgtaaacaactagaaaaaatggagcgtttggacaagcctgaagctggcaagaaagcagccaacatgaccttccagtctgaaaaaacgtcgggcaatgttgttttgactgttgaaaatgcagctgttggctatgacggggaagtcttgtcacaacctatcaacctagatcttcgtaagatgaatgctgtcgctatcgttggtccaaatggtatcggcaagtcaacctttatcaagtctattgtggaccagattccttttatcaagggagaaaagcgctttggcgctaatgttgaggttggttactatgaccaaacccaaagcaagctgacaccaagtaatacggtgctggatgaactctggaatgatttcaaactgacaccagaagttgaaatccgcaaccgtcttggagccttccttttctcaggagatgatgttaaaaaatcagtcggcatgctatctggtggcgaaaaagctcgtttgcttttagctaaattgtctatggaaaacaataactttttgattctggatgagccgaccaaccacttggatattgatagtaaggaagtgctagaaaatgccttgattgactttgatggtaccttgctttttgtcagtcatgatcgttactttatcaatcgtgtggcaactcatgttttggaattgtctgagaatggttcaactctctaccttggagattacgactactatgttgagaagaaagcaacagcagaaatgagtcagactgaggaagcttcaactagcaatcaagcaaaggaagcaagtccagtcaatgactatcaggcccagaaagaaagtcaaaaagaagttcgcaaactcatgcgacaaatcgaaagtctagaagctgaaattgaagagctagaaagtcaaagccaagccatttctgaacaaatgttggaaacaaacgatgccgacaaactcatggaattacaggctgagctggacaaaatcagccatcgtcaggaagaagctatgcttgagtgggaagaattatcagatcaggtgtaa

SEQ ID NO: 1247 - DNA (genomic), 360 bp, Streptococcus pneumoniae; double-stranded, circular
  misc_feature (B) LOCATION 1...360
  hypothetical: NO
  anti-sense: NO
tcaaacaacgatttggcgaaatgtaaaaaatatgaggagttcggactcgactctctccttcaagaaacacgtggtggtcgtaaccatgcatatatgacagttgaggaagagaaagcctttcttgctcgccatttgaaggctacagaggcaggagaatttgttacaattgatgccttatttcaggcttataaaaaggagttaggtcgttcctacacacgtgatgccttctatcaactgttgaagcaccatggttggcgaaatattatgccacgtccagaacatcctaggaaagcagacgctcaaaccattgtcgcgtctaaaaataaaatctcaattcaagaaggcaagaaagcgctttaa

SEQ ID NO: 1248 - DNA (genomic), 666 bp, Streptococcus pneumoniae; double-stranded, circular
  misc_feature (B) LOCATION 1...666
  hypothetical: NO
  anti-sense: NO
gcatgcaacgaacaattacctgatgaaatgacattagctaaacagtttgcctgtagtcgaatgacgatcaaaaaagctttagacttgttagtttctgagggcttaatttttagaaaacgtgggcagggatcctttgttctctctcgtggcagctcaaaaagaaaattaatcgttccagaaagagatatccggggactgacaaaaatatctgaagatgctcattctacaattgactcgaggattattcacttcaaattagaatttgcaaatgaatttttagcagaaaaactacaggtcgctttgcagagtccagtttataatatttaccgcctgcgtattattgacggtaaaccttatgttctggaacaaacttatatgagtaccgatgttattccaggtattactgaagatattttacaaaaatcgatttacaattacattgaaggaaagttaggattgcatattgccagtgctacaaaaatcttacgagcttcttctagttcagaaaatgagcaacattacttgcagctccttccaacggaaccggtatttgaagtagaacaagtggcttatttggataacggaactccgtttgagtactcgattagtcgtcatcgctatgatttatttgaatttaattcttttgcattacgacattcttcctag

SEQ ID NO: 1249 - DNA (genomic), 1392 bp, Streptococcus pneumoniae; double-stranded, circular
  misc_feature (B) LOCATION 1...1392
  hypothetical: NO
  anti-sense: NO
ttcaaaaacgaattaaaaatagaaaaggattttataacaatgggtaaatattttgggactgatggagtccgtggagaagctaacctagaactaacaccagaattagcctttaaactaggacgttttggaggctatgttcttagtcaacatgaaacggaagcgccgaaagtctttgtaggacgtgacacacgtatttcaggggaaatgctggaatcggccttggtggcaggtctcctttcagtagggattcacgtatacaaacttggtgtccttgcaacaccagcagtagcttacttggttgaaactgaaggagcaagtgccggtgtcatgatttctgctagccacaacccagcccttgataacggaatcaagttctttggcggtgatggcttcaaactagatgatgaaaaagaagcagaaattgaagccttgctagatgctgaggaagacactcttcctcgtccaagtgcagaaggcttaggaattttggtagattatccagaaggcttgcgtaagtatgaaggataccgtgtgtcaactggaactcctcttgatggaatgaaggttgccttggatacagctaatggagcagcttctaccagtgcccgtcaaatctttgcagaccttggtgcccaattgacggttatcggggaaacaccagacggtcttaacatcaaccttaatgttggttcaacacatccagaagcccttcaagaagtggtcaaagaaagtgggtcagctattggtttggcctttgatggagacagtgaccgcttgattgctgttgatgagaatggtgacatcgtcgatggtgacaagattatgtacatcatcggaaaatacctttctgaaaaaggacaattggctcaaaatacaattgtgacaactgttatgtctaaccttggtttccacaaggccttgaatcgcgaaggtattaacaaggcagttactgcagttggtgaccgctacgttgttgaagaaatgagaaaatcaggctacaaccttggtggtgaacagtctggtcacgttatcttgatggattacaataccacaggtgatggtcaattatcagcagttcaattgactaaaatcatgaaggaaactggtaagagcttatcagagttggcggcagaagtaacgatttatccacaaaaattagttaatatccgagtggaaaacgtcatgaaggaaaaggccatggaagtgccagctatcaaggccatcatcgagaagatggaagaagaaatggcggggaacggccgtatccttgttcgtccaagtggaacagagcccctcttgcgtgttatggcagaagcgcctacaacagaagaagtggactactatgttgataccatcacagatgtagttcgtgctgaaattgggattgactaa

SEQ ID NO: 1250 - DNA (genomic), 1008 bp, Streptococcus pneumoniae; double-stranded, circular
  misc_feature (B) LOCATION 1...1008
  hypothetical: NO
  anti-sense: NO
ngtgaagacgatttgattaaaacggacaacagaacaagttataccgtacagtatggtgatactttgagcaccattgcagaagccttgggtgtagatgtcacagtgcttgcgaatctgaacaaaatcactaatatggacttgattttcccagaaactgttttgacaacgactgtcaatgaagcagaagaagtaacagaagttgaaatccaaacacctcaagcagactctagtgaagaagtgacaactgcgacagcagatttgaccactaatcaagtgaccgttgatgatcaaactgttcaggttgcagacctttctcaaccaattgcagaagttacaaagacagtgattgcttctgaagaagtggcaccatctacgggcacttctgtcccagaggagcaaacgaccgaaacaactcgcccagttgaagaagcaactcctcaggaaacgactccagctgagaagcaggaaacacaagcaagccctcaagctgcatcagcagtggaagtaactacaacaagttcagaagcaaaagaagtagcatcatcaaatggagctacagcagcagtttctacttatcaaccagaagagacgaaaataatttcaacaacttacgaggctccagctgcgcccgattatgctggacttgcagtagcaaaatctgaaaatgcaggtcttcaaccacaaacagctgcctttaaagaagaaattgctaacttgtttggcattacatcctttagtggttatcgtccaggagacagtggagatcacggaaaaggtttggctatcgactttatggtaccagaacgttcagaattaggggataagattgcggaatatgctattcaaaatatggccagccgtggcattagttacatcatctggaaacaacgtttctatgctccattcgatagcaaatatgggccagctaacacttggaacccaatgccagaccgtggtagtgtgacagaaaatcactatgatcacgttcacgtttcaatgaatggataa

SEQ ID NO: 1251 - DNA (genomic), 198 bp, Streptococcus pneumoniae; double-stranded, circular
  misc_feature (B) LOCATION 1...198
  hypothetical: NO
  anti-sense: NO
gctcaggacgatcaggaagatttgacagcgattgtacgagaccatttttcagacatgggggaaattgcgaccctctatgttcaagtctatgaaagcagtctagagagcttgcttggtggcgttatttttgaggatggccgtcattatacctttgtctatgaaaatgaagacctagtctatgaggaggaagtcttatga

SEQ ID NO: 1252 - DNA (genomic), 219 bp, Streptococcus pneumoniae; double-stranded, circular
  misc_feature (B) LOCATION 1...219
  hypothetical: NO
  anti-sense: NO
agaatttgcgagatatgtttaaagcaagagaagcagcttctgttaaaattgctaccttgttggataaaccaagaaggacgtgttgtagaaattgaggcagactatacctgctttactatcccaaatgagtttgtagtaggttatggtttagactacaaagaaaattatcgtaatcttccttatattggagtattgaaagaggaagtgtattcaaattag

SEQ ID NO: 1253 - DNA (genomic), 231 bp, Streptococcus pneumoniae; double-stranded, circular
  misc_feature (B) LOCATION 1...231
  hypothetical: NO
  anti-sense: NO
actttctgcgaaacaaaaatacaacacaataaaactatgaatgatgaagcaagtaaacaattaagagatagccgtttcaagagccttgcaggtgttcagcgcacgacttttgaagagatgttagccgtgctaaaaacaacttatcaacgtaaacacgcaaaaggtggacgaaaaaccaaattaagcctagacgatctcctcatggtaactattcaatacatgcgagaatag

SEQ ID NO: 1254 - DNA (genomic), 939 bp, Streptococcus pneumoniae; double-stranded, circular
  misc_feature (B) LOCATION 1...939
  hypothetical: NO
  anti-sense: NO
agtctacgcgagacaacagattacgtggaagtgtcaaaaaacattcaagagcgtgttgcctttagctgtggaaaaccagcttggaattactgctcagactgtaaatgtctacattcaaaatatcaaagttgtaggagaataaccgtgtcaaaaattactactagcttatttcaagaaatggtgcaggctgcatcaactcgcttgaataagcaagctgaatatgtcaattcattaaacgtctttccagttccagatggagatactgggacaaatatgggaatgaccattgaaaatggtgctaaagaagttgcagacaagccagcttctacagttggagaagtagcgagcattcttgccaaagggcttttgatgggtgcgcgtgggaactcaggagtgattacgtctcagcttttccgtggattttcccaagctatcaaggataaagacgagttaacaggtcaagacttggctctggccttccaatcaggtgtggaagttgcctataaggcagtgatgaaacctgttgaaggaacgattttaacagtttctcgtggagctgctatcggtgctaagaaaaaagctgagcaaacagatgacgctgttgaagtcatgcgcgcagccttggaaggtgctaaaacagctctagctaaaacaccagacatgcttccagtattgaaagaagttggcgttgtggactcaggtggtcaaggattggtcttcatctacgaaggtttcctttcagcccttactggcgaatatattgcatctgaggactttgtagcgactcctgccaacatgagtgagatgatcactgtagagcatcataagtctgtagctggtcacgtagcgactgaggacatcacgttttgttactgtactgaaatcatggtagctcttaagcaaggtccaacctatgctaaagattttgactacgaatga

SEQ ID NO: 1255 - DNA (genomic), 1653 bp, Streptococcus pneumoniae; double-stranded, circular
  misc_feature (B) LOCATION 1...1653
  hypothetical: NO
  anti-sense: NO
ggagaaagcgaaagaagtaaaaaaagcttcggaagagaacaagctgcaaatctgaaatatcaacaagagttggttaaatatattaaatatacacgtgaaaataattcaacaaaaagaactgaagctgagaaagtaatgactgcagctaagaaagagcatgagaaaaaacaaacagaacttgctaaagttctcgcaaaggtaattcctagcgcggaagaattagaaaatactagacaaaaagcagagaaagctaaagaaaaagaaccagagcttactaaaaaactagaagaagctaaagcaaaatcagaagaagctgagaaaaaagctactgaagccaaacaaaaagtggatgcagaacatgctgaagaagtcgttcctcaagctaaaatcgctgagttggaaaatgaagttcagaaactagaaaaagatctcaaagagattgatgaatctgactcagaagattatgttaaagaaggtctccgtgctcctcttcaatctgaattggatgccaaacaagctaaactatcaaaacttgaagagttgagtgataagattgatgagttagacgctgaaattgcaaaacttgaaaaaaatgtagaagatttcaaaaactcaaacggtgagcaagctgaacaataccgtgctgcagctgaagaagacttagctgctaaacaagctgaattagaaaaaactgaagctgaccttaagaaagcagttaatgagccagaaaaaccagctccagctccagaaactccagccccagaagcaccagctgaacaaccaaaaccagcgccggctcctcaaccagctcccgcaccaaaaccagagaagccagctgaacaaccaaaagcagaaaaaccagctgatcaacaagctgaagaagactatgatcgtagatcagaagaagaatataaccgcttgacccaacagcaaccgccaaaagcagaaaaaccagctcctgcaccacaaccagagcaaccagctcctgcaccaaaaacaggctggaaacaagaaaacggtatgtggtacttctacaatactgatggttcaatggcgacaggatggctccaaaacaacggttcatggtactacctcaacagcaatggtgctatggcaacaggttggctccaaaacaatggatcatggtattacctaaatgctaacggtgctatggcaacaggttggctccaaaacaatggttcatggtactacctcaacagcaatggcgctatggcgacaggatggctccaatacaatggctcatggtactatctaaacgctagcggcgctatggcaacaggttgggctaaagtcaacggttcatggtactacctcaacgctaacggttcaatggcaacaggatggctccaatacaacggttcatggtactacctcaacgctaacggtgctatggcaacaggttgggctaaagtcaacggatcatggtactacctcaacgctaacggttcaatggcaacaggttgggtgaaagatggagatacctggtactatcttgaagcatcaggtgctatgaaagcaagccaatggttcaaagtatcagataaatggtactatgtcaatggcttaggtgcccttgcagtcaacacaactgtagatggctatgaagtcaatgccaatggtgaatgggtttaa

SEQ ID NO: 1256 - DNA (genomic), 1389 bp, Streptococcus pneumoniae; double-stranded, circular
  misc_feature (B) LOCATION 1...1389
  hypothetical: NO
  anti-sense: NO
agaggaagcgatgtaatggctagagaaggcttttttacaggtctagatattggaacaagctctgtcaaggtgcttgtggccgagcagagaaatggtgaattaaatgtaattggcgtgagtaatgccaaaagtaaaggtgtaaaggatggaattattgttgatattgatacagcagcaactgctatcaagtcagccatttcccaagcggaagaaaaggcaggcatttcgattaaatcagtgaatgtcggcttgcctggtaatcttttgcaggtagaaccaactcaggggatgattccagtaacatctgatactaaggaaattacggatcaagatgttgaaaatgttgtcaaatcagctttgacaaagagtatgacacctgaccgtgaagtcattacctttattcctgaagaatttattgtggatggtttccaagggattcgtgacccacgtggtatgatgggggttcgccttgaaatgcgtggtttgctttatacaggacctcgtactatcttgcacaatttgcgtaagacggttgagcgtgcaggtgttcaggttgaaaatgttatcatttcaccactagcaatggttcagtctgttttgaatgaaggggaacgtgaatttggtgctacagtgattgatatgggggcaggtcaaacgactgtcgctacaatccgtaatcaagaactccagttcacacatattctccaagaaggtggagattatgtaactaaagatatctccaaggttttgaaaacctctcgcaaattagcggaaggcttgaaactgaattacggggaagcctatccgcctcttgcaagcaaagaaaccttccaagtagaggttattggagaagtggaagcagtcgaagtgacggaagcctacttgtcagaaattatttctgcacgaatcaagcacatccttgaacaaatcaagcaagaattagatagaaggcgtctattggacctccctggtggtattgtcttaatcggtgggaatgccattttaccaggtatggttgagcttgctcaggaagtctttggcgtccgtgtcaagctttatgttccaaatcaagttggtatccgtaatccagcctttgcgcatgtgattagtttatcagaatttgcgggtcaattaacagaagttaatcttttggctcagggagcgataaaaggtgagaatgacttaagtcatcagccaattagttttggtgggatgctgcaaaaaacagctcagtttgtacaatcaacgcctgttcaaccagctcctgctccagaagtagagccggtggcgcctacagaaccaatggcggatttccaacaagcttcacaaaataaaccgaaattagcagatcgtttccgtggcttgatcggaagcatgtttgacgaataa

SEQ ID NO: 1257 - DNA (genomic), 213 bp, Streptococcus pneumoniae; double-stranded, circular
  misc_feature (B) LOCATION 1...213
  hypothetical: NO
  anti-sense: NO
tgggtaggcgaaaagttacaatctggagagtacgaaattcgtactctcttttttgatgttcaaagtcatcaaaatccgttttttaaaattgttaaagttccggaaaccaaaggctttgcacttgataaccttaatcaaattattggtcgcttcaagtttagcgttggaataaggcagcttaagtgcgttgataatcttatctctatcccttaa

SEQ ID NO: 1258 - DNA (genomic), 222 bp, Streptococcus pneumoniae; double-stranded, circular
  misc_feature (B) LOCATION 1...222
  hypothetical: NO
  anti-sense: NO
tttctgggcgaccaaaggtcactcagtagaccatcagtaagtttggttcctgtaaatgacccaactcttttgtggatcaactctggggtagcaacccttaagaaatactttgacgggaccattatccctgaaaatccacgtattaccaatgcccaaaaggctatccgtactaacgacatcgaaaacgtagggcaagactgcgcgtcaccataccatgtttga

SEQ ID NO: 1259 - DNA (genomic), 267 bp, Streptococcus pneumoniae; double-stranded, circular
  misc_feature (B) LOCATION 1...267
  hypothetical: NO
  anti-sense: NO
agaaacagcctttgtcttgaactattttggtgtggaagcacacgtgttatcacttctgccaaagcagagggggcagagcaagttatcttgactgaccacaatgaattccaacaatctgtatcagatatcgctgaagtagaagtttacggtgttgtagaccaccaccgtgtgctaactttgaaactgcaagcccactttacatgcgtttggagccagttggatcagcgtcttcaatcgtttaccgtatgttcaaagaacatggtgtag

SEQ ID NO: 1260 - DNA (genomic), 522 bp, Streptococcus pneumoniae; double-stranded, circular
  misc_feature (B) LOCATION 1...522
  hypothetical: NO
  anti-sense: NO
ttttctttagaaaatattatcagaagaaagttgagaaaaatggcagaaaaaacatatcctatgacccttgaggaaaaggaaaaacttgaaaaagaattagaagaattgaaattggttcgtcgaccagaagtggtagaacgcattaagattgcccgttcatacggtgacctttcagaaaacagtgagtacgaagcagctaaggatgaacaagcctttgtcgaaggacaaatctctagcttagaaacaaaaatccgctatgctgaaatcgtcaatagcgacgcagttgcccaggacgaagtagcgattggtaaaacagtcaccatccaagaaattggtgaggacgaagaagaagtttatattatcgtaggttcagctggtgcggatgcctttgcaggtaaggtttcaaatgaaagcccaattgggcaggccttgattggcaagaaaacaggtgatacagcaaccattgaaacgcctgttggtagctatgatgtaaaaatcttgaaggttgaaaaaacagcctaa

SEQ ID NO: 1261 - DNA (genomic), 516 bp, Streptococcus pneumoniae; double-stranded, circular
  misc_feature (B) LOCATION 1...516
  hypothetical: NO
  anti-sense: NO
agtatgttagaaaatggcgatttgatttttgtgagagatgggtcagacatgggacaggccatccagacttccacaggtaactatagccatgttgccatttatttggatgggatgatttatcatgctagtggacaggctggtgttgtctgtcaagaaccggcagacttctttgagtccaatcatttatacgacctctatgtttacccagaaatggatatccagtcggtgaaggaaagagcttgcagacatcttggagcaccctacaatgcttctttctatccagatgcagctggtttctactgctcccagtatatagcagaaatcctacctatttttgaaactattcctatgaaatttggagatggggaacaggagattagtgatttttggagggagtattacatagaactaggtctgcctgttcctctgaaccaagctgggaccaatcctagtcagttggcagcatcgcctctgttacaatgtaaagaaaggaatcttcatgattcagatttttaa

SEQ ID NO: 1262 - DNA (genomic), 423 bp, Streptococcus pneumoniae; double-stranded, circular
  misc_feature (B) LOCATION 1...423
  hypothetical: NO
  anti-sense: NO
aaaatgttagaaaacgatattaaaaaagtcctcgtttcacacgatgaaattacagaagcagctaaaaaactaggtgctcaattaactaaagattatgcaggaaaaaatccaatcttagttgggattttaaaaggatctattccttttatggctgaattggtcaaacatattgatacacatattgaaatggacttcatgatggtttctagctaccatggtggaacagcaagtagtggtgttatcaatattaaacaagatgtgactcaagatatcaaaggaagacatgttctatttgtagaagatatcattgatacaggtcaaactttgaagaatttgcgagatatgtttaaagcaagagaagcagcttctgttaaaattgctaccttgttggataaaccaagaaggacgtgttgtagaaattga

SEQ ID NO: 1263 - DNA (genomic), 864 bp, Streptococcus pneumoniae; double-stranded, circular
  misc_feature (B) LOCATION 1...864
  hypothetical: NO
  anti-sense: NO
aaaggtctagagatgattttaattacaggggcaaatggccaattaggaacggaacttcgctatttattggatgaacgtaatgaagaatacgtggcagtagatgtggctaagatggacattaccaatgaagaaatggttgagaaagtttttgaagaggtgaaaccgactttagtctaccattgtgcagcctacaccgctgttgatgcagcagaggatgaaggaaaagagttggacttcgccatcaatgtgacggggacaaaaaatgtcgcaaaagcatctgaaaagcatggtgcaactctagtttatatttctacggactatgtctttgacggtaagaaaccagttggacaagagtgggaagttgatgaccgaccagatccacagacagaatatggacgcactaagcgtatgggggaagagttagttgagaagcatgtgtctaatttctatattatccgtactgcctgggtatttggaaattatggcaaaaacttcgtttttaccatgcaaaatcttgcgaaaactcataagactttaacagttgtaaatgatcagtacggtcgtccgacttggactcgtaccttggctgagttcatgacctacctagctgaaaatcgtaaggaatttggttattatcatttgtcaaatgatgcgacagaagacacaacatggtatgattttgcagttgaaattttgaaagatacagatgtcgaagtcaagccagtagattccagtcaatttccagccaaagctaaacgtccgctaaactcaacgatgagcctggccaaagccaaagctactggatttgttattccaacttggcaagatgcattgcaagaattttacaaacaagaagtgagataa

SEQ ID NO: 1264 - DNA (genomic), 315 bp, Streptococcus pneumoniae; double-stranded, circular
  misc_feature (B) LOCATION 1...315
  hypothetical: NO
  anti-sense: NO
aagctgctagaggagggaaagatgaaaacaagaaaaatccctttgcgcaagtctgttgtgtctaacgaagtgattgataagcgtgatttgctccgcattgttaagaacaaggaaggacaagtctttattgatcctacgggcaaggccaatggccgcggcgcttatatcaaactagacaatgcagaagccctagaggcgaaaaagaagaaggtctttaaccgcagctttagcatggaagtggaagaaagcttttatgacgagttgatcgcttatgtggatcacaaagtgaaaagaagagagttgggacttgaataa

SEQ ID NO: 1265 - DNA (genomic), 492 bp, Streptococcus pneumoniae; double-stranded, circular
  misc_feature (B) LOCATION 1...492
  hypothetical: NO
  anti-sense: NO
aatcagctagattgtaatcatgtagttagtagagatgatctaaatttagtatatgactatttattccagaaggaacgatgggagtcctatgagataacgctgattggtaatttatatcatctttttgaaacagattatatttacatggtcggaaaagaaatactagaacgtacacattattacgaaaaaatcggcaagaatagaaatttagttgtgtcagcttgtttaaatttttggttctgttgccttgaaaattcacatctaatatatgcagactactttgaaatgaaattacaaaaattattaaaagatgacacaaaagtttttgaaaaatctacattcaaatttgtagaaggatataaaatatacctgacagaatctaaagaatctggaattaaacaaatggacaatgtcataaaatattttgagtttattgaatctaaaagtattgctttatattttcaaaaacgattaaatgagctgatagattaa

SEQ ID NO: 1266 - DNA (genomic), 1092 bp, Streptococcus pneumoniae; double-stranded, circular
  misc_feature (B) LOCATION 1...1092
  hypothetical: NO
  anti-sense: NO
cgaaagctagaggtgaaaagaatgaaactaaatcgagtagtggtaacaggttatggagtaacatctccaatcggaaatacaccagaagaattttggaatagtttagcaactgggaaaatcggcattggtggcattacaaaatttgatcatagtgactttgatgtgcataatgcggcagaaatccaagattttccgttcgataaatactttgtaaaaaaagataccaaccgttttgataactattctttatatgccttgtatgcagcccaagaggctgtaaatcatgccaatcttgatgtagaggctcttaatagggatcgttttggtgttatcgttgcatctggtattggtggaatcaaggaaattgaagatcaggtacttcgccttcatgaaaaaggacccaaacgtgtcaaaccaatgactcttccaaaagctttaccaaatatggcttctgggaatgtagccatgcgttttggtgcaaacggtgtttgtaaatctatcaatactgcctgctcttcatcaaatgatgcgattggggatgccttccgctccattaagtttggtttccaagatgtgatgttggtgggaggaacagaagcttctatcacaccttttgccatcgctggtttccaagccttaacagctctctctactacagaggatccaactcgtgcttcgatcccatttgataaggatcgcaatgggtttgttatgggtgaaggttcagggatgttggttctagaaagtcttgaacacgctgaaaaacgtggagctactatcctggctgaagtggttggttacggaaatacttgtgatgcctaccacatgacttctccacatccagaaggtcagggagctatcaaggccatcaaactagccttggaagaagctgagatttctccagagcaagtagcctatgtcaatgctcacggaacgtcaactcctgccaatgaaaaaggagaaagtggtgctatcgtagctgttcttggtaaggaagtacctgtatcatcaaccaagtcttttacaggacatttgctgggggctgcggcgtgcagtagaagctatcgtcaccatcgaagctatgcgtcataa

SEQ ID NO: 1267 - DNA (genomic), 255 bp, Streptococcus pneumoniae; double-stranded, circular
  misc_feature (B) LOCATION 1...255
  hypothetical: NO
  anti-sense: NO
gaggggctagagattatcccctactcgatatttttttttttcgtatttcataaacatttcatatttgggttttataatagtcttacaaatatggaggtgacaaatgaatccaatccaaagatcttgggcttatgtcagcagaaagcgactgagaagttttattttatttctgattttattggtcttattggccggaatttcagcctgtttgactctgatgaagtccaacaaaacagtagaaagcaatctttataa

SEQ ID NO: 1268 - DNA (genomic), 855 bp, Streptococcus pneumoniae; double-stranded, circular
  misc_feature (B) LOCATION 1...855
  hypothetical: NO
  anti-sense: NO
ctgtttatagacaacatggctttcggtttgaaattgcgtaaatacagcaaagaagacattaacaaacgtgttcaagaagcagctgaaatacttggattgaaagaattcttggaacgtaaaccggctgacctttcaggtggtcaacgtcaacgtgttgccatggggcgtgcgattgtccgtgatgcgaaagtattcttgatggacgaacctttgtcaaacttggatgccaaacttcgtgtatcaatgcgtgctgaaatcgctaaaattcaccgtcgtatcggagctacaactatctatgtaactcacgaccaaacagaagcgatgacacttgcagaccgtatcgttattatgtcagctactaagaaccctgctggtacaggtacaatcggaagtgtagaacaaatcggtactcctcaagaagtttacaaaaatccagttaacaaattcgttgcaggattcatcggaagcccagctatgaacttcatcaacgtgaaattggttggtagcgaaattgtttctgacggtttccgtttgaaagtgccagaaggagcattgaaagttcttcgtgaaaaaggctacgaaggaaaagaattgatctttggtatccgtccagaaaacgtgaatgcagaacctgctttccttgaaacattcccagactgtgttgtaaaagcgactatctctgtatcagaactgcttggttcagaatctcacctttactgccaagttggtaaagacgagtttgttgcaaaagttgatgctcgtgactacttgcaaacaggtgcaacagttgagcttggatttgacttgaacaaagcacacttcttcgatgtagaaactgaaaaaacaatctactaa

SEQ ID NO: 1269 - DNA (genomic), 921 bp, Streptococcus pneumoniae; double-stranded, circular
  misc_feature (B) LOCATION 1...921
  hypothetical: NO
  anti-sense: NO
ccctctatagaaaggatttttatgacatcaaaagttagaaaggcagttatccctgctgctggactaggaactcgatttttaccagcaaccaaggcccttgccaaagaaatgttgccaatcgtagacaaaccaactatccagtttatcgtggaagaagctctcaaatcaggtattgaagatattctagttgtcactggtaaatcaaaacgttctattgaggaccacttcgattcaaacttcgaattggaatataacctcaaagaaaaagggaaaacagatcttttgaagctagttgatgaaacaactggcatgcgtctgcattttatccgccaaactcatccacgcggtctcggagatgctgttttgcaagccaaggctttcgtcggaaatgaaccttttgtcgttatgcttggtgatgacttgatggatatcacagacgaaaaggctgttccacttaccaaacaactcatggatgactacgagcgtacccacgcgtctactatcgctgtcatgccagtccctcatgacgaagtatctgcttacggggttattgctccgcaaggcgaaggaaaagatggtctttacagtgttgaaacctttgttgaaaaaccagctccagaggacgctcctagcgaccttgctattatcggacgctacctcctcacgcctgaaatttttgagattctcgaaaagcaagctcctggtgctggaaatgaaatccaacttactgatgcaatcgatactcttaataaaacacagcgtgtttttgcccgtgaatttacaggagctcgttacgacgttggggataagtttggctttatgaaaacatctattgactacgccctcaaacacccacaagtcaaagatgatttgaagaattacctcatccaacttggaaaagaattgactgagaaggaataa

SEQ ID NO: 1270 - DNA (genomic), 714 bp, Streptococcus pneumoniae; double-stranded, circular
  misc_feature (B) LOCATION 1...714
  hypothetical: NO
  anti-sense: NO
agtagaatagatattaaggacctatctttctcttattccaaagactcagctcctgtaatagaaaatttaaatttgactattgagccaggacagagaattgcactagtcggtcaatcggggtcaggaaaaagtacgttatcaaaaataccatcaggattatataagattgatacaggaaaagttttatttgatggtgtaaatattaatcaaatagataaaaaaatattaagtcaaaatttaggagtagttccacaggattcgtttttattgaacagaagtattcttgataatataactttaaagcacgaagttacttcacaaaagatagaggaagtttgtaaagcagttcaaatctatgatgaaatcatggctatgccgatgaaatttaatactatcatctcagagatggggtcaaatatttcaggtgggcaaaggcaacggatagcactggcacgtgcattaataaataatcctagtattgtaattttagatgaagcaactagtgcattagacactattaatgagaaaagaataacaaagtatatacaaagtcagggttgtactcaaataattatagctcatagattgtcaacgattaaggatgcggatattatttttgtaatgaaaggtggtaagattgttgagtcaggaaatcataagtacttaatgactcttggtggagagtactacagcttatatacaaaaaggaaatga

SEQ ID NO: 1271 - DNA (genomic), 318 bp, Streptococcus pneumoniae; double-stranded, circular
  misc_feature (B) LOCATION 1...318
  hypothetical: NO
  anti-sense: NO
ttagcagtagatttcaaaatgataaaaacgtataatagtaggtgtagtgtactgccccccaaaaagttagacagaaaaaatctaactttttggggtgtttttattatgaaattaagttatgatgataaagttcagatctatgaacttagaaaacaaggatatagcttagagaagctttcaaataaatttgggataaacaattctaatcttaggtacatgattaaattgattgatcgttacggaatagagttcggcaaaaaaggaaaaaatcgttactattctcctgatttaaaacaagaaatgattcataaagtctga

SEQ ID NO: 1272 - DNA (genomic), 1080 bp, Streptococcus pneumoniae; double-stranded, circular
  misc_feature (B) LOCATION 1...1080
  hypothetical: NO
  anti-sense: NO
ataggagtagaaatgacaaaagaaaaaaatgtaattttgactgctcgcgatattgtcgtggaatttgacgttcgtgacaaagtattgacagccattcgcggcgtttcccttgaactagttgaaggagaagtattagccttggtaggtgagtcaggatcaggtaaatctgttttgacaaagaccttcacaggtatgctcgaagaaaatggtcgcattgcccaaggtagtattgactaccgtggtcaggatttgacagctttatcttctcacaaggagtgggaacaaattcgtggtgctaagattgcgactatcttccaggacccaatgactagtttggaccccattaaaacaattggtagtcagattacagaagttattgtaaaacaccaaggaaaaacagctaaagaagcgaaagaattggccattgactacatgaataaggttggcattccagacgcagatagacgttttaatgaatacccattccaatattctggaggaatgcgtcaacgtatcgttattgcgattgcccttgcctgccgacctgatgtcttgatctgtgatgagccaacaactgccttggatgtaactattcaagctcagattattgatttgctaaaatctttacaaaacgagtatcatttcacaacaatctttattacccacgaccttggtgtggtggcaagtattgcggataaggtagcggttatgtatgcaggagaaatcgttgagtatggaacggttgaggaagtcttctatgaccctcgccatccatatacatggagtctcttgtctagcttgcctcagcttgctgatgataaaggggatctttactcaatcccaggaacacctccgtcactttatactgacctgaaaggggatgcttttgccttgcgttctgactacgcaatgcagattgacttcgaacaaaaagctcctcaattctcagtatcagagacacattgggctaaaacttggcttcttcatgaggatgctccaaaagtagaaaaaccagctgtgattgcaaatctccatgataagatccgtgaaaaaatgggatttgcccatctggctgactag

SEQ ID NO: 1273 - DNA (genomic), 780 bp, Streptococcus pneumoniae; double-stranded, circular
  misc_feature (B) LOCATION 1...780
  hypothetical: NO
  anti-sense: NO
acaggagtagagatgagtattcgagtaattattgccggttttaagggaaagatgggccaggctgcttgtcagatggtattgactgatccagacttggacttggtggcagttttggatccttttgagtctgagtcagaatggcagggtattcctgttttcaaggataaggctgatttagctggttttgaagcggatgtctgggtagattttactactccagctgttgcctacgaaaatacacgttttgctcttgaaaatggctttgctccagtagttggaacgactggtttcacgagtgaagaaattgcagagctaaaagaattttctcgtgcccaagacttgggtggcctgattgcccctaactttgccttgggtgctgtcttactcatgcaatttgcgacgcaggctgccaaatatttcccaaatgtggagattattgagctccatcatgacaagaaaaaggatgctccgagtggaacagccattaaaacagctgagttgatggcagaggttcgagagtcaattcagcaaggtgcagcagatgaggaagagctgattgctggtgctcgtggtgctgactttgatggtatgcgcatccactcagttcgtttgccaggcttggtagctcatcaggaagtcatctttggcaatcagggagaagggttgaccctccgtcatgactcctatgatcgcatctccttcatgacaggagtcaatttgggaattaaagaagttgtcaagcgtcatgagcttgtctatggattagaacacttattatga

SEQ ID NO: 1274 - DNA (genomic), 1725 bp, Streptococcus pneumoniae; double-stranded, circular
  misc_feature (B) LOCATION 1...1725
  hypothetical: NO
  anti-sense: NO
ttcggggtagatgtctttttcacattttcaggtttcctgattacagctctactcattgaagaattttctaaaaaccatgagattgatttgataggattttttagaagacgcttttatcggattgtgccacctgtggttttgatggtcttggtgaccatgccttttactttcttggttcgccaagactatgttgctggaattggtggccagattgcgagcgtcttaggctttatgaccaacttctatgaactcctaacaggtgggagttatgaatctcagttccatcctcatttgtttgttcataattggagtctggcagttgaggttcactactatattctntggggattggcagtttggttcttatccacacacgctaaatcaaatggtcagttgaaggggatggtctttctcttatctgctgttgccttcttgatcagtttcttctccatgtttattggtagttttctagtgacctcttattcctctgtttatttctccagtttaactcatgtctatccattctttttgggaagtatgttagcaactattgtaggcgttcgtcagacgacttccctcgtcaagcagttggataaaatctgggatttacgaaagactttggtagtttttggaggaggctttggtttcctagttcttttgactttctttgtcaaattcacttatctttttgcctatcttatcggcttcttacttgccagtcttgcagctcttgccatgattctggcggcgcgtgtcttacatgaaaagacacatcatatacaggagccgaagattatcagctttttagcggatactagctatgcggtttatcttttccattggcctttctatatcattttctcacagttgacatcaaatcttcttgctgtattactgactctgatttgttcttatggctttgccagtctgtcattttatgtattggaaccttggattgcaggcaagaacacacctattgtccaaacccttcgtcccctgccttatattcacgcaattcttgcagcaggtacaggaatcttgaccatcattgtctgcacggtgaacttgttggcaacacaagtgggagcgtttgagacagacttgactgtcaatggcttgaagcaagctgcaacaaatattggccagaccaaggtgatggcagaacgggcagatgcaaacagtttgggaattgctgatggcactatgttaattggtgactcagtggctttaagggcaaatacagcactacagacagctcttcctggagcacagattaacgcgcaggtcagcgtaacaaccaagaccgcaaatgaaatcatgctaaataatagccagaataaatttttacctaagacggtggtcattgcgactggggtaaataatcctgagaattacaaggatgactgggacagtatcgtgaaaaatcttcctaagggacaccatatgattttggtgactccttatgagggagataagacaaaagagacctatgccatcgttgagaaggctgctgcctatatgagagaattggcagagaagacaccttacattacgatagcagattggaatcaagttgcgaaagagcatccagaaatttgggcaggaacagaccaggttcatttcgggagtgagagtagcactatcgaagcaggagcaaaattgtatgcagatacgattgccacagctttgcagacagctcaagacaagccggttaaatcaaaataa

SEQ ID NO: 1275 - DNA (genomic), 507 bp, Streptococcus pneumoniae; double-stranded, circular
  misc_feature (B) LOCATION 1...507
  hypothetical: NO
  anti-sense: NO
ccaaactcagaaggcttaattggagcaactattcctgcctttgaagaaaaatatggtatcaaaatagaactgattcaagctggtactggagaacttttcaaaaaactagagtcagaaaaagaagttcctgtagctgatgttatctttggtggttcttatacacaatatgctacccacggagaactctttgaaaactatatttcaaaagaaaatgataatgttatcaaagaatatcaaaacacaactggcttctctactccttatacactagatggtagtgttttaatcgtccaccctgatttaactaaaggcatgaacatcgaaggatatagcgaccttctcaaacctgaactaaaaggaaaaatcgcaactgctgacccagcaaactcttctagcgcctttgctcaattaacaaatatgctacaagctcaaggtggttacaaagatgataaggcttggtcttatgtaaaagatcttttcacacttattgatggtatagtaaaatga

SEQ ID NO: 1276 - DNA (genomic), 1203 bp, Streptococcus pneumoniae; double-stranded, circular
  misc_feature (B) LOCATION 1...1203
  hypothetical: NO
  anti-sense: NO
gggaaatcagaaggagcattttcgtcagggcaagccgaagtgattgcctattatcctctccaaggggagaaagtgatttcctctgttagggagttgataaatcaagatgttaaggacaagctagaaagtaaggacaatcttgttttctactatacagagcaagaagagtcaggtttaaagggagtcgttaatcgtaatgtgaccaaacaaatctatgatttagttgcttttaaggttgaagagactgaaaagaccagtctaggaaaggttcacttaacagaagatgggcaaccttttacacttgaccaactgttttcagatgctagtaaggctaaggaacagctgataaaagagttgacctccttcatagaggataaaaaaatagagcaagaccagagtgagcagattgtaaaaaacttctctgaccaagacttgtctgcatggaattttgattacaaggatagtcagattatcctttatccaagtcctgtggttgaaaatttagaagagatagccttgccagtatctgctttctttgatgttatccaatcttcgtacttactcgaaaaagatgcggccttgtaccaatcttactttgataagaaatatcaaaaagttgtcgctctaacctttgatgatggtccaaatccagcaacgaccccgcaggtattagagaccctagctaaatatgatattaaagcgactttctttgtgcttgggaaaaatgtttctgggaatgaggacttggtgaagaggataaaatctgaaggtcatgttgttggaaaccatagttggagccatccgattctctcgcaactctctcttgatgaagctaaaaagcagattactgatactgaggatgtgctaactaaagtgctgggttctagttctaaactcatgcgtccaccttatggtgctattacagatgatattcgcaatagcttggatttgagctttatcatgtgggatgtggatagtctggactggaagagtaaaaatgaagcatctattttgacagaaattcagcatcaagtagctaacggctctatcgttttgatgcatgatattcacagtccgacagtcaatgccttgccaagggtcattgagtatttgaaaaatcaaggttatacctttgtgaccataccagagatgctcaatactcgcctaaaagctcatgagctgtactatagtcgtgatgaataa

SEQ ID NO: 1277 - DNA (genomic), 1047 bp, Streptococcus pneumoniae; double-stranded, circular
  misc_feature (B) LOCATION 1...1047
  hypothetical: NO
  anti-sense: NO
aaaatgtcagattcaccaatcaaatatcgtttgattaagaaagaaaaacacacaggagctcgtctgggagaaatcatcactccccacggtacctttccgacacctatgtttatgccagttgggacacaagccactgtcaaaactcagtcacctgaagaattgaaggagatgggttcgggaattatcctatcaaacacctatcatctctggcttcgccctggagatgaactcattgcacgcgctggtggtctccacaagttcatgaattgggaccagcctatcttgacagatagtggtggttttcaggtttattctttagcagatagccgtaatatcacagaagaaggagtaacctttaaaaatcatctaaatggttctaagatgttcctatccccagaaaaagccatctctattcagaataatctgggttcagacatcatgatgtcctttgatgaatgtcctcagttttatcaaccttatgactacgttaagaaatcgatcgagcgtaccagccgttgggctgagcgtggtttgaaggctcaccgtcgtccacatgaccaaggtttgtttggaattgtgcaaggtgcaggatttgaagaccttcgccgccaatcagctcatgatcttgtcagcatggatttctcaggctactctatcggtggtttggcagtgggagaaacccatgaagagatgaatgcggtcttggactttacaactcaactgctgcctgaaaataaacctcgttatctgatgggtgtgggagcgccagatagcttgatcgatggggtcattcgtggggtggatatgtttgactgtgtcttaccgactcgaattgctcgtaacgggacttgtatgaccagtcaaggacgtttggttgtgaaaaatgcccagtttgctgaggactttacgccactggatcctgagtgtgattgctacacatgtaataactatacacgcgcttaccttcgtcacctgctcaagggtgatgaaacctttggtatccgcttgactagctaccacaatctttacttcttgcttaacctgatg

SEQ ID NO: 1278 - DNA (genomic), 447 bp, Streptococcus pneumoniae; double-stranded, circular
  misc_feature (B) LOCATION 1...447
  hypothetical: NO
  anti-sense: NO
agatggtcagattgggaaagatccagtcaagagattggtgagctgatagtggagactatcttgggtattctaagtagtagaggtatccatttagcagttcaaggttgtgagcatgtcaatcgggctctcgttgttgaacgtcaggtggcagagcagtttggtctggaaattgtcagtgtccatcctactcttcatgcaggaggttcggggcagttggcagcctttaagtttatgcaggatccagttgaggttgaatttatcaaggctcatgctggattggatatcggagacactgcaattggcatgcatgtcaagcatgttcaggttccgattcgccctattttgagagagattggtcatgcccatgtaacggcactggctagtcgtccaaaattaatcggaggtgcgcgtgcgcactatccgcaagacgctattagaaagtcttga

SEQ ID NO: 1279 - DNA (genomic), 645 bp, Streptococcus pneumoniae; double-stranded, circular
  misc_feature (B) LOCATION 1...645
  hypothetical: NO
  anti-sense: NO
gatgatacagagagcctgaattggtcaggtgacgtgcttatttacattagcctgataatgaaaatggagagattatcgatggttatattggaattgtaccaaaatgattattctaaagatttagtagcatttgattccatagaagatgggaaagcctttgtagctcaaatcccgggatacactctggaaacagaagatggttttgaagtggagtattttaatcctaaaaacataccggattatatggaaattatttttaacggaaatattgttcctttatctaaatttatgttcgatcctgaggaaaatgtaaacattatttggaaagagatttcaaatttatccctcaaaaatgatagagtgatcgaaggatattcaaaaattgatgcatatgtcgttaacaaccatgaagttaaagcctatgtcgaaacaagagaaacgaactatcgtaaagcaaaagacttcttagaaagccgcggatatgaaatcgacagaagctttttcggaagtgaagacggtgaagcgattctttacagaaaaaaagggatcgaagtttggcatttcttgtgtcacttagacccaatgtttgtagagattgaagatgtagaaggatatgttaaagaagaagttggagagattcaatag

SEQ ID NO: 1280 - DNA (genomic), 267 bp, Streptococcus pneumoniae; double-stranded, circular
  misc_feature (B) LOCATION 1...267
  hypothetical: NO
  anti-sense: NO
agagatacagacatggataaacaatacctacacgaaaagctggatgccatgcgccagaattttgttgaatcaacccaccacgaacgagcggtgggcgtgctagaccaagcgcatatgagcaaaaaaatgcttaaaatcaagaaaaaattagttgctcttgaaatggaacggtgccagagaaaaattgagcacaaagactgttccaagattgaccaaaaaatcaaagagcagaaggagatatttgaatcctgttgtaaaaaagattaa

SEQ ID NO: 1281 - DNA (genomic), 462 bp, Streptococcus pneumoniae; double-stranded, circular
  misc_feature (B) LOCATION 1...462
  hypothetical: NO
  anti-sense: NO
gaaatcacagatgcagatactcgagctttggtagctggaaccatggttgaaaatccagaaggcttccactttgatgatttacaacttcaaactcatgcagataatgacattgaagcgctcgttagcctagccaatatggatggtgagaaagtcgaatttaatgcgacagggcaaggttccgttcaagcaatctttaacgctatcgataagttctttaaccaatctgttcgtttggtgtcctacactatcaatgcggtaacagatggaatcgatgcccaggatcgggttttggtcactgttgaaaacagagatacagaaaccatctttaatgcagcagggcttgattttgatgtgttgaaggcttctgctattgcctatataaacgctaatacctttgttcaaaaagagaatgcaggtgagatgggacgcagtgtttcttaccacgatatgcctagtgtgtaa

SEQ ID NO: 1282 - DNA (genomic), 294 bp, Streptococcus pneumoniae; double-stranded, circular
  misc_feature (B) LOCATION 1...294
  hypothetical: NO
  anti-sense: NO
tctgcgacagatagcaaggaagaagtagaaagtcttttgagcaaggcaaatcaactcttggaacaaatccatgaagaaggaatcagacaatccttggcagaagaagtagaaaatctaaaagctgccacaaacaaggttgatgcagacttggatgaagtaaacagtcaggtaaaagatgttttgactcgtatcgctagcgcccttcaacaagaaaaggaaaatgctgagcaagattctcagacacttgtactctatcaaaaactctacgatattctcatgtcgcttagaaagtaa

SEQ ID NO: 1283 - DNA (genomic), 249 bp, Streptococcus pneumoniae; double-stranded, circular
  misc_feature (B) LOCATION 1...249
  hypothetical: NO
  anti-sense: NO
ctatttgcagataacaagcatctatataaggttatcaaagaagacttccccatgactctaaatgaatatatcttacaatatcgcctgaaacaagctatagataagatggctgaatctcccaactcccctttaagcgctatctctgaccaagttggattttcagactataaatattttgccaaagtatttaaaaagcatctccatatttccccaaaggaattgaaattactcggaagaatagtaaaatag

SEQ ID NO: 1284 - DNA (genomic), 1362 bp, Streptococcus pneumoniae; double-stranded, circular
  misc_feature (B) LOCATION 1...1362
  hypothetical: NO
  anti-sense: NO
ctgattgcagaagctaagaagcgtgacattcgtatcatcatggacttggtggttaatcatacctcagatgaacatgcttggtttgtcgaagcctgtgaaaatactgacagccctgagcgagactactatatctggcgcgatgaacccaatgacctagattctatctttagtgggtctgcttgggaatacgatgaaaagtcaggtcaatactatctccactttttcagcaaaaaacagccggatctcaactgggaaaatgaaaaacttcgccagaaaatttatgagatgatgaacttctggattgataaaggtattggtggtttccgtatggatgttattgacatgattggcaaaattcctgacgagaaggtagtcaataatggtcctatgctccatccctatctcaaggaaatgaatcaggcgacctttggagataaggatctcttgacagtaggggagacttggggagcaacgccagagattgccaagctctactctgatccaaaggggcaagaattgtctatggtcttccagtttgaacatatcggtcttcagtatcaggaaggtcagcctaaatggcactatcaaaaagagctgaatatcgctaagttaaaagaaatcttcaacaaatggcagacagagttaggagttgaggacggctggaattccctcttctggaacaaccatgacctccctcgtattgtctcaatctggggaaatgaccaagaataccgcgaaaaatctgccaaagcctttgcaatcttgcttcatcttatgagaggaactccttatatctaccaaggtgaggagattgggatgaccaactatccgtttgaaacactggatcaagtagaagatattgaatctctcaactatgcgcgtgaggctcttgaaaaaggtgttccgattgaagaaatcatggacagtatccgtgttattggacgtgacaatgcccgtacccctatgcaatgggacgagagcaaaaacgctggtttctcaacaggtcaaccttggttggcggttaatccaaattacgagatgatcaatgtccaagaagcgctggcaaatccagattctattttctatacctatcagaaactggtccaaattcgcaaggagaatagctggctagttcgagctgactttgaattgcttgatacggctgataaggtctttgcttatatacgtaaggatggcgaccgtcgcttcctagtcgtggctaatttatccaatgacaaacaaaacttttcagtagatggaaaagttagatctgtcttgattgaaaacactgcggctaaagaagtacttgaaaaacaggtcttggctccatgggatgctttctgtgtggaaatgactgattag

SEQ ID NO: 1285 - DNA (genomic), 2328 bp, Streptococcus pneumoniae; double-stranded, circular
  misc_feature (B) LOCATION 1...2328
  hypothetical: NO
  anti-sense: NO
gaatatcaagatagactagaccaagaattgtctgttattcatgatatgggctttgatgattatttcttggttgtttgggatttgttgcgttttggacgatcgaatggctattatatgggaatgggaaggggttctgcagtaggcagtttggtttcttatgccttagacatcacggggactgacccagtagagaaaaatctgatttttgaacgctttcttaatcgtgaacgctataccatgcctgatattgatattgatatcccagatatttatcgtccagattttatcagatatgttggtaataaatatggtagtaaacatgcggcacaaatcgttactttttcaacctttggagccaagcaagctcttcgagatgtcttgaaacgctttggtgtgccagagtatgaattatctgcaattactaagaaaatcagttttcgtgacaatcttaagtcggcctatgagggcaatctccagtttcgtcagcaaatcaatagtaagttagaataccaaaaagcttttgagattgcttgcaagatagagggctatccaaggcaaacctctgtccatgcggctggtgttgtaattagtgaccaagatttaaccaactacattcctctaaagtatggtgatgaaattccactgactcagtatgatgctcatggagttgaggctagcggacttttgaagatggactttctgggactacgaaatttgacctttgtccagaagatgcaagagttgcttgctgaaatagaaggtattcaccttaaaattgaagaaatagatttggaagacaaagaaacgttagatttatttgcctctggaaatacaaaaggtatctttcaatttgagcaacctggtgctattcgcttgctcaaacgtgttcaaccagtctgttttgaagatgtcgtagcaactacttctctaaatcgaccgggtgctagtgactatatcaataattttgtggcaagaaagcatgggcaggaagaagtgactgttctggatccagtactggaggatatgttggctccaacctacggcataatgctctatcaggagcaggttatgcaggttgcccagcgatttgccggatttagtcttgggaaagccgatattttgcgtcgggctatggggaaaaaggatgcctctgccatgcatgagatgagggcttcctttattcaaggttcattagaggctggtcatactgtggaaaaagcagagcaggtctttgatgttatggagaggtttgcaggctatggttttaacaggtcacacgcctatgcctactcagcattggccttccagttggcttattttaaaacacattatccagccatattttatcagatcatgttgaattctgccaacagtgattacttaatagatgcacttgaagcaggttttgaagtggcgcctctgtccatcaacacgattccctatcacgataaaattgccaacaaggccatctatctaggtttgaaatccattaaaggagtcagtaatgatttagctctctggattattgaacatagaccttattctaatattgaagattttatagctaaattacctgagaattatctgaaacttcctctgctagaacctttggtaaaagttggtcttttcgattcatttgaaaaaaatcgtcaaaaagtatttaataacttagctaatctatttgaatttgtgaaagagttgggaagtttgtttggagatgctatttatagttggcaggaatcggaagattggacggaacaagaaaaattttatatggaacaagagcttttagggataggtgtcagcaaacatccactacaagctattgcaagtaaggctatttacccgattaccccaatcggaaatttgtcagaaaatagctatgctattattttggttgaagttcagaaaataaaagtgattcgtaccaaaaagggtgaaaatatggccttcttacaggcagatgatagtaagaaaaaattggatgtcactctcttttcagacttatatcgtcaggttggacaggaaataaaagagggagccttctactatgtaaaaggaaaaatacaatcacgtgatggccgtctgcaaatgattgcacaagaaataagagaagcagttgctgaacgcttttggatacaggtgaaaaatcatgaatcggatcaagaaatttcacgtattttagaacaatttaaaggcccaatcccagtcatcatccggtatgaagaggaacagaaaaccatcgtttctccccatcattttgtagctaaatccaatgaattagaggagaaattgaatgaaatcgttatgaaaacgatttatcgctaa

SEQ ID NO: 1286 - DNA (genomic), 225 bp, Streptococcus pneumoniae; double-stranded, circular
  misc_feature (B) LOCATION 1...225
  hypothetical: NO
  anti-sense: NO
cctggtcaagaagttacttttaacgaagttgttcttgttggtggtgaaaacactgttgtcggaactccacttgttgctggagctactgtagttggaactgttgaaaaacaaggaaaacaaaagaaagtggttacttacaagtacaaacctaaaaaaggtagccaccgtaaacaaggtcaccgtcaaccatatacaaaagttgtcatcaacgcaatcaacgcttaa

SEQ ID NO: 1287 - DNA (genomic), 267 bp, Streptococcus pneumoniae; double-stranded, circular
  misc_feature (B) LOCATION 1...267
  hypothetical: NO
  anti-sense: NO
aatctacaagattttacgaataaactaatgaaactaaaaaaggagaagaaaatggcagaatttacatttgaaatcgaagagcacttgttgattctttctgaaaacgaaaaaggttggaccaaggaaattaaccgtgtgagctttaatggtgcccctgcaaagtttgatattcgtgcttggagtccagaccatactaaaatgggcaaagggattactctctcaaatgaagaatttcaaacgatggtggatgcctttaaaggcaactaa

SEQ ID NO: 1288 - DNA (genomic), 876 bp, Streptococcus pneumoniae; double-stranded, circular
  misc_feature (B) LOCATION 1...876
  hypothetical: NO
  anti-sense: NO
aaaggacaagatgtgacaaaacaagccttcaaagaagcagtttttagggcaatttttttcatgagtgcaacagtagctgttgtagctattttgctaatctgtttctttatttttagtaatggcttacctttcatggctaactacggctttgcccgttttttattaggcagtgattggtcgccaacgaacattccggcaagctatggtattttaccaatgatcgttggttccttattaattaccttaggagcgattgtgattggggtgccaacaggcatcttgacatcggtgtttatggtttattattgtccaaagcccgtctatggcttcttaaaatcagctatcaacttgatggcggccattccatctattgtttatggttttttcggcctacaattattggtgccttggattagaacctttttaggaaatggcatgagtgtcctaaccgcttcgttactattaggaataatgattttgccaaccattatcagtttgtcagaatctgctatccgaacagttcccaaaacgtattattctggtagcttggctctaggagctagtcatgaacggagtatttttagtgtcatcttgccagctgcgagatctggtattttatcagcagttattttaggaatcggtcgcgcagtaggtgaaaccatggcagttattttggtggcaggcaaccagccgattattccaagcggactcttttcaggaaccagaaccttaacaaccaatattgttctggaaatggcttacgcatcaggtcagcatagggaagcccttattgcaacctcagcagttctctttttccttattctcttgattaatgcctactttgcctacttgaaaggaaaatcatcttatgagtaa

SEQ ID NO: 1289 - DNA (genomic), 1185 bp, Streptococcus pneumoniae; double-stranded, circular
  misc_feature (B) LOCATION 1...1185
  hypothetical: NO
  anti-sense: NO
actgttaaagacgttgacttgaaaggtaaaaaagtcctcgttcgtgttgacttcaacgtaccattgaaagatggcgtaatcactaacgataaccgtatcacagcagctcttccaactattaagtacatcatcgaacaaggtggacgtgcaattcttttctctcaccttggacgtgtgaaagaagaagctgataaagctggtaaatcacttgctcctgtagcagcagacttggcagcaaaacttggtcaagatgttgttttcccaggtgtcactcgtggtgctgaattggaagcggcaatcaacgctcttgaagatggacaagttctcttggttgaaaacactcgttacgaagatgttgacggcaagaaagaatctaaaaacgatcctgaacttggtaaatactgggcatcacttggagatggtatcttcgtaaacgatgcattcggtacagctcaccgtgcacacgcatctaacgttggtatctcagcaaacgttgaaaaagcagttgctggtttccttcttgaaaacgaaattgcctacatccaagaagcagttgaaactccagaacgtccattcgtggctatccttggtggttcaaaagtttcagacaagatcggtgttatcgaaaacttgcttgaaaaagctgataaagtccttatcggtggtgggatgacttacacattctacaaagcacaaggtatcgaaatcggtaactcacttgtagaagaagacaaattggatgttgcgaaagctcttcttgaaaaagcaaatggtaaattgatcttgccagttgactcaaaagaagctaacgcatttgctggttacactgaagtgcgtgacactgaaggtgaagcagtttctgaaggcttccttggtcttgacatcggtccaaaatctatcgccaaatttgacgaagctttgactggtgccaaaacagttgtatggaacggacctatgggtgtatttgaaaacccagatttccaagctggtacaatcggtgtgatggacgctatcgtgaaacaaccaggagttaaatcaatcatcggtggtggtgactcagctgccgcagcgattaaccttggccgtgcagacaagttctcatggattagtacgggtggtggagcatcaatggaacttcttgaaggtaaggttcttccacaacttgcagccttgacagaaaaataa

SEQ ID NO: 1290 - DNA (genomic), 2361 bp, Streptococcus pneumoniae; double-stranded, circular
  misc_feature (B) LOCATION 1...2361
  hypothetical: NO
  anti-sense: NO
acattcaaagacaaggaaataaagatgaataagaaaatattagaaacattagagttcgataaggtcaaggccttgtttgagcctcatttgttgaccgagcagggcttggagcaattgagacagctggctccgactgccaaagcagataaaatcaaacaggcttttgctgagatgaaagaaatgcaggctcttttcgtcgagcaaccgcattttactattctctcaactaaggaaattgcaggagtctgcaagaggttggagatgggagcggatctcaatatcgaggagttcctactcttgaaacgcgtgcttcttaccagccgagaacttcaaagtttttacgccaatctggaaaatgtcagcttggaagaattagccctttggtttgagaaattacatgattttccgcaattacaaggaaatcttcaggcctttaatgatgcgggtttcattgaaaattttgccagtgaagaattggcgcgaatccgtcgaaaaatacatgatagcgagagtcaggtacgcgatgttttacaagacttgctcaagcaaaaagcgcagatgttgacggaaggaattgttgctagcagaaatggccgtcaggttttaccagtcaaaaacacctaccgcaataagattgcaggtgtcgttcatgatatttctgctagtggaaacaccgtctatatcgaaccacgtgaggtagtcaaactgagcgaagaaattgctagtctgcgagcagatgagcgctatgaaatgcttcgcattctccaagaaatttctgagcgtgtccgccctcatgcggctgagattgctaatgacgcttggattatcggtcatctggacttgattcgtgccaaggttcgatttatccaagaaagacaagcagtcgtgcctcagctgtcagaaaatcaagagattcaactgctccatgtctgccatcctttggtcaaaaatgccgtcgcaaatgatgtctattttggtcaagatttaacagctattgtcattacaggtcccaatacaggtgggaagaccatcatgctcaaaactctgggcttgacacaggtcatggcccagtcaggattgccgattttagcagacaagggaagtcgtgttggtatttttgaagaaatttttgctgatattggagatgagcagtctattgagcagagcttgtctaccttctctagccatatgaccaatatcgtggatattcttggcaaggtcaaccaacattcactcttacttttggatgagttgggggctggtactgatccccaagagggagcagcccttgccatggctattctggaggaccttcgcctgcgtcaaatcaagaccatggcgacgacccactatccagaactcaaggcctacggtattgagacagcctttgtgcaaaatgccagtatggagtttgatactgcaactcttcgcccgacctatcgctttatgcagggtgttcctggccgaagtaatgcctttgaaattgccaaacgtctaggcctatctgaagttatcgtaggagatgccagtcagcagatcgatcaggacaatgacgtcaatcgtatcattgagcaactagaagagcagacgctggaaagccgcaaacgcttggacaatatccgtgaggtggagcaagaaaatctcaagatgaaccgtgtgctaaaaaaactctacaacgagcttaatcgtgaaaaggaaaccgagcttaacaaggcgcgtgaacaggctgctgagattgtggatatggccctaagtgaaagtgaccagattctcaaaaatctccacagtaaatcccaactcaagccccacgaaatcattgaagccaaagccaagttgaaaaaattggctcctgaaaaagtggacttgtctaaaaacaaggtccttcaaaaggccaagaaaaaacgagctccaaaggtgggagatgatatcgtggttctcagttatggtcagcgtggtaccttgaccagtcaactcaaggacggtcgctgggaagcccaagttggcttgattaagatgaccttggaagagaaagagtttgatcttgttcaagcccagcaagaaaaaccagtcaagaagaaacaggtcaatgttgtgaaacgaacttctgggcgaggacctcaagctagactggatcttcgaggcaagcgctatgaagaagccatgaatgagctagatgccttcatcgaccaagccttgcttaacaatatggctcaagttgatatcatccatggtatcggaacaggagtcatccgtgaaggagttaccaaatacttgcaaagaaacaaacatgtcaagagtttcggctatgccccacaaaatgctggaggcagtggtgcgactattgtcacttttaaaggatag

SEQ ID NO: 1291 - DNA (genomic), 186 bp, Streptococcus pneumoniae; double-stranded, circular
  misc_feature (B) LOCATION 1...186
  hypothetical: NO
  anti-sense: NO
tccatcaaagaaatgcatacgattgatgtcatcggtaaggctccagacgtgactccaagtcaagtgtcaaaagagttgatggtaactcttggaactgttacgacaagtttgaacaatttagagcgtaagggctacattgagcgagttcggtcagaacaggatcgtcgtgtggtgcatctgcatttg

SEQ ID NO: 1292 - DNA (genomic), 1566 bp, Streptococcus pneumoniae; double-stranded, circular
  misc_feature (B) LOCATION 1...1566
  hypothetical: NO
  anti-sense: NO
agaatcaaagaaagagaacttatgaatattcaagaagaaattaagaaacgtcgtacctttgccattatctcccacccggacgcggggaaaacaaccatcactgagcagttactctactttgggggtgagattcgtgaggctggtacggtaaaagggaagaaaacagggacttttgctaaatctgactggatggatatcgagaagcaacgtgggatttctgttacttcatctgttatgcaatttgactacgacggcaagcgcgtgaatatcttagacacgccagggcacgaggacttctcagaagatacctatcgtaccttgatggcggtggatgctgcggtcatggtcgtggactctgccaaggggatcgaggctcaaaccaagaaattgtttgaggttgtgaaacatcgtggcattccagtctttacctttatgaacaagctggaccgtgacggtcgtgagcctttggaactcttgcaagaattggaagaaatcttgggcattgctagctaccctatgaactggcctatcgggatggggaaagcctttgagggcttgtatgacctctataaccaacgtttagaactttataaaggggatgagcgttttgctagcctagaagatggagacaaactttttggtagcaatcctttctacgagcaagtcaaggatgacattgagcttttaaatgaagctgggaatgagttttcagaggaagctattctggctggagaattgacgcctgtctttttcggttcagccctgacaaactttggtgtgcagaccttccttgaaatcttcctcaagtttgctccagaaccacatggtcacaagaaaacagatggtgacattgtggatccttatgacaaggatttctcaggctttgtctttaaaatccaagccaacatggatcctcgtcaccgtgaccgtattgcctttgtccgtatcgtatcaggcgaatttgagcgcggcatgagtgtcaatctccctcgtactggtaagggggctaaactatctaatgttacccagtttatggcggagagtcgtgagaatgtgaccaatgccgtggcaggtgatattatcggggtttacgataccggtacttatcaggttggggataccttgacggttggaaaaaacaagtttgaatttgaaccattgccaacctttactcctgaaattttcatgaaagtttctgctaagaatgttatgaagcaaaaatccttccacaaggggattgagcaattggtgcaagaaggagccgttcagctttataagaattaccaaacaggtgagtacatgctgggagctgttggtcaactccagtttgaagtctttaaacaccgtatggaaggcgaatacaatgcggaagtggtcatgagcccaatgggtaaaaagaccgttcgttggatcaagcctgaggacttggatgaacggatgtcgtcaagtcgcaatatcttagccaaagaccgttttgaccaaccagtctttctctttgaaaatgactttgccctccgctggtttgcggacaagtatccagacgtagagttagaggagaagatgtga

SEQ ID NO: 1293 - DNA (genomic), 744 bp, Streptococcus pneumoniae; double-stranded, circular
  misc_feature (B) LOCATION 1...744
  hypothetical: NO
  anti-sense: NO
ttatccaaagaagatttaagtgctcacaataactgtattatttctagatgggaggttctatttttggattggtccattgttgaacaatatctaccactatatcaaaaggcattctttctgaccttgcatattgcagtttggggaattttgggatcctttctgctcggtttaatcgttagtatcatccgacattatcgaatccctgttttggcgcaagtagcgacagcctacattgaattgtcacgtaatacgccccttttgattcaactcttctttctctacttcggtcttccccgaatcgggattgtcctatcttcagaagtctgtgcaacgcttggccttgtctttttaggaggctcctatatggcagaatctttccgaagtgggctggaagccatcagtcaaacccagcaggagattggcctcgctattggtctgacacctctacaggtctttcgctatgtggttcttccgcaagcaacagcggtggcactcccctcctttagtgccaatgtcattttccttatcaaggaaacctctgttttctcagcagtggctttggccgacctcatgtacgtcgccaaggatttgattggtctctactatgagacagacattgcgctagctatgttggtagttgcttatctgatcatgctgctacccatctcactggtctttagctggatagaaaggaggacccgccatgcaggattcgggaatccaagtactctttcaaggaaataa

SEQ ID NO: 1294 - DNA (genomic), 231 bp, Streptococcus pneumoniae; double-stranded, circular
  misc_feature (B) LOCATION 1...231
  hypothetical: NO
  anti-sense: NO
aacataaaagaaaagaagaaaaatccactttttgtgggtatcttgtcgattattcttggtttgttatttccaattgtaggcctgattttgggtatcataggattggtcttggctatttcataccaaaaagagtcacaattagactataaaatagaaaagattcttaatatcataggaattgtgatttctgtagttaactggattgtagcaatcgccttaatttttcggtaa

SEQ ID NO: 1295 - DNA (genomic), 1200 bp, Streptococcus pneumoniae; double-stranded, circular
  misc_feature (B) LOCATION 1...1200
  hypothetical: NO
  anti-sense: NO
atgtcaaaagataagaaaaatgaggacaaagaaatcctcgaagaattgaaagagttatcagaatggcagaaacgaaaccaagaatatctaaaaaagaaggctgaagaagaagcggctctagctgaggagaaggaaaaggaaagacaagctcggatgggagaagaatctgagaagtcagaggacaaacaggaccaggagagtgaaacagaccaggaagattcagaatcagctaaggaagagtctgaagaaaaagtagcatcctcagaggctgacaaagagaaagaagagaaagaagaatcagagtctaaagagaaggaggaacaggataaaaagcttgctaaaaaggctacaaaggaaaaaccagccaaagcaaagattcctggtatccatatcttgcgagccttcacgattttatttccaagtctgcttttattgattgtctctgcctacttgctcagtccttatgcgaccatgaaagatattcgtgttgagggaacggtgcaaactacagctgatgatattcgacaggcttcaggcattcaggattcggattatacgattaaccttctgctagacaaggcaaaatatgaaaagcagattaagtctaactattgggttgaatcagctcaacttgtctatcaatttccaactaagatcactattaaggtcaaggaatatgatattgtggcctactatatttctggtgaaaatcattatcctattctttccagtggtcagcttgagactagttctgtgagtctgaacagtttaccagaaacttatttatcagttctctttaatgatagtgaacaaatcaaggtttttgtctcagaacttgctcaaattagcccagaactcaaggcgactatccaaaaggtggaattagctccaagcaaggtgacatccgatttaattcgattgaccatgaatgattcggacgaagtcttggttcctctatctgaaatgagtaagaaactgccatattacagtaagattaagcctcaattgtcagaaccgagtgtggtcgacatggaagctggaatctacagctacactgtggcggataaattaattatggaagctgaggaaaaagccaaacaagaggctaaggaagctgagaaaaaacaagaagaagaacagaaaaaacaagaggaagagagcaatcgaaaccaaacgacccagcgctcatcgcgtcgctag

SEQ ID NO: 1296 - DNA (genomic), 609 bp, Streptococcus pneumoniae; double-stranded, circular
  misc_feature (B) LOCATION 1...609
  hypothetical: NO
  anti-sense: NO
cttgcaaaagaaactaactttgcaaaatttgatgcaactgtagaagttgcttacaacttgaacatcgatgttaaaaaagctgaccaacaaatcctgtgtggagcaatggtattgccaaacggtactggtaaaacttcacgcgttcttgttttcgcacgtggtgcaaaagctgaagaagcaaaagctgctggtgcagactttgttggtgaagatgaccttgttgctaaaatcaacgacggttggttggacttcgacgtagttatcgctacacctgatatgatggctcttgttggacgtcttggacgtgtccttggaccacgtaacttgatgccaaaccctaaaactggtactgtaacaatggatgttgctaaagcagttgaagagtctaaaggtggtaaaatcacttaccgtgctgaccgtgcaggtaacgttcaagcaatcatcggtaaagtatcatttgaagctgaaaaattggttgaaaacttcaaagctttcaacgaaacaatccaaaaagcaaaaccagctacagctaaaggaacttacgtaacaaacttgactatcacaactactcaaggtgttggtatcaaagttgacgtaaactcactttaa

SEQ ID NO: 1297 - DNA (genomic), 873 bp, Streptococcus pneumoniae; double-stranded, circular
  misc_feature (B) LOCATION 1...873
  hypothetical: NO
  anti-sense: NO
gtagaaaaagaaatggagttatttatgaaaatcacaaactatgaaatctataagttaaaaaaatcaggtttgaccaatcaacagattttgaaagtgctagaatacggtgaaaatgttgatcaggagcttttgttgggtgatattgcagatatatcaggttgtcgtaatccagccgtttttatggaacgttattttcagatagacgatgcgcatttgtcgaaagagtttcaaaaatttccatctttctctattttagatgactgttatccttgggatttgagtgaaatatatgatgcgcctgtacttttattttacaagggaaatcttgacctcctgaaattcccgaaggtagcggtcgtgggcagtcgtgcttgtagcaaacagggagctaaatcagttgaaaaagtcattcaaggcttggaaaatgaactggttattgtcagtggtctggccaagggcattgacacagcagctcatatggcagctcttcagaatggcggaaaaaccattgcagtgattggaacaggactggatgtgttttatcctaaagccaataaacgcttgcaagactacatcggcaatgaccatctggttttaagtgaatatggacctggcgaacaacctctgaaatttcattttcctgcccgtaatcgcatcattgctggactttgtcgtggtgtgattgtagcagaggctaagatgcgttcaggtagtctcattacgtgtgagcgagcaatggaagaaggacgcgatgtctttgctattcctggtagcattttagatggactatcagacggttgccatcatttgattcaagaaggagcaaaattggtcaccagtgggcaagatgttcttgcggaatttgaattttaa

SEQ ID NO: 1298 - DNA (genomic), 627 bp, Streptococcus pneumoniae; double-stranded, circular
  misc_feature (B) LOCATION 1...627
  hypothetical: NO
  anti-sense: NO
aaagaaaaagaggttttacagatggctattatcttaccagaacttccatatgcatacgacgctttggaaccatacatcgatgcggaaacaatgcatttgcaccatgacaaacaccatcaaacttatgtcaacaatgccaatgcagctttagaaaaacaccctgaaatcggtgaagaccttgaagccttgcttgctgatgtagaatctatcccagctgatatccgtcaagcacttatcaacaatggtggcggacacttgaaccacgctcttttctgggaattgatgactcccgagaaaacagctccttcagcagaactggcagcagcaatcgatgcaacatttggttcatttgaagaattccaagcagccttcactgcagcagcaacaactcgttttggttcaggttgggcatggttggttgtcaacaaagaagggaaacttgaagtgacttcaacagcaaaccaagacacaccaatctcagaaggtaaaaaaccaatcttgggcttggacgtttgggaacatgcttactacgtgaaataccgcaacgtgcgtcctgactacatcaaagctttcttttcagtaatcaactggaataaagtagatgaattgtacgcagctgctaaataa

SEQ ID NO: 1299 - DNA (genomic), 909 bp, Streptococcus pneumoniae; double-stranded, circular
  misc_feature (B) LOCATION 1...909
  hypothetical: NO
  anti-sense: NO
aatagaaaagataaaaatacacaaatcctagttcatatatgtaaggtaaatataactaggatttataaagtttacagaggacggtctataatgtcagatagaaaaaacatgaaacttttcgcactcaactctaaccaagagattgcacaaaaaattgcccaagctgttggtgtcccacttggaaaactatcatcacgtcaattttcagacggagaaatccaagtaaatatcgaagaaagtgtccgtggttatgatgtttacatcatccaatcaacaagtttccctgtcaacaaccacctaatggaattgttaatcatggtcgatgcttgtgtgcgtgcaagtgcccacagtatcaacgttgtccttccatattttggctatgcacgtcaagaccgcattgcttgtcctcgtgagccacttacagcaaaactagttgccaatatgctggttaaggctggagttgatcgtatcctgactcttgatttgcatgccgttcaggttcaaggtttctttgatattccagtggataatcttttcactgttcccctattcgcaaaacattactgcgataaaggattgcttggttcagatgttgttgtcgttagccctaaaaattcaggtgtcaaacgtgcgcgtagcctggctgaatatcttgatgctcctatcgccattatcgactaccctcaagacgatgcaactcgtaacgaaggttatattattggtgatgttgaaggtaagacagctatcttgattgatgatattttaaatacaggacgtaccttctctgaagcttctaaaatcgttgaacgtgaaggagctacagaaatttatgctgtttctagccacggtctcttcgtcgagggagctgctgagcttcttgacaatactaatattaaagaaatcttgtga

SEQ ID NO: 1300 - DNA (genomic), 1029 bp, Streptococcus pneumoniae; double-stranded, circular
  misc_feature (B) LOCATION 1...1029
  hypothetical: NO
  anti-sense: NO
aaaagaaaagaggaaatcaaaatgaagaaaacatggaaagtgtttttaacgcttgtaacagctcttgtagctgttgtgcttgtggcctgtggtcaaggaactgcttctaaagacaacaaagaggcagaacttaagaaggttgactttatcctagactggacaccaaataccaaccacacagggctttatgttgccaaggaaaaaggttatttcaaagaagctggagtggatgttgatttgaaattgccaccagaagaaagttcttctgacttggttatcaacggaaaggcaccatttgcagtgtatttccaagactacatggctaagaaattggaaaaaggagcaggaatcactgccgttgcagctattgttgaacacaatacatcaggaatcatctctcgtaaatctgataatgtaagcagtccaaaagacttggttggtaagaaatatgggacatggaatgacccaactgaacttgctatgttgaaaaccttggtagaatctcaaggtggagactttgagaaggttgaaaaagtaccaaataacgactcaaactcaatcacaccgattgccaatggcgtctttgatactgcttggatttactacggttgggatggtatccttgctaaatctcaaggtgtagatgctaacttcatgtacttgaaagactatgtcaaggagtttgactactattcaccagttatcatcgcaaacaacgactatctgaaagataacaaagaagaagctcgcaaagtcatccaagccatcaaaaaaggctaccaatatgccatggaacatccagaagaagctgcagatattctcatcaagaatgcacctgaactcaaggaaaaacgtgactttgtcatcgaatctcaaaaatacttgtcaaaagaatacgcaagcgacaaggaaaaatggggtcaatttgacgcagctcgctggaatgctttctacaaatgggataaagaaaatggtatccttaaagaagacttgacagacaaaggcttcaccaacgaatttgtgaaataa

SEQ ID NO: 1301 - DNA (genomic), 1179 bp, Streptococcus pneumoniae; double-stranded, circular
  misc_feature (B) LOCATION 1...1179
  hypothetical: NO
  anti-sense: NO
tttatgaaagatgttagtctatttttattgaaaaaagttttcaaaagtcgtttaaactggattatcttacttttatttgcatctgtactcggtgttaccttttatttaaatagtcagactgcaaactcacacagcttggagagcaggttggaaagtcgcattgcagccaacgagagagccatcaatgaaaatgaagcgaaactttcccaaatgtctgacaccagctcggaggaataccagtttgctaaaagtaatttagaattgcaaaaaaatcttttgaagcgaaagacagaaattctgactttattaaaagaagggcgctggaaagaggcctactatctgcagtggcaagatgaagagaagaattatgaatttgtatcaaatgacccgactgctagctctggcttaaaaatgggggttgaccgcgaacggaagatttaccaagccctgtatcccttgaacataaaagcacatactttggagtttccgacccacgggattgatcagattatctggattttagaggctatcatcccaagcttgtttgtggttgctattatttttatgctaacacaactatttgcagaaagatatcaaaatcatctggacacagctcacttatatcctgtttcaaaagtgacatttgcaatgtcttctcttggagttggagtgggctatgtaactgtgctgtttatcggaatctgtggcttttcttttctagtgggaagtctgataagtggttttggacagttagattatccctacccgatttatagcttagtgaaacaagaggtaactattggaaagatgcaggatgtattatttcctagcttgctcttagctttcttagcctttatcgtcattgtggaagttgtgtatttgattgcttactttttcaagcaaaaaatgcctgtcctctttctttcactcattgggattgttggcttattgtttggcatccaaaccattcagcctcttcaaaagattgcacatctgattccctttacttacttgcgttcagtggagattttatctggaagattacctaagcagattgataatgtcgatctaaattggagcatgggaatggtcttacttccttgcctgattatctttttgctattgggaattctatttattgaaagatggggaagttcacagaaaaaaagaattttttaa

SEQ ID NO: 1302 - DNA (genomic), 1905 bp, Streptococcus pneumoniae; double-stranded, circular
  misc_feature (B) LOCATION 1...1905
  hypothetical: NO
  anti-sense: NO
ataatgaaagaagaaagaagacaattttttgaaagaatcgatggaaaccaatgtcgtgattatatcttgtcgcactgttcaaaagactatgagaaagtcaagagttcccttgaacgcttgatggacaatcgttttatgtttgatagtccttgggatatggagccttgttcaaaaatccatcaaaaccagccgatggtatgggatcaagtatttgaagatgatccagaatgggcttatatgctcaatcgacaagaatatctcttgcagtttatgatagggtatgtggtagaaggagataaggactatattcaaaagtgcaagttctttctatttgattggattgagcaggtgagagaattttctcctcaatccttgatgactagaaccttggatacgggtattcgttcctttacttggttgaaactactcttgcttctcttgaaatttgacttgctagaggagaaagaactagagaaaattttggtcagtctagaaaagcagattgactttatgaaaagctactatcgcgccaagtacacccttagtaactgggggattttacaaacaattccgatgcttgctatctatcatttcttttcagataagatggacctagaagaagcttaccattttgcttcagaggagttgaaacagcaaattgagacacagattttaggagatggaagccagtttgaacagtcgattctctatcatgtagaggtttataaagccttgctggatttgtgtctcttgcttccagacttgcaagatagttaccaagagttgctggaaaagatggcgacctatattcaaatgatgacaggcttagatggacggactttggcttttggtgatagcgattctacagaaacgacagaaatgttgagcctgtctgctgtggttttgaacaaggaagaccttcttaacggtctggatgttaaagttgatttgcttagcctcttgttcctggggcgagaaaaggtcaagcgactgcaggaatttgaaaggagagcttggcagcctaagtccatgatctttgaagactctggacatgtctgcattaaggatgaacatcgttatctatttttcaaaaatggtccgctaggaagtgcccatagccatagtgacgagaatagtttttgcttacagtatcaaggccaacctattttcatagatgctgggcgttattcttatcgggagatatatgaacgttatctcttaaagagtgcttggagtcattcgacctgcattgtagatgggaaagctccggaaagaatcacgggatcctgggaatatgaatactatcctcactccctgttttgtcaccataaagaaagggagggagtgcattatattgagggggcttattggtcagcagaacctgatttgccttatcttcacaagagaaaaatcctcatgttggtagaggatgtctggctcttggtagatgacatcaggtgtcaaggtcagcatgaggcgttgactcagtttatccttgacaaggatgtgacctatcaagatgggaaaatcaatcagttgagactatggagtgaagttgattttgatttggaagataccatcatttctcctaaatacaatgagcttgaaagaagtagcaaactcaccaagcgccaattctttgagaatcagatgctggattataccatcattgcgcatgagagttttgaaatcatccgtcattctgtctaccagacagatgatcgtgaagtggaaaatgctctggcttttgaagtgaaaaatgacgaaacagacaagctgattctgttattaagcgaggatatttgtgtaggtgaaaaattgtgcctcgttgacggaacaaaaatgcgtggaaaatgtctagtatatgataaaataaatgagagaatgattcgcttgcagtgctag

SEQ ID NO: 1303 - DNA (genomic), 2181 bp, Streptococcus pneumoniae; double-stranded, circular
  misc_feature (B) LOCATION 1...2181
  hypothetical: NO
  anti-sense: NO
atgatgaaagatacattcaaaaatgtcttgtctttcgaattttggcaaaaattcggtaaggctttgatggtagttatcgcggttatgccggctgctggtttgatgatttcaatcggtaagtctatcgtgatgattaacccaacctttacaccacttgtcatcacaggtggaattcttgagcaaatcggttggggggttatcggtaaccttcacattttgtttgccctagccattggaggaagctgggctaaagaacgtgctggtggtgctttcgccgctggtcttgccttcatcttgattaaccgtatcactggtacaatctttggtgtatcaggcgatatgttgaaaaatccagatgctatggtaactactttctttggtggttcaatcaaagttgctgattactttatcagtgttcttgaagctccagccttgaacatgggggtattcgtagggattatctcaggttttgtaggggcaactgcttacaacaaatactacaacttccgtaaacttcctgatgcactttcattcttcaacgggaaacgtttcgtaccatttgtagttattcttcgttcagcaatcgctgcaattctacttgctgctttctggccagtagttcaaacaggtatcaataatttcggtatctggattgccaactcacaagaaactgctccaattcttgcaccattcttgtatggtactttggaacgtttgctcttgccatttggtcttcaccacatgttgactatcccaatgaactacacagctcttggtggtacttatgacattttaactggtgcagctaaaggtactcaagtattcggtcaagacccactatggcttgcatgggtaacagaccttgtaaaccttaaaggtactgatgctagtcaataccaacacttgttagatacagtacatccagctcgtttcaaagttggacaaatgatcggttcattcggtatcttgatgggtgtgattgttgctatctaccgtaatgttgatgctgacaagaaacataaatacaaaggtatgatgattgcaacagctcttgcaacattcttgacaggggttactgaaccaatcgaatacatgttcatgttcatcgcaacacctatgtatcttgtttactcacttgttcaaggtgctgccttcgctatggctgacgtcgtaaacctacgtatgcactcattcggttcaatcgagttcttgactcgtacacctattgcaatcagtgctggtattggtatggatatcgttaacttcgtttgggtaactgttctctttgctgtaatcatgtactttatcgcaaacttcatgattcaaaaattcaactacgcaactccagggcgcaacggaaactacgaaactgctgaaggttcagaagaaaccagcagcgaagtgaaagttgcagcaggttctcaagctgtaaacattatcaaccttcttggtggacgtgtaaacatcgttgatgttgatgcatgtatgactcgtcttcgtgtaactgttaaagatgcagataaagtaggaaatgcagagcaatggaaagcagaaggagctatgggtcttgtgatgaaaggacaaggggttcaagctatctacggtccaaaagctgacatattgaaatctgatatccaagatatccttgattcaggtgaaatcattcctgaaactcttccaagccaaatgactgaagcacaacaaaacactgttcacttcaaagatcttactgaggaagtttattcagtagcagacggtcaagttgttggtttggaacaagtaaaggatccagtatttgctcaaaaaatgatgggtgatggatttgcagtagaacctgcaaatggaaacattgtatctccagtttcaggtactgtgtcaagcatcttcccaacaaaacatgcttttggtattgtgacggaagcaggtcttgaagtattggttcacattggtttggacacagtaagtcttgaaggtaaaccatttacagttcatgttgctgaaggacaaaaagttgcagcaggagatctccttgtcacagctgacttggatgctatccgtgcagcaggacgtgaaacatcaacagtagttgtcttcacaaatggtgatgcaattaaatcagttaagttagaaaaaacaggttctcttgcagctaaaacagcagttgctaaagtagaattgtaa

SEQ ID NO: 1304 - DNA (genomic), 201 bp, Streptococcus pneumoniae; double-stranded, circular
  misc_feature (B) LOCATION 1...201
  hypothetical: NO
  anti-sense: NO
aaagtgaaagaagagaaaaaagcgattgtcttaggtgcagataatgcttatatggataaagttgaaacaacaataaaatctctttgtgttcatcattataatcttaagttttatgtttttaatgatgaccttccgcgagaatggttccaattgatggaaaaaagactagagactttgaatagtgagattgtgaatgtttag

SEQ ID NO: 1305 - DNA (genomic), 750 bp, Streptococcus pneumoniae; double-stranded, circular
  misc_feature (B) LOCATION 1...750
  hypothetical: NO
  anti-sense: NO
actcggaaagatttttggttctgcggtaatcgggctaactttatttttaggaggaatctgaatacaagttttgttcatgctgctgatgggattcaatatgtcagagatgatactagagataaagaagagggaatagagtatgatgacgctgacaatggggatattattgtaaaagtagcgactaaacctaaggtagtaaccaagaaaatttcaagtacgcgaattcgttatgaaaaagatgaaacaaaagaccgtagtgaaaatcctgttacaattgatggagaggatggctatgtaactacgacaaggacctacgatgttaatccagagactggtcatgttaccgaacaggttactgttgatagaaaagaagccacggatacagttatcaaagttccagctaaaagcaaggttgaagaagtttttgttccatttgctactaaatatgaagcagacaatgacctttctgcaggacaggagcaagagattactctaggaaagaatgggaaaacagttacaacgataacttatgatgtagatggaaagagtggacaagtaactgagagtactttaagtcaaaaagaagactctcaaacaagagttgttaaaaaaggaaccaagccccaagttcttgtccaagaaattccaatcgaaacagaatatctcgatggcccaactcttgataaaagtcaagaagtagaagaagtaggagaaattggtaaattactcttactacaatctatactgtag

SEQ ID NO: 1306 - DNA (genomic), 528 bp, Streptococcus pneumoniae; double-stranded, circular
  misc_feature (B) LOCATION 1...528
  hypothetical: NO
  anti-sense: NO
cctaggaaagaagtgttagagggcacttgcagtttttggtataatggaagatatttgaaagaaaagagaagtgatatgacacagattattgatgggaaagctttagcggccaaattgcaggggcagttggctgaaaagactgcaaaattaaaggaagaaacaggtctagtgcctggtttggtagtgattttggttggggataatccagccagccaagtctacgttcgcaacaaggagaggtcagctcttgcggctggttcccgtagcgaagtagtgcgagttccagagactattactcaagaggaattgttagacctgattgctaaatataatcaggatccagcttggcatgggattttggtccagttgccattaccaaaacatatcgatgaagaggcggttttattagccattgacccagaaaaggatgtggatggtttccatcccctaaacatagacgtcttttgggtctggacatccagtcatgattccctcgacacctgcaggaattatggaaatgtttcatga

SEQ ID NO: 1307 - DNA (genomic), 258 bp, Streptococcus pneumoniae; double-stranded, circular
  misc_feature (B) LOCATION 1...258
  hypothetical: NO
  anti-sense: NO
tgggttgaagaaaagctaagctcgagaaaggacaaattttgtcctttcttttttgatgttcagagcgatgaaaatccgttttttgaagttttcaaagttccgaaaaccaaaggcattgcgcttgatgtctttgatgagtttgttagtggcctcaagtttagcgttagaataaggcaattcaatggcgttagtgatgtagtttttatagcaaataaatgtgctcaaagtggttttaaaggtgcggttgagatgaggtaa

SEQ ID NO: 1308 - DNA (genomic), 567 bp, Streptococcus pneumoniae; double-stranded, circular
  misc_feature (B) LOCATION 1...567
  hypothetical: NO
  anti-sense: NO
gctggtgaagaccacatcatgtctaaaaaagtattatttatcgtcggatcactacgccaaggttctttcaaccaccaaatggccctcgaagctgagaaagcacttgctggtaaagcagaagttagctaccttgattattcagcccttcctctcttcagccaagatttggaagttccaactcatccagctgtagcggcagctcgtgaagctgtccttgctgcggatgccatctggatcttctctccagtctacaacttctctatccctggaacagtgaaaaacttgcttgactggctatctcgtgcccttgacttgtctgatacacgcggcgcttctgcccttcaagacaagttcgtcacagtatcatctgtagccaatgcaggtcacgatcaactcttcgctatctacaaagacctcttgccatttatccgtacacaaggcgttggtgatttcactgctgcacgtgttaatgactctgcctgggcagacggaaaattggttcttgaagaaacagtcctaaactcacttgaaaaacaagctcaagacttgatcgaagctatcaagtaa

SEQ ID NO: 1309 - DNA (genomic), 222 bp, Streptococcus pneumoniae; double-stranded, circular
  misc_feature (B) LOCATION 1...222
  hypothetical: NO
  anti-sense: NO
agaatagaagataggatggggaaactcttgaccagagggtttcatatcctttttgtgaaaagaagtttatactcaatgaaaatcaaagagcaaactaggaagctagcgcaggctgctcaaaacagtgttttgaggttgtggatagaactgaagaagtcagctcaagacagtgttttgaggttgcagatagaactgacgaagtcagtaacatatatacggtaa

SEQ ID NO: 1310 - DNA (genomic), 297 bp, Streptococcus pneumoniae; double-stranded, circular
  misc_feature (B) LOCATION 1...297
  hypothetical: NO
  anti-sense: NO
caaccagaagaggcagaagctcatccgcaaaaaaatattatcacccagtctattgggcaaaaagatgaaattcagcctgattttgggacagttatccttgagtcaggtgactatctcttgctcaatagtgacggcttgaccaacatgatttcaggcagtgagattcgtgatattgtaaccagtgatattcctttagcagataaaacggagacacttgttcgttttgctaacaatgcaggaggtttagacaacattacggttgcccttgtttctatgaacgaggaggatgaagaatga

SEQ ID NO: 1311 - DNA (genomic), 948 bp, Streptococcus pneumoniae; double-stranded, circular
  misc_feature (B) LOCATION 1...948
  hypothetical: NO
  anti-sense: NO
gaaggagaagatatgacaaaactaatctttatggggacccccgacttttcagcaacagtcttaaaaggacttttgacagatgaccgttacgaaattctagccgttgtgacccagccagaccgtgctgttggtcgtaaaaaagttatccaagaaaccccagtcaagcaggctgccaaggaagcaggactatctatctaccaacctgaaaaattatctggaagtccagagatggaagaacttatgaagctaggagcagatggaattgtgactgctgcttttgggcagtttctcccaagcaaactccttgatagcatggactttgctgtcaacgttcatgcctccctccttcctagacaccgtggtggtgcgcctatccattatgccttgattcaaggggatgaggaagctggtgtgaccatcatggaaatggttaaggaaatggatgcaggagatatgatttttcgtcgcagcattccgatcacagatgaggacaatgttggcaccttgtttgaaaaattggcgctagttggtcgtgatttgcttttggacactctgcctgcctatattgctggtgatatcaaacctgaaccgcaggatacgagtcaggttaccttctctccaaatataaagccagaggaagaaaaactggactggaacaaaaccaatcgtcaactctttaaccaaattcgtggaatgaacccctggcctgttgcccatactttccttaagggcgaccgctttaagatttatgaagccctaccagtagaagatcagggaaatccaggtgagattctctctatcggcaagaaagaattgattgtcgcaacggctgaaggggctctatccctcaaacaagtgcagccagctggtaagcctaagatggacattgcttccttcctcaacggagttggacgtacattgactgtaggagaacgatttggtgactaa

SEQ ID NO: 1312 - DNA (genomic), 1245 bp, Streptococcus pneumoniae; double-stranded, circular
  misc_feature (B) LOCATION 1...1245
  hypothetical: NO
  anti-sense: NO
aatatggaagaaaattataatttatctataactcaaataaagaattctattaaagaaaattccttagttttgtttgttggtgcaggaatatcagctaattctaatctaccaacttggggagaattgattcaatcattaaaaaaagaattgaacataccagaagaaagaacagatagtccactgagaattgctcagtattattatgatacttttgggaaaaatcagtacacaaagaagatagaagaaattttctttaagaagggattgagtaaaccaaatgagttacataaattaatagaaaaaattgcaccaaaacatattattacgacaaactatgattcacttctggagagtcaatttgaaagtggcttgttaaagtacaatgtagtcgctgaggataaagacatcccttatacgagttcggaaagatacttgattaaaatgcatggtgacttcagtaagaaaaatattgttttgaaagaagatgattatttagactatcatttgaacttcccaatgatttctactttaatccagtcattgataatgaatcatactctattgtttgtggggtattctctaagtgattcgacttttaattcaatttttagaatgattcaaaatacatttgacctggatgctaaaaatgcttatttttatactcccgaggaaccgtctatgatcattcgagagtattataagaagcaaggaattttcattatctctaatgaagagaatctaggtcaggagacatcagaaaaacagaacaaattgtattgcaggacaaaagattttttagaggttctatcagaaaaccgaagtcaagatgtaaataatgctgatgatttatggaatcaactggcttttttagatagacttagttttattgatgcgaaagatttttctagatattctgatttaaagaaaagggctttaaactgggatgatgagtattgctggtttggaaatgatcaattaagatttgaaattgatggtcatgaagaattacgaattatggtatctaaaaaatctttattaaatcgctttctagatatggagattggtgagcctagggatttaaaggggaatcgattcttaagtaaggcttttaagttgtatgaagaaaaacaatattctttagcaaaagcaaaatttagagaactagctaatatagcttttgttcagaagaactattttaattttcttagttggggaattaaattttcagcaaattcaaataattga

SEQ ID NO: 1313 - DNA (genomic), 627 bp, Streptococcus pneumoniae; double-stranded, circular
  misc_feature (B) LOCATION 1...627
  hypothetical: NO
  anti-sense: NO
aaaatggaagagttagtgaccttagattgtttgtttattgacggaactaagattgaagccaatgccaacaagtatagttttgtgtggaagaaaacgacagagaaattctccgccaaacttcaagaacagatacaagtctattttcaagaagaaatcactccccttctgattaaatatgccatgtttgataaggaacaaaagagaggctataaacagtcagctagaaacttagcgaattggcactataatgacaaggaggatagctacacacatcctgatggctggtgctatcgttttcaccataccaaatatcagaaaacacagacagactttcaacaagaaatcaaggtttactacgccgacgaacctgaatcagcccctcaaaagggactgtatatgaacgaacgctatcaaaacttgaaagctaaagaatgtcaggcgcttttatctccccaaggtagacagattttcgctcaacgcaagattgatgtggaacctgtctttgggcagataaaggcttctttgggttacaagagatgtaatctgagagggaagtgtcaagtgagaattgacatgggattggtacttatggccaataacctcctaaaatatagtgaaatgaaataa

SEQ ID NO: 1314 - DNA (genomic), 1716 bp, Streptococcus pneumoniae; double-stranded, circular
  misc_feature (B) LOCATION 1...1716
  hypothetical: NO
  anti-sense: NO
aggaaggaagacatggccttagaagtaattatgccaaaagccggcgtggatatgacagaaggacaaatcgtccaatggaataaaaaagtcggagaatttgtaaaagaaggagaaatccttttggaaatcatgactgataaagtcagcatggaattggaagccgaagaagatgggtacttgattgccattctcaaaggagatggtgaaactgtccctgtaacggaagttatcggttaccttggtgaagaaagggaaaacatcccaacagctggagcagcatcgccagaagctagccctgtacctgtagcaagtacctcaaacgatgatggtaatagcgatgatgcttttgatatcgttgtgattggtggaggtcctgctggttatgttgcagccattaaagctgcccaactcggcggtaaggttgcccttgttgagaaatctgaacttggtggaacctgcttaaaccgtggatgtattccaaccaagacctaccttcataacgctgaaattattgaaaatatcggtcatgctgcaaatcgtggtatcgtgattgaaaatcctaacttcactgttgatatggaaaaacttttagaaactaaatctaaagttgttaatactcttgttggtggtgttgcaggacttcttcgtagctacggagttactgttcataaaggaattggtacaatcactaaagacaagaacgtcttggtaaatggttctgaattgcttgaaaccaagaaaatcattcttgctggtggttcaaaagtcagcaagatcaacgtccctggtatggaatctccacttgtcatgactagtgatgacattcttgaaatgaacgaagtgccagaaagccttgttatcatcggtggtggagttgtcggtatcgaactcggtcaggccttcatgacatttggttcaaaagtgactgttatcgaaatgatggaccgtatagttccagctatggatgcggaagtttctaagaaccttcgcttgatccttgagcgtaaaggaatgaccatcttgactggtactaaactgcaagaaatcattgaggaaaatggtcaacttcgtatcaaggttgaaggaaaagacgatatcatcgcaagcaaagctcttctttcaattggtcgtatgccagaccttgaaggtattggagaggttgagtttgaattggatcgtggttgtatcaaggtcaacgaatacatggaaacttcagttccaggcatttatgcaccaggtgacatcaacggtactaagatgttggctcacgcagctttccgcatgggtgaagttgccgctgaaaatgcccttaaaggaaatcatgcagttgccaaattgaatttgactcctgcagccatctacactctccctgaagtagcagcagtaggtttgacagaagaacaagcccgtgagaaatacgatgttgccatcggtaagtttaactttgctgctaacggtcgtgctattgcatctgacgcagctcaaggtttcgtaaaagttatcgctgataagaaatgcggagaaatccttggtgtacacattattggtcctgcagccgcagaattaataaacgaagcatcaagcatcatcgaaatggaaatcactgttgaggaaatgctgaagaccatccacgggcacccaacttactctgaagtgatgtacgaagcgtttgcagatgttctaggaatggccatccattcacctaagaaaaaataa

SEQ ID NO: 1315 - DNA (genomic), 717 bp, Streptococcus pneumoniae; double-stranded, circular
  misc_feature (B) LOCATION 1...717
  hypothetical: NO
  anti-sense: NO
ttttgtcgagaagacaccttggcaaatggcagctctgccttcatcgtctccctcctaggatggatgccggctcctattgaaatttcagccatcaattcactttggtcagctgaaaagagaaagaccgtcaactttaacacagaagacgctctgtttgactttaacactggttatattggaacagctatcctagccgtcttctttgtggcactgggagcactgattcagtatcctacagggcaggcggttgaagctgcttcagccaaatacatctctcaattcgtgggcatgtatgcctctgttcttggcgaatggtcccgttacttgattacctttattgccttcctctgtatctttggaacagttataactgttatcgatggctattctcgcgttaatcaggaatctctccgactgctaatcagtcaaaaagaggacaatcgtaaatctttgaacatctggatgaccatcactgctatcatcggtatcgtcattatcaagttcttcgctggtcaggtttcaaccatgctccgctttgccatgattggctctttcctgacaacacctttctttgctcttttgaattacgccttggtaacgcgtgaaaacaaaaatcttccttcttggctcaaacaccttgccattgcgggattgattttcctctttggcttcgccatcttctttatctacgcactcgcaatcggaaaagcagggtaa

SEQ ID NO: 1316 - DNA (genomic), 1263 bp, Streptococcus pneumoniae; double-stranded, circular
  misc_feature (B) LOCATION 1...1263
  hypothetical: NO
  anti-sense: NO
atgactagagaaaatattaaacttttttcagaaatgcacgctgaaccaagctggttggctgatctccgtcaaaaagcttttgacaagattgagactttggaattaccagttattgagcgtgtcaaattccaccgttggaatctgggtgatggaacgattacagaaaatgagccatcagcaaatgttccagatttcacagctttagatcatcacttgaagttggtgcaagtaggaactcaaactgttttcgaacaaactccagttgagttagctgaacagggtgttgtcttcacagactttcactcagctttagaagaaattccagagctgatcgaagaattcttcatgtcatctgttaagtatgatgatgacaagttggcggcttaccacacagcttactttaacagtggtgctgtactctatattccagataacgtagaaatcacagagccaattgaaggaattttctaccaagatagcgatagcaatgtgccgtttaacaagcatattatgattatcgctggtaaaaattctaagattagttatctggagcgtttagagtcacgcggtgaaggaagtgacaaagtaactgccaatatcacagtggaagtgattgcacgttctggtgcgcaagtcaagtttgctgctatcgaccgtctaggtgaaaacgtcactgcctacattagccgtcgtggtaaattaggcaacgatgcaagtattgactgggctatcggtgtcatgaacgaaggaaatgtcgttgctgattttgatagtgacttgattggtaatggtagccatgctgacctcaaggttgtagctctttcaagtggtcgtcaggtacaagggattgatactcgtgtaactaactatggctgcaactctatcggaaatatcctacaacatggggttatccttgaaaaagcaactttgactttcaatggtatcggccacatcatcaagggtgctaagggagcagatgcgcaacaagagagccgtgttctcatgctttcagaccaagcgcgttcagatgctaacccaattcttttgattgatgaaaatgatgtcactgcaggacacgcagcgtctatcggacaagttgatccagaagacatgtattacctcatgagtcgtggattggataaggcaactgcagagcgtttggttgttcgtggtttccttggatctgttatcgtggagattccagtcaaggaagttcgtgatgaaatgattgcaactatcgaagagaaattgtcaaaacgctaa

SEQ ID NO: 1317 - DNA (genomic), 708 bp, Streptococcus pneumoniae; double-stranded, circular
  misc_feature (B) LOCATION 1...708
  hypothetical: NO
  anti-sense: NO
tataatagagataagaatttttataaggggaaactgatgaaatcacttcgttttcaatctgtctttgatatcatcggaccagttatgattggcccatctagtagccataccgctggtgctgttcgtattgggaagattgtctcttccatttttgatgatactccgacagaagttgaattccaactttttaactcatttgccaagacctatcgtggtcacggaacagacctagcccttgttgcaggtattttaggaatggatacagatgatcctgaaattccaaatagtctggaaattgcccacaagcgtggtatcaagattgtctggaccattcagaaagacagcaatgcccctcaccctaacaccactaaaattactgttaaaaatgcccacaagaccatcagcgtgactggtatttctatcggtggaggaaatattcaggtaaccgaactcaatggttttgccgtctctctcaatatgaatacaccgactatcatcatcgttcatcaagatattccaggtatgattgcccttgttacagaggcgctttcccgctatggtatcaatatcgcccagatgaatgtcactcgtgaaaaagctggtgaaaaagccattatgattatcgaagttgacagtcgcaactgtgatgaggctatcgaagaaattcgaaaaatccctcatctccacaatgtcaatttctttaaatag

SEQ ID NO: 1318 - DNA (genomic), 1017 bp, Streptococcus pneumoniae; double-stranded, circular
  misc_feature (B) LOCATION 1...1017
  hypothetical: NO
  anti-sense: NO
gagtgtagagatgctggtttattgaatcatgtatctctcactcttgttttttcaggagaaattaaaatgaaaaaatatattctaaaaaaagtattattcatgattcctatgttgttgattattagctttttagtattcattgcactagatttaacaccagcagatccattgacatatatggtatctccagatatggctagtagtgcagaacaaatcgaaaagctaagacagcaattaggtttaaatgatccagtattagttcgctatggaagatggctttggcaattactccatggtgattttggatacagtattgtaaatggtaacccaatttccaaaattgtaggacaagcattgcctgcaacttttgaattagcttttgtgtcattaattatttcaacaattgttggtattgtaattggggttatatcagccgttaaacaaaatggtattatcgataatgttgctcgttttctagctgttatcggaactgcgattccacaatttttctttggtattttaattttaaacttctttgcaattcagttaagaattttacctattggtggtagatttgccagtggagattttacatttattaatagagttgaacacttaattctaccagtaatggctatgtcaattgcattggtagctgctttaatgagatacacacgtaattctatgttggatgtttttaatgcagattatgttaaaacagctcgtgcaaaaggtgttcctgaatggaaagtttattttaaacacatatttagaaatgctatgcgaccaattttagtgttattgattttccgtctaccaatgttaattggtggatcagtaattatcgagagtgtcttttcttggcctggaattggttctatcatcctatctagtgtaacagcaggtgactatcctgtaattatgattaccacattaatgatttctgtcgtagtgttatttgctagtctacttgtagatattatggctgcaatattagacccacgtattcgttattag

SEQ ID NO: 1319 - DNA (genomic), 990 bp, Streptococcus pneumoniae; double-stranded, circular
  misc_feature (B) LOCATION 1...990
  hypothetical: NO
  anti-sense: NO
accaaaagagattacagaacgttttgtagcgggattaaaatagcatgccagagtaagaggtgtaatatgaaaattgatgttataaatcatttagactcaccaggattagctgggatgatttgtagacggattaataatagaattttagtttatggaggtagttatttcccaaataacgatcctttaaaaagttcaaaagttcaatcaaataaaattagagtttatgatgagaaatttaatcttctatatgaacaagatggaaaaatttctccagataaaggaataacgattgaagttgaaaatgaaatctattacattctaggctcgagcatttatcgtattacgattggtgaaagtgtagaagaaacctgtatcgggaattttgatttccaactagagagtggttatggttgttattttgatggccacttattctttggatttcaggaaagttatttgttcaatattgagactcaagagctttttaaaaaatctgacttcccagtttctggtagaggccaaggtttgtcagtcaaatatcaaaatgaattgtattatttaggtggagcgaacaatgaagcttatttagatggatacaaatatagtttaaaaaaagataagtgggaaaaacttgagttcgaattaccaagctcagttctaggagcatcaagtatacaaataaatgaaagtggtttattaatacttggtggctttaatgaaattgtttataataaagcagttattgatttagcaacccctggctatagggaagaatatttttctaaagggagagatttctttaattggaatcgtagcatgcgaatactagatttagagacaggtaaggtcaagattattgcaaacgatgagcgttttgctctttgtggggcaggatttttaaaaactgataatggatattacgttgttagtggggaatgtagcccaggaagacgtacttctgacatacttttgttagaggaggaaatgtaa

SEQ ID NO: 1320 - DNA (genomic), 1008 bp, Streptococcus pneumoniae; double-stranded, circular
  misc_feature (B) LOCATION 1...1008
  hypothetical: NO
  anti-sense: NO
ggagaaagagataaaatggaaacaaaaacaatgtccttccgtgacaccattatccttgctatgtctgaggaaatgcgtcgcgatgaaaatgtgttcttgatgggagaagacgtcggtgtcttcggaggagacttcggtacttctgttggaatgcttgaagaatttggtccagaacgtgtccgtgactgtccgatttctgaagctgccatctctggagcagcagcaggagcagccatgacaggacttcgtccaatcgtcgatatgaccttcatggacttctctgttattgccatggacaatatcgtcaaccaagctgctaaaacacgttacatgtttggtggtaaaggtcaggttccaatgactgttcgttgtgcagctggtaacggagttggctctgccgcccagcactcacaatctctagagtcttggtttactcacattccaggacttaaggttgtggcacctggaacacctgcggacatgaaaggcctgcttaagtcttctatccgtgataacaacccagttattatacttgagtacaagtcagaatttaaccaaaaaggggaagtgccagttgatccagactacacaattccacttggggttggtgaaatcaaacgccaaggaacggatgtaacagttgttacttatggaaaaatgcttcgccgtgtggttcaagctgctgaagaattagcagaagaaggaatttcagttgaaattgttgacccacgtacccttgttccgcttgataaggatatcatcataaactcagtgaagaagactggtaaggttgttctggtcaacgatgcccacaaaacaagtggctatatcggtgaaatttcagctattatttcagaatcagaagcatttgactatctagatgcaccaattcgccgttgtgcaggagaagatgtgccgatgccttatgcacaaaacctagaaaatgcaatgattccaacagttgaaagtatcaaagatgcaatccgaaaaacttataacaaagaatag

SEQ ID NO: 1321 - DNA (genomic), 2043 bp, Streptococcus pneumoniae; double-stranded, circular
  misc_feature (B) LOCATION 1...2043
  hypothetical: NO
  anti-sense: NO
aaaggaagagaaatgtttgattatagagcactagttattttgatgactttgatggatcattgtgagctatcattatatgaattatctgttaaggtgagcttacctataaaggaagtcaaagaaggaatagattatttagtgccttatctagctaataaagggatagtgctggataaaaaacaaggtcgctatagtttatcaaatcgtacgaagcagtctttgacagatattattaagtcggatgaattggttttaccaaagtcgactcgcttagctttaatctatctttacactttttgccgattagattttatatcgaataatcattaccaagactttttgaaagtaagtaagaatacaaccttatctgatattcaatcattaagaaagattatgttagataatgatttggagctagggtacagtagagcaaaaggttatactttacacggttcagagtggaataagcaccgtttagcttttcaaatggttagtgagttgctggaatcctccatagggatttggggtttggattatgttttatccagttgggggtattcattaacttatgatttgattgatcaggtagttaaagattattatgagaagctacagctagtacctattgttaatcaattaaaagtttaccttttcggtttagtattcattctgtgtaggtatcaaagggatgttgaaagagtatgtctttcagagacattagtatctcctgttattcaagatataacgactattttattggatacagtggttgatttgggaattatagatacggtgttttctgaggatgattatcgctatatcacagttttattatcaagttgctttgaaggtgaagtagatgttgctccggtttactttaatcaattaacagaggctattataagtagaatggaagatatttctttgttacattttaaacaaagggaaggattgagagaaaatcttcgtcgccaccttataccggcttactatagattaaagttcggcctacctagttcaaatgaatatgtattgcatgttaaagaacattatcctgatttatttgaattagtcaaagattctttgatgcccttgatggacgctattgacaatcccatacctgatagtgaaacagcatattttgttatccatttcggaggttatttaaagaaagcagatactttgcctcaaaaatggtataaagcagcaatcatttgtcctaatggtgttagttcttcattgatgttaaaagagaatctattagcattatttcctcaaattgagtttataggaacctcaaagattgatgatttacaggtgaaagctagtagtgactatgatatggttttttctaccataaaggtggagacagaaaagccaaattatctagtttcggttatgatgactgaagagcaagcaatacaactagtagaactagtgttaaaagattttccgaatttagagtatggagattttgagattgaacaaatcctgaatattgtcaaaagatatggaattattacacaagaattggaattaagattggcgttaaagaattatctttatcaaaaaaatgatagaaaggaaattgtaccagtgctagaacaacttattaccaaagaaacctatcaggttagttcgcaaaaattaggatggaaggaggcgattcgtttagcagctaaaccgcttttggatcaagataagataacggagaactaccctgaggcaatgattcaaaaagtagaagagtttggaccttttattaatttagggaagggagtagcaattcctcacgctcggccagatgaaggtgtgaatgaaataggaatgtcaatgttagttttggaagaaccgatttatttattggataatccagaacaagaggtaagattgttgatttgtattgcagccattgataatgagagtcatttaaaggctttgtcacatttaacaacaattttaagagataaaaatcatgttcaaactttaatatcatcaaaaaactatgatgatattaaaatgataattaaacaggaggattag

SEQ ID NO: 1322 - DNA (genomic), 666 bp, Streptococcus pneumoniae; double-stranded, circular
  misc_feature (B) LOCATION 1...666
  hypothetical: NO
  anti-sense: NO
aaagggagagagatgaacattttagttgcagatgacgaggaaatgattagagaaggaattgcagcatttctgacagaagagggttatcatgtcattatggctaaggatggacaagaggtcttggaaaaatttcaagatctccctatccatctcatggtactggatttaatgatgcctaggaagagtggttttgaagtgttaaaagaaatcaatcaaaagcacgatattcctgtcatcgtcttgagtgctctgggagatgaaactactcagtcacaggtatttgatctctatgctgatgatcatgtgacaaaacctttttctttggtactgcttgtcaagcgtattaaggcgcttatcagacgttactacgtcatagaggatctttggcgatatcaggatgtaacagtggattttacctcttacaaagcacattataaaaatgaagaaattgatctcaaaccaaaggaattactggtactaaagtgtttgattcagcataaaaatcaagttttaagtagagagcagatattggaagaaatttcaaaagatgtagctgatttaccttgtgatagggtcgttgatgtctatattcgtactcttcgcaaaaaattagctttagattgtatcgtgactgtgaaaaatgttgggtataagattagcttatga

SEQ ID NO: 1323 - DNA (genomic), 675 bp, Streptococcus pneumoniae; double-stranded, circular
  misc_feature (B) LOCATION 1...675
  hypothetical: NO
  anti-sense: NO
aatgatggagaagaagcctatcgtgcagtgttagaagccttgaaggctggttatcgtcatattgatacggcggcgatttatcagaatgaagaaagtgttggtcaagcaatcaaagatagcggagttccacgtgaagaaatgttcgtaactaccaagctttggaatagtcagcaaacctatgagcaaactcgtcaagctttggaaaaatctatagaaaaactgggcttggattatttggatttgtatttgattcattggccgaacccaaaaccgctcagagaaaatgacgcatggaaaactcgcaatgcggaagtttggagagcgatggaagacctctatcaagaagggaaaatccgtgctatcggcgttagcaattttcttccccatcatttggatgccttgcttgaaactgcaactatcgttcctgcggtcaatcaagttcgcttggcgccaggtgtgtatcaagatcaattcgtagcttactgtcgtgaaaagggaattttattggaagcttgggggccttttggtcagggagaactatttgatagcaagcaagtgcaagaaatcgcagcaaatcacggaaaatcgattgctcagatagccttggcctggagcttggcagaagggatttttaccacttccaaaatctgtcacaacctctcgtattcaagctaa

SEQ ID NO: 1324 - DNA (genomic), 213 bp, Streptococcus pneumoniae; double-stranded, circular
  misc_feature (B) LOCATION 1...213
  hypothetical: NO
  anti-sense: NO
actaaaggagacaatcatatgtcacttgaaaacaaattggaacaagcaacaggcgctgtcaaagaaggttttggtaaagttactggagacagcaagacagaacttgaaggagctgttgaaaaaacagttgctaaggcaaaagacgttgtagaagacgcaaaaggtgctgtagaaggtgccgttgaaggtttgaaaaacgtttttactaaataa

SEQ ID NO: 1325 - DNA (genomic), 642 bp, Streptococcus pneumoniae; double-stranded, circular
  misc_feature (B) LOCATION 1...642
  hypothetical: NO
  anti-sense: NO
ctaaaaggagacacaatggcagaccgaggcttactaatcgttttttctggtccttcaggggttggaaaaggaacggttagaagagagatttttgagagttctgaaaaccaatttcaatattctgtatcgatgacgacacgcgcacaacgtcctggagaagtggacggtgttgactatttcttccgtactcgtgaagaatttgaagagctgattcgtcaaggacagatgttggaatacgcagaatatgtcggcaactactatggaactcctctgacctatgtcaatgaaaccttggacaagggaatcgatgttttccttgaaattgaagttcagggtgctcttcaggtcaagaaaaaggttccagatgctgtctttatcttcctgacaccaccagatttggatgaattgcaagatcgcttggtaggtcgtggaacagatagtgcagaagtgattgtccaacgaatcgaaaaggccaaggaagaaattgccctcatgcgtgagtatgattatgcgattgtcaacgatcaggtgcccctagctgctgaacgtgtcaaatgtgtgattgaagcagaacacttctgtgtggatcgtgtcattggtcactatcaggagatgttaccaaaatctccaactacccgataa

SEQ ID NO: 1326 - DNA (genomic), 210 bp, Streptococcus pneumoniae; double-stranded, circular
  misc_feature (B) LOCATION 1...210
  hypothetical: NO
  anti-sense: NO
agaaaaggagaaagaaaaacgatggaatatatttacctggtaacaatcgtaggaattggactatggtcgctagtaaataaactagatgaccacgctgaaatgaaacaaaaagagcgccagctgatggcaaacaatgtcgcacggatgaatctgagaaattcagataagcaatttacttatgatgtagaaccgcctgaagggttgaaataa

SEQ ID NO: 1327 - DNA (genomic), 252 bp, Streptococcus pneumoniae; double-stranded, circular
  misc_feature (B) LOCATION 1...252
  hypothetical: NO
  anti-sense: NO
aagaaaggagaatcaagatatattatggcgatattagatgatttacaagcgttatatgataatggatgggacgcttcttttaattataatggtcaagtatgtggcattttccctaattctatttatgatgttgttgttattattgcggacgacgaatatagagcatcttcttttgacgatttgatttctttacagattgaagggaaaactttaccggaaatcatgaacgaagttgaagtacaatatggctaa

SEQ ID NO: 1328 - DNA (genomic), 573 bp, Streptococcus pneumoniae; double-stranded, circular
  misc_feature (B) LOCATION 1...573
  hypothetical: NO
  anti-sense: NO
aaagaaggagaattttcgaatatgaaatcaataactaaaaagattaaagcaactcttgcaggagttgctgccttgtttgcagtatttgctccatcatttgtatctgctcaagaatcatcaacttacactgttaaagaaggtgatacactttcagaaatcgctgaaactcacaacacaacagttgaaaaattggcagaaaacaaccacattgataacattcatttgatttatgttgatcaagagttggttatcgatggccctgtagcgcctgttgcaacaccagcgccagctacttatgcggcaccagccgctcaagatgaaactgtttcagctccagtggcagaaactccagtagtaagtgaaacagttgtttcaactgtaagcggatctgaagcagaagccaaagaatggatcgctcaaaaagaatcaggtggtagctatacagctacaaatggacgttatatcggacgttaccaattaacagattcatacctgaacggtgactactcagctgaaaaccaagaacgtgtagcagagccaaacggccaccagctcgaaaagtatcatgggggg

SEQ ID NO: 1329 - DNA (genomic), 267 bp, Streptococcus pneumoniae; double-stranded, circular
  misc_feature (B) LOCATION 1...267
  hypothetical: NO
  anti-sense: NO
atgatgggagatgggatgaaagaatttcaatttgagagaaagcagcgtttttctttgaggccatatgcaataggagcttgttcggtcttgctaggaacgagtttattttttgctggtatgggtgctcagcctgtacaggatacagaaacgagttcagcactaatttcaagtcattatttggatgagcaggatttatctgaaaagctgaaatctgagttgcaatggcttgaattagaaaacaagcttttgaacttatgggagcattag

SEQ ID NO: 1330 - DNA (genomic), 1086 bp, Streptococcus pneumoniae; double-stranded, circular
  misc_feature (B) LOCATION 1...1086
  hypothetical: NO
  anti-sense: NO
agaaagggagactctcctatgaaaatcagaatcgatattcctcatcatccttatgatattcagattgaaaaaggttgtatggcccaggctggtcagtggttgcgagaactctggcaaccgcaaaaggtagtcattgtgacagataaccatgtagcctctctctatgcagagaaggtcaagctcagcctagaagatgctggttttcaggtagctgtttttgatttcttagaaggtgaagaaagaaagaatttaactactgttcagaaagtctatgaatttctagtcaagcaaggtctgactcgtagcgatggaatcgttgctcttggtggtggcgttgttggggacctggctggctttgtagcctctacctatatgcggggtattcactttgttcagattccgactagtttgacagctcaggttgattcttctatcggtggaaagacaggcgttaacacaccatttgctaaaaatatggtggggacctttgcccaaccagatggggttctgattgatccacttgttcttgaaaccctcggaaaaagagagttgattgaagggatgggtgaagttatcaagtatggcttgattgaggatccagaactgtgggctctcttgacgggactgaatggttctgttgagagtattttggaacatgcagagaccttgattgaacattcttgtcaggtgaagcgcaagatggtggttgaagatgagttggacaatggtattcgtctttacctcaattttggccacactattggccatgccatcgaagcgactgccggttatggcaaggtcatgcatggagaggctgttgccatgggaatggtacagatttccaaggttgctgaggaaaaaggcctcatgccagctggcattacccaatctatcacagagatgtgtcagaaattcggcttgcctgttgactatgaaaattgggaagttgacaagctttatcaggctcttactcatgacaagaaaacgcgtggtaacaccttgaaattggtcttggtgtcagagcttggttcagcgatcattcacccagtttctctggaagagatgaaagactacttggtaaaataa

SEQ ID NO: 1331 - DNA (genomic), 276 bp, Streptococcus pneumoniae; double-stranded, circular
  misc_feature (B) LOCATION 1...276
  hypothetical: NO
  anti-sense: NO
agagagggagagatagataaaaagtccacccccattttttatggagaattcaaaaatgtaaggttaagcaaagaagaatataaaaatctaaaagaaaaattaaactcacacacagatataatgataaataaactatccagatacatggaaagcagtggtaagacctatcaaaaccactatgtgacaatcttaaaatggtatgaagaagataaagacaaactaagacagaaaggtttaaataaaaaaatgaattatgatgtaggagaatctttatag

SEQ ID NO: 1332 - DNA (genomic), 201 bp, Streptococcus pneumoniae; double-stranded, circular
  misc_feature (B) LOCATION 1...201
  hypothetical: NO
  anti-sense: NO
atctacttggaatttgcatcctcttctcctttttacgaggctaccctgcctctactcttctttttctattattataccctttttagttgtaatgtcaatcgttaccacttttcaaccagtcgtctaactcccggtcgcagccctctttctgagccaattctctcaaaaattcctgatgatgagtatggtggatcccattga

SEQ ID NO: 1333 - DNA (genomic), 1386 bp, Streptococcus pneumoniae; double-stranded, circular
  misc_feature (B) LOCATION 1...1386
  hypothetical: NO
  anti-sense: NO
atgggtctggaactacgagcgattcagtccccaatcttctctgagccgtttgattttacttttcatgcgcaagcctttaccttgttagttgggagcagtggttcaggaaaatccagcctttttcaagtcattgcccaagtcagttctcttccctatagtggtcaagtcctgatagatgggagcgaggtcagtcagctttctatcatcgcacgtgtccagaaggttggcattctctttcaaaatcccaatcatcaatttaccatggagaacttgtttgaggagctgattttcaccttggagaatatcggctatcaccttcaggaaattgattctaaaatagcagaggttgtccagcaatgtcgttgcgaggcaatcttacaccgtcccattcatcacctatcaggtggggaaaagcaaaaagcagcgctggctgtcctctttgccatgaatcctagggtctatctcttggatgagcccttcgcttctattgaccgcaagagcagaatcgagatattggagattctaaaagagttggctcttgatgggaagacagttattttgtgcgaccatgatttatctgactataaagcctatatcgaccatatggttgagctaagagacggaaaactaagggaagtgtttcaaatcccttcctatgagatgacacaggttgcttcaaaggaagttgcttctagcccggaactattccatatgaaccgtgtgactggtgagcttggtaatcgccccctcttttcaattgctgatttcacattctatcaagggatttcctgtatcctgggtgacaatggtgtcgggaaatcaaccctctttcgctctattcttcaatttcaaaagtataaggggcgcattgcatggaaggggacagtcctgaaaaagaaaaagagtttgtaccgtgatctgacgggtgttgttcaggaagctgagaagcagtttatccgagtcagtctgcgagaggagcttcgattagatggacctgattctgaaagaaatcagcggatttttcaagctttacgatattttgatttggagcaggcagtcgataagagtccctatcaattaagtggtggtcagcaaaaaattcttcagctcctgaccatcttgaccagtaaggcttccgtgatcttgctagatgaaccttttgcaggtttggatgatagagcctgccattatttttgcaagtggattgtggaggagaggaatcaaggaagaagttttctgctcattagtcatcgtttagaccctttgatttctgtggttgattattggattgagatgactagtcaggggctcagtcatgtgaaagaagtgaccattaccaaaccacttacatctcagagtagcaatacccaaggggaggtgagatag

SEQ ID NO: 1334 - DNA (genomic), 213 bp, Streptococcus pneumoniae; double-stranded, circular
  misc_feature (B) LOCATION 1...213
  hypothetical: NO
  anti-sense: NO
tcgttgctggacgagatggagttcagatttcaacttcaaaaaaaggaaaatagaagggggcataagatgtctaaatttaatcgtattcatttggtggtactggattctgtaggaatcggtgcagcaccagatgctaataactttgtcaatgcaggggttccagatggagcttctgacacactgggacacatttcaaaaacagttggtttttga

SEQ ID NO: 1335 - DNA (genomic), 201 bp, Streptococcus pneumoniae; double-stranded, circular
  misc_feature (B) LOCATION 1...201
  hypothetical: NO
  anti-sense: NO
accattatggatacagttagcaaaaaaagactaaagaaaacagatgtaatagctatggcaggacttacaacaaatgttatggcacaaatgggaaaggataaaccaattacatttaagaatttagaaagaatatgtaaggctttatcttgcactcctaatgatattattagttttgaagataattttagtgacgaggaatag

SEQ ID NO: 1336 - DNA (genomic), 972 bp, Streptococcus pneumoniae; double-stranded, circular
  misc_feature (B) LOCATION 1...972
  hypothetical: NO
  anti-sense: NO
gaaattatggaatcaaaagttacaattatcatgcaagaaatgttacctcttttaaataatgaacaattactagcgttgagagagagtttagaacatcatctagtagacggaaaaaagcagcagaagtattcgaataataacctgttgcaactatttattaccgccaagcaggtagagggctgtagctcaaaaacaattcgttattaccagaggacgattgaaaacttgtttaatgctattaaagagtctgtgacacaactcacaacagatgatttaaggagttatttagcaaattaccagtctgaaaaggattgtagtaaggcaaatttagacaatattaggcgtatattgtcttctttttttgcttggcttgagcaagaggaatatatcattaaaaatcccattcgacggataaagaaaattaagactgagcaaaatgtgaaggaaacttatactgatgaacatttggaaattatgcgtgataactgtgaaaatttgagagatttggcaataatagacctactagcatcgacaggtatgcgtgtaggggagcttgtacagttgaatcgttcagatattgattttgaaaacagagagtgtgttgtctttggtaaaggaaagaaggagagaccagtatattttgatgctcggacgaaaattcatttaagaaattatcttaacgacagaaaagatagtcaccctgctctttttgtaacgctagttggaaaagcccagagacttggaattgctggtgtagagattcgcttaagaaagttaggagacaaactcggcatacaaaaggttcacccacataagttcagaagaactttagcgactaaggcaattgataaaggtatgcctatcgaacaagtccaaaaactgctaggtcatagcaagattgacacaaccctggcctatgccatggtcaatcaaaataatgtcaagcattcacaccaaaaattcatctcttaa

SEQ ID NO: 1337 - DNA (genomic), 402 bp, Streptococcus pneumoniae; double-stranded, circular
  misc_feature (B) LOCATION 1...402
  hypothetical: NO
  anti-sense: NO
cagcctatggactcacaagacaataaacgaaaatggaaaaatcgtgacctgatatccagtttagaatttgccatcacaggaatttttactgctatcaaggaagaacgcaatatgcgaaaacatgcagtgacggctctagtggtcatccttgcaggttttggttttcaggtgtcacgaatcgaatggctctttctcctgttgagcattttcttggtggtagcctttgaaattatcaattctgctatcgaaaatgtggtggatttggccagtcactatcacttttccatgctggctaaaaatgccaaggatatggcggctggcgcggtatttgtggtttctctttttgcagccttaacaggcgcattgatttttctcccacgaatctgggatttattattttaa

SEQ ID NO: 1338 - DNA (genomic), 999 bp, Streptococcus pneumoniae; double-stranded, circular
  misc_feature (B) LOCATION 1...999
  hypothetical: NO
  anti-sense: NO
gttgtcatggacttccttctcatgggagcactcttcatcgttcttccccgaactatggtctctgctaagcggattaatcaagttttagatttgcattcttctatccaaaaccctgctcaagtgcagctgactgatgaaaacttcaaaggtcaggtcgagtttaaggatgtgaccttccgctatgcggcaaattcggaggcagttattgaacatgttagctttaaagcagaaactggtcaaacagtggcctttattgggtcaataggttctggtaaatcaactctggtcaatctgattccacgtttctacgacgtgtcagcaggagaaattctggtggacggtgtcaatgttcaagactatgacttctctgcgacagctcatgctggtcaaagggttgccattgttgggccgactggggctggtaagacaaccattgtcaatcttttgatgaaattctatgagattgataagggaagtattcgcattgatggtgtggataccaaggctatgacgcgttcagaagtgcatgatgccttttcaatggtcttgcaggatacctggctctttgaaggaactattcgagacaatctcatctataatcaaatagggattagtgatgaacgaatgatggaagctagtaaggctgtgggaattcaccactttattatgaccttgccagatggctatgataccatcttggatgacaccgtgaccttgtctgtaggacaaaaacaactattgactattgcttgtgcccttcttaaggatgcatcgcttttgattttggatgaggcgacttcttctgttgacacacggacagaggaattgatccaaaaagccatggaccgtttgatggaaggacgcacatcctttgtcattgcccaccgcttgtcaatcatccgaaatgcagacttgatcttggtcatgaaagatggaaatatcatcgagcaaggcaactatgaggaactgatggcgtcttcaccacgaggttccggccaa

SEQ ID NO: 1339 - DNA (genomic), 3732 bp, Streptococcus pneumoniae; double-stranded, circular
  misc_feature (B) LOCATION 1...3732
  hypothetical: NO
  anti-sense: NO
gaattgatggataaacgtatttttgttgaaaaaaaggctgattttcaggtcaagtcagagagtttggttagagagctccagcacaacttgggactgtcaagcttgaaaagtattcgtattgtgcaagtatatgatgtatttgacttggctgaggacttgtttgcacctgcagagaagcacattttctctgagcagggaaccgaccatgttttagatgaagtatctgtgcaggcggatcttgctaactatgctttctttgccattgaaagtctgccagggcagtttgaccagcgtgcagcttcgtcacaggaagccttgcttttgttgggaagttcgagtgacgtgacagtcaacacagcccaactttacttggtgaataaagatattgatgcgactgagttggaagctgtcaaaaactacctgctcaatccagttgattctcgtttcaaggatatcacgacagggattgccaagcaggagttttcagagtcagacaagaccattccaaaattgactttctttgaaagctatacagcagaagactttgctcgctacaaggccgagcaagggatggccatggaagtggatgatttgctctttatccaagactactttaagtcaatcgggcgcgtgccaactgagactgaactcaaggttttggacacttactggtctgaccactgccgtcatacgacttttgagacagagttgaaacacatcgacttttcagcttctaaatttcaaaagcaattgcagtcaacctatgacaagtatattgccatgcgcgaggagttaggtcggtctgaaaaaccacaaaccttgatggatatggcgactattttcggtcgttatgagcgtgctaacggacgattggatgatatggaagtctctgacgaaatcaatgcctgctcagttgaaattgaagtggatgttgatggtgtcaaggaaccttggctcctcatgtttaaaaatgaaacccacaaccatccaacagaaattgagccatttggtggagcggctacctgtatcggtggagctattcgtgatccgttgtcaggccgttcctatgtttaccaagccatgcgtatttcaggtgctggtgatattacagcaccgatttcggaaactcgtgctgggaaattgccacaacaagtcatttctaaaacagcagctcatggttattcttcatatggtaaccagattgggcttgccacaacctacgttcgtgaatacttccacccaggctttgtagctaaacgtatggaacttggtgccgttgttggtgcggctcccaagggcaatgttgtccgtgaaaaacctgaagcaggtgatgtgatcatccttctcggaggcaaaacaggtcgtgatggtgtcggtggtgcgacgggctcttctaaggttcaaacagttgagtctgtagagactgctggtgctgaggttcaaaaaggaaatgccatcgaagaacgcaagattcagcgcctcttccgtaatggcaatgtcactcgtctgatcaagaagtccaatgactttggggcaggcggcgtctgtgtggctatcggtgaattggcagacggtcttgaaatcgacctcaacaaggtgcctcttaaataccagggcttgaatggtacagaaattgccatctctgaatcacaagaacggatggcggtcgtggttcgtcctgaagatgtggatgccttcgttgccgaatgtaacaaagaaaatattgatgctgttgtggtggcgacagtaactgaaaaaccaaatcttgtcatgcactggaatggtgagacaatcgttgacttggagcgtcgtttccttgacaccaatggtgtgcgcgtggttgtcgatgccaaagttgtggacaaggatgtcaaactcccagaagagcgtcaaacatctgctgaaacactggaatcagatacccttacggttctatctgacctcaaccatgcaagtcaaaaaggattacagactgtctttgactgctctgttggacgctcaacggttaatcacccacttggtggtcgttaccaactcacaccaactgaggcatctgtgcagaaattgccagttcaacacggtgtgactcatactgcgtcggtcattgctcaaggtttcaacccatatgtagctgaatggtctccataccacggtgctgcttacgcggttatcgaagcaactgctcgtttggtggctgctggtgccaactggtctaaggctcgtttctcttaccaagaatatttcgagcggatggacaagcaagcagagcgttttggtcagccagtagccgcccttctaggctctattgaagctcagattcaacttggcttgccatctatcggtggtaaggactccatgtctggtacctttgaagaattgactgttccgccaaccttggttgcctttggggtgacgacggcagatagccgtaaggtgctctctccagaatttaaagctgttggggaaaatatctactacatcccaggtcaagccctctctgcagagattgattttgacttgattaagaaaaattttgctcagtttgaagcaagccaagctgaccataaagtgacatctgcatcagctgtcaaatacggtggtgtagttgaaagtttggctcttgctacctttggaaactatattggtgcagaggtgaccttgcctgaacttaaaacagctttgacagctcaattaggcggctttgtcttcacatctcctgaagaaattgctggagtagagaagattggacaaacgaaagcagactttacactgactgtcaacggtgtgaagctagatggacacaagcttgacagtgcatttcaagggacattggaagaagtttacccaacagaatttacccaagcgaaagaactagaagaagtaccagctgtggcatcagatgttgtgattaaagccaaagaaaaggttgaaaaacctgtggtttacatcccagtctttccaggaaccaactcagaatatgattcagctaaggccttcgaaaaagaaggtgcagaggtcaatttggtgccattcgtgaccttgaatgaagaagctattgtcaagtcagttgaaactatggttgacaatatcgacaagactaatattctcttctttgccggtggattctcggctgcggatgaaccagatggttcagctaagtttatcgtcaatatcctgcttaatgaaaaagtgcgtgtggctattgatagctttatcgcccgtggtggcttgattatcggtatttgtaatggattccaagccttagtcaaatcgggtctcctaccatacggaaactttgaagatgctaacagtactagtccaaccctcttctacaatgatgccaaccaacacgtggccaagatggtggaaactcgcattgccaataccaactcaccatggttggctggtgtgcaagtgggcgatatccacgctattcctgtttcgcacggtgaagggaagtttgtcgtgacggctgaggaatttgcagagctccgtgacaatggacaaattttcagccaatacgttgactttaacggtaaaccaagtatggattctaagtacaatccgaatggttctgtccatgccatcgaaggaattaccagcaagaatggtcaaatcatcggtaagatgggccactcagaacgttatgaggatggtcttttccaaaatatcccaggcaataaagaccaacacctgttcgcatcagcggttaaacatttcactggaaaataa

SEQ ID NO: 1340 - DNA (genomic), 1248 bp, Streptococcus pneumoniae; double-stranded, circular
  misc_feature (B) LOCATION 1...1248
  hypothetical: NO
  anti-sense: NO
gagatgatggagttttttcaacagcttcctcatttagagccatatggcaatcctcagtattttgtttatgtgattgctgcaaccttgcccatctttataggcctctttttcaagaaacgctttgcctggtatgaagtgttggtaagtctcttctttattgtcaccatgttggtgggtggaaagaccaatcaactagctgccttgggtatttacctttgctgggaaatattgctcctgcttttctacaagcattatcgaaaaagcaaggatggcaagtgggtcttctacttagttagttttctgtccctacttccgattatctttgtcaaggtgcaaccagctatcaatggaacgcagtctttgcttgggttcttgggaatttcttacctgacctttcgttctgttgggattatcatcgagctgagagatggagtgattaaggattttaccctctgggaattcctccgtttccttctcttcatgccaactttctcgagtggtccaatcgatcgctttaagcgatttaatgaaaattatcaggccattcctgagcgagatgagttgatggatatgctggatgaatctgtccgctatatcatgcggggctttttgtataagtttatcctagctcatgttttaggagagaccttactccctcctctgaagaatttagccttgcagtcaggtggcttctttaatctctatgccttggcagttatgtatacttttggtctggagctcttctttgactttgcaggttattctatgtttgctttggccatctcaaacttgatgggaatccgtagccctatcaactttaacaagccctttttatcaagggatttaaaggagttttggaatcgctggcatatgagtctgtctttctggttccgtgactttgtctttatgcgaatggtgatggtgttaaccagaaagaaagtctttaaaaatcgtaatgtaacctcaagcatggcctacattgtaaatatgctgattatgggattttggcatggcgtgacctggtactatatcgcctatggactctttcatggactaggcttggtcatcaatgatgcctgggttcgcaagaaaaaaacgctcaataagaaacggaaaaaagcagggaaggctgccctacctgagaatcgctggattcagtttcttggcatggttgtcactttccatgttgtcatgttgtcattcttaatcttttctggattcttgaataatctatggtttaaaaaataa

SEQ ID NO: 1341 - DNA (genomic), 579 bp, Streptococcus pneumoniae; double-stranded, circular
  misc_feature (B) LOCATION 1...579
  hypothetical: NO
  anti-sense: NO
ttgcagatggagatgcggctgatggcgttcgaactggtggatttggatcgacagggcactagaatgaagattatctttgtacgtcatggggagccagattaccgtgagttagaggagcgttcttatataggatttgggatagatttggcacccttgtctgagatgggacggcagcaagtccagaaattgagcaaaaatcctttactctcgtcagctgaaataatcgtatcttctgcagtcacaagagctttagaaacggcttcgtatgtggtctgtgctacgggttttcctttaagagtagagcctttattacatgaatggcaggtctataaaacaggaatagaaaactttgaaacagctagaagactgtttttagaaaacaagggggagttgcttcctaatagtcctattcaatatgagacagctacggaaatgaagtctcggtttctagaatgtatgtctaagtatcgagaacatcagactgtggtagttgttgctcatcgaatgctcatgcgccagtttgtgccaaatgagaagattgatttttgccaagtgattgagtgtgagttagagatatag

SEQ ID NO: 1342 - DNA (genomic), 1347 bp, Streptococcus pneumoniae; double-stranded, circular
  misc_feature (B) LOCATION 1...1347
  hypothetical: NO
  anti-sense: NO
gtggagatggaaaagtatttatcggtaacaactttgaccaagtatctgaaaatgaaattcgataaagacccatacttggaacgggtctatttaactggtcaagtttccaactttcgtaaacgacctactcaccaatatttctccctaaaggatgaccatgcagttattcaagcgaccatctggtctgggatttatcagaaattagggtttgacctggaagaaggaatgaagatcaatgtgattgggcgtgtacaggtctatgaaccaagtggtagctactccatcatcattgaaaaagctgagcctgatggggttggggcgcttgcgattcagtttgaacaacttaagaaaaaattgacagaagaaggcctgtttcaagaacgcttcaagcaagctctaccccaattttctaagagaattggggtagtaaccagccgtagtggagccgttattcgagatattatcacgaccgtcagcaggcgattcccaggtgttgacatccttctttatccgaccaaggttcaaggtgaaggggctgcggaggaaattgctagaaatattgcgcgtgctaatcaatgggacgatttggatttgctcattattggtcgtggaggtggttctattgaggatctctgggcctttaacgaagaaattgtggtacgagctatttttgaatctcgtttgccagttatctctagtgtggggcatgagacggatgtgaccttggcagattttgtggcagatcgacgcgctgcaacgccaacagcggcggctgaactggcaacacctgtgaccaagttggatgtattagctcatttgcaaaatcaggaaaaacggatggtaacggcagtccgaaatgttctatctaagaaacaagaggctttgaaaaaatgcagtcagtctgttatctttagacaacctgagcgcttgtatgacggttatttgcaacgcttggaccaactgcaactgcgtttgaaacaaagtttgcgaactcggatttctgataacaaacaattagttcaagcaagaactcatcaattagtacaattatcacctgttaccaaaatccaacgctatcaagaccgtttaggacagttggacaagctcttaggtagccaagtggcgttagtttatgacgccaaggttgctgaggtcaagcgactttcggaagctttgctcatgttggatactagccgaatcgtggcgcgtggttatgctattgtcaaaaaagaagagtccgttgtagattcggttgagagtttgaagagaaaagaccaagtaacgcttttgatgcgagatggtcaagtagaattagaggttaaagatgtcaaaacaaaagaaatttga

SEQ ID NO: 1343 - DNA (genomic), 1092 bp, Streptococcus pneumoniae; double-stranded, circular
  misc_feature (B) LOCATION 1...1092
  hypothetical: NO
  anti-sense: NO
tggctggtggaaacttgggaaaggagaagagtgatgtctaaaaaattacaacaaatttcggttcccttgatttctgtattcctaggaattttactcggagccattgtcatgtggatcttcggttatgatgctatttggggctacgaagaattgttctatacagcctttggcagtctgcgtgggattggagaaatcttccgtgctatgggtcctctggtcttgattggtcttggttttgcggttgccagtcgagctggtttctttaacgtcggacttcctggtcaggctttggcaggttggattctcagtggttggtttgccctgtcgcatccagatatgccccgtcccttgatgattctagcaaccatcgtgattgccttgattgctggtgggattgtcggagcgattccaggtattcttagggcctatctagggacgtcagaggttattgtaaccatcatgatgaactacattgtcttgtatgtagggaatgcctttatccatgctttccctaaagacttcatgcaaagtacagattcgaccattcgtgttggggctaatgcaacctatcagacaccttggttggctgagttgactggtaactcacggatgaatattggtattttctttgccatcattgccgttgcagttatttggttcatgctcaagaaaacaactcttggttttgaaatccgtgcagttggtcttaatccacatgcttcagaatatgctggtatttctgccaagcggactattatcctatctatgattatttcaggtgccttggcaggtcttggtggatctgttgaaggtttgggaaccttccagaacgtctatgttcaaggttcgtcattagctatcggatttaacggaatggcggttagtttgcttgcggccaactcaccaattggtatactctttgcagccttcctatttggcgttctccaagttggggctcctggtatgaatgcggcgcaggtaccatctgagcttgtcagcattgtaacagcgtctattatcttctttgtcagtgttcattaccttatcgaacgctttgtcaaaccgaaaaaacaagttaaaggaggtaagtaa

SEQ ID NO: 1344 - DNA (genomic), 390 bp, Streptococcus pneumoniae; double-stranded, circular
  misc_feature (B) LOCATION 1...390
  hypothetical: NO
  anti-sense: NO
atgaaggtggaaccacgttgcgacgtcctttcgaggatgtcgcatttttttattaggatactaattatggagttgcaagaattagtggagcgcagttgggcaatccgacaagcttatcacgaactggaagttaagcatcatgattccaagtggacggtagaagaagacctcttggctttatctaatgatattggaaatttccaacgactggtgatgacaaagcaaggacgctactatgatgaaacaccctacacactggaacaaaaactttcagaaaatatctggtggctattagaactttctcaacgtttggatatagacattctgacggaaatggaaaacttcctctctgataaagaaaagcaattgaacgttaggacttggaagtag

SEQ ID NO: 1345 - DNA (genomic), 249 bp, Streptococcus pneumoniae; double-stranded, circular
  misc_feature (B) LOCATION 1...249
  hypothetical: NO
  anti-sense: NO
ctttctagtttgttctttgattttcattgtgtatttaaacacaaaaacaccctaaaacatcagggtgccattcttacatcaaatataaaattgctagggtcaggagacttgctagaagcccaactccccaaaagaagaagtcaaccttccactcgctccaaggatttcctttaccagacaatcccccaagctcaaaatggtgatgtacaggcgtcatacggaaaatacgtttaccacctgtcagtttga

SEQ ID NO: 1346 - DNA (genomic), 324 bp, Streptococcus pneumoniae; double-stranded, circular
  misc_feature (B) LOCATION 1...324
  hypothetical: NO
  anti-sense: NO
gattctagttttgcaggaagtctactattttccttattgtctgtaagtctactgaccttgttgtttatcccagtcatggtttctagttcgggctcagagtttcaaagtggatggcaagagcatcaattgattgctgagaaggttagtaaaacacttgacaagacatttgataaggatgtcagagaaattccgaccagtcagttttatcaaaaatttgtagatcagatgggaaggacttactcaggaaatttgatcctccaggagctgataactgtgaatggagcttataaagctacttatatcggtgaactctctagcaactaa

SEQ ID NO: 1347 - DNA (genomic), 519 bp, Streptococcus pneumoniae; double-stranded, circular
  misc_feature (B) LOCATION 1...519
  hypothetical: NO
  anti-sense: NO
gcatcaacggagttgagattcaggtattttctagtgaaaaaggattggaggtctaccatggttcagaacagttgttggcaatcaaagagccataaggtcaaggcttttaccttgttagaatccctgcttgccctcattgtcatcagtgggggattactcctttttcaagctatgagtcagctcctcatttcagaagttcgctaccagcaacaaagcgagcaaaaggagtggctcttgtttgtggaccaacttgaggcagaattagaccgttcgcagttcgaaaaagtagaaggcaatcgcctatacatgaagcaagatggcaaggacatcgccatcggtaagtcaaagtcagacgattttcgtaaaaccgatgctagtggacgggggtatcagcctatggtttatggcctcaaatcagctcagattacagaggacaatcaactggttcattttcgtttccagtttcaaaaaggcttagaaagggagttcatctatcgtgtggaaaaagaagaaagttaa

SEQ ID NO: 1348 - DNA (genomic), 744 bp, Streptococcus pneumoniae; double-stranded, circular
  misc_feature (B) LOCATION 1...744
  hypothetical: NO
  anti-sense: NO
aaagtgacggaggaatttatgaatgtaaatcagattgtacggattattcctactttaaaagctaataatagaaaattaaatgaaacattttatattgaaacccttggaatgaaggccttgttagaagaatcggcctttctgtcactaggtgaccaaacgggtcttgaaaagctggttttagaagaagctcccagtatgcgtactcgtaaggtagagggaagaaaaaaactagctagattgattgtcaaggtggaaaatcccttagaaattgaaggaatcttatctaaaacagattcgattcatcgattatataaaggtcaaaatggctacgcttttgaaattttctcaccagaagatgatttgattttgattcatgcggaagatgacatagcaagtctagtagaagtaggagaaaagcctgaatttcaaacagatttggcatcaatttctttaagtaaatttgagatttctatggaattacatctcccaactgatatcgaaagtttcttggaatcatctgaaattggggcatcccttgattttattccagctcaggggcaggatttgactgtggacaatacggttacctgggacttatctatgctcaagttcttggtcaatgaattagacatagcaagtcttcgccagaagtttgagtctactgaatattttattcctaagtctgaaaaattcttcctttgtaaagatagaaataatgttgaattgtggtttgaagaagtatga

SEQ ID NO: 1349 - DNA (genomic), 186 bp, Streptococcus pneumoniae; double-stranded, circular
  misc_feature (B) LOCATION 1...186
  hypothetical: NO
  anti-sense: NO
agtggtcaggaacttactcctgacctttttcttttgcaaaatgacaaaaatcataaactttttgacaactatacttgtcaaaaagaaaaagatgtgttacaatgtaagcaagttaagagaaaagaagaaaggagctatgatgtgggtactagggtttatactatttctgattttcttttattctaa

SEQ ID NO: 1350 - DNA (genomic), 879 bp, Streptococcus pneumoniae; double-stranded, circular
  misc_feature (B) LOCATION 1...879
  hypothetical: NO
  anti-sense: NO
acttaccaggaattaatttggagttctaatatgaaattagctgttttcacagattcctctgcttatctcagtgaagagaccttgcaaagagaagacttgtttgtcttggatattcctgtcaatattgatggtgaggaatatgtcgaaggcatcaatctgtctgctgaggaattttaccaaaaaatggctcaggcttctgaattgcctaagaccagtcaaccaagtattgccaagttagatgagatcttaacttcgctcaaagaacaaggctatacacatgccttggggcttttcctatcttctggaatttcaggtttttaccaaaatatccagtatatggtcgatgactatgagggcttaaccattgctttcccagacactttgattacaagtgctcccctaggcatcatggttgaaagcgtctttaattggcgtgatcagggcgatgattttgccagcattcaggataagctagccattcaaatcagccgtacgtcagcctttatcatggtagatgacttggatcatttggtaaaaggtggacgcctttcaaatggggctgccattttgggcaatttgcttagcattaagccaatcctttattttaacgatcaaggtgtgattgaagtttacgaaaaagttcgtactgaaaagaaggccaccaagcgcttaattgaaattatcaaggaaacaacggcttcaggtcaataccgggtcattgtcattcatgggaatgctcctgaaaaggctgaagaattgcgtcagcacttgcttgattttggcttgggttcggatgtttcacttgctacatttggtagtgtcattggaacgcacctaggagcaggaagtattgctctgggttatattccagtgatttag

SEQ ID NO: 1351 - DNA (genomic), 498 bp, Streptococcus pneumoniae; double-stranded, circular
  misc_feature (B) LOCATION 1...498
  hypothetical: NO
  anti-sense: NO
ctaatacaggaggttttttttatgggacagacaatcatatctgctattggtgtttatatttccaccagtatcgattatttaattattttaattattttatttgcacagctatcacagaataaacagaaatggcatatttatgcggggcaatatctaggcacaggcttacttgtaggggcgagtttagttgctgcttatgtcgttaatttcgtgcctgaagaatggatggttggattgcttggtttaatccctatctatttagggattcgctttgcaattgttggagaagatgcggaagaagaagaggaagaaattattgaaagattagaacaaagcaaggcaaatcaactgttttggacagttacattgctgacaattgcgtctggcggagataatttaggtatctatataccttattttgcttcgttagattggtcacagaccctcgtggccttgcttgtgtttgtaatcggcataattatcttttgcgagaattag

SEQ ID NO: 1352 - DNA (genomic), 327 bp, Streptococcus pneumoniae; double-stranded, circular
  misc_feature (B) LOCATION 1...327
  hypothetical: NO
  anti-sense: NO
agcaagcaggatctgctttaccctagaaaaggaaaagcgcttaagaaacaggccagcaccaactttaaacctgctggtcaatccatcgaacagcggcctgaagctatcaattttcgcttggagaatgggcattatgagattgatacggttctacttacgagagcgaaaaactactgcttgcttgtcttgacggatcgaaaaagtagacatcagatcatccgattgattccaaataaaagtgctgacgtggtcaatcaggctctaaaactcatcttaaaacagcccaagttctttccntcncatnngcagaagctatcatgccactaa

SEQ ID NO: 1353 - DNA (genomic), 252 bp, Streptococcus pneumoniae; double-stranded, circular
  misc_feature (B) LOCATION 1...252
  hypothetical: NO
  anti-sense: NO
ttttataaggaaattgactttattcaccgtaagtggccagatgttcagaagtatctggtttattttcaaaattttaccaacacccgtgaaaaggtggaagttattcgagagcgttatgaacaggctatcaatgagccaggtgtggtaggaatcaatattggaacgcgcccagactgtttaccagacgaaaccatcgaatatttggctgagttatcggagtgcatgcatgtgacggttgaattgggcttgtag

SEQ ID NO: 1354 - DNA (genomic), 204 bp, Streptococcus pneumoniae; double-stranded, circular
  misc_feature (B) LOCATION 1...204
  hypothetical: NO
  anti-sense: NO
gaaaataaggagcattgtgtgagtctcttcttgaaaaaaacacgaaattttggtaaaatgagtcttatgaaaacattctatgatgtgcagcaattccacaagagatttggtattaatgtttacatgggaaaacgcttatatgatattgaactgatgaagttggaactatctcggatttacaatgcgaggtggatggataaataa

SEQ ID NO: 1355 - DNA (genomic), 534 bp, Streptococcus pneumoniae; double-stranded, circular
  misc_feature (B) LOCATION 1...534
  hypothetical: NO
  anti-sense: NO
aaattaaaggagaaaaatttgatgagatacataactcttggtcaagatgacaaagaattatcagaaattgttctcggaatgatgagaataaaagataagtctgtaaaagaagttgaagagcttgtagaaacagcactttctgttggaatcaatgccttcgacttggctgatatttatggtcgtggtcgttgtgaagaactgttaggtcttgtcctaaaaaatcgtccagatttaagagaaaagatgtggattcagtccaaatgtggcattcgtattgaagaatttacctattttgattttcctaaggactatattataaaatcagtagacggtattttgcaaagattgaagattgatcatctagatagcttgctccttcatcgaccagatgctttgatggaatctgaccaagtagcagaagcctttgatctcctttataaacaaggtaaagttcgagattttggagtttctaatcaaaatcctatgatgatggagttacttaaaaaaagatgtcaagcagccgttagctgttaa

SEQ ID NO: 1356 - DNA (genomic), 708 bp, Streptococcus pneumoniae; double-stranded, circular
  misc_feature (B) LOCATION 1...708
  hypothetical: NO
  anti-sense: NO
agaataaaggagattcgtgtgaaagccattatcttagcagcgggattgggaactcgcttgcgtcctatgactgaaaatacccctaaagccttggttcaggttaatcaaaaacctttgattgaataccaaattgagtttctcaaagaaaaaggaatcaatgacatcatcatcattgttggttatcttaaagaacaattcgattacttaaaagaaaaatacggtgttcgcctcgttttcaatgataaatacgctgactacaataacttttactctctctatcttgtaaaagaagaattggccaacagctatgttattgatgcagataactatctctttaaaaatatgttccgcaatgatttgactcgttcgacttattttagtgtttatcgtgaagattgtaccaacgaatggttcttggtctatggagatgactacaaggttcaagacattattgttgatagcaaggcaggtcgcatccttagtggtgtatccttctgggatgctccaactgcagaaaagattgtcagctttatcgacaaggcttatgcaagtggcgaatttgttgatctctactgggacaatatggttaaggataatatcaaagagctagatgtctatgttgaagaattagaaggcaatagcatttatgagatcgatagtgtccaagactatcgtaaattagaagaaattcttaaaaacgaaaattaa

SEQ ID NO: 1357 - DNA (genomic), 1056 bp, Streptococcus pneumoniae; double-stranded, circular
  misc_feature (B) LOCATION 1...1056
  hypothetical: NO
  anti-sense: NO
tgtgtaaaggagaaggctatggcaaagaaaatagtagctctagtaggagacggaattggcccagaaatcatggaggctggtttagaagttctggaggctctagctgaaaaaacaggttttgactatgagattgacagacgaccgttcggaggtgcagatattgatgcagcaggacctcccttacctgatgaaacccttaaggcaagtagggaagcagatgctatcctactagcagctatcggtagtcctcagtatgatggagcagcggttcgccctgaacaaggcctgatggctctccgtaaggaactcaatctttacgctaatattcgtcctgtaaaaatctttgacagtctcaagtatttgtcaccactcaaaccggaacgaatttctggtgtagactttgtcgtggtgcgtgaattgacaggcgagatttactttggagatcatattcttgaagagcgcaaagcgcgtgatatcaacgactatagctatgaggaagtggagcggattattcgcaaagcctttgaaattgcaagaaatcgcagaaaaatcgttactagtatcgataagcaaaatgttctagcgacctcaaaactctggcggaaagtagctgaggaagtcgcacaggatttcccagatgtaaccttggaacaccagctggtagactcagctgctatgcttatgattaccaatcctgctaagtttgatgttattgtaacggagaatctttttggagatattttatctgatgaatcaagcgtcttatctggtacacttgaggttatgccatcagccagtcattctgaaaatggaccaagtctctatgaacctattcacggttcagcacctgatattgcaggtcaaggaattgccaatcctatttccatgattttattagttgtcatgatgttgagagatagtttcggacgttatgaggatacagagcgtatcaaacgtgctgttgagacaagtctggcggcaggaattttaacgagagatataggaggtcaggcttcaacaaaggaaatgatggaagctattattgcaaggttatga

SEQ ID NO: 1358 - DNA (genomic), 1383 bp, Streptococcus pneumoniae; double-stranded, circular
  misc_feature (B) LOCATION 1...1383
  hypothetical: NO
  anti-sense: NO
atagtaaaggaggagaaaggattgaaagaaaaacaattttggaatcgtatattagaatttgcacaagaaagactgactcgatccatgtatgatttctatgctattcaagctgaactcatcaaggtagaggaaaatgttgccactatatttctacctcgctctgaaatggaaatggtctgggaaaaacaactaaaagatattattgtagtagctggttttgaaatttatgacgctgaaataactccccactatattttcaccaaacctcaagatacgactagctcacaagttgaagaagctacaaatttaactctttataactatagtccaaagttagtatctattccttattcagatacgggattaaaagaaaagtatacctttgataactttattcaaggggatggaaatgtttgggctgtatcagccgctttagctgtctctgaagatttggctctgacctataaccctctttttatctatggaggaccaggccttggtaagactcacttattaaacgctattggaaatgaaattctaaaaaatattcctaatgcgcgtgttaaatatatccctgccgaaagctttattaatgactttcttgatcacctaagacttggggaaatggaaaagtttaaaaagacctatcgtagtcttgatcttttgttaatcgatgatatccagtcactcagcggaaaaaaagttgcaactcaggaagaatttttcaatacctttaacgcccttcatgacaagcaaaaacagattgtcctaacgagtgatcgtagtccaaaacatctagaagggctcgaggagaggcttgtcacgcgttttagttggggattgacacaaactatcacaccccctgactttgaaacacgtattgccattttacaaagtaaaacggaacatttaggctacaatttccaaagtgatactctagaatacctagctgggcaatttgattcaaatgttcgagatcttgagggagccatcaacgacatcactttaattgccagagtaaaaaaaatcaaggatatcactattgatattgctgcagaagccattagagcccgcaaacaagatgttagccaaatgctcgtcatcccaattgataaaatccaaactgaagttggtaacttttatggtgttagtatcaaagaaatgaagggaagtagacgccttcaaaatattgttttggcccgtcaagtagccatgtatttatctagagaactaacagataatagtcttccaaaaattgggaaggaatttgggggaaaagatcataccacagtcattcatgcccatgccaaaataaaatctttgattgatcaagacgataatttacgtttagaaattgaatcaatcaaaaagaaaatcaaataa

SEQ ID NO: 1359 - DNA (genomic), 756 bp, Streptococcus pneumoniae; double-stranded, circular
  misc_feature (B) LOCATION 1...756
  hypothetical: NO
  anti-sense: NO
gtggtaaaggagcagatcatgacctacacaatcttaatcgtagaggatgaatatctggtaagacaaggtttgactaaactggtcaatgtagcagcctacgatatggaaatcattggtcaggctgaaaatggaaggcaggcttgggaattgatccaaaagcaggtgccagatatcattttaaccgatatcaacatgcctcatctaaatggcatccagttggccagtctggtacgagaaacctatcctcaggttcatttggtctttttaacaggttacgatgattttgattatgccttgtctgctgtcaaactaggtgtggacgactacctgctcaaacccttttctcgtcaggatattgaggaaatgttggggaaaatcaaacaaaaactagacaaggaagagaaagaagagcagttacaagatttattgactaataggtttgaaggaaacatggcccagaaaatccagtctcatctggctgatagccaatttagtttaaagtctttagccagtgacttaggttttagtccgacctatctgagttccttgattaagaaagagttgggcttgccttttcaggattatctggtgagagaacgtgttaaacaagccaagctcttgcttttaactacagatctgaagatttatgagatcgcagagaaggttggttttgaagatatgaactattttacccaacgttttaagcagattgcaggtgtgacacctcgtcagtttaagaagggagaagaccgatga

SEQ ID NO: 1360 - DNA (genomic), 642 bp, Streptococcus pneumoniae; double-stranded, circular
  misc_feature (B) LOCATION 1...642
  hypothetical: NO
  anti-sense: NO
gagaaaaaggaaacaatgatttttacatataacaaagaacatgtcggtgatgtccttatggtcatcgtgaaaaatagcggagatgctaaactgaatgtggaacgcaaagacaaggtagcccgtgttttcctcaaagaaaatggggaaacagtagcttggaacatttttgaggtttcgagcttgtttgaaattgcagagcgcggtcaagtctttttatcagatgagcaagtcgctcgtttgaaccaagaattacaggcggaaggttttacagaagaaattgttaatgataaggaacctaagtttgttgttggtgaaattgtcgagatggtagctcatccagacagtgaccacctcaacatctgccaagttgcagtcgcaagtgacaagatagtgcaaatcgttgcaggagcacctaatgcgcgtgttgggttgaaaaccattgtggctcttcctggtgccatgatgccaaaagggaatttcattttcccaggcgaacttcgtggtgaaaagagttttgggatgatgtgtagtcctcgtgaattgcatttgccaaatgctccgcaaaaacgtggggtgcttgaattatcagaagaccaagttgtcggaacaccgttcgacccagcgaaacactggactgcctag

SEQ ID NO: 1361 - DNA (genomic), 486 bp, Streptococcus pneumoniae; double-stranded, circular
  misc_feature (B) LOCATION 1...486
  hypothetical: NO
  anti-sense: NO
ctaagaaaggagccaagcatggcaaagggcgagggaaaggtcgtcgcacaaaataaaaaggcacgccacgactatacaatcgtagatacgctagaggcagggatggtcctgactggaactgaaatcaagagtgtacgagctgctcgaattaatctcaaggatggctttgctcaagtgaaaaatggagaagtttggctgagcaatgttcatatcgcgccttacgaagagggcaatatctggaaccaggaaccagaacgtcgtcgtaaactcctgctccataaaaagcaaattcaaaaattggaacaagagaccaaagggacaggaatgaccttagttccccttaaggtctatataaaagatggctacgctaagcttcttttaggacttgccaaagggaagcatgactatgacaaacgggagtctatcaaacgtcgtgagcaaaatcgagatatcgcgcgtgtgatgaaagctgttaatcagcgataa

SEQ ID NO: 1362 - DNA (genomic), 2034 bp, Streptococcus pneumoniae; double-stranded, circular
  misc_feature (B) LOCATION 1...2034
  hypothetical: NO
  anti-sense: NO
aaaagaaaggagtggagcatgaatctacatcaacccttgcatgtcttgcctggtgtgggaccaaagtcagcagaaaaatacgccaaactaggaattgaaaacttgcaagatctcttgctctactttcctttccgttatgaagacttcaaaaccaagcaggtgctggagctggaagacggtgagaaggcagttctttctggtcaggtagtgactcctgctagtgtccagtattatggtttcaagcgcaatcgcctgcgttttagtctcaagcagggagaggtcgtttttgcggtgaatttctttaaccagccctatctggctgataaaatagagttgggagcaacccttgctgtctttggaaaatgggaccgcgctaaggctagtctgaatgggatgaaggttctggctcaggtagaagatgacctccagcctgtttatcgtctggctcagggaatcagtcaggccagtctggttaaggtcatcaagacggcttttgatcagggactggacctcttgatagaagaaaatctgccccagtctttactagacaaatacaaactcatgtcccgttgtcaggcagtccgagctatgcattttccaaaggatttggcagaatacaagcaggctcttcgccgtataaagtttgaggaactcttttatttccaaatgcagctgcagatgctcaaatctgaaaatagagttcagggaagtggtctggttctgaattggtctcaggaaaaagtgacagcagttaaagtaagtcttccttttgccctgacccaagctcaggaaaagagtttgcaggaaattttaactgatatgaagtccgaccaccacatgaatcgtctcctacaaggggatgtggggagtggaaaaacggtagtcgctggcttggccatgtttgcggcagtgacagcaggttatcaggctgccctaatggtaccaacagaaatcctcgcagagcaacactttgagagtttacagaacctttttcccaatttgaaactggctctcttgacaggttccttgaaagctgcagaaaagagagaggtcttggagaccattgccaagggtgaggctgatttgattatcggaactcacgctctgatacaagatggggtggagtatgctcgtcttggtttgattattatcgatgagcagcaccgttttggtgtagggcaaaggcgtattttacgggaaaaaggtgacaatccagatgtcctcatgatgacggcgactcccattccacggacgcttgccatcacagcctttggagatatggatgtttccattatcgaccagatgccagcaggtcggaagcctattgtgacgcgctggatcaaacatgagcaactacctcaggtcttgacttggttagagggggaaattcaaaaaggttcccaagcctatgtcatctctcctttgattgaagaatcagaagctctagatttgaaaaatgccattgccttatcagaggagttgacgactcattttgcaggcaaggcagaggtggctcttctacatggtaggatgaagagtgacgaaaaagaccagatcatgcaggatttcaaggagagaaagacggatattctggtttcgacgacggttattgaggttggggtcaacgttcccaatgcgactgtcatgattatcatggatgccgatcgcttcgggctcagccagcttcaccagcttagaggtcgtgtcggtcggggggacaagcagtcctacgctgttctcgttgccaatcccaagacggattctgggaaagaccgcatgcgcatcatgacagaaacgaccaatggatttgtccttgcggaggaagatttgaaaatgcgtggttctggtgagatttttggaaccagacagtcaggacttccagagttccaagtggctgatattatcgaagattttccgattttagaagaagcaagaaaggttgctagctacattagttctatagaaacttggcaagaagatccagagtggcgcatgattgcccttcatctggaaaagaaagaacatctggattaa

SEQ ID NO: 1363 - DNA (genomic), 681 bp, Streptococcus pneumoniae; double-stranded, circular
  misc_feature (B) LOCATION 1...681
  hypothetical: NO
  anti-sense: NO
ttgatgaaggaaatctttgatagacgttaccctgtgacgagtttcttcctcttagtgacgaccttggtatttttactaatgttggtcactacaggcggaaactttgacagggcagatacattatttcgatttggagccatgtatgggccagctattcgcctctttcccgagcaggtttggcgtctcttgtctgccatttttgttcatattgggtgggaacatttcattgttaatatgctttcactttattatcttggaaggcaggtagaggagattttcggttctaagcagtttttctttctctatcttttatcaggaatgatgggcaatctctttgtttttgtatttagtcctaaatccttagcagcaggcgcctctacctctctttatgggctatttgccgcgattattgttcttcgctatgcaactcgcaatccttatatccaacagctagggcaatcctatctgacactttttgtggttaacattattggaagtgttctgattccaggaatcagcctagcaggccatatcggtggtgcagttggtggcgcatttctagcagttatctttccagttagaggagaaaaacggatgtataacaccagccagagattaggagcggtagtcttgttcgtaggactcgccattttgcttttctacaagggaatgggaatgtga

SEQ ID NO: 1364 - DNA (genomic), 960 bp, Streptococcus pneumoniae; double-stranded, circular
  misc_feature (B) LOCATION 1...960
  hypothetical: NO
  anti-sense: NO
acgatgaaggaaaatttaaaagttaatattctatggttactccttttgttagctggctatagcttgattagtgtactggtttcagtcggagtacttaatctattctatgtacagattttacaacaaattggaattaatattattttggctgttggtctcaacttaatcgttggtttttcaggacaattttcacttggtcatgctggtttcatggcgattggtgcctatgcagcagctattattggttctaaatcaccaacctacggtgccttctttggagctatgcttgtaggggctttgctttcaggagcagttgccttacttgtcggcattccaaccttgcgcttgaagggggactatcttgcggtagcaactctaggtgtttctgaaattatccgtatctttatcatcaatggtggaagccttacaaatggtgcggcaggtatcttagggattcctaactttacaacttggcaaatggtttacttctttgtcgtgattacaaccattgcaaccttgaacttcttgcgtagcccaattggtcgttcaaccctctctgttcgtgaagatgaaatcgctgctgagtcagttggggttaatacgactaaaattaaaatcatcgcttttgtctttggtgccattactgcaagtattgctgggtcacttcaggcaggatttatcgggtctgttgtaccgaaagattacaccttcatcaactcaatcaacgttttgattattgttgtatttggtggactcggttccattacaggtgcgattgtttcggctattgttctgggaattttgaatatgcttctccaagatgttgctagtgtgcgtatgattatttacgctttggccttggtattggtaatgattttcagaccaggtggactccttggaacatgggaactgagcctatcacgtttctttaaaaaatctaagaaggaggaacaaaactaa

SEQ ID NO: 1365 - DNA (genomic), 1335 bp, Streptococcus pneumoniae; double-stranded, circular
  misc_feature (B) LOCATION 1...1335
  hypothetical: NO
  anti-sense: NO
aatgagaaggaaaaatgtcaaacttttatattgcaaataggagaaattatgacaaaaacattaaaacgtcctgaggttttatcacctgcagggactttagagaagctaaaggtagctgttcagtatggagcagatgctgtctttatcggtggtcaggcctatggtcttcgtagccgtgccggaaactttactttcgaacagatggaagaaggcgtgcagtttgcggccaagtatggtgccaaggtctatgtagcggctaatatggttatgcacgaaggaaatgaagctggtgctggtgagtggttccgtaaactgcgtgatatcgggattgcagcagttatcgtatctgacccagccttgattatgattgcagctactgaagcaccaggccttgaaatccacctttctacccaagccagtgccactaactatgaaacccttgagttctggaaagagctaggcttgactcgtgtcgttttagcgcgtgaggtttcaatggaagaattagctgaaatccgcaaacgtacagatgttgaaattgaagcctttgtccatggagctatgtgtatttcatactctggacgttgtactctttcaaaccacatgagtatgcgtgatgccaaccgtggtggatgttctcagtcatgccgttggaaatacgacctttacgatatgccatttgggaaagaacgtaagagtttgcagggtgagattccagaagaattttcaatgtcagccgttgacatgtctatgattgaccacattccagatatgattgaaaatggtgtggacagtctaaaaatcgaaggacgtatgaagtctattcactacgtatcaacagtaaccaactgctacaaggcggctgtggatgcctatcttgaaagtcctgaaaagtttgaagctatcaaacaagacttggtggacgagatgtggaaggttgcccaacgtgaattggcaacaggtttctactacggtataccatctgaaaatgagcagttgtttggtgctcgccgtaaaattcctgagtacaagtttgtcgctgaagtggtttcttatgatgatgcggtacaaacagcaactattcgtcaacgaaacgtcattaacgaaggggaccaagttgagttttatggtccaggtttccgtcattttgaaacctatattgaagatttgcatgatgccaaaggcaataaaatcgaccgcgctccaaatccaatggaactattgactattaaagtcccacaacccgttcaatcaggagacatggttcgtgcattaaaagaaggactcatcaatttttataaggaagatggaaccagcgtcacagttcgagcttaa

SEQ ID NO: 1366 - DNA (genomic), 462 bp, Streptococcus pneumoniae; double-stranded, circular
  misc_feature (B) LOCATION 1...462
  hypothetical: NO
  anti-sense: NO
gatggtgaggaaaagatgacaattcgttttgaagaaaaggtgagtatagaaaacgctcaatttgtatgccagtggtccaactccctaggcaaatcctttcaagaacaatggatgggaccaaggattccttttctactgacccttcaagccttggaaggagtcttttcaatctttgatgaacaagagtttgtgggacttatccagaaaatcaggctagaagacagcaatcttcatatcgggagattttttatcaacccccagaaacaggagcaagacttaggtagccaggctttaaggaaatttgttagtttggcctttgaaaatgaagatatagatagtatttctctaaatgttttcgaggcaaatcaaagagctcagaatctttaccaaaaagaaggatttgaaatcgttcaaatggttgaagcacctgtacgaaaatatagtagattgaaactagaatag

SEQ ID NO: 1367 - DNA (genomic), 1305 bp, Streptococcus pneumoniae; double-stranded, circular
  misc_feature (B) LOCATION 1...1305
  hypothetical: NO
  anti-sense: NO
aatttcgaggacataaagatgacagttaaaattgctttactgggatttggtaccgttgcaagtggtgtgcctttcctcctaaaggaaaatggaggaaaaatcaatcaatcagcacattcagatatcaaagttgctaaggtattggtcaaggatgaagatgaaaaaaatcgcttgcttgcagcagggaatgactttaactttgtaaccaatgtggatgatattttatcagaccaggatattactatcgtagtggaattgatggggcgtattgagcctgctaaaacctttatcactcgtgccttggaagctggaaaacacgttgttactgctaacaaggaccttttagctgtccatggcgcagaattgctagaaatcgctcaagctaacaaggtagcactttactacgaagcagcagttgctggtgggattccaattcttcgtactttagcaaattccttggcttctgataaaattacgcgcgtgcttggagtagtcaacggaacttccaacttcatggtgaccaagatggtggaagaaggctggtcttacgatgatgctcttgcggaagcacaacgtctaggatttgcagaaagcgatccgacgaatgacgtagatgggattgatgcagcctacaagatggttattttgagccaatttgcctttggcatgaagattgcctttgatgatgtagcccacaagggaatccgcaatatcacaccagaagacgtagctgtagctcaagagcttggttacgtagtgaaattggttggttctattgaggaaacttcttcaggtattgctgcagaagtgactccaaccttcctacctaaagcgcacccacttgctagtgtgaatggcgtaatgaacgctgtctttgtagaatctatcggtattggtgagtctatgtactacggaccaggtgcgggtcaaaaaccaactgcaacaagtgttgtagctgatattgtccgtatcgttcgtcgtttgaatgatggtactattggcaaagacttcaacgaatatagccgtgacttggtcttggcaaatcctgaagatgtcaaagcaaactactatttctcaatcttggctccagactcaaaaggtcaggtcttgaagttggctgaaatcttcaatgctcaagatatttcctttaagcaaatccttcaagatggcaaagagggtgacaaggcgcgtgtcgttatcatcacacacaagattaataaagcccagcttgaaaatgtctcagctgaattgaagaaggtttcagaattcgacctcttgaataccttcaaggtgctaggagaataa

SEQ ID NO: 1368 - DNA (genomic), 621 bp, Streptococcus pneumoniae; double-stranded, circular
  misc_feature (B) LOCATION 1...621
  hypothetical: NO
  anti-sense: NO
gaggtagaggaaatgtctcaatccagctacctgtcgcccttgctctggttaaaaaaagaagccgataaggaaaagatgagcgcgacccagtgccagatatttttcttttactatcaaatgtttgagctcttatttgctagagaaagcgacatgaaagacttatgtctgggaacgaaaggtttttatttctcgcagttagagaaaaatttgctttctggagtttcccgatttctaaaaaacttggaggggaaagtaactctcaaggctaaccaagaagtatcagctcgcaaagccctttttctagccttgacaactagccaatcagattggcaggagttagctcctgtttttgatttttatcagactatcgggaggcttgaaaatccttctctcttgagttctcaggacagacaacatctgatgtggatttaccagtcagctttggagaaagattatattgtcaacgttattggcgacaagcattttgtattgaaaagacaacatgctactaaattgacagcgcgccaaactcaaactttggaaattctgagtcaatcagaagacttggtcaatcctgtctatgttacattaggagaaaagggggtgctcttgcttgattaa

SEQ ID NO: 1369 - DNA (genomic), 477 bp, Streptococcus pneumoniae; double-stranded, circular
  misc_feature (B) LOCATION 1...477
  hypothetical: NO
  anti-sense: NO
tcaaaagaggaaatcatgaaaaaaagagcaatagtggcagtcattgtactgcttttaattgggctggatcagttggtcaaatcctatatcgtccagcagattccactgggtgaagtgcgctcctggattcccaatttcgttagcttgacctacctgcaaaatcgaggtgcagccttttctatcttacaagatcagcagctgttattcgctgtcattactctggttgtcgtgataggtgccatttggtatttacataaacacatggaggactcattctggatggtcttgggtttgactttgataatcgcgggtggtcttggaaactttattgacagggccagtcagggctttgttgtggatatgttccaccttgactttatcaactttgcaattttcaatgtggcagatagctatctgacggttggagtgattattttattgattgcaatgctaaaagaggaaataaatggaaattaa

SEQ ID NO: 1370 - DNA (genomic), 2343 bp, Streptococcus pneumoniae; double-stranded, circular
  misc_feature (B) LOCATION 1...2343
  hypothetical: NO
  anti-sense: NO
aaaaaagaggacattaatatggttgttaagacagttgttgaagcacaagatatttttgacaaagcttgggaaggcttcaaaggcgtagattggaaagaaaaagcaagtgtatcacgctttgtacaagctaactacacaccttatgatggagacgaaagcttccttgcaggaccaacagagcgttcacttcacatcaagaaaattgtagaagaaactaaagcacactacgaagaaactcgtttcccaatggacactcgtccaacatctatcgctgatatccctgctggatttatcgacaaagaaaatgaagttatctttggtatccaaaatgatgaactcttcaaattgaacttcatgccaaaaggtggtatccgtatggctgaaactactttaaaagaaaatggatacgaaccagacccagctgttcacgaaatcttcactaaatatgtaacaacagttaacgacggtattttccgtgcctacacttcaaatattcgtcgcgctcgtcatgcacacactgtaactggtcttccagatgcatactcacgcggacgtatcatcggtgtttacgcacgtcttgctctttacggtgcagactacttgatgcaagaaaaagtaaacgactggaatgcaatcaaagaaatcgatgaagaaacaatccgtcttcgtgaagaagtaaaccttcaataccaagcattgcaacaagttgttcgcctgggtgacctttacggggttgatgttcgcaaaccagcgatgaacgtgaaagaagcaatccaatgggttaacattgctttcatggctgtctgccgtgtgattaacggtgctgctacatctctaggtcgtgtaccaatcgtattggacatctttgcagaacgtgaccttgctcgtggtacatttactgaatcagaaatccaagaattcgttgatgatttcgttatgaaacttcgtacagttaaatttgctcgtaccaaagcttatgaccaattgtactcaggtgacccaacctttatcacaacttctatggctggtatgggtaacgacggtcgtcaccgtgttactaagatggactaccgtttcttgaacactcttgacaacatcggtaactcaccagaaccaaacttgacagttctttggactgacaaattgccatacaacttccgtcgctactgtatgcacatgagccacaaacactcttctatccaatacgaaggtgtaacaacaatggctaaagacggatatggtgaaatgagctgtatctcatgctgtgtgtctccacttgatccagaaaatgaagaacaacgccacaacatccagtacttcggtgctcgtgtaaacgttcttaaagcccttcttactggtttgaatggtggttacgacgatgttcacaaagactacaaagtatttgatatcgaaccaatccgtgacgaagttcttgaatttgaatcagttaaagcgaactttgaaaaatctcttgactggttgactgacacttacgtagatgccttgaacatcatccactacatgactgataggtacaactacgaagctgttcaaatggccttcttgccaactaaacaacgtgccaacatgggattcggtatctgtggatttgctaacactgttgatacattgtcagctatcaaatacgctacagttaaaccaatccgtgacgaagatggctacatctacgattacgaaacaatcggtgactacccacgctggggtgaagatgacccacgttcaaacgaattggcagaatggttgatcgaagcttacacaactcgtctacgtagccacaaactatacaaagacgcagaagctacagtatcacttttgacaatcacatctaacgttgcttactctaaacaaactggtaactcaccagttcacaaaggtgtatacctcaacgaagatggttctgtgaacttgtctaaacttgaattcttctcaccaggtgctaacccatctaacaaagctaaaggtggttggttgcaaaacttgaactcactttctagccttgactttagttatgcagctgacggtatctcattgactacacaagtatcacctcgcgctcttggtaagactcgtgatgaacaagttgataacttggtaacaatccttgatggttacttcgaaaacggtggacaacacgttaacttgaacgttatggacttgaacgatgtttacgaaaaaatcatgtcaggcgaagacgttatcgtacgtatctctggatactgtgtaaacactaaatacctcactccagaacaaaaaactgaattgacacaacgtgtcttccacgaagttctttcaatggatgacgccttggatgcattgagctaa

SEQ ID NO: 1371 - DNA (genomic), 717 bp, Streptococcus pneumoniae; double-stranded, circular
  misc_feature (B) LOCATION 1...717
  hypothetical: NO
  anti-sense: NO
aagggagaggatgaacctatgagaaaatttaaaatctttttatttatcgaagcctgtcttctgacaggagctctgattttgatggtatcagagcatttttcgcgttttctgctgatactattcctctttttgcttttgattcgctactacactggtaaagagggaaataatcttcttttagtagcggcaaccattctcttctttttcatcgttatgctcaatccttttgtgattctagctatttttgttgcggttatctatagcctctttcttctttacccgatgatgaaccaggaaaaagagcagaccaatttggtttttgaagaggtcgtgacggttaagaaggagaaaaatcgttggtttggaaatcttcatcatttttcaagctaccagacttgccaattcgatgatatcaatctctttcgcttcatgggcaaggacactattcatctggagagggtcatcttaaccaatcatgacaatgtcattatcctcagaaagatggtaggaacgaccaaaatcatcgtacctgtagatgtggaagtcagtctcagcgttaactgtctctatggggatttgacttttttcaaccagcccaagcgagccctccgcaatgaacactatcatcaagaaacaaaagactatctcaagagtaacaagagtgtcaagattttcttgaccactatgattggtgatgtggaggtggttagaggatga

SEQ ID NO: 1372 - DNA (genomic), 375 bp, Streptococcus pneumoniae; double-stranded, circular
  misc_feature (B) LOCATION 1...375
  hypothetical: NO
  anti-sense: NO
ttagcggaggaaaggtattgtactatgataattcaactaagtgatttaggtcaagttcaccttgtttgtagcaagatagatatgaggcagggaatagactcattagcctatgtagttaaaacccactttgaattggatcctttctccggtcaagtctttctcttttgtggtggacgtaaagaccgctttaaagccctttactgggatggtcaaggattttggctactatataaacgctttgagaacggcagactgacttggcccagtacagaaaaggatgtcaaagctctcacacctgaacaagtagactggcttatgaagggcttttctatcactccaaaaataaatccatcagaaagtcgtgatttctattga

SEQ ID NO: 1373 - DNA (genomic), 219 bp, Streptococcus pneumoniae; double-stranded, circular
  misc_feature (B) LOCATION 1...219
  hypothetical: NO
  anti-sense: NO
tacaaggaggaaagcatggaagaatcaaaagaattaaatgccgtcattgatgtgattatgctagcggggactattctccttaaaagtggctcagaaatccatcgtgtagaagataccatgattcgaatcgcgattcgcaggggattgtggattgcaatgtccttgccatgcctgccgctatctttttctctattgaaaataccaatatttcgcgcatga

SEQ ID NO: 1374 - DNA (genomic), 1788 bp, Streptococcus pneumoniae; double-stranded, circular
  misc_feature (B) LOCATION 1...1788
  hypothetical: NO
  anti-sense: NO
gaaaaggaggatgatctaatggaagaaaaagtatcattgaaagtcagggttcaaaaactagggacatcgctttcaaatatggttatgcccaatattggagcatttattgcttggggagtattgactgccctttttatcgctgatggttatctgccaaatgaacagttagctactgttgttggtcctatgttaacgtatttattgccaatcctgattggttacacaggtggatatatgatccatggccaacgtggtgccgttgtaggagctattgctactgttggtgcaatcacaggttctagtgttcctatgtttatcggagctatggtaatgggcccactgggaggatggactatcaagaaatttgatgagaagttccaggaaaaaattcgtcccggatttgaaatgttagttaataacttctcagctggtctcgttggttttgcattattgcttttggctttctacgcaatcggtccagtcgtatcgactcttactggagctgttgggaatggtgttgaggctattgtcaatgctcacctccttcctatggctaatattatcatcgaaccggctaaagtccttttcctcaataatgccctcaatcatggcatttttactcctctgggagtagaacaggtagctcaagctggtaagtcaattctcttcctattggaagctaatcctggaccaggcctgggaattctattaacttatgctgtattcggtaaaggttctgctaaatcttcttcttggggggcaatggttattcatttcttcggagggattcatgaaatttactttccttatgttatgatgaagcctactctatttttagctgctatggcaggaggtatctctggaacttttacttttcaactcttagacgctggtcttaaatctccagcttcaccaggttctattattgcgattatggctacggcgccaaaaggtgtttggccccatctaaatgttcttttaggtgttttagtggcagcagttgtttctttccttgtagcagcccttattcttcatgcagacaagtcaactgaggattcgctcgaagctgctcaggcggctacccaagcagctaaggctcagtctaaaggtcagttagtatcaacttctgttgatgcagttgtttcgacagactcagtggaaaaaatcattttcgcctgcgatgctggtatgggaagctctgctatgggagctagtattcttcgagataaggttaaaaaagcaggtctagagattccagtatctaatcaggcaatctcaaatttgcttgatacaccaaaaacattaattgttactcaggaagaactgacaccaagagctaaagacaagagtccaagtgctattcatgtttctgttgataatttcttagcgtcccctcgttatgatgaaattgtagcttcattaacaggagcttctccaatagcagaaattgaaggagatataccaacttcagcaccagtagatagtcaggaaattgaccttaaccatattgatgctgtagtagttgcttatggtaaagcacagggaactgcaactatgggctgtgaaacgattcgggctatctttagaaacaagaatattcgtattccagtttctactgccaaaatttcagaattaggtgaatttaattctaaaaatataatgattgtaacaactatttctttacaggcagaagtgcagcaagcagcaccgaattctcaatttcttattgtggatagtttagtaacaacaccagaatatgacaaaatggctgctagaatgtacaaatag

SEQ ID NO: 1375 - DNA (genomic), 336 bp, Streptococcus pneumoniae; double-stranded, circular
  misc_feature (B) LOCATION 1...336
  hypothetical: NO
  anti-sense: NO
aatgaggaggaatttatggaaattattgttccagatcaaattatcatgggtttaattttatatgctggcgatgcgaaacaacatatttataaagcattagattacataaagaacggtacatgtgaacgatgtgaagaagaaatccagttagctgatgccgccttattagaagctcataatctacaaacaaaattcttggcacaggaagcgtctggtacaaagacagaaattacagctctctttgttcattcacaagatcatctcatgactagtatgacggagattaatttaatcaaagaaattattagtttgagaaaagaacttcataaaaaataa

SEQ ID NO: 1376 - DNA (genomic), 1110 bp, Streptococcus pneumoniae; double-stranded, circular
  misc_feature (B) LOCATION 1...1110
  hypothetical: NO
  anti-sense: NO
tcgggggaggaggaatcgttgactttgcaagcagagattatcaagaacaccaagcagccaagtggaatgagcaaattgaccagcttcttaaagatggacatatcacaagtcttcaggctgagacggaaaaaattagctacagctaagcaaaaaaatatcatcaccctatttaacaatctcttttctagcggttttcatctggtggagactatctcctttttagataggagtgctttgttggacaagcagtgtgtgacccagatgcgtgtgggcttgtctcaggggaaatcattctcagaaatgatggaaagtttgggatgttcaagtgctattgtcactcagttatccctagctgaagttcatggcaatctccacctgagtttgggaaagatagaagaatatctggacaatctggctaaggtcaagaaaaaattgattgaagtagcgacctatcccttgattttgctgggttttcttctcttaattatgctggggctacggaattacctgctcccacaactggatagtagcaatattgccacccaaattatcggtaatctgccccaaatttttctaggcatggtagggcttgtttccgtgcttgcccttttagcactcactttttataaaagaagttctaagatgagtgtcttttctatcttagcacgccttccctttattggaatctttgtgcagacctacttgacagcctattatgcacgtgaatgggggaatatgatttcacagggaatggagttgacgcagatttttcaaatgatgcaggaacaaggttcccagctctttaaagaagtcggtcaagatctggctcaaaccctgaaaaatggccgtgaattttctcagacgataggaacctatcctttctttaggaaggaattgagtctcatcatagagtatggggaagttaagtccaagctgggtagtgagttggaaatctatgctgaaaaaacttgggaagccttttttacccgagtcaaccgcaccatgaatttggtgcagccactggtttttatctttgtggcactgattatcgttttactttatgcggcaatgctcatgcccatgtatcaaaatatggaggtaaatttttaa

SEQ ID NO: 1377 - DNA (genomic), 820 bp, Streptococcus pneumoniae; double-stranded, circular
  misc_feature (B) LOCATION 1...820
  hypothetical: NO
  anti-sense: NO
tttttgggaccatttcttggttaatagtcttgtcgaaatngaacaatttaaggccggaaatctagacgttcgaatgattaatgatatcaaccagattcagaacgttgtcatgatgaccttccaaattcttttcagacttcccctcttgttcatcggttcgtttatcctagcggttcaaaccttaccttctctgtggtgggtgattgttctcatggtagtcttgatttttggtttgactgctgtcatgatgggaatgatggggcctcgttttgccaagtttcaaacccttcttgagcgcatcaatgccattgccaaggaaaatttacgtggcgttcgtgtggtcaagtcctttgtccaagaaaaagagcaatttgctaagtttacagagatctcagacgagctttttggtcaaaacctttacattggttatgccttttcagtagtggaaccctttatgatgttggttggttacggggcggtcttcctctctatttggctggtcgcgggaatggttcagtcggatccgtctgttgttggttccatcgcttcttttgttaattacctaagccagattatctttaccattgttatggttggatttttgggaaattctgtcagccgtgccatgatttccatgcgtcgtattcgagaaattcttgacgcagagccagctatgaccttcaaggatatcccagatgaagagttggttggaagccttagctttgaaaatgtgacctttacctatcccatggacaaggaaccgatgctgaaagatgtgagctttactattgaaccttgtcaaatggttggtgtagtatga

SEQ ID NO: 1378 - DNA (genomic), 882 bp, Streptococcus pneumoniae; double-stranded, circular
  misc_feature (B) LOCATION 1...882
  hypothetical: NO
  anti-sense: NO
ttgagctgggagcgcaaggtgttgcgattgaagacagtctggactatgtgggaaatgttgaccgcttcggcgagattttccccagaggtcgagcagcaagaagaaatcgtagtgacagcctactaccctgacacggtggatgtgacagtggttgaggcggacttgcaggctcgcatatcagaattgacggattttatggatttgggagagttaaaaataggtacgactgccttggctgaggaagactgggcagataactggaagaaatactatgagccagctcgtatcactcatgatttgaccatcgttccctcttggacagactatgaggcgactgcgggagaaaaaattatcaagctggatcctggcatggcttttggtactggaacccacccaactaccaagatgagcctttttgccttggaacaggttcttcgtggtggcgaaacggtgctagatgtggggactggttcaggggttctctctattgccagctcgcttctgggggctaaagaaattttcgcctatgacctggatgatgtggcggttcgtgtggctcaggaaaatattgagctcaaccctggcatggaaaatatccatgtagcggctggagatttgcttaagggtgtggaaattgaggcagatgtcatcgtggctaatatcttggcggatattctcattcatctgacggaggatgcttatcgcttggtaaaggatgaaggctacctgatcatgagtggcattatcaaggacaagtgggacatggtgcgccagtcggctgagtcagctggatttttcctcgaaactcacatggttcaaggggaatggaatacctgtgtctttaagaaaaccaaggatatctctggtgtgattggaggctag

SEQ ID NO: 1379 - DNA (genomic), 261 bp, Streptococcus pneumoniae; double-stranded, circular
  misc_feature (B) LOCATION 1...261
  hypothetical: NO
  anti-sense: NO
aataatagggattttaaggagtttgatatgtataacctattattaaccattttattagtattatctgttgtgattgtgattgcaattttcatgcaaccaaccaaaaaccaatccagcaatgtatttgatgccagttcaggtgatttgtttgaacgcagtaaagctcgcggttttgaagctgtaatgcagcgtttgacagggattttagtctttttctggctagccattgccttagcattgacggtattatcaagtagataa

SEQ ID NO: 1380 - DNA (genomic), 318 bp, Streptococcus pneumoniae; double-stranded, circular
  misc_feature (B) LOCATION 1...318
  hypothetical: NO
  anti-sense: NO
accataagggaggtggtagggatggtagaaccaaacctagaaagccttataaaagatctttacaatcatgctcgacatgatttgagtgaagatttagttgctgctctcctagagactactaaaaaactgcctactacaaatgagcaattgcaggcagttcgtctctcaggcctggtcaatcgtgaattgctcctaaatcccaaacatccagcacctgagttgctcaacttggctcgctttgtcaaaagagaagaagccaagtacagaggaactgcgacttctgcgcttatgtatgaggaactttttaaaatgctttga

SEQ ID NO: 1381 - DNA (genomic), 1302 bp, Streptococcus pneumoniae; double-stranded, circular
  misc_feature (B) LOCATION 1...1302
  hypothetical: NO
  anti-sense: NO
gtagaaagggagaaaatgtataaagtattattagtagatgatgagtacatggtgacagaaggtctgaagcgtttgattccctttgataagtgggatatggaggttgtcgcaacagccagtcatgccgatgaagctctagaatatgttcaggaaaatcctgtcgatgtcatcatttccgatgtcaatatgccagacaaaacagggcttgatatgattcgggagatgaaagagatcttaccagatgctgcctatatcctgctctcaggttatcaggagtttgattatgtaaaaagagcaatgaaccttagtgtggtggactatttggtcaagcctgttgataaggtagagctgggaaatctgctggagaagattgcaggtcagctcggcgagagagggaagaaaagtcagactcttagtcaagaattagacgaggctggatttgttagttatttaggggataaggagaattggtggataggtctatccaaggaaaaacaaggttccttcaccattccctactatgtcttgggccaagactggcagattttcatttctggccaacctctagatggtttagtcgttacaccttttgaagctccttatcaagaacactttgaacgctggaagctgaatgctgagaaaaccctcttttacggttctgtaaatttgcagcagtctgagagtctctttgcctattacgaaccgatttatagggttatcattcagggaaatctcaatcaaatcgtagaagagttaaatctcttggagaaggtagttcttgaaaatacgccgcgtgttccgattactaaacagctttttattcagtttgtcatggatgttttccatttatttgaacatctcaaagctgatgacctgacagacatcgtcaaaaccattcatgctattcaatccttcgatgaattggtttcttatatcaaggaaactctgatcagctttttcggtcaataccgtatgaatgaaaatgtggtcagtgtgctggaagtcattggtcgtgattaccaaaaagagctttccctcaaggatatcagtaaggccctctttatcaatcctgtctatctagggcagttgattaagcgtgaaaccgattcgacctttgcagagttactaaataaacaacgtattaaggctgcccagcagctcttgctttcaactagtgacagcatcgaagatatttgttatgctgttggttacagtaaccttggatatttctataaagttttccgaaaattgtgcggaaaatcgccaaaagcctaccgaaaacaggtagaaactatactataa

SEQ ID NO: 1382 - DNA (genomic), 969 bp, Streptococcus pneumoniae; double-stranded, circular
  misc_feature (B) LOCATION 1...969
  hypothetical: NO
  anti-sense: NO
aaaaggagggaattcatgtttgttgcgagagatactaggggagaattggtaaatgtgttagaggataaacttgagaagcaagcatacacctgcccagcttgtggaggccagatccatttgcgtcaaggaccaagtgtacggacgcattttgcccataaatccttaaaagactgtgattttttctttgaaaatgaaagtccagaacacatagccaataaggaatccctctatcactggttgaaaaaagagacaaaggttcaattagagtacccgctttcagaacttaaacagattgcggatgtatttgtaaatggcaatctagctctagaagttcagtgtagtcccttgcctcagaaagtccttaaagagcgaagtgagggctatcgtagtcagggttaccaagtactgtggttgctgggtcaaaaactgtggctcaaggagcgtttgactcgtctacagcaaggttttctgtatttcagtcaaaacatgggcttttatgtttgggaattagacaaggaaaaacaagttttaagactcaaatacctgatttaccaggatctccgcggtaaactccattatcaaatcaaggaattttcctatggtcaaggtagtttattggaaatattgcgtcttccctataagagacaaaaaatatctcattttacagtttctgaggacaaggacatctgtcgctatattcggcaacaactttattatcaaaatctcttttggatgaaagaacaagcagaagcctatcaaaagggagaaaatatcctgacttatggactgaaagaatggtatccacaaattcgaccaatagtgggcaaatttttccagattgaacaagacttgactagctattatcggaacttttatacctattaccaaaaaaatcctcaaaatgattggcaaaagctttatccaccagccttttatcagcaatatttcttgaaaaatatggtagaatag

SEQ ID NO: 1383 - DNA (genomic), 1719 bp, Streptococcus pneumoniae; double-stranded, circular
  misc_feature (B) LOCATION 1...1719
  hypothetical: NO
  anti-sense: NO
aatgggagggataagatgactgaattagataaacgtcaccgcagtagcatctatgacagcatggttaaatcacctaaccgtgctatgcttcgtgcgactggtatgacagataaggactttgaaacatcgattgtgggagtgatttcgacttgggcggaaaatacaccatgtaacattcacttgcatgatttcgggaaactggctaaagaaggtgtcaaatctgcaggcgcttggcctgtacagtttggaaccattaccgtagcggacgggatcgctatgggaacgcctggtatgcgtttctctctaacatctcgtgacatcatcgcggactccatcgaggcggctatgagtggtcacaacgtggatgccttcgtcgctatcggtggctgtgacaagaacatgcctggatctatgattgctattgctaatatggatatcccagctattttcgcctatggtggaactattgcaccgggaaatcttgatggtaaagatatcgacttggtttctgtctttgaaggtatcggaaaatggaaccacggtgacatgacagctgaggacgtgaaacgtcttgaatgtaatgcctgccctggccctggtggttgtggtggtatgtatactgctaataccatggcaactgctatcgaagttctagggatgagtttgccagggtcatcctctcacccagctgaatcagctgataagaaagaagatatcgaagcagcaggacgtgctgttgttaagatgttggaacttggtctcaaaccatcagatatcttgactcgtgaagcctttgaagatgctattactgtaacgatggctctcggtggttctacaaacgccactcttcacttgctcgccattgcccatgccgcaaatgttgacttgtcacttgaggacttcaatacgattcaagaacgtgtgcctcacttggccgacttgaaaccatctggtcagtatgtcttccaagacctctacgaagtcggtggtgtccctgcggttatgaagtacttgttggcaaatggtttccttcacggagatcgcatcacatgtactggtaagactgtagctgaaaacttggctgactttgcagacttgactccaggccaaaaagttatcatgccacttgaaaatccaaaacgtgcggatggtccgcttatcatcttgaacgggaaccttgctcctgacggtgcagttgccaaggtatcaggtgttaaagtgcgtcgtcacgttgggccagctaaggtctttgactcagaagaagatgcgattcaggccgttctgacagatgaaatcgttgatggcgatgtagtcgttgttcgttttgttggacctaaaggtggtcctggtatgcctgagatgctgtcactttcttcaatgattgttggtaaaggtcagggagataaggtggccctcttgacggacggacgtttctctggtggtacttatggtctggttgttggacatatcgctcctgaagctcaggatggtggaccaattgcctatctccgtaccggcgatatcgttacggttgaccaagataccaaagaaatttccatggccgtatccgaagaagaacttgaaaaacgcaaggcagaaacaaccttgccaccactttacagccgtggtgtcctcggtaaatatgcccacatcgtatcatctgcttcacgcggagccgtgacagacttctggaatatggacaagtcaggtaaaaaataa

SEQ ID NO: 1384 - DNA (genomic), 258 bp, Streptococcus pneumoniae; double-stranded, circular
  misc_feature (B) LOCATION 1...258
  hypothetical: NO
  anti-sense: NO
ctacgaggggatatagaaaacaagaccctactaataagaataatctgggacaactgcaccagattcacaactaatactcttcgaaaatctcttcaaaccgcgtcaacgtcgccttgccgtagatatgtgttcctgactttgtcagtcttatctacaacctcaaaacagtgttttgagcagcctacggctagtttcctagcttgctctttgattttcattgagtataaaatacaagaagataacttcttgaaaaaataa

SEQ ID NO: 1385 - DNA (genomic), 729 bp, Streptococcus pneumoniae; double-stranded, circular
  misc_feature (B) LOCATION 1...729
  hypothetical: NO
  anti-sense: NO
ctaaagggggagcgctacatgtctaattcatttgtcaagttgttagtctctcaattatttgcaaatttagcagatattttctttagagtaacaatcattgctaacatatacattatttcaaaatcagtaattgccacatcactagttcctatcttaataggaatatcctcttttgttgcgagtcttttagttccgttggttactaaaaggttagcgctaaatagggttttatctttatctcaatttggaaagactatattattggcgatactggtaggaatgtttaccgtaatgcaatccgtagcgcctttggtgacctatctatttgttgttgcaatttccatactagatggttttgcagcacccgtttcctatgctattgtgccacgctatgcgaccgatttgggtaaggctaattcagccttatcaatgactggtgaagctgttcaattgataggttggggattaggtggactcttgtttgcaacaattggtctgttacctaccacgtttatcattttagtcttgtatatcatttctagctttctgatgttatttcttcctaacgctgaagtggaggtgttagagtcagaaactaatcttgaaattttgctcaaaggttggaagttagttgctagaaatcctagattaagacttttgtatcagcaaatttattggaaattttttcaaatacgatttgggtttcttccattatacttgtttttgtaa

SEQ ID NO: 1386 - DNA (genomic), 630 bp, Streptococcus pneumoniae; double-stranded, circular
  misc_feature (B) LOCATION 1...630
  hypothetical: NO
  anti-sense: NO
ctgaaaagtttgcttcaaccatcacccaaggtgagtcatgagccagagcaggtttatcaagtggcgcgtgatggcattgccaagcaggatcatctagcctatctcaaacctatgtcttatcaaaatacctatgctgtagctgttccgaaaaagattgctcaagaatatggcttgaagaccatttcggatttgaaaaaagtggaagggcagctgaaggcaggctttacgcttgagtttaacgaccgtgaagatggaaataagggcttgcaatcaatgtatggtctcaatctcaatgtggcgactatgcagccagctcttcgttatcaggcaattcagtcaggggatattcaaatcacggatgcctattcgactgatgcggaattggagcgttatgatttacaggtcttggaagatgacaagcaactcttcccaccttatcaaggggctccactcatgaaagaagctcttctcaagaaacacccagagttggaaagagttcttaatacattggctggtaagattacagaaagccagatgagccagctcaactaccaagtcggtgttgaaggcaagtcagcaaagcaagtagccaaggagtttctccaagaacaaggtttgttgaagaaatga

SEQ ID NO: 1387 - DNA (genomic), 705 bp, Streptococcus pneumoniae; double-stranded, circular
  misc_feature (B) LOCATION 1...705
  hypothetical: NO
  anti-sense: NO
aactctttactccttatatcctttatattgtcccttatatggtgcttgaaaaatatgaagataatgtttaagaattttaacaatattttgctaaagagaaagattgttttactacttcgtatagttctgatgatgattttgataaactatctattgtcaacagcggttcaaaagcaggatgctgttatctttttcaagagagaattgatttcaattttttcctataatgactattctgaagcgaatttagaaatccccaaactcttgttaaacctttcgcttttcatggtaggatggctctctgtcattttacttgaaagtgatttggcagaccattaccatcacttgattcgctatcaatcaagctcctttttcgattatacaaggaaacgattggttgtcatttctaaattttttactcaagatttacttgtctggttccttggtttacttccgctaggaattcatttcaaaacagtcgcacttttctttttacttgctcagttaatgatgttgtacttactactgtcttatctgatagcactgattagtgcgggcgctggtttttccttttttctctattttttagcatttgtgggacaagaatggatgatggatcatattgtaacagtgtatttactactcttaagcttattagttatgttgattgttagtcgcttggaagagaaatttaagaaaggataa

SEQ ID NO: 1388 - DNA (genomic), 345 bp, Streptococcus pneumoniae; double-stranded, circular
  misc_feature (B) LOCATION 1...345
  hypothetical: NO
  anti-sense: NO
aaatatttactagaagcgaaaaaaacaaagattatcgattgggattttgcagacacttgctgggaaaaggagcttagaaaataccaatatgtggctgctaactatttgaaagcaatgcagtcttatctaaaggaaaccgatttgcctaagctagagcagttagtcgtgacaaaatcctggtgggacacggtagatatcctagatcgagtagtagggagtttggtgtatgaacaccctgaactagaagaaataatcttaatactcttcgaaaatctcttcaaaccacgtcagctctatctgcaacctcaaaacagtgttttgagcaatctgcggctagcttcctag

SEQ ID NO: 1389 - DNA (genomic), 564 bp, Streptococcus pneumoniae; double-stranded, circular
  misc_feature (B) LOCATION 1...564
  hypothetical: NO
  anti-sense: NO
ggtggcttacttaaaaaagttaaaagagttagaggaaagggacgaagccctagagcgagaaaggcagaaacagttagagaaatggtttcaggaggatttcgactagattttcttcttgaaacagcacgtttagctcgctcgacttactattatcagttgaaacaactggatggggttgataaagataaagagattaaaaccgaaattcaggccatttataatgaacataaaggcaactatggctatcgtcgaatccatttagaactaagaaatcgtggttttgtggtgaatcataagaaagttcaacgtctgatgaaagttcttggtttaacagctcgaattcgtcggaaacgaaagtattcctcctaccaaggagagattggcaagaaagcagagaatctcattcaacgtcagtttgaagcaaccaaaccaatggaaaagtgctatacggatgtgacagagtttgccattccaaatagcacacagaaactctatttatcgcctgttttagatggctttaacagcgaaatttcgcctataatctttcaacttcaccaaacttag

SEQ ID NO: 1390 - DNA (genomic), 666 bp, Streptococcus pneumoniae; double-stranded, circular
  misc_feature (B) LOCATION 1...666
  hypothetical: NO
  anti-sense: NO
agtagaagtttacggtgttgtagaccaccaccgtgtgctaactttgaaactgcaagcccactttacatgcgtttggagccagttggatcagcgtcttcaatcgtttaccgtatgttcaaagaacatggtgtagctgttcctaaagagattgcaggtttgatgctttcaggtttgatttcagatacccttcttttgaaatcaccaacaacacacccaacagataaaatcattgctcctgaattggctgaattggctggtgtaaacttggaagaatatggtttggcaatgttgaaagctggtaccaacttggctagcaaatctgctgaagaattgattgacatcgatgctaagacttttgaactcaacggaaataatgtccgtgttgcccaagtgaacacagttgacatcgctgaagttttggaacgccaagcagaaattgaagctgcaatgcaagctgccaacgaatcaaacggctactctgactttgtcttgatgattacagatatcgtcaactcaaactcagaaatattggctcttggtgccaatatggacaaggtcgaagcggctttcaatttcaaacttgaaaacaatcatgccttccttgctggtgccgtttcacgtaagaaacaagtggtacctcaattaactgaaagctttaatacgtaa

SEQ ID NO: 1391 - DNA (genomic), 189 bp, Streptococcus pneumoniae; double-stranded, circular
  misc_feature (B) LOCATION 1...189
  hypothetical: NO
  anti-sense: NO
ctactattactcttaacattttatcctccactaacaactcaagctcccttacattatatcgaccagccccatggaaagattatagctagactaatcaatgatataatacatactagaatacaaaatatttttatattcatactttttctcctatctttattttctacctacatagtacctcttatttaa

SEQ ID NO: 1392 - DNA (genomic), 228 bp, Streptococcus pneumoniae; double-stranded, circular
  misc_feature (B) LOCATION 1...228
  hypothetical: NO
  anti-sense: NO
gctatattactctttcctaacctccttttttcatatgtggataaaatctcttgtctatcccttcccccattgtcacccattatagtcatttcgtgtctctttttcccctttttaatgcaagggaaattactctccttagatgataatccaaaagctagaaaggtatctcaaacctctctactctcccagactagtttacaactaaaaggaaaagattctattttatga

SEQ ID NO: 1393 - DNA (genomic), 198 bp, Streptococcus pneumoniae; double-stranded, circular
  misc_feature (B) LOCATION 1...198
  hypothetical: NO
  anti-sense: NO
gtatggttactgacttcgtcagttctatccacaacctcaaaacggtgttttgagctgacttcgtcagttctatccacaacctcaaaacagtgttttgagctgacttcatcagttctatctgcaacctcaaaacggtgttttgagcaacctgcggctagtttcctagtttgctctttgattttcattgagtattattaa

SEQ ID NO: 1394 - DNA (genomic), 189 bp, Streptococcus pneumoniae; double-stranded, circular
  misc_feature (B) LOCATION 1...189
  hypothetical: NO
  anti-sense: NO
gtatggttactgacttcgtcagtttcatctacaacctcaaaaccatgttttgagctgacttcgtcagttctatccacaacctcaaaacagtgttttgagcaacctgcggctagcttcctagtttgctctttgattttcattgagtataaaatcctagtttttcaaagatttctgagaagttttggctga

SEQ ID NO: 1395 - DNA (genomic), 225 bp, Streptococcus pneumoniae; double-stranded, circular
  misc_feature (B) LOCATION 1...225
  hypothetical: NO
  anti-sense: NO
gtatggttactgacttcgtcagttctatccacaacctcaaaacagtgttttgagctgacttcgtcagtcttatctacaggttcaaagcagtgttttgagcaatctgcggttagcttcctagtttgctctttgattttcattgagtataaatcattcaacgtaaatgaaaaaaatttcttaacgaaagatagagataaatcgaaatcagtagatcgtataaagtga

SEQ ID NO: 1396 - DNA (genomic), 1308 bp, Streptococcus pneumoniae; double-stranded, circular
  misc_feature (B) LOCATION 1...1308
  hypothetical: NO
  anti-sense: NO
gtcattctactcaaatctacgttagaaaggactgctatgccagacaatctcgcgcttcgcatgcgccctaaaaccatcgaccaggtcatcggtcaggagcatctggtcggacctggaaaaatcatccgccgcatggtggaagccaaccgcctgtcctccatgattctatatggccctcctggaatcggcaaaaccagtattgcctctgccatcgctggaacgaccaagtatgcctttcgaactttcaatgcaacagttgatagtaaaaagcgactgcaagaaatctcggaagaagctaaattttctggtggtctcgtcctattgctagacgaaattcatcgactagataagaccaagcaagacttcctcttgcctctcttggaaagtggactggtcatcatgattggagcaacgactgaaaatcctttcttctctgtcactcctgccattcgtagccgagttcaaattttcgagttggaacctctgtctaaccaagacgtcaaagaggccctgcagatagctctaagtaaccctgaacgtggttttgattttccaatagaactagatgaggatgcgctggatttcatcgcaacctctacaaacggagaccttcgctctgcctttaactcactggacttggctgttctctctacccctgagaatgacgagggcattcgccacatcaccttagacatcatggaaaatagtcttcagagaagctacatcactatggacaaggatggagacggtcactatgatgttctatctgccctgcaaaagtctattcgtggctcagatgtggatgccagtctccactatactgcccgcttgattgaggctggggatctgcctagtctcgctcgtcgcttgactgttatcgcctatgaagatatcggcttagccaatcctgaggcccagattcataccgtgactgctctggatgctgcccagaagattgggttcccagaagcccgcattctcattgccaatgtcgtgattgatttggccctttctccaaaatccaactcagcctatgtagctatggataaggcacttgctgacctcaaaacatcagggcacttgcctattccgcgacacctgcgtgatgggcactacagtggaagcaaggaactggggaatgcccaagactatctctatccacacaactatcctggaaattgggtcaagcaagactatctgccagaaaaaattcgtaatcatcactatttccaagcagaagatactggtaaatatgaacgggctttggctcaaagaaaggaagctatcgaccatttgcgaaaaatctga

SEQ ID NO: 1397 - DNA (genomic), 285 bp, Streptococcus pneumoniae; double-stranded, circular
  misc_feature (B) LOCATION 1...285
  hypothetical: NO
  anti-sense: NO
agcattctactaaaaacattggatgaagatattcttcttggttgtatccttccttggaaaccagaagcctttgaaaaactcaaagcatacggggatggccgtgaagaacttatgactgatgtacgtggtactagctgttttgttatcaagtttggaaaagcaggtgaacaattggctgccaagctttgggaagaaggtaaaatggtctacgcctcatatgcttcaatgacaaaacgattgaaactcgctatgagagcaaggtgtaatggtgtctatggtcgataa

SEQ ID NO: 1398 - DNA (genomic), 1356 bp, Streptococcus pneumoniae; double-stranded, circular
  misc_feature (B) LOCATION 1...1356
  hypothetical: NO
  anti-sense: NO
gatcagagtttaactatgtcagaaaaatcacaatgggggtcgaaacttggctttattctagcatctgctggctcggtcatcgggcttggttccgtttggaagtttccctacatgactgctgctaatggcggtggaggctttttactaatctttctcatttccactattttaatcgatttccctctcctgctggctgagtttgcccttggccgtagtgctggcgtttccgctatcaaaacctttggaaaactgggcaagaataacaagtacaactttatcggttggattggcgcctttgccctctttatcctcttatctttttacagtgttatcggaggatggattctagtctatctaggtattgagtttgggaaattgttccaacttggtggaacgggtgattatgctcagttatttacttcaatcatttcaaatccagccattgccctaggagctcaagcgacctttatcctattgaatatcttcattgtatcacgtggggttcaaaaagggattgaaagagcttcgaaagtcatgatgcccctgctctttatcatctttgtcgtcatcatcgaacgctctctcagtttgccaaatgccatggaaggggttctttacttcctcaaaccagatttttcaaaactgactagcgctggtctcctctatgctctgagacaatctttctttgccctctcactaggggttacagccatgttgacctatgcttcttacttggacaagaaaaccaatctggtccagtcaagaatctccatcgtagccatgaatatctcggtatccatcatggcaggtctagccattttccaagctcggtcccccttcaatatccagtctgaagggggaccgagcttggtctttatcgtcttgcctcaactctttgacaagatgccttttggaaccattttctatgtcctcttcctctttgcgactgtcacttcttctgtcgttatgctggaaatcaatgtagacaatatcaccaatcaggacaacagcaagcgtgctaaatggagtgttattttaggaattttgacctttgtctttggcattccttcagccctatcttacggtgtcatggcggatgttcacatttttggtaaagccttctttgacgctatggacttcttggtttccaatctcctcatgccatttggagctctcttcctttcactttttacaggctatatctttaaaaaggctcttgcaatggaggaactccatctcgatgaaagagcatggaaacaaggactgttccaagtctggctcttccttcttcgtttcgtcattccaatcatcatctgtggtcttcatcgcccaatttatgtaatcaaaaggacttga

SEQ ID NO: 1399 - DNA (genomic), 381 bp, Streptococcus pneumoniae; double-stranded, circular
  misc_feature (B) LOCATION 1...381
  hypothetical: NO
  anti-sense: NO
acggagagtttacggaaaagtaagatgagtgtattggatgaagagtatctaaaaaatacacgaaaagtttataatgatttttgtaatcaagctgataactatagaacatcaaaagattttattgataatattccaatagaatatttagctagatatagagaaattatattagctgagcatgatagttgtgtcaaaaatgatgaagcggtaaggaattttgttacctcagtattgttgtctgcatttgtatcggcgatggtatcagctatgatatcattagaaatacaaacatataaatttgtaataccgttcataattggtatgatttggacagtagttgtatttcttatgatcaattggaattatataggcaaatactaa

SEQ ID NO: 1400 - DNA (genomic), 573 bp, Streptococcus pneumoniae; double-stranded, circular
  misc_feature (B) LOCATION 1...573
  hypothetical: NO
  anti-sense: NO
aacaggagtttgaaaatgaaaagaccacttgagatggcacatgattttttggctgaggtcgtgacaaaagaggatgtcgtagtggatgcgactatgggaaatggtcatgacacgctttttttagccaagctagccaagcaagtctatgcctttgatattcagaagcaagccttggaaaagacccaagagcgtttgcatcaggctgacttgacaaatgcccagttaatcttgcaaggccatgagacactggaccagtttgtgataaaagctaaggcagggatttttaatctgggctatttgccgtcagctgataagtctgtcatcacccgaccgcagacaacgattgaggcattagaaaagctatgtggcttacttgtcaaaggtggacgaattgctattatgatttactatggtcatgaaggaggcgatctcgagagagatgctgtcttggattttgtgatccagttgaaccaacaagagtacacagctgccatttaccgaactttaaaccaagtcaacaacccgccgtttttagtgatgattgaaaaattagagagatacagacatggataa

SEQ ID NO: 1401 - DNA (genomic), 618 bp, Streptococcus pneumoniae; double-stranded, circular
  misc_feature (B) LOCATION 1...618
  hypothetical: NO
  anti-sense: NO
gtgttaatacttttcaaaaatctcttcaaaccacgtcagcttcgccttgccgtatatatgttactgacttcgtcagttctatctgccacctcaaaacggtgttttgagctgacttcgtcagttctatctgccacctcaaaacggtgttttgagctgacttcgtcagttctatctgccacctcaaaacggtgttttgagctgacttcgtcagttctatctgccacctcaaaacggtgttttgagctgacttcgtcagttctatctgccacctcaaaacggtgttttgagctgacttcgtcagttctatctgccacctcaaaacggtgttttgagctgacttcgtcagttctatctgccacctcaaaacggtgttttgagctgacttcgtcagttctatctgccacctcaaaacggtgttttgagctgacttcgtcagttctatctgccacctcaaaacggtgttttgagctgacttcgtcagttctatctgccacctcaaaacggtgttttgagctgacttcgtcagttctatctgccacctcaaaacggtgttttgagcatcatgcgactagcttcttagtttgctctttgattttcattgagtataaaaacagatga

SEQ ID NO: 1402 - DNA (genomic), 1407 bp, Streptococcus pneumoniae; double-stranded, circular
  misc_feature (B) LOCATION 1...1407
  hypothetical: NO
  anti-sense: NO
aaagggatactcatgagtaaaaaaagacgaaatcgtcataaaaaagaaggtcaagaaccgcaatttgattttgatgaagcaaaagagctaacagttggtcaagctattcgtaaaaatgaagaagtggaagcaggagtcttgcctgaggattccattttggacaagtatgttaagcaacacagagatgaaattgaggcggataagtttgcgactcgtcaatacaaaaaagaggagttcgttgaaactcagagtctggatgatttaattcaagagatgcgtgaggctgtagagaagtcagaagcttcttcggaggaagttccatcttctgaagacatcttactacccttgcctctggacgatgaggagcaaggcttggatcctctattgctagatgatgaaaatccaacagaaatgactgaagaagtggaagaggagcaaaacctttctcgtctggatcaagaggactcagaaaagaaaagtaaaaaaggctttattttgaccgttttggcgcttgtatcagtaattatttgtgtcagtgcttattatgtctaccgtcaagtgaatcgctcgaccaaggaaattgaaacttctcaatcaactacagccaatcaatcagatgtggatgattttaatacactttatgacgccttttacacagatagcaataaaacggctttgaaaaatagccagtttgataaactgagtcaactcaaaaccttgcttgataagctggaaggtagtcgtgaacatacacttgccaaatctaaatatgatagtctagcaacgcaaatcaaggctattcaagatgtcaatgcacaatttgaaaaatcagctattgtggatggtgtgttggatacccatgccaaagctaaatcggatgctaaatttacagatattaaaactgggaatacggagcttgataaagtgctagataaggctatcagtcttggtaagagccagcaaacaagtacttttagctcaagttcaagtcaaactagcagctcaagctctagtcaagcaagctcaaatacgacaagtgagccaaaaccaagtagttcaaatgagactagaagtagtcgcagtgaagtcaatatgggtctctcgagtgcaggggttgctgttcaaagaagtgccagtcgtgttgcctataatcagtctgctattgatgatagtaataactctgcctgggattttgcggatggtgtcttggaacaaattctagcgacttcacgttcacgtggctatatcactggagaccaatatatccttgaacgtgtcaatatcgttaacggcaatggttattacaacctctataagccagatgtaacctatctctttacccttaactgtaagacaggctactttgtcggaaatggcgctggtcatgcggatgacttggactactaa

SEQ ID NO: 1403 - DNA (genomic), 768 bp, Streptococcus pneumoniae; double-stranded, circular
  misc_feature (B) LOCATION 1...768
  hypothetical: NO
  anti-sense: NO
gaacctgtacttgcgactttgacaattccagaaggttataccttggatcagattgctcaaactgtgggtcaattgcaaggtgacttcaaagagtctttgacagcggaggctttcttggctaaagttcaagatgagacgtttatcagtcaagcagtagcgaaatatcctactttactggaaagtttgcctgtaaaagacagcggtgcgcgttatcgtttggaaggataccttttcccagctacatactctatcaaggaaagcacaactattgagagcttgattgatgagatgttagctgctatggataagaacctatctccttactatagtactatcaaatctaaaaacttgactgtcaatgagttgttgaccattgcttccttggtcgaaaaagaaggtgccaagacagaagatcgtaagctcattgcaggtgtattctacaatcgtttgaatcgtgatatgccacttcaaagtaatattgcaatcttgtatgcccaaggaaaactggggcaaaatatcagtctagctgaggatgttgcgattgataccaacattgattcaccttataatgtttataaaaatgtaggtctcatgcctggtccagtcgatagtccaagtctggatgcgattgagtcaagcatcaatcaaactaagagcgataacctctactttgtagcagatgtcacagaaggcaaggtctactatgctaacaatcaagaagaccacgaccgcaatgtcgctgaacatgtcaacagcaaattaaactaa

SEQ ID NO: 1404 - DNA (genomic), 669 bp, Streptococcus pneumoniae; double-stranded, circular
  misc_feature (B) LOCATION 1...669
  hypothetical: NO
  anti-sense: NO
cagttttcacttatgtttgaaatttttaaatcctatcaatttaatcaagaaaaggctcatgattatggttttatagaaaatagcgaagtctggacatatagttgccagattttgcaaggtgactttgtcatgactgtgtccatcactgctgataatgtgaactttcaagtctttgaccaagagactggtgacctctatcctcacgttcatatggaaagcatgaggggaagttttgtcggaaatgtccgtgaggcttgtctggagattctttaccagattcggaaggcttgttttgatgtgcaagattttatctgtcatcagactaagcgtatcatgactcaagttcaggaaaagtatggaaaccagttggagtatctgtgggaaaaatcgcctgatacagctgtattgcgccatgaaggcaatcaaaagtggtatgccgtcttgatgaaaatctcttggaataagctggaaaagggcagagaaggacaagtggaagcagtcaacctcaagcatgaccaagtagctaatttgctttcacaaaaggggatttatccagccttccatatgagcaagcgctactggattagtgtgtcccttgatgatactttatcagatgaagaagtactggaattgatagaaaaaagttggaacttaacctctaaaaaatga

SEQ ID NO: 1405 - DNA (genomic), 597 bp, Streptococcus pneumoniae; double-stranded, circular
  misc_feature (B) LOCATION 1...597
  hypothetical: NO
  anti-sense: NO
actgtttcactcccgaatgctaaaatcgttcttgatcgctttcacattgtacaacatcttagccgtgctatgagtcgtgtgcgtgtccaaatcatgaatcagtttcatcgaaaatcccatgaatacaaggctatcaagcactactggaagctcatacaacaggatagccgtaaactgagtgataaacgtttttatcgtcctacttttcgtatgcacttaaccaataaagagattttaaacaagcttttgagttattcggaagacttgaaacaccactatcagctctatcagctcttgctttttcacttccagaataaggaaccagagaaatttttcgaacttattgaggacaatctaaagcaggctcatcctctttttcagactgtctttaaaacctttctaaaggacaaagagaaaatcgtcaacgcccttcaactacactattctaacgccaaattggaagcgaccaataatctcatcaaacttatcaagcgcaatgcctttggttttcggaactttgaaaacttcaaaaaacggatttttatcgctttgaacatcaaaaaagaaaggacgaaatttgtcctttctcaagcttag

SEQ ID NO: 1406 - DNA (genomic), 585 bp, Streptococcus pneumoniae; double-stranded, circular
  misc_feature (B) LOCATION 1...585
  hypothetical: NO
  anti-sense: NO
gatgttggtttggaaagtcgtaaattagctgttagtggaaaaattaagcattatgtggttgataatgacaatgttgtgactcccttgattcataataatcgtgatattgttacatttacaggtaattcacgctttaaacaccgttctcgtggctattttgaaagtccaatgaatgatattcctaactttaatattggtaaacaagctatcttggataaacatggttatcgtgatccgaaattggataaagtgcgattctttaagaaacaggctctgcctcgatcttctagtcaaccaagcgctgaaccaatggaaaatattgccttaggaaaacaggttactcaaagttcgacagttttcggaggagatgctagaagagctgtggatggcaaagtcgatggtaactatggtcacaattctgtcactcatacaaacttccaatctaagccttggtggcaagtagatttggctaaagaagaaaccattcgccaaatcaatatttacaaccgaacagacactgcccaggatagattggcaaactttgatgtcattcttttagacagttctggtaaagaaattgagtga

SEQ ID NO: 1407 - DNA (genomic), 543 bp, Streptococcus pneumoniae; double-stranded, circular
  misc_feature (B) LOCATION 1...543
  hypothetical: NO
  anti-sense: NO
ttctggtcactatcaggctgcggcaataacttgagttacacaaaagagcgtgctgaaaaatacctttactcgcttccaatttccaacaatcccctcgtccttgtcagcaacaagaaaaatcctttgacttctcttgaccagatcgctggtaaaacaacacaagaggataccggaacttctaacgctcaattcatcaataactggaatcagaaacacactgataatcccgctacaattaatttttctggtgaggatattggtaaacgaatcctagaccttgctaacggagagtttgatttcctagtttttgacaaggtatccgttcaaaagattatcaaggaccgtggtttagacctctcagtcgttgatttaccttctgcagatagccccagcaattatatcattttctcaagcgaccaaaaagagtttaaagagcaatttgataaagcgctcaaagaactctatcaagacggaacccttgaaaaactcagcaatacctatctaggtggttcttacctcccagatcaatctcagttacaataa

SEQ ID NO: 1408 - DNA (genomic), 222 bp, Streptococcus pneumoniae; double-stranded, circular
  misc_feature (B) LOCATION 1...222
  hypothetical: NO
  anti-sense: NO
tccataccacttgaaggttcgtcaaaaaagacaaatggagaattcttgcacataacagatgctattgcaagcctttgctttcgccctcctgataaactcatcggatgcctttcaataaattcgtccaggcataaatcttttaaaatgattttcgccttttcttcatcaaaattctttactcctaatctaagctcgttgaatacttcatctgtgaataattga

SEQ ID NO: 1409 - DNA (genomic), 378 bp, Streptococcus pneumoniae; double-stranded, circular
  misc_feature (B) LOCATION 1...378
  hypothetical: NO
  anti-sense: NO
ccgctcgcactcagccaagttgcgcgtggtcagaaaaattcacaagtaagagggaaaaagatggcagaaaaaatggaaaaaacaggtcaaatactacagatgcaacttaaacggttttcgcgtgtggaaaaagctttttacttttccattgctgtaaccactcttattgtagccattagtattatttttatgcagaccaagctcttgcaagtgcagaatgatttgacaaaaatcaatgcgcagatagaggaaaagaagaccgaattggacgatgccaagcaagaggtcaatgaactattacgtgcagaacgtttgaaagaaattgccaattcacacgatttgcaattaaacaatgaaaatattataatagcggagtaa

SEQ ID NO: 1410 - DNA (genomic), 249 bp, Streptococcus pneumoniae; double-stranded, circular
  misc_feature (B) LOCATION 1...249
  hypothetical: NO
  anti-sense: NO
gtccngcagnaatttgntttnnnnnngcttttttnggaatnacgtctgcttagcaagnaacgtatcacaggagctcttccaactaataagtacatcatcgaacaaggtggacgtgcaattcttttctctcaccttggacgtgtgaaagaagaagctgataaagctggtaaatcacttgctcctgtagcagcagacttggcagcaaaacttggtcaagatgttgttttcccaggtgtcactcgtggttag

SEQ ID NO: 1411 - DNA (genomic), 585 bp, Streptococcus pneumoniae; double-stranded, circular
  misc_feature (B) LOCATION 1...585
  hypothetical: NO
  anti-sense: NO
gaactaggtttgcatcaagctcaaactgtaaaagaaaataatcgtgtttcctatatagatggaaaacacgcgacgcaaaaaacggagaatttgactcctgatgaggttagcaagcgtgaaggaatcaacgccgaacaaatcgtcatcaagattacggatcaaggttatgtgacctctcatggagaccattatcattactataatggcaaggtcccttatgatgccatcatcagtgaagagctcctcatgaaagatccgaattatcagttgaaggattcagacattgtcaatgaaatcaagggtggttatgtcattaaggtaaacggtaaatactatgtttaccttaaggatgcagctcatgcggataatgtccgtacaaaagaagaaatcaatcggcaaaaacaagaacatagtcagcatcgtgaaggagggacttcagcaaacgatggtgcggtagcctttgcacgttcacagggacgctacaccacagatgatggttatatcttcaatgcatctgatatcatcgaagatacggggcgatgcctatatcgttcctcatggagatcattaccattacattcctaa

SEQ ID NO: 1412 - DNA (genomic), 1524 bp, Streptococcus pneumoniae; double-stranded, circular
  misc_feature (B) LOCATION 1...1524
  hypothetical: NO
  anti-sense: NO
aaaagacaactactatatcaaggtgccagctatcctagacgatggaggagatgcctaatgacttttaacaataaaactattgaagagttgcacaatctccttgtctctaaggaaatttctgcaacagaattgacccaagcaacacttgaaaatatcaagtctcgtgaggaagctctcaattcatttgtcaccatcgctgaggagcaagctcttgttcaagctaaagccattgatgaagctggaattgatgctgacaatgtcctttcaggaattccacttgctgttaaggataacatctctacagacggtattctcacaactgctgcctcaaaaatgctctacaactatgagccaatctttgatgcgacagctgttgccaatgcaaaaaccaagggcatgattgtcgttggaaagaccaacatggacgaatttgctatgggtggttcaggtgaaacttcatactacggagcaactaaaaacgcttgggaccacagcaaggttcctggtgggtcatcaagtggttctgccgcagctgtagcctcaggacaagttcgcttgtcacttggttctgatactggtggttccatccgccaacctgctgccttcaacggaatcgttggtctcaaaccaacctacggaacagtttcacgtttcggtctcattgcctttggtagctcattagaccagattggatcttttgctcctactgttaaggaaaatgccctcttgctcaacgctattgccagcgaagatgctaaagactctacttctgctcctgtccgcatcgccgactttacttcaaaaatcggccaagacatcaagggtatgaaaatcgctttgcctaaggaatacctcggtgaaggaattaacccagaggttaaggaaaccattctaaatgccgctaaacactttgaaaaattgggtgctattgtcgaagaagtcagccttcctcactctaaatacggagttgccgtatactacatcatcgcttcatcagaagcttcatcaaacttgcaacgcttcgacggtatccgttacggctatcgcgcagaagatgcaaccaaccttgatgaaatctatgtaaacagccgaagccaaggttttggtgaagaagtgaagcgccgtatcatgctgggtactttcagtctttcatcaggttactacgatgcctactacaagaaggctggacaggtccgtacacttatcattcaagatttcgaaaaagtcttcgcggattacgatttgattttgggtccaactgctccaagtgttgcctatgacttggattctctcaaccatgacccagttgccatgtacttagccgacctattgaccatacctgtaaacttggcaggactgcctggaatttcgattcctgctggattctctcaaggtctacctgtcggactccaattgattggtcccaagtactctgaggaaaccatttaccaagctgctgctgcttttgaagcaacaacagactaccacaaacaacaacccgtgatttttggaggtgacaactaa

SEQ ID NO: 1413 - DNA (genomic), 795 bp, Streptococcus pneumoniae; double-stranded, circular
  misc_feature (B) LOCATION 1...795
  hypothetical: NO
  anti-sense: NO
gattttaaactttccagatatgacgacagaaggtccttccctcttgggggagctgttgctgtcactttgataaccaaaggcgtgaacccatttttagcgacacttgttgctgtaggagcaggttgtttggctggaatggcagcaggccttctttatacaaaaggaaagatcccaaccttgctctcagggattttggtgatgacttctcgtcactcaatcatgctcttgattatgggacgtgcaaatttaggcctgcttggaaccaagcaaattcaggatgttttgccttttgattcggatttgaatcaactcttgacaggtctcatctttgtgagcattgttattgctctcatgctctttttcttggacactaaactcggacaagcctatattgctacaggggataatcctgatatggctagaagtttcgggattcatactggacgcatggagctcatgggcttggtcttatcaaatggtgtgattgcccttgcaggtgccctcattgctcagcaagaaggctatgccgatgtgtctcgagggatcggggttatcgttgtgggacttgcaagtttgattattggagaagttattttcaagagtttgagcttggcagagcgtttggttactatcgttgtaggttctatcgcttatcaatttttagtgtgggcagttatcgcacttggctttaatacaagttaccttcgtttatacagtgccttgattttagcagtctgcctcatgattccaacatttaagcaaacaatcttgaaaggagccaagttaagcaaatga

SEQ ID NO: 1414 - DNA (genomic), 1221 bp, Streptococcus pneumoniae; double-stranded, circular
  misc_feature (B) LOCATION 1...1221
  hypothetical: NO
  anti-sense: NO
ctgagtaaactggttgatgttgttatgattcaatctctatttaagttggaaaatagtcaaagtcttttggatgagtatgagatgatgattgtggatgagtgtcaccatatctctgccttgatgtttgaaaaagttgttgctcagcttagagggaagtatctttacggtttgacggctacgcctgagcgtaagaatggtcatgagcctattgtttttcagagaattggtgagatactccatactgctgataagagggaaacggattttaaacggcaattgcaattaagattcacttcttttggtcatttggagattgaaaagaccaaagcaagtaattttatacagctcagtgattggattgctacagactcagcgaggaatcagttgattctcaaggatattctagcccaagtggcagaaggacggaatatcttgggtttagttaatcgaattcaacagatagatgtctttgaaaagttattgaaagagaaagaggttgatgactgttacattattagcggaaaaaccaaagtccgagaaagaacgagtttactggagacgttagaacagttagataaagggtttgttttgttgtctactggaaaatacattggcgaagattttgacttacctcagttggacacgcttatcttggcagcacccttttcttggaaaaataatttaattcagtatgcaggtcggattcatagaaactacaaggataagtctttggtgcgtattttcgattatgtggatattcatgttccttatttagaaaagatgtttcagaaacgacaagtagcttatcgaaagatggattatcgtgtcatcgagggtgaggagaaacaattcgtttatgttgatagtagatatgagaaggtgttgagagaggacttagcaggggaaagacaggaatgtctgcttattttaccttatgtgcaccagacaaaactgatgaattttctaaaagaatttaggattagtcaaattgagatatgtataccagagacggttgcaaataaagcatggctagaccagttgaagagccagaaaattaaagtgtcttttactcaatcaaaaatagtaacgcctattcttttggtgaataagactattgtttggtatggtgcaatgccattattagggaaggtagatgagatgaccatattacgtttggaatcagctagtatagtttctgaactagtggcaggtttacgatag

SEQ ID NO: 1415 - DNA (genomic), 918 bp, Streptococcus pneumoniae; double-stranded, circular
  misc_feature (B) LOCATION 1...918
  hypothetical: NO
  anti-sense: NO
atggacaaactggagcaagtaaaatcttgcgtaatctctttgtgccaccaacatttgttcaagcagatggtaaaaactttggcgatatggtcaaagagaaattggtcacttatggggatgaatggaaggatgttaatcttgcagattctcaggatggtctttacaatacagaaaaaggcaaggctgagatttgctaaagctaaatcagccttacaagcagaaggagtccaattcccaattcatttggatatgccagttgaccaaacagcaactacaaaagttcagcgcgtccaatctatgaaacaatccttggaagcaactttaggagctgataatgtcattattgatattcaacaactacaaaaagacgaagtaaacaatattacatattttgctgaaaatgctgctggcgaagactgggatttatcagataatgtcggttggggtccagactttgccgatccatcaacctaccttgatatcatcaaaccatctgtaggagaaagtactaaaacatatttagggtttgactcaggggaagataatgtagctgctaaaaaagtaggtctatatgactacgaaaaattggttactgaggctggtgatgagactacagatgttgctaaacgctatgataaatacgctgcagcccaagcttggttgacagatagtgctttgattattccaactacatctcgtacagggcgtccaatcttgtctaagatggtaccatttacaataccatttgcattgtcaggaaataaaggtacaagtgaaccagtcttgtataaatacttggaacttcaagacaaggcagtcactgtagatgaataccaaaaagctcaggaaaaatggatgaaagaaaaagaagagtctaataaaaaggctcaagaagatctcgcaaaacatgtgaaataa

SEQ ID NO: 1416 - DNA (genomic), 900 bp, Streptococcus pneumoniae; double-stranded, circular
  misc_feature (B) LOCATION 1...900
  hypothetical: NO
  anti-sense: NO
ggctttttttgttacaatatctgtatgcaattcacatttacattacccgcctctctacctcaaatgacggtaaagcaattacttgaggaacaactcctcatccctagaaaaatccgtcattttttgagaatcaagaaacatattttgataaatcaagaagaagtccactggaacgaaatcgtaaatcctggagatgtttgccagttgacttttgacgaggaagattattcccaaaagacgatcccttggggcaacccagacttagtgcaggaagtttatcaagatcaacacttgattattgtaaacaaaccagaggggatgaaaacgcatggtaatcaaccaaacgaaattgcccttcttaaccatgtcagtacctatgttggccaaacctgctatgtcgttcatcgtctggacatggaaaccagtggcttagttctctttgccaaaaatccttttatcctgcccattctcaatcgcttattggagaaaaaagagatttctagagaatattgggctctagttgatggaaatatcaacagaaaagaacttgttttcagagacaaaattggacgtgatcgccatgatcgtagaaaaagaatagttgatgcaaaaaatgggcaatatgctgaaacgtatgtaagcagattaaagcaattctcaaacaagacttccttggctcattgcaagctaaagacagggcgaacccatcagattcgtgtgcacctttcgcatcataacttccctattttgggcgaccctctctataacagcaattcaaagacaagtcggcttatgcttcatgcctttcgactttcctttacccatccacttacattagaaaaattaaacttcactgccctctcaaatacttttgaaacagaattaaaaaagaatggatga

SEQ ID NO: 1417 - DNA (genomic), 681 bp, Streptococcus pneumoniae; double-stranded, circular
  misc_feature (B) LOCATION 1...681
  hypothetical: NO
  anti-sense: NO
cccgttttttggtataataagaagaataaattgaaagaaggaattccaaaaatgggaaaaattgaagttattaatcacccactgattcaacacaaattgtcaatcttgcgtcgtacagatacttctacaaaagcttttcgtgagctagtagatgagattgcaatgttgatggggtatgaagtacttcgtgatcttccactagaagatgtggaaatcgaaacaccaattacaaaaacagttcaaaaacaattggcaggtaagaaattggccatcgtcccaatcttgcgtgcaggtatcgggatggttgatggtctcttgagcttggttccagctgctaaagttggccacatcggtatgtaccgtgatgaagaaacacttcaaccagttgaatacttggtgaaattgcctgaggacattgaccaacgtcaaatttttgtagtagacccaatgttggcaacaggtggctcagcaatcttggctgttgattctcttaaaaaacgtggcgcatcaaatatcaaatttgtctgccttgtatctgctccagagggtgtaaaagcccttcaagaagctcatccagatgtagaaatctttacagcagccttggatgaacgtttgaacgaacacggttatatcgttccaggtcttggagatgctggagaccgcttgttcggtacaaaataa

SEQ ID NO: 1418 - DNA (genomic), 345 bp, Streptococcus pneumoniae; double-stranded, circular
  misc_feature (B) LOCATION 1...345
  hypothetical: NO
  anti-sense: NO
taccgaaaactagttagggggctagaggaggagcccgaaggtggcgaccgttgcaaggtttgttttgactaccgactggataaaacagcgcaagtggctatggacttgggctttgactactttggttcagccttgaccatcagtcctcataagaattctcaaactatcaatagcatcggaatcgatgtgcaaaaaatttacacgccccactattttcccaacgatttcaagaaaaatcaaggctacaaacgttcagtagagatgtgtgaggagtatgatatctatcgtcaatgttattgtggctgcgtctatgcagcccaagcccagaatattgacctggtttaa

SEQ ID NO: 1419 - DNA (genomic), 288 bp, Streptococcus pneumoniae; double-stranded, circular
  misc_feature (B) LOCATION 1...288
  hypothetical: NO
  anti-sense: NO
atatgcttttgcaactgcaacaccgtcagatgctgcgattcctttaagcatttctgtcatttcccttatgccaatccttctttttccattgtttctgagattgcagcgatagcgtcatctgcatctgcaccttcagctgagatagttacgtcagcaccttggccaacaccaagactcataacacccataattgatttaaggttaactgatttacctttgtactcaagagtgatatctgaagcaaatttgctagcagtttgtaccaacaatgttgctggacgtgcgtga

SEQ ID NO: 1420 - DNA (genomic), 315 bp, Streptococcus pneumoniae; double-stranded, circular
  misc_feature (B) LOCATION 1...315
  hypothetical: NO
  anti-sense: NO
aacagcttttggataaggtgttgctctatgacaattcatctatctagcctaggacaggtctatctcgtatgtgggaaaacggatatgaggcaaggcattgattcactggcttatctggttaaaacccactttgaattagatcctttctcaggtcaagtttttctcttttgtggtggacgtaaagaccgctttaaagccctttactgggatggtcaaggattttggctactatataaacgctttgagaacggcagactgacttggctaagtacagaaaaggatgtcaaagctctcgcacctgaacaagtagactag

SEQ ID NO: 1421 - DNA (genomic), 987 bp, Streptococcus pneumoniae; double-stranded, circular
  misc_feature (B) LOCATION 1...987
  hypothetical: NO
  anti-sense: NO
aggagaaaactcatggaagtttttgaaagtctcaaagccaaccttgttggtaaaaatgctcgtatcgttctccctgaaggggaagagcctcgtattcttcaagcaacaaaacgcttagtaaaagaaacagaagtgattcctgttttgcttggaaatcctgaaaaaattaaaatttatcttgaaattgaaggaatcatggatggttatgaggtcatcgaccctcaacattatcctcaatttgaagaaatggtttctgccttggtggagcgtcgcaagggcaaaatgactgaagaagatgtacgcaaggttttggttgaagatgtcaactactttggtgtgatgttggtttacttgggcttggttgatggaatggtgtcaggagcgattcactcaacagcttcaacagttcgcccagctctacaaatcatcaaaactcgtccaaatgtaactcgtacttcaggagccttcctcatggttcgtggtacggaacgttacctatttggagactgtgccattaatatcaatccagatgcggaagccttggctgaaattgccatcaactcagcaatcacagctaagatgtttggcatcgaacctaaaattgccatgttgagctattctactaaaggttcagggtttggtgaaagcgttgataaggtcgttgaagcaactaaaattgctcacgacttgcgtcctgaccttgaaatcgatggtgagttgcaatttgatgcggcctttgttcccgaaactgcagctctgaaagctccgggaagtacagtagctggtcaagcaaatgtcttcatcttcccaggtatcgaggcaggaaatatcggttacaagatggctgaacgcatgggtggctttgcggctgtaggacctgttttgcaaggtttaaacaagccagttaatgatctttctcgtggatgtaatgcagatgatgtttacaagttgaccctcatcacagcagctcaagcagttcatcaatag

SEQ ID NO: 1422 - DNA (genomic), 489 bp, Streptococcus pneumoniae; double-stranded, circular
  misc_feature (B) LOCATION 1...489
  hypothetical: NO
  anti-sense: NO
aagggaaaacttatggtattagattatttctttgacaaaaaccttgtgttttgcttagaagcggataatcaagaacaactctttgatcaggttgcaactttattggaagaacgagaaattgtcactccaacttatcgtgaagccttgatcacgcgtgaaaagtcatttccaactggtttagatatggaatttctaggaaaggacttgccaaatgtagcgattcctcatacagatattgttcataatctagctgagaaagtggtggttgttcgattagaaaaaccagtaacttttcacaatatgatagctcctgataaggaagtagaagtatccttgctcttctttatcatcaataactcaagttcaagtcaaacaaatattctggctcagttgatggactttttcacaggaaatggacatcttgaagacctatcaaaaatttccgaaccagaaaaactttatgcttacattgctgaagcaaccgcttaa

SEQ ID NO: 1423 - DNA (genomic), 906 bp, Streptococcus pneumoniae; double-stranded, circular
  misc_feature (B) LOCATION 1...906
  hypothetical: NO
  anti-sense: NO
ggaatgaaactgcttgttgtcggttctggtggtcgtgagcatgcgattgctaaaaagttacttgaatcaaaagacgtggaaaaagtctttgtagctcctgggaatgatgggatgactctggatggtttggaattggtaaatatctctatttccgaacattctaaattgattgacttcgcaaagaccaatgatgttgcttggacctttatcggtccagatgatgcccttgctgctggcatcgtggatgattttaaccaagctggacttaaggcctttggtccgactagggctgcagcggagctggagtggtccaaggatttcgccaaggaaatcatggtcaaatacggcgttccgacagcaatatatggcacattttcagatttcgaggaagccaaggcctatatcgaaaagcatggtgcgcctatcgtagtcaaggcggatggcttggcacttgggaagggtgtcgtcgttgctgagacggttgagcaagcggtcgaagccgctcatgagatgcttttggacaataaatttggtgactcaggtgcgcgcgtggttattgaggaattccttgaaggagaggaattttcactctttgcctttgtcaatggtgataagttctacatcatgccaacggctcaggaccacaaacgtgcctatgatggcgacaaagggcctaacacgggtggtatgggtgcctatgcgccagttccacacttaccacagagtgtagttgatacagcggttgacaccattgtcaagccagttctagaaggggtgattaaagaaggtcgtccttatctgggagttctttacgcagggcttatcctgacagctgatggaccgaagtcatcgagttcaacgctcggttcggagatccagaaactcagcttatcttgcctcgcttaa

SEQ ID NO: 1424 - DNA (genomic), 636 bp, Streptococcus pneumoniae; double-stranded, circular
  misc_feature (B) LOCATION 1...636
  hypothetical: NO
  anti-sense: NO
acgatgaaacttgaaattataaatggacagaaaatttatgggaaaagacctattttaaatcagttgaatttggtgtttcaatcaggaaaaatttatggacttaaaggtgataatggatctggcaagacggttcttttaaaggtacttgctggttatattaagcttgacaaaggaaaagttcttcaagatggtaaagtttacgggataaaaaatcattatattcaggatgcaggaattttaattgaaaaagtcgagtttttatctcatttatccctgagagaaaatttggaactgttaaggtatttttcatctaaagttacggaaaaaagaattgcctattggattcaatactatgatttacaggaatttgaagacgttgaataccggcatttatccttgggaacaaagcaaaaaatggccttgattcaagcctttatttcctctccttctatactctttctcgatgaacctatgaatgctttggatgagaagagtgtgaggttaaccaaacaggtcattttatcttacctgaaaaaagaaaatggtctggttatcctgacgtcgcacatatcggaagatatttcagacctttgtacagatgtattagttgtcgaaaatggacatatacaaatgtaa

SEQ ID NO: 1425 - DNA (genomic), 1386 bp, Streptococcus pneumoniae; double-stranded, circular
  misc_feature (B) LOCATION 1...1386
  hypothetical: NO
  anti-sense: NO
cagcgactttggtcagtgctaaaacaggggaaattctggcaacaacgcaacgacccgacctttgatgcagatacaaaagaaggcattacagaggactttgtttggcgtgatatcctttaccaaagtaactatgagccaggttccactatgaaagtgatgatgttggctgctgctattgataataatacctttccaggaggagaagtctttaatagtagtgagttaaaaattgcagatgccacgattcgagattgggacgttaatgaaggattgactggtggcagaatgatgactttttctcaaggttttgcacactcaagtaacgttgggatgaccctccttgagcaaaagatgggagatgctacctggcttgattatcttaatcgttttaaatttggagttccgacccgtttcggtttgacggatgagtatgctggtcagcttcctgcggataatattgtcaacattgcgcaaagttcatttggacaagggatttcagtgacccagacacaaatgattcgtgcctttacagctattgctaatgacggtgtcatgctggagcctaaatttattagtgccatttatgatccaaatgatcaaactgctcggaaatctcaaaaagaaattgtgggaaatcctgtttctaaagatgcagctagtctaactcggactaacatggttttggtagggacggatccggtttatggaaccatgtataaccacagcacaggcaagccaactgtaactgttcctgggcaaaatgtagccctcaagtctggtacggctcagattgctgacgagaaaaatggtggttatctagtcggggtaaccgactatattttctcggctgtatcgatgagtccggctgaaaatcctgattttatcttgtatgtgacggtccaacaacctgaacattattcaggtattcagttgggagaatttgccaatcctatcttggagcgggcttcagctatgaaagactctctcaatcttcaaacaacagctaaagctttggagcaagtaagtcaacaaagtccttatcctatgcctagtgtcaaggatatttcacctggtgatttagcagaagaattgcgtcgcaatcttgtacaacccatcgttgtgggaacaggaacgaagattaaaaacagttctgctgaagaagggaagaatcttgccccgaatcagcaagtccttatcttatctgataaagtagaggaagttccagatatgtatggttggacaaaggagactgctgagacccttgctaagtggctcaatatagaacttgaatttcaaggttcgggttctactgtgcagaagcaagatgttcgtgctaacacagctatcaaggacattaaaaaaattacattaactttaggagactaa

SEQ ID NO: 1426 - DNA (genomic), 1602 bp, Streptococcus pneumoniae; double-stranded, circular
  misc_feature (B) LOCATION 1...1602
  hypothetical: NO
  anti-sense: NO
catagactttgggctctactaggtaaagtagagctttttgttatgcactatgaacattctagaaagggaaatcatatgataaaaatcaatcatctaaccatcacacaaaacaaagatttacgagatcttgtatctgacctaaccatgaccatccaagacggggaaaaggttgctattattggtgaagaaggaaatggcaaatcaaccttacttaaaattttaatgggggaagctttgtctgatttcactatcaagggaaacatccaatctgactatcagtcactggcctacattcctcaaaaacttcccgaggagctgaaaaagaaaactttacacgactacttctttttagattctattgatttagactacagtatcctctatcgtttggcggaggaattgcattttgatagcaatcgtttcgcaagtgaccaagagattggcagtctatcagggggcgaagctttgaaaattcagcttatccatgagttagccaaaccctttgagattctatttttagatgaaccttcaaatgacctagaccttgagacagttgattggttaaaaggccaaattcaaaagaccaggcaaaccgttattttcatttcccatgatgaagactttctttctgaaacggcagacactattgttcacttgcgactggtcaaacaccgtaaagaagcggaaacgctagtagagcatttagactatgatagctatagtgagcagagaaaggctaattttgccaaacaaagtcagcaagctgctaacaaccaaagagcctacgataaaaccatggaaaaacatcggagagttaagcaaaatgtagaaactgcgcttcgagctaccaaagatagtactgccggtcgcctattggctaaaaagatgaaaactgtcctctcacaagaaaaacgctacgaaaagacagctcagtccatgactcaaaagccacttgaagaggaacaaatccaacttttcttttcagacatccaaccattaccagcttctaaagtcttagtccaactggaaaaagaaaatttgtccattgacgaccgagttttggttcaaaaactacaactaactgtccgtgggcaagaaaaaatcggtattatcgggccaaatggtgttgggaaatcaactctgttagccaaattaaagcaacttctgaatgataaaagagagatttcccttggttttatgccacaagattaccacaaaaaactgcaattggatttatcaccaatagcttatatcagcaaaactggggaaaaagaggaacttcagaaaatccactctcacctagccagtctcaatttcagttatccagaaatgcagcatcaaattcgctccttatctggcggacaacagggaaaactcctgcttttggatctagtcctgcgcaaaccaaactttctcctgctggatgaacccacacgaaacttttctcccacttctcaaccccaaatcaaaaaactctttgcaacctatccaggcggtctcatcactgtttcgcatgaccgtcgtttcttaaaagaagtctgctcgatcatctatcgcatgacagaacacggtttggagttagttaatttagaagatttataa

SEQ ID NO: 1427 - DNA (genomic), 645 bp, Streptococcus pneumoniae; double-stranded, circular
  misc_feature (B) LOCATION 1...645
  hypothetical: NO
  anti-sense: NO
aaggagaaacttatgcgagaacatcgtccaatcattgctcttgattttcctagttttgaggcggtcaaggaatttttagctctttttccagcagaagaaagcctttatctcaaggtagggatggagctttattacgcagcggggcctgagattgtgtcctacttaaaaggtttgggtcatagtgtctttttggatctcaaacttcatgacattcctaatacagtcaagtcagccatgaaggtcttgtctcagcttggtgtcgatatgactaatgtccatgcggctggtggtgtagagatgatgaaggcggcgcgtgaaggtcttgggagtcaagctaaattgatcgctgtaacgcagctgacatcaacgtcagaagcccagatgcaggagtttcaaaatatccaaaccagtctgcaagagtctgtgatttactatgccaagaagacagctgaagctggcttggatggtgttgtttgctcggctcaggaagtacaagtcatcaagcaggctaccaatccagattttatctgtctgacaccagggattcgtccagctggtgctgcagttggagatcaaaaacgagtcatgacacctgctgatgcctatcaaatcggcagtgacttcttcaccacggaggtttgggcc

SEQ ID NO: 1428 - DNA (genomic), 750 bp, Streptococcus pneumoniae; double-stranded, circular
  misc_feature (B) LOCATION 1...750
  hypothetical: NO
  anti-sense: NO
agggacatttggttcgaaatgaaatcaataattgatgtaaaaaatctttcttttcgctataaagaaaatcagaactactacgatgtgaaggatattacgtttcacgtgaaacgtggagaatggctttcgattgtagggcataatggtagtggtaaatcaacgacggttcgattaattgatggcttactggaagcagaatccggagagattgtaattgatggccaacgtttgactgaggaaaatgtttggaatatacgtcgtcaaatcggtatggtttttcaaaatccagacaatcaatttgttggagcgactgttgaagatgatgttgcttttggtttggaaaatcagggactttctcgtcaagaaatgaaaaagagagtggaagaagctctggctttagttggcatgttggactttaaaaagagagagccagcgcgtctatcaggtggccaaaagcaacgtgtggccattgcaggtgttgtagccctaagaccagctattttaatcttagatgaagcaacgagtatgttggatcctgaggggcgtagagaacttattgggacagtaaaaggaattcgaaaagactatgatatgacagtcatttctattacccatgatttggaagaaatcgccatgagtgatcgccttttggttctgagaaaaagggaaattgaatcaactagtagtccaagggagcttttctctcgaaatgatttagatacaaattggattagacgatccttttgctaa

SEQ ID NO: 1429 - DNA (genomic), 186 bp, Streptococcus pneumoniae; double-stranded, circular
  misc_feature (B) LOCATION 1...186
  hypothetical: NO
  anti-sense: NO
caagcaatttgctacgtggatccaatcggtgaacaatcgaatcccctgggatataacgccctaaaatcatactatccatttagcgactccttgaactcctctatcttaaccggtaatcgtttaaatgacacgcctctatcagccaatcgtttacaaaaggccgtaattttaggtactcccaactga

SEQ ID NO: 1430 - DNA (genomic), 468 bp, Streptococcus pneumoniae; double-stranded, circular
  misc_feature (B) LOCATION 1...468
  hypothetical: NO
  anti-sense: NO
tggctcgtttgtcaaagaggaggatttggcatgataccgaaatttagagtgtgggtaaaaataggaaaacgtatggttttttcagatgacattcttgctattgactacgaaaacaaagaaatagtgacacaacaagtttattttgagaatggtttaccagacgatagagatatctattgttatgattttgacgaaatcgaactcatgcaatcaacaggactcaaagacaagaacggcaaggaaatctttgaaggcgatattgtacgaactactagatttttgggtagagctgacgaaattggcggtttctatgagtatgacaaggaatttatagggattgttaagcagcttgagggttcttgggtaattgatacgggcagtgacgcagtatgtttatggactgaaattgaagaaaatgaaatcatcggcaacatctatgaaaataaggagtttggaggacgcaaatga

SEQ ID NO: 1431 - DNA (genomic), 1107 bp, Streptococcus pneumoniae; double-stranded, circular
  misc_feature (B) LOCATION 1...1107
  hypothetical: NO
  anti-sense: NO
atggcagtttgcctgcaggtagaagatgcggattttacaaagatagccaagaaggctggactgggtcctgaggtggctcggttattgtttgagagagggattcaggaccaagaaagtctgaagaagtttttagaaccttccttggaggacttacatgatgcttatctgctccatgatatggacaaggcagtggagcggattcgtcaggctattgaagtaagggaaaatattctcgtttatggagactatgatgcggatggcatgacttcggcttctattgtgaaggaaagtttggaacaacttggtgctgagtgccgagtttacctgccaaatcgttttaccgatggctatggccctaatgctagtgtttataaatactttatcgagcaagaaggaatttccttgattgtgacggtggacaatggggttgctggtcatgaggctattgcattggctcagtctatgggagtagatgtcattgtgacagaccatcattccatgcctgaaaccctgccagatgcttatgctattgtccatcctgaacatccagatgcggattatccttttaaatatttggctggttgtggagttgctttcaagttggcttgtgccctgttagaagaagtgcaagtggaattgcttgatttggtcgctattggaactattgcagatatggtgagtctgacggatgaaaatcgtatcttagttcaatatggtctggaaatgttgggtcatacccagcgcattggtctgcaagaaatgctggacatggctgggattgctgccaacgaagtaacagaagaaacggttggtttccagattgctcctcgtttgaatgccttgggccgcttggatgatcccaatcctgccattgatttgttgactggatttgatgatgaggaagcgcatgagattgcccttatgattcaccagaaaaacgaagagcgcaaggaaatcgttcagtctatctatgaagaagccaagaccatggtggatcctgagaagaaggttcaggtcttggccaaggaaggctggaatcctggggttctaggaatcgtggctggtcgtttattggaagaattggggacagacagtcattgttcttaa

SEQ ID NO: 1432 - DNA (genomic), 657 bp, Streptococcus pneumoniae; double-stranded, circular
  misc_feature (B) LOCATION 1...657
  hypothetical: NO
  anti-sense: NO
atcagagtttgtgaggaagatttaagcatgtcaaaacactataaacttgtattttatagccgtatcttcttgtttctagcggcttttacgggagtttatcttgaaattactaggcatggtggttttgggatgcttctctattacacggttctgtccaacctcttggtaactatttttaccctttatcttctaaaggttatgagccgtgtaggtgaaaattggcaaaggccaagtctcttgcgcttaaaaggtggggtcaccatgagtatcatgattacctgtgtgatttaccatttcctcttggcgcccattgcgactaatttctataccctagaaaatttcctttgccactatatcgttcccatctggtttttagcggataccctcttttttgacaaacagggtcaatacaagatttgggatccagcagtgtggaccattttaccctttctgtatatgatgtttgctctttttaatggcttggttctaaaactcaatattccaaatgccaaggataatcctttcccttacttctttttgaatgtgaacaagggttggaatgttgtgtttaagtggtgtctgattatctttgttgcctatatggtagcaggatttattttctactttatcaagcaaatcaagagaaagtcatcctaa

SEQ ID NO: 1433 - DNA (genomic), 621 bp, Streptococcus pneumoniae; double-stranded, circular
  misc_feature (B) LOCATION 1...621
  hypothetical: NO
  anti-sense: NO
gtagcatcttgctcgaccaagccagcattttcaaagaagaggttgttgattcgctcttcaatcttgtcgatgttttggtttttaaggactgaaatacggataacgtcttcaggtagtttcgaagtttcaatcgtttctggcaggtcggttttattaagtagaataatgcgattggtatcttggctaatttcaagaagttgtctgtcttgcgcagtcagtggttcactggcatttagcactagtagaaccaagttggcttctttgagggcttttttcgaacgctcaacaccgatttgttccactatgtcatctgtttcacgaataccggctgtatcaatcaatttgagaggtacaccattgatgttgacgtactcttcgatgacatctcgtgttgtcccagcgatatctgttacgatagccttgtcctcacgcaagaggttgttgagaaggcttgatttcccaacgttgggacgtccaatgatagccgttgaaattccttcacgaaggattttaccacgacgtgctgtcctaagaagattggttagtaattgctcaaactccattgtcttctctcggacaacagcagtagtggcttcctcaacatcgtcatactcaggatag

SEQ ID NO: 1434 - DNA (genomic), 222 bp, Streptococcus pneumoniae; double-stranded, circular
  misc_feature (B) LOCATION 1...222
  hypothetical: NO
  anti-sense: NO
tttttgtcttgttgcaactttgacaagtttagtatatcattattttttaatttttttcatccaaatcttgaattggcatcgaaacgtcttgaattagcttttttatttcaagccacctctaaatgtttaaaaaaaataatttctaatcacttttttaccattcaggaagttttaatgactattcaagatttcataaaatatgaacttagttttatggcataa

SEQ ID NO: 1435 - DNA (genomic), 420 bp, Streptococcus pneumoniae; double-stranded, circular
  misc_feature (B) LOCATION 1...420
  hypothetical: NO
  anti-sense: NO
ataaggtcttgtcgaacaaggttatgtttgatggatcttctattgaaggttttgtacgtatcaatgagtcggatatgtacttgtacccggacttggatacatggacagtcttcccttggggaagatgaaaatggaagtgttgcaggtctgatctgtgatgtctatacaacagaaggtgaaccatttgcgggtgaccctcgtggtaatttgaaacgagctcttcgtcacatggaagaagttggattcaaatccttcaaccttggtccagagccagaattcttcctatttaagttggatgaaaatggggacccaacacttgaagtgaatgacaagggtggctactttgatttggcacctactgaccttgcggacaacacacgtcgtgagattgtgaatgtcttgacccaaaatgggatttga

SEQ ID NO: 1436 - DNA (genomic), 501 bp, Streptococcus pneumoniae; double-stranded, circular
  misc_feature (B) LOCATION 1...501
  hypothetical: NO
  anti-sense: NO
gtaaggtcttgggagttgctctcaagacttatttttgaaaaggagagacagaaaatggcgatagaaaagctatcacccggcatgcaacagtatgtggatattaaaaagcaatatccagatgcttttttgctctttcggatgggtgatttttatgaattattttatgaggatgcggtcaatgctgcgcagattctggaaatttccttaacgagtcgcaacaagaatgccgacaatccgatccctatggcgggtgttccctatcattctgcccaacagtatatcgatgtcttgattgagcagggttataaggtggctatcgcagagcagatggaagatcctaaacaagcagttggggttgttaaacgagaggttgttcaggtcattactccagggacagtggtcgatagcagtaagccggacagtcagaataattttttggtttccatagaccgcgaaggcaatcaatttggcctaccttatatggatttggtgaacgggtga

SEQ ID NO: 1437 - DNA (genomic), 1368 bp, Streptococcus pneumoniae; double-stranded, circular
  misc_feature (B) LOCATION 1...1368
  hypothetical: NO
  anti-sense: NO
gttgaaccttgtggtggacgagcggctatctctactccactaggtgaaggggctattggtattgtccgcctgagcggaacagacagttttgctattgtgcaaaagatttttaaaggaaaagacttgaacaaggttgccagccacactctcaactacggtcacattattgatcctctgactggtaaagtcatggacgaggttatggttggggctatgaagtctccaaagaccttcactcgtgaggatattatcgagattaacacccacggtggtattgcggtgaccaatgagattctccagctagctatccgtgaaggagctcggttggcagaacctggtgaatttaccaaacgtgcctttttaaacggtcgcgtagatttgacacaggccgaggcggtgatggatatcatccgcgccaagacagacaaggccatgaacatcgcggtcaaacaacttgatggttccctttctgatcttatcaataatatccgtcaagaaatccttaatacacttgcccaagttgaggtcaatatcgactatcctgagtatgacgatgttgaggaagccactactgctgttgtccgagagaagacaatggagtttgagcaattactaaccaatcttcttaggacagcacgtcgtggtaaaatccttcgtgaaggaatttcaacggctatcattggacgtcccaacgttgggaaatcaagccttctcaacaacctcttgcgtgaggacaaggctatcgtaacagatatcgctgggacaacacgagatgtcatcgaagagtacgtcaacatcaatggtgtacctctcaaattgattgatacagccggtattcgtgaaacagatgacatagtggaacaaatcggtgttgagcgttcgaaaaaagccctcaaagaagccaacttggttctactagtgctaaatgccagtgaaccactgactgcgcaagacagacaacttcttgaaattagccaagataccaatcgcattattctacttaataaaaccgacctgccagaaacgattgaaacttcgaaactacctgaagacgttatccgtatttcagtccttaaaaaccaaaacatcgacaagattgaagagcgaatcaacaacctcttctttgaaaatgctggcttggtcgagcaagatgctacttacttgtcaaacgcccgtcacatttccctgattgaaaaagcagttgaaagcctacaagccgttaatcaaggtcttgagctggggatgccagttgatttgcttcaagttgacttgactcgtacttgggaaatcctcggagaaatcactggggatgctgctccagatgaactcatcacccaactctttagccaattctgtttaggaaaataa

SEQ ID NO: 1438 - DNA (genomic), 1106 bp, Streptococcus pneumoniae; double-stranded, circular
  misc_feature (B) LOCATION 1...1106
  hypothetical: NO
  anti-sense: NO
ccgaaccttgtggtgaagactgtgttgtgacatacaaaggtggacttcgtttccacccaactgtaaaccaagggatcttgaaattcctcggatttgaacaaatctttaaaaatgtcttgactggacttcctatcggtggaggtaaaggtggatcagacttcgatcctaaaggtaaaacagatgctgaagtgatgcgcttctgccaaagcttcatgactgaattgcaaaaacacatcggaccatcacttgacgtacctgctggtgatatcggtgttggtggacgtgaaattggttacctttacggtcaatacaaacgtcttaaccaatttgatgctggtgtcttgactggtaaacctcttggatttggtgggagcttgattcgtccagaagcaactggttacggtttggtttactatactgaagaaatgctcaaagctaacggtaacagctttgctggtaagaaagtcgttatttcaggttctggtaacgttgctcaatatgctcttcaaaaagcaactgaactcggtgcaactgttatttctgtttctgactcaaatggttatgtcatcgatgaaaatggtatcgacttcgatcttttggttgatgttaaagaaaaacgtcgtgctcgtttgactgagtatgcagctgaaaaagcaactgcaacctaccacgaaggtactgtatggacttacgctggaaactatgacattgctcttccatgtgccactcaaaacgaaatcaacggtgaagcagctaaacgtttggttgctcaaggcgttatctgtgtatctgaaggtgccaacatgccgagcgaccttgatgccatcaaagtttacaaagaaaatggtatcttatacggacctgcaaaagctgccaacgctggtggtgtagccgtttcagctcttgaaatgagccaaaacagtcttcgcctctcatggactcgtgaagaagttgatgaccgtctcaaagacatcatgacaaacatcttcaacacagctaaaacaacttcagaaacatacggtcttgataaagactaccttgcaggagctaacattgctgcctttgaaaatgtagcaaacgctatgattgcccaaggtattgtttaa

SEQ ID NO: 1439 - DNA (genomic), 225 bp, Streptococcus pneumoniae; double-stranded, circular
  misc_feature (B) LOCATION 1...225
  hypothetical: NO
  anti-sense: NO
ggcaagccttgtcaagcgtatcttgattggtatgctttatggggaatactaggactgacccttcctaatctctcagggattgggctactcggggatttattcgttggaggtctaaaagctgttgctcctatcctagtctttgccctcgttgccaatgccctttcccaacatcaaaagggacaagatagcaatatgaaaactgttgttttcttgtatatcctatga

SEQ ID NO: 1440 - DNA (genomic), 273 bp, Streptococcus pneumoniae; double-stranded, circular
  misc_feature (B) LOCATION 1...273
  hypothetical: NO
  anti-sense: NO
ttgtttacttgcttcatcattcatagaactactataccatattttgtttcgcaggaagtctattggaaagtaagaaatattgaagctgaggcgattagaagaaattgtgagcgtggtgctattttttcaggtaaaataaaacatcacgaagattctcagtttaaaggagaccactatgttgaatgttatgctgttttagataatacggttatagcaagagatagaataacagtccctatcgatccgttatgtggaaaagattttatagagtag

SEQ ID NO: 1441 - DNA (genomic), 195 bp, Streptococcus pneumoniae; double-stranded, circular
  misc_feature (B) LOCATION 1...195
  hypothetical: NO
  anti-sense: NO
tttcctacttggcttattatatcgctatcaatcgcttggcaaccagccaaggttacaggcttgaacgtgagctatgtagtattggacgggtcttgtttggcaattgtttttttaggggtgcacccgctagatatgctgaccattatgacgtcacttgtcgtcattgctggagtttatattattattaaagaataa

SEQ ID NO: 1442 - DNA (genomic), 924 bp, Streptococcus pneumoniae; double-stranded, circular
  misc_feature (B) LOCATION 1...924
  hypothetical: NO
  anti-sense: NO
aaaaatacttgtggaggttccattatggcaatatttttcatgatttttctgattgtttgtgtgctcctattggtgatagtcacactgagtacagtttatgtggttcgtcagcagtcggtggcgattattgaacgctttgggaaataccaaaaggttgctaatagcggtattcatattcgcttgccttttgggattgactcgattgcagcacggattcagttgcgcttgttgcaaagtgatattgtggttgagactaagaccaaggacaatgtgttcgttatgatgaatgtagcgactcagtaccgtgtcaacgagcagagcgtgacagatgcttactataaactcatacgtccagaatctcagattaaatcttatatcgaagatgctcttcgctcttctgttccaaaattaaccttggatgaattgtttgagaaaaaagatgagattgcccttgaagttcaacaccaagtagcagaagaaatgaccacttacggctacattatcgtgaaaaccttgattaccaaggtcgaaccggatgcagaagttaagcaatccatgaatgaaatcaatgcggcgcaacgtaagcgggtcgcagcacaagaattggcggaagctgacaagattaaaattgtcactgcagctgaagccgaagcagaaaaagaccgccttcatggtgtggggattgcccaacaacgtaaggcgattgtggatggattggcagagtctatcaccgaactcaaggaagccaatgttggcatgacagaagaacaaatcatgtctatcctcttgaccaaccagtatttggataccttgaatacctttgcctctaaaggaaatcaaaccatctttttaccaaatacgccaaatggtgtggatgatatccgaacacaaatcttgtcagcccttcgcgctgagaagaaataa

SEQ ID NO: 1443 - DNA (genomic), 243 bp, Streptococcus pneumoniae; double-stranded, circular
  misc_feature (B) LOCATION 1...243
  hypothetical: NO
  anti-sense: NO
atgagaacttgtcttgcccatcgaanatgggcgcttgaccttgctgagagtgtatcagacaatatcntgctaaacattcctatcaagttcttgacggctgaagaagaagctggtcaaggatttgtctcaggaaatgactggcaaatcatgacagaggaagaataccaagctcaacaagcagtaaagaaagaagaaaacagtccttttgctggcttacaaggactatttgacggagatgaataa

SEQ ID NO: 1444 - DNA (genomic), 318 bp, Streptococcus pneumoniae; double-stranded, circular
  misc_feature (B) LOCATION 1...318
  hypothetical: NO
  anti-sense: NO
cagcagacttggcagcaaaacttggtcaagatgttgttttcccaggtgtcactcgtggttagcagtttggatattttgacagagaagcggattgtcgataatctcatggctttggacaagaccttgattttcattgctcaccgcttgactattgctgagcggacagagaaagtagttgtcttggatcagggcaagattgtcnnaaaaaganagcatgctgatttgcttgcacagggtggcttttacgcccatntnnnnnnnnnnnnnnnnnnnnnnnnnnnnnnnnnnnnnnnnnnnnnnnnnnnnnnnnnnnnnnnt

SEQ ID NO: 1445 - DNA (genomic), 213 bp, Streptococcus pneumoniae; double-stranded, circular
  misc_feature (B) LOCATION 1...213
  hypothetical: NO
  anti-sense: NO
cagcagacttggcagcaaaacttggtcaagatgttgttttcccaggtgtcactcgtggtgctgaattggaagcggcaatcaacgctcttgaagatggacaagttctcttggttgaaaacactcgttacgaagatgttgacggcaagaaagaatctaaaaacgatcctgaacttggtaaatactgggcatcacttggagatggtatcttcgtaa

SEQ ID NO: 1446 - DNA (genomic), 852 bp, Streptococcus pneumoniae; double-stranded, circular
  misc_feature (B) LOCATION 1...852
  hypothetical: NO
  anti-sense: NO
ggatattattggaggggttctctaatggcatttacacttccagcaaataaaccacaagttcctaaagataccccacgaaattttttcatctacggcgaaaccatgagcggaaagtcttatcttgcaaatgaattcccaaatccaatcgttttgaacacagacgggaatgcagaagctaacactgttccaagcattcagctgatcaatgaaaaagatgacaagggacgaattaccaattcagtaattaagcagcttggagatatcttgcttgctctccagacacagaagcactcttatgaaacagtcgttattgatgtaattgacgatgttattgaaatgattaagattgcagtttgtgatgaattaaccccagttggtaaacctcgcttgaaatccttgtcggaaattccatacggcaaaggatacgacttctttaaccaagctatcacagaattagtcattgacctcaaagcattgccaatgaatgttatttacatcagccgtcaggtatctgaatatgatgacaatggcaatgccaccaaagacaagccaagcttgaaagataagtatgtcaatcttatcaatggaaactctgatttgatgatccacactgaaaaactcggcaacaactacaaccgtgaggttgaccgcaagcgtaagacctattatgcggaccaggttgatgacaaggccatcttgaaaatcttggcaactatccgtggggctgttgagcctgcaaagggcaagctagcccctaaaaaagaagcagctaagacaactaaaccagctaagaccgaaaaaacaaaagaggcacctaagaaagaagttgactctgatgatgaactattttaa

SEQ ID NO: 1447 - DNA (genomic), 192 bp, Streptococcus pneumoniae; double-stranded, circular
  misc_feature (B) LOCATION 1...192
  hypothetical: NO
  anti-sense: NO
cttttatattgttcaattactttatcaatcattttaaatgacctccactctataatttggcattatatcacaagaataaagatagtgttaaataagttatataaatgcaaaaaaggaatattccgttatagcagagttgtaacacatttctataaagaaatttattcctacgactcagtttggcatgcttaa

SEQ ID NO: 1448 - DNA (genomic), 267 bp, Streptococcus pneumoniae; double-stranded, circular
  misc_feature (B) LOCATION 1...267
  hypothetical: NO
  anti-sense: NO
gaaatatattgtagtgttttagtttcaatccgccatatgagcgatattaaggtaaatatccctggcgaatgcttgtatgacaaggtatttgttctttcatttataatttacaacatatcaataaatttaaatatagtaaatgggatattttatattcaagctaagaaagatagcatcacttttgaatggaaggctaaagagcaaactaggaagttggccatagatagctcaaaaccctgctttgaggttgtagatatagtaaaatga

SEQ ID NO: 1449 - DNA (genomic), 384 bp, Streptococcus pneumoniae; double-stranded, circular
  misc_feature (B) LOCATION 1...384
  hypothetical: NO
  anti-sense: NO
agaggagaactgatgtctcaagtaaaaggcttgtgtgttttggatgtagatggaaccttaatcctagaagaagtgattgattttttagggagagaggcaggtcatgaggcggaaatttcgcagattacaagtcgggcaatgcgaggagagttggtctttgaaagcagtttaagaaaaagagtgtccttgttggaaggtcttcctattttggtctttgataacgtcttcaactcaattcatctatcgctaaatgtcccagagttcatctctattctccaaaagaatggcatcctagttgatctggtgtctggtggatttacaccaatagttggagagattagcaaaatcccttggtattgcctatttcactgccaaccagcttga

SEQ ID NO: 1450 - DNA (genomic), 243 bp, Streptococcus pneumoniae; double-stranded, circular
  misc_feature (B) LOCATION 1...243
  hypothetical: NO
  anti-sense: NO
aagcagcattgtgctagtctagattcagtttactatactaaaacgagtagcttgaaatcaaaaaacccaccctcacaggcaggttttatctgtattattcagctagattatgctttaccttctgaaccgaatacgtcgatacgttcttcaaccgatgcttggatagcttttacaccgtcagccaagaatttacgtgggtcgaagagttttttcttgtcgtattctgcttcgtttgcttcgtag

SEQ ID NO: 1451 - DNA (genomic), 2235 bp, Streptococcus pneumoniae; double-stranded, circular
  misc_feature (B) LOCATION 1...2235
  hypothetical: NO
  anti-sense: NO
agaaaaaattgtgaggtagagatgacgatttatattaataaggacgagaccgtttttcatttggcaatgaaagatagtagttatatttttagaattttagaaaatggggaacttcaacatctacattttgggaaaaggattcatgtcaaggaaaattataaccaattgatggcctatgaaaaaagaggatttgaagtatctttttctgaagaatttgaggatattcaacagtctatgatacaaaatgaatattcttcatatgggaaaggagattttcggcatccagcctttcaagttcaaggaatgaatggtagtaggataacgacactaaaatatcaaggttttgaacttgaaaaagggaaaaatcgtcttaactctctaccttcaacatttgatgatattggtcagtgtgcggaaacattaacgattattttaacagattccatattagatttaactgttagactaaattacacaatttttccggaatacaatgtcttagttagaaatacggaatttttaaataatagcaataataagttgactcttttgaaagcaatgagcttacagctagatctacctgatagtcaatatgactttattcaattttctggagcatggctgagggaacgtcagttatatagaacttcgcttagaccaggtattcaagcaatagatagcttgagatactcatcaagtcctcagcaaaatcctttctttatgctatcaaggagggaaactacagagcatagtggtgaggtttatggttttaactttatctattctggaaattttcaaaatatgattgaagttgaccattttgacaccgctagagtaacggtaggaataaatccagtagaatttcgttttttattaaatcctgccgaaagttttgtgacaccagaagcaattgtgatctattctgatcaagggatgaatcagatgagccaacaactatcagatttttatcgacatcatttagttaatcctaatttttctcaagctagtcgtcctataatactcaatagttgggaaacattttattttgacttgggtacagaaaaaattttagatttagcaaaggctgctaaagatttagggatagaattatttgtactggatgatggttggtttggtcataggaaagatgacaaaagttctctgggggattgggtaacagatagaagtcgccttcctgaaggtattggatttcttgcagatgaaattcacaaaataggtttacaatttggtttgtggtttgagcctgaaatgatttctattgatagtgatttgtacaagaatcatgccgattggactatccatttgttagacagagagaagtcagtaggaagaaatcaatatgtgttggatttgacgagacaggaagttgttgattacctttttgattctatttctaaaatcataatcaaaacaaatctggattatatcaaatgggatatgaatcgtcatataacagatatttatagtattgaacttgattctgaacagcagatggaatttggtcatcgatatatcttaggtctttatcagttattagatcgtttaataactaagttcccttcagttctatttgaatcttgttcttcaggtggtggacgttttgatttaggacttatgtattatgcaccgcaagcgtggacgagtgatgatacggacccgatagaaagattgaaaattcagcatggaacttcttatggatattctccatcaatgatgacagcccatgtttctatttctccaaatgaacaaagtagaagacaaacgagtttggacactaggacaaatgtagcttattttagttctttcggttatgaattagatgttacgagattgtcggtagaagaaaaagaacaagtgagagaacaaattcagttttataaaaaatatcgttcattgtttcaatatggggatttctataggataaacagtccttttagttgtgattctgctagttggcaagttgtttcaaaagataaatgccaatcgattttattgtatgctcaattgaatagtaagttgaatccaggttatacaagagtttattttagtggtttagataaagataaatgctattccgtctctggatttgatgagttcttttatggagatgaattaatgaatgctggaataaaagtcagtttaagtaatttagcactatgtgttccagaatatcttacaaaattatttgttattgaggaagttgtatgtaaataa

SEQ ID NO: 1452 - DNA (genomic), 210 bp, Streptococcus pneumoniae; double-stranded, circular
  misc_feature (B) LOCATION 1...210
  hypothetical: NO
  anti-sense: NO
cctagaaattgtgtctttctagacgatattgaggacaatataatcgtagccccaaaattaggaatcaagacttatcaggttaagaaaagaagtgatgttgttgatattttaaacaatttatttaaactaaaaactctctatctattaatccgagattcccctctcggattttgtgttgctttcattaaatttacaggtaagacttgctag

SEQ ID NO: 1453 - DNA (genomic), 405 bp, Streptococcus pneumoniae; double-stranded, circular
  misc_feature (B) LOCATION 1...405
  hypothetical: NO
  anti-sense: NO
aaggagaattggcagatggcgactactgagttgattgaactggcaattgaaaccagcaaacatgcctatgtcccctattctcactttcctatcggagcagttttagtagccaaagacggaaatgtttacacgggagtgaatatcgaaaatgttagctatcctttgaccaattgcggtgagagaacagctatttttaaggctatatctgaaggccaaagagaattttcagaattgattgtctatggtcaaactgaaaaaccgatttcaccatgtggtgcttgtcgccaagtaatggtcgaattttttgaacaagatttaaaagtgaccttagtcgcaaaagataaatcgacggtcgagatgacggtcggggagttacttccatattcttttacagacttaaattag

SEQ ID NO: 1454 - DNA (genomic), 735 bp, Streptococcus pneumoniae; double-stranded, circular
  misc_feature (B) LOCATION 1...735
  hypothetical: NO
  anti-sense: NO
caggattgttgggtagggtnttcttattcatccaaggcagcggcgacggttcatttccgtgcagaccatgtggtcagcggtacggtattgaacttgatggcgcctgccttggctgttttcttagttaaagttctttataacaaaggacaaaccgacaacctaagtcaaacttttggacgctttgatttcccagtcttggcaaatatcccagtgattggtgatatcttcttcaagtcaactagtctacttggttatctggcgattgccttctcattccttgcttggtttattctctttaagactcaatttggtcttcgtcttcgctctgtcggtgaacatcctcaagcagcggataccttgggaatcaacgtctacaagatgagatatttagggattattatttcaggttttctaggtggaattggcggagcgatttatgcgcaatcaatctcagttaacttctcagtgacaactattgttggacctggatttatcgcccttgctgcgatgatctttgggaaatggaatccaatcggtgctatgctttctagtctcttctttggactttcacaaagtttggctgttatcggttctcaattgccgttcctacaaggagtgccagcggtttatcttcaaattgcaccttatgttttgacaattcttgtcttagcagccttctttggaaaagcagtcgcaccaaaagcagatggtatcaactacatcaaatcaaaataa

SEQ ID NO: 1455 - DNA (genomic), 2640 bp, Streptococcus pneumoniae; double-stranded, circular
  misc_feature (B) LOCATION 1...2640
  hypothetical: NO
  anti-sense: NO
ccaactcgttgtgaagacggaaaagaactcgttgctgaaaaacacgtagatgagttggttcaaaaagctctagttgcccttgaagaaatgcgtaaattggatcaagagcaagttgactacatcgttgccaaagcatcagtagcagctttggatgcccacggagaattggctttacatgcctttgaagaaacaggacgtggtgtatttgaagacaaagcaactaagaacttgtttgcctgtgaacacgtagtaaacaacatgcgccacactaagacagttggcgttatcgaagaagacgatgtaacaggattgactcttattgctgaaccagttggtgttgtttgtggtattactccaacaacaaacccaacatcaacagcaatcttcaaatcattgatttcattgaagacacgtaacccaatcgtctttgccttccatccatcagcacaagaatcatctgctcatgcagctcgtatcgtccgcgatgcagctatcgcagctggtgctcctgaaaactgtgtgcaatggattactcaaccatctatggaagcaacaagtgcccttatgaaccacgaaggtgttgcgacaatccttgcaacaggtggtaatgccatggttaaggcggcttattcatgtggtaaaccagctcttggggtaggtgccggaaacgttccagcttatgttgaaaaatcagcaaacattcgtcaagcagcacacgatatcgtcatgtctaaatcatttgataacggtatggtctgtgcatctgaacaagcagttatcattgataaagaaatttacgatgaatttgtagcagagttcaaatcttaccacacttactttgtaaacaaaaaagaaaaagctcttcttgaagagttctgcttcggcgtcaaagcaaacagcaaaaactgtgctggtgcaaaattgaacgctgacatcgttggtaaaccagcaacttggattgcagaacaagcaggatttacagttccagaaggaacaaacattcttgctgcagaatgtaaagaagttggcgaaaatgagccattgactcgtgaaaaattgtcaccagttattgcagttttgaaatctgaaagccgtgaagatggtattactaaggctcgtcaaatggttgaatttaacggtcttggacactcagcagctatccacacagctgacgaagaattgactaaagaatttggtaaagctgttaaagctattcgtgttatctgtaactcaccttctacttttggtggtatcggggacgtttacaatgccttcttgccatcattgacacttggatgtggttcttacggacgcaactcagttggggataacgttagtgccattaacctcttgaatatcaaaaaagtcggaagacggagaaataacatgcaatggatgaaacttccttcaaaaacatactttgaacgtgattcaattcaataccttcaaaaatgtcgtgacgttgaacgtgtcatgatcgttactgaccatgccatggtagagcttggtttccttgatcgtatcatcgaacaactggaccttcgtcgcaataaggttgtttaccaaatctttgcggatgtagaaccggatccagatatcacaactgtaaaccgtggtactgagattatgcgtgccttcaaaccagataccatcatcgcactcggtggtgggtctccaatggatgctgccaaagtaatgtggctcttctacgagcaaccagaagtggacttccgtgaccttgtccaaaaattcatggatatccgtaaacgtgccttcaagttcccattgcttggtaagaagactaaattcatcgcgattccaactacatctggtacaggatctgaagtaacaccatttgccgttatctctgataaagcaaacaaccgtaaatacccaatcgctgactactcattgacaccaactgtggcaatcgtagatcctgctttggtattgacagttccaggatttgttgctgctgatactggtatggacgtattgactcacgcgacagaagcatacgtatcacaaatggctagtgactacactgatggtttagcacttcaagccattaaattggtctttgaaaatctcgaaagctcagttaagaatgcagacttccactcacgtgagaaaatgcataacgcttcaacaatcgctggtatggcctttgccaatgccttcctaggtatttctcactcaatggcccataagattggtgcgcaattccacacaatacacggtcgtacaaatgctatcttgcttccatacgttatccgttacaacggtacacgtccagctaagacagcaacatggcctaagtacaactactaccgtgcagatgaaaaataccaagatatcgcacgcatgcttggacttccagcttctactccagaagaaggggttgaatcttacgcaaaagctgtctacgaactcggtgaacgtattgggatccaaatgaattttagagaccaaggaattgacgaaaaagaatggaaagaacattctcgtgaattagccttcctggcttatgaagaccaatgttcaccagctaacccacgtcttccaatggtagaccatatgcaagaaatcatcgaagatgcatactatggctacaaagaaagaccaggacgccgtaaataa

SEQ ID NO: 1456 - DNA (genomic), 834 bp, Streptococcus pneumoniae; double-stranded, circular
  misc_feature (B) LOCATION 1...834
  hypothetical: NO
  anti-sense: NO
cagagaggttgtttatttatgaaatcaaaaaaatggatatttgttttatgtaattttcttgcaagtttcttcttagtagcttgccagtcaggttctaatggttctcagtcagctgttgaggccattaagcaaaaggggaaattagttgtggcaaccagtcctgactatgcaccctttgaatttcaatcattggttgatggaaagaaccaggtagtcggtgcagacatcgacatggctcaggctatcgctgatgaacttggggttaagttggaaatctcaagcatgagttttgacaatgttttgaccagtcttcaaactggtaaggctgacctagcagttgcaggaattagtgctactgacgagagaaaagaagtctttgatttttcaatcccatactatgaaaacaagattagtttcttggttcgtaaggctgatgtggaaaaatacaaggatttaactagcctagaaagtgctaatattgcagcccaaaaagggactgttccagaatcaatggtcaaggaacaattgccaaaagctcaattaacttccctaactaatatgggtgaagcagtcaatgaattgcaggctggaaaagtagatgctgttcatatggatgagcctgttgcacttagttatgctgctaaaaacgctggcttagctgtcgcaactgtcagcttgaagatgaaggacggcgacgccaatgccgttgctcttagaaaaaatagtgatgatttgaaagaagtggtagacaaggtcatccaaaaacttaaggatgaaggaatttaccaaagctatcttgaaaaagcagcaagtctaactgaagttgaagaataa

SEQ ID NO: 1457 - DNA (genomic), 249 bp, Streptococcus pneumoniae; double-stranded, circular
  misc_feature (B) LOCATION 1...249
  hypothetical: NO
  anti-sense: NO
tgttttttctgtatttttagggacatctggctggacttctttttcagtcttattagcttcggctgctggcttagactcatccccttggttagttgcttcgggctttgcttctgtttccttgtcagacttaggttttgcttctgcagatggtgtttctgcaaccacctcacttgctttttcctctggtttagctgcgctagctgcttctgcagtttcagatgctgtcgctactccttctgccttttctag

SEQ ID NO: 1458 - DNA (genomic), 201 bp, Streptococcus pneumoniae; double-stranded, circular
  misc_feature (B) LOCATION 1...201
  hypothetical: NO
  anti-sense: NO
ctgcctctctggactgctttaaaggttttttactattctattatttctactagcacttgtcaagtaaaaacatggtcactaaagaactataagagaaaaagtaaacctagcgacgcgatgagcgctgggtcgtttggtttcgattgctctcttcctcttgttttttctgttcttcttcttgttttttctcagcttccttag

SEQ ID NO: 1459 - DNA (genomic), 671 bp, Streptococcus pneumoniae; double-stranded, circular
  misc_feature (B) LOCATION 1...671
  hypothetical: NO
  anti-sense: NO
gcacactctgtgatactgatggctccccctgtagaacatggtactacctaaacagcaatggcgctatggcgacaggatggctccaaaacaatggttcatggtactatctaaacgctaatggttcaatggcaacaggatggctccaaaacaatggttcatggtactatctaaacgctaatggttcaatggcaacaggatggctccaaaacaatggttcatggtactacctaaacgctaatggtgatatggcgacaggatggctccaatacaatggttcatggtactacctaaacgctaatggtgatatggcgacaggatggctccaatacaatggttcatggtactacctaaacgctaatggtgatatggcgacaggatggctccaatacaatggttcatggtactacctaaacagcaatggtgctatggtaacaggatggctccaaaacaatggctcatggtactacctaaacgctaacggttcaatggcaacaggttgggtgaaagatggagatacctggtactatcttgaagcatcaggtgctatgaaagcaagccaatggttcaaagtatcagataaatggtactatgtcaatggctcaggtgcccttgcagtcaacacaactgtagatggctatggagtcaatgccaatggtgaatgggtaaactaa

SEQ ID NO: 1460 - DNA (genomic), 687 bp, Streptococcus pneumoniae; double-stranded, circular
  misc_feature (B) LOCATION 1...687
  hypothetical: NO
  anti-sense: NO
aaatcgacctgtcttaaaggatattacttgttcaattttcaaggggcaaaaattgcttttgttggaccatctggatcaggaaaatcaacgattgtgcgtttgttagagcggttttataaaccgctttcaggagatattctaatggagcaatcaagtatatatgattttaacttaaaagaatggagaagtaaaatcgcttgggtttcacaaaataatgcagtcttatctggcagtattcgtgacaatctttgtctcggtttgaatcgcttagtaactgatgatgaattgatgaaagtgctagacttagtatcactaggtgatgagattcgctccatgaaagagggactagatactgaagttggtgaacgcggacgattcttgtcaggggggcaaagccaaagacttcaaatagctagaacctacttaaaagatgctgaaattcttatatttgatgaagctactgctaatcttgatgcggattctgagtatgcgattatcagtagcctctattctgtattaaaggagaagacggttgtgattatagcgcatagtttgtcaacggtaaaagatgtggattgtattttcttcttagaggaggggaaaatcactggctcaggaactcataaggaactactggaaaatcatgagcgttatgctcgttttgtgcaggagcaaatgatagagtga

SEQ ID NO: 1461 - DNA (genomic), 231 bp, Streptococcus pneumoniae; double-stranded, circular
  misc_feature (B) LOCATION 1...231
  hypothetical: NO
  anti-sense: NO
tttgggcactgtctcaacgagagactcggtgaaattttagtacctgtgaagatgcaggttacccgcgacaggacggaaagaccccatggagctttactgcagtttgatattgagtgtctgtaccacatgtacaggataggtaggagtctaagagatcgggacgccagtttcgaaggagacgctgttgggatactacccttgtgttatggccactctaacccagataggtga

SEQ ID NO: 1462 - DNA (genomic), 231 bp, Streptococcus pneumoniae; double-stranded, circular; identical to SEQ ID NO: 1461
  misc_feature (B) LOCATION 1...231
  hypothetical: NO
  anti-sense: NO

SEQ ID NO: 1463 - DNA (genomic), 231 bp, Streptococcus pneumoniae; double-stranded, circular; identical to SEQ ID NO: 1461
  misc_feature (B) LOCATION 1...231
  hypothetical: NO
  anti-sense: NO

SEQ ID NO: 1464 - DNA (genomic), 318 bp, Streptococcus pneumoniae; double-stranded, circular
  misc_feature (B) LOCATION 1...318
  hypothetical: NO
  anti-sense: NO
aaggtcaactggatgatattgccagtcacttggatcaagctcgccagcagaatgaggagtggatgcccaagcaaacacgtgctgaagccaagaaagaaaaggtcagcgagcgtgcgccatctacaaaatcaattaacagaccagtaccagattagctatactgaagcactagaaaaggcacatgaattggaaaacctcaatctggcagagcaagaggtgcaggatttagagaaggctattcgctcattgggacctgtcaacttggaagctattgaccagtacgaagaagttcacaaccggtctggactttctaaatag

SEQ ID NO: 1465 - DNA (genomic), 597 bp, Streptococcus pneumoniae; double-stranded, circular
  misc_feature (B) LOCATION 1...597
  hypothetical: NO
  anti-sense: NO
agtttgaactgcaccccaaaagttagacagaaaaaatctaacttttggggtgtttttattatgaaattaacttatgatgataaagttcagatctatgaacttagaaaacaaggatatagcttagagaagctttcaaataaatttgggataaataattctaatcttaggtatatgattaaattgattgatcgttacggaatagagttcgtcaaaaaagggaaaaatcaatactattctccagaactaaaacaagaaatgattgataaagttttacatgcaaactggtctcaagatagagtttctctcaaatatgctctcccaaatcgtggtatgcttccaaattggctggcgcaatataagaaaaacgggtatactattgttgagaaaacaagagggagaccagctaaaatggaacgtaaacgaaagaaaacttgggaagaaatgacagaattagaacgacttcaagaggagaatgaacgcttacggactgaggtggcttacttaaaaaagttaaaagagttagaggaaagggacgaagccctagagcgagaaaggcagaaacagttagagaaatggtttcaggaggatttcgactag

SEQ ID NO: 1466 - DNA (genomic), 678 bp, Streptococcus pneumoniae; double-stranded, circular
  misc_feature (B) LOCATION 1...678
  hypothetical: NO
  anti-sense: NO
aaagaagactgtatggataatcgaccaattggttttttggattcgggtgtcgggggcttgaccgttgtgcgcgagctcatgcgccagcttccccatgaagaaatcgtctatattggagattcggcgcgggcgccctatggcccccgtcctgctgagcaaattcgtgaatatacttggcagctggtcaactttctcttgaccaaggatgtcaaaatgattgtcattgcttgtaacactgcgactgcggtcgtctgggaagaaatcaaggctcaactagatattcctgtcttgggtgtaattttgccaggagcttcggcagccatcaagtccagtcaaggtgggaaaatcggagtgattggaacgcccatgacggtacaatcagacatataccgtcagaaaatccatgatctggatcccgacttacaggtggagagcttggcctgtcccaagtttgctcccttggttgagtcaggtgccctgtcaaccagtgttaccaagaaggtggtctatgaaaccctgcgtcccttggttggaaaggtggatagcctgattttgggctgtactcattatccactccttcgccctattatccaaaatgtgatggggccaaaggttcagctcatcgatagtggggcagagtgcgtacgggatatctcagttcttactcaattattttga

SEQ ID NO: 1467 - DNA (genomic), 279 bp, Streptococcus pneumoniae; double-stranded, circular
  misc_feature (B) LOCATION 1...279
  hypothetical: NO
  anti-sense: NO
ttcggagactggaaggacgtggctccgcttcttgaaggtttggtagaaaatcaagattatgttgtcgagcaagatgctcgtaattctgcagttcctttgctagataagcgtgctatcaacgctcgtatcgagccaggtgctattatccgtgaccaggtggaaattggtgacaatgctgttatcatgatgggagctgttatcaatatcggtgctgaaatcggtgctggaaccatgattgacatgggtgccatccttggtggccgtgccatcgttggataa

SEQ ID NO: 1468 - DNA (genomic), 414 bp, Streptococcus pneumoniae; double-stranded, circular
  misc_feature (B) LOCATION 1...414
  hypothetical: NO
  anti-sense: NO
aaaagatgctgccggaactgtgacagtgttggaagggagacaataatgaatcaagaagaattagctaagaaaatgttgcttccatcaaagaattctcgtctggagaaattaggaaaaggtttgacctttgcctgtctttctttgatagtcatccttgtggccatgattttggttttcgtagcgcaaaaaggcttgtcgaccttctttgtcaatggtgtgaatatctttgactttcttttgggaggaacttggaatccttctagtaaagaatttgggtgcccttcctatgattttgggttcctttatcgttaccattctctcagcccttatcgcaacaccctttgctattggtgcagcagtttttatgaccgaagtatcaccaaaaggggcgaagattttgcaaccagctattga

SEQ ID NO: 1469 - DNA (genomic), 1287 bp, Streptococcus pneumoniae; double-stranded, circular
  misc_feature (B) LOCATION 1...1287
  hypothetical: NO
  anti-sense: NO
cgctatcgctgcaatctcagaaacaatggaaaaagaaggattggcataagggaaatgacagaaatgcttaaaggaatcgcagcatctgacggtgttgcagttgcaaaagcatatctactcgttcagccggatttgtcatttgagactattacagtcgaagatacaaacgcagaagaagctcgccttgatgccgctctacaggcatcacaagacgagctttctgttattcgcgagaaagcagtaggtacgctcggtgaagaagcagctcaagtttttgatgctcacttaatggttcttgctgacccagaaatgatcagccaaatcaaggaaactatccgtgcgaagaaagtgaatgcagaagcaggtctgaaagaagttacagatatgtttatcactatctttgaaggcatggaagacaacccatacatgcaagaacgcgcagcggatatccgcgatgtgacaaaacgtgtattggcaaaccttcttggtaaaaaattgccaaacccagcttctatcaatgaagaagtgattgtgattgcacatgacttgacaccatctgatacagctcaattggacaaaaactttgtaaaagcttttgtaaccaacatcggtggacgtacaagccactcagctatcatggcacgtacacttgaaattgcagctgtattaggtacaaacaacatcactgaaatcgttaaagacggtgacatccttgctgttaacgggatcactggtgaggttattatcaacccaactgatgaacaagcggcagaatttaaagcagctggtgaagcttatgcgaaacaaaaagctgaatgggcgctcttgaaagatgctcaaacagtgactgctgacggtaaacacttcgagttggctgctaatatcggtactccaaaagacgttgaaggtgttaacaacaacggtgcagaagctgttggactttaccgtacagagttcttgtacatggattctcaagacttcccaactgaagatgagcagtatgaagcatacaaggctgttcttgaaggaatgaacggtaaacctgttgtcgttcgtacaatggatatcggtggagataaggaacatccttacttcgatatgcctcacgaaatgaacccattccttggattccgtgctcttcgtatctctatctctgagactggagatgctatgttccgcacacaaatccgtgctccttcttcgtgcgtctgttcacggtcaattgcgtatcatgttcccaatggttgcgctcttgaaagaattccgtgcagcgaaagcagtctttga

SEQ ID NO: 1470 - DNA (genomic), 240 bp, Streptococcus pneumoniae; double-stranded, circular
  misc_feature (B) LOCATION 1...240
  hypothetical: NO
  anti-sense: NO
ctggagagctggagatgctctcggacgaggagaatcctagctgatatagaagctaatatgggcatggtaatcgaaggaatttcaacgactcgagcagcctatgaactagcccaagaacttggagtctatatgcccattacacaggctatttaccaagttatttatcacggaaccaatatcaaagatgccatttatgacatcatgaacaatgaatttaaagcagaaaatgagtggtcttaa

SEQ ID NO: 1471 - DNA (genomic), 1134 bp, Streptococcus pneumoniae; double-stranded, circular
  misc_feature (B) LOCATION 1...1134
  hypothetical: NO
  anti-sense: NO
ggaggtggctgtatgaaaaaagtgaagttgggggaagtcttatctctaaaaaaaggcaagaaagccactgtacttgctgaacaaacaactctaagccaacgttatattcaaatagatgatttaagaaataataataatttaaaattcactgaaagtttaaatatgactgaagcacttccagatgatattctaatagcatgggatggtgctaatgcaggaacagttggttatggattatcgggagctgttggtagtacaattacggtcttaaaaaagaatgagcgatacaaagaaaaaattatatcagattacttgggagtctttttggaaagtaaatcgcagtatttacgagatcattcaacaggtgcaactattcctcatttaaacaagaatatattacttgatttacaattagaattgctaggtatcgaagaacaagagaacattatctgtattcttaatacgattaaaaggcttattactaaaagaaaatttcagttagatgaactaaacttgctcgtcaaatcccgatttaacgagatgtttggggaaaataaaatatttgaaagcattgataacttatttgatattatagatggtgataggggcaaaaattatcctaaatcagatgagttgtttagtgaggagtactgtttatttttaaatacaaagaatgttactaaaaacggattttcattcgatacaaagcaatttatcactaaaacaaaggataaattacttcgaaaaggcaaacttgagcgttatgatatagtcttgacaacaagaggtactgttggaaatgtagcgtactacgatgaattaataaaatataaacatttacgtataaattcaggtatggtaatattacgtcccaagacaccaaatctaaatcagaaatttattatccatgttttaagaaataataattatagtcgagtgatatcaggaagtgctcagcctcagttaccaattacaaaattaaaaaaaatacttctccccctccccccactagccctccaaaatgagttcgcagactttgtagttcaggtcgacaaatcacaattggcaatccaaaaatctctggaagaacttgaaactttgaagaaatctctgatgcaggagtattttggctga

SEQ ID NO: 1472 - DNA (genomic), 498 bp, Streptococcus pneumoniae; double-stranded, circular
  misc_feature (B) LOCATION 1...498
  hypothetical: NO
  anti-sense: NO
catgaaggctggactaaagatagagtttctcttgaatactgtctcccaagtcgtacgatacttcttaactggctagcacaatacaggaaaaacgggtatactattgttgagaaaacaagagggagagtacctgagagcggaaaatgccatcctaaaaaagttaagagaactccgattgaaggaggaaaaagagaaagaagaaagacagaaattgttcaagaattaattactgagttttcgttagatcttcttctaaaagccattaaactagctcgttcgacctactactatcacttgaaacagctagataaaacagataaggaccaagagcttaaagctgaaattcaatccatttttatcgaacacaagggaaattatgcttatcgtcggatttatttagaactaagaaatcgtgcttatctggtaaattataaaagagttcaaggcttgatgaaagtactcaatttacaagctaaaatgcgacagaaacgaaaataa

SEQ ID NO: 1473 - DNA (genomic), 498 bp, Streptococcus pneumoniae; double-stranded, circular
  misc_feature (B) LOCATION 1...498
  hypothetical: NO
  anti-sense: NO
catgaaggctggactaaagatagagtttctcttgaatactgcctcccaagtcgtacgatacttcttaactggctagcacaatacaggaaaaacgggtatactattgttgagaaaacaagagagagagtacctgagatcggagaatgccatcctaaaaaagttaagagaactccgattgaaggaggaaaaagagaaagaagaaagacagaaattgttcaagaattaatgactgagttttcgttagatcttcttctaaaagccattaaactagctcgttcgacctactactatcacttgaaacagctagacaaaccagataaggaccaagagcttaaagctgaaattcaatccatttttatcgaacacaagggaaattatgcttatcgctgtattcatttagaactaagaaatcgtggttatctggtaaatcataaaagagttcaaggcttgatgaaagtactcaatttacaagctaaaatgcgacagaaacgaaaataa

SEQ ID NO: 1474 - DNA (genomic), 498 bp, Streptococcus pneumoniae; double-stranded, circular
  misc_feature (B) LOCATION 1...498
  hypothetical: NO
  anti-sense: NO
catgaaggctggactaaagatagagtttctcttgaatacggtctcccaagtcgtacgatacttcttaactggctagcacaatacaggaaaaacgggtatactattgttgagaaaacaagagggagagtacctgagagcggagaatgccatcctaaaaaagttaagagaactccgattgaaggaggaaaaagagaaagaagaaagacagaaattgttcaagaattaatgactgagttttcgttagttcttcttctaaaagccattaaactagctcgttcgacctactactatcacttgaaacagctagacaaaacagataaggaccaagagcttaaagctgaaattcaatccatttttatcgaacacaagggaaattatgcttatcgctgtattcatttagaactaagaaatcgtgcttatctggtaaatcataaaagagttcaaggcttgataaaagtactcaatttacaagctaaaatgcgacagaaacgaaaataa

SEQ ID NO: 1475 - DNA (genomic), 303 bp, Streptococcus pneumoniae; double-stranded, circular
  misc_feature (B) LOCATION 1...303
  hypothetical: NO
  anti-sense: NO
catgaaggctggactaaagatagagtttctcttgaatacggtctcccaagtcgtacgatacttcttaactggctagcacaatacaggaaaaacgggtatactattgttgagaaaacaagagggagagtacctaaaatgggacgtaagccaaaaacgatacctgaagagaggacagaattagaacatcttcaagcagaaaatgagtacctgagagcggagaatgccatcctaaaaaagttaagagaactccgattgaaggaggaaaaagagaaagaagaaagacagaaattgttcaagaattaa

SEQ ID NO: 1476 - DNA (genomic), 303 bp, Streptococcus pneumoniae; double-stranded, circular
  misc_feature (B) LOCATION 1...303
  hypothetical: NO
  anti-sense: NO
catgaaggctggactaaagatagagttttttttgaatacggtttcccaagttgtacgataatttttaactggttagcacaatacaggaaaaacgggtataatattgttgagaaaacaagagggagagtacctaaaatgggacgtaagccaaaaacgatacctgaagagaggacagaattagaacgttttcaagcagaaaatgagtacctgagagcggagaatgccatcctaaaaaagttaagagaactccgattgaaggaggaaaaagagaaagaagaaagacagaaattgttcaagaattaa

SEQ ID NO: 1477 - DNA (genomic), 2379 bp, Streptococcus pneumoniae; double-stranded, circular
  misc_feature (B) LOCATION 1...2379
  hypothetical: NO
  anti-sense: NO
tttattttatggagaagtagatttttagaatgcggagggttcaatatggttgagtttataaagtctaagaaagaaatgagtgaggaggatattaaagcaaatttcatcactcctgctattgtatccaaaggatggaaaaatggtgagcatatcgcttacgaagaatacttcactgatggtcgaattgaggttagaggagataaggctcgtcgtaaagaaggaaaaaaatcagactattcactgtattaccaatttggaactcgaattgcaattgttgaggcaaaggataataaacacagcgttcgagcaggattacaacaagctattgaatatggagagattttagatgttccatttgtttattcttcgaatggtgatggctttattgaacacgaccgtatcacgagagaagaacgtgagctggagttagacgaattccctactcgtgaagaattattttctcgtatgacgaaggaaaaaggattgacgtacgaaattacagaagctatctcaactccatactatacagacgccttctcaatgaaaacgccacgctattatcagcaaatagctatcaaccgtactattgaaacagttgccagaggacaaaaacgagtaatgtttgtgatggcaacaggaacggggaaaacgttcatggcttttcaaattattcatcgccttcgaaaagctggtttggctaaacgagttttattcttagcggatagaaacatcttagtagaccaaacgatggctgaagactttaggccattcgaaaaggtaatgacgaaaattacaccaaaacttttgactgctcctgaaaaattaaattcttttgaaatttatctagggctttatcagcaactaactggtgaagatggaactgaaacacattatcaaaaatttgacaaagacttctttgatttaatcgtaattgatgaagcgcaccgtggttcagctaaggaaaacagtaactggcgtaagataattgattatttcagttctgcgacacagattgggatgaccgctactcctaaagaaaccaagaatgcttccaatacggaatactttggtgagccaatctatacttatagtttaaaacagggaatcgaggatggttttttggctccatatcgtgttatgagagttaatttagatgtagatgtggatggttatcgtccagaaactggaaaagttgatgctaacggacaattaatagaagataggtactacggcaggaaagattttgataaaaccattgtcattgatgatagaacgcaaagagttgccaagtttgtttctgattatatgaagcaaaacaatgcacgatttgataaaacaattgttttttgtgttgatattgaccatgccgagcgaatgcgtgctgcacttgtaaaagagaatctagacttagtccaagaagactatcgttatgtcatgcaagtaactggtgacaacgctgaaggaaaagctcaactggataactttatggatgtcaattctaattttcccgctattgtaacaacgtctaaattattaacgacaggagttaatgctaaaacatgtcgtttgattgttttagactctaatatccaatccatgactgaatttaaacaaattattggtcgtggcacacgtctttatcctcaaaaggggaaagaattttttacgattattgattttcgaaatgttaccaatttgtttgctgaccctgattttgatggtgatccagtgaaggtgctggaaacaggtgcgaaaacagtcagtggttctacgcccggtttcgtaggtgaggaaggtgacccagtagaaaaatatatcgttacagacaagcaggttaccattcttaattctactgttcaagtattggatgaaaacgggaaactgattaccgaaagcctgaccgactacactcgaaagaatatcttaggtagctacgccactttgaacgattttatcacagtttggcatacggcagataaaaagaagcttatcttagacgaactttataaaaaaggagtttatctagatgctattcgagagtcggagggaatatcagaacaagaaatcgatgattttgatttactcctaaaacttgcctatggtcaaaaagaattaaccaaaacggaacgtatcaataaactcaaacaaagcggatatttatataaatatagtgaggaagcgcgtgctgttttggaaattttactgaacaaatacatggataaaggtattggagaactcgaaagcattgaaacattaaaacttccagaatttcagatatatggtggaaccttcaaaatcatcaatacttattttggagataaaaaacgatatttacaagcaattaaagaattggagcaagagctatttacagtagcttaa

SEQ ID NO: 1478 - DNA (genomic), 387 bp, Streptococcus pneumoniae; double-stranded, circular
  misc_feature (B) LOCATION 1...387
  hypothetical: NO
  anti-sense: NO
aagcatttatgggtagtgagaatgattgatcattttgagattaaggtaaaggatttacaaatttcagaaggattttataggagttttctcgctcctttggactataaattggcttttaagactagttctctaattagttttctatccccgaacagccctcatcctggtggtgatttttggctgactcagggaacacaagatcctgttcattttgcttttttagcagaaaataaggaagaagttcaggcttgttatgaggctggcatagaggcaggtgggcgagacaatggggttcctggttatcgaagtgagcatccgatttactatgctgcttttatgattgacctggatgggaacaatatagaggtggtttgccataaagaataa

SEQ ID NO: 1479 - DNA (genomic), 591 bp, Streptococcus pneumoniae; double-stranded, circular
  misc_feature (B) LOCATION 1...591
  hypothetical: NO
  anti-sense: NO
atgaatttatgggatattttctttacgactcaggcaaccgagccgcccaaatttgaccttttttggtatgttagcctatttacgctcttagccttaaccttttatacagcccatcgctatcgtgaaaagaaggtttaccaacgatttttccaaatcttgcagactgttcagttaatccttctttatggttggtactgggtcaatcatatgccactgtcagaaagcctacccttttaccattgccgtatggctatgtttgtggtactcttgcttcctggtcagtccaaatataaacaatactttgcattattgggaacatttgggacattagcagcctttgtttatccagtgccagatgcttacccttttccacatatcaccattctatcctttatctttggtcatttagcactcttggggaactctctagtttatctattgagacagtataatgcgcgattgctggatgtgaagggaatttttctcatgacctttgccctaaatgccttgatttttgtggtcaatttggtgacaggtggcgattacggatttttgacaaaaccgcccattggttgggggatcacgttctag

SEQ ID NO: 1480 - DNA (genomic), 861 bp, Streptococcus pneumoniae; double-stranded, circular
  misc_feature (B) LOCATION 1...861
  hypothetical: NO
  anti-sense: NO
atggatttatggttttctgaagttcatactccagatgtcaaattgtctctgagaacagccaagcaactttacgctggaaaaagtgaatggcaggatatcgaagtcttggatacgccagcttttgggaaaatactgattttaaatggccatgtcttgttctcagatgcggatgatttcgtctacaatgaaatgaccgttcacgttcccatggctgtccacccaaatccaaagaaagtattggttattgggggtggtgacggcggtgttgcccaagtattaacactctatcctgaactggaacaaatcgatatcgtggaaccggatgagatgttggtcgaagtctgtcgtgagtatttcccagactttgctgcagggctagatgatcctcgtgttaccatttactaccaaaatgggctacgctttttgcgaaactgcgaagatgattacgatattatcatcaacgatgcgacagatccatttggccatacggaaggactctttaccaaggaattctacggcaatagttatcgagctctgaaggaagacggcatcatgatttaccagcatgggagtcccttctttgacgaggatgagtcggcctgccgaagcatgcaccgcaaggtcaatcaagcctttccaatcagtcgggtttatcaggcccatattccaactagcccagctggctattggttgtttggatttgcatcgaaaaaataccaccctgtcaaagattttgacaaggaaggttggaaaaaacgccagcttttcacagaatactacactgcaaacttacacgtgggatcctttatgttgcccaagtatgttgaggacattttagaagaagaggaaggaaaaaaatga

SEQ ID NO: 1481 - DNA (genomic), 258 bp, Streptococcus pneumoniae; double-stranded, circular
  misc_feature (B) LOCATION 1...258
  hypothetical: NO
  anti-sense: NO
ttttgtttatgttttagcggttgctggacttattgtgggaggcttaatatggttgaaataaaaaatttaagtcttgattatggtgaagagcatatattagatgatatatcactatccatagccgagggagagtgcgtgctatttacaggaaaaagtggagatggtaagtcatctttaataaattcaatcaatggactagctgtaaggtatgataacgcacagacaaagggcgaaataattatgaaggttagaatataa

SEQ ID NO: 1482 - DNA (genomic), 2826 bp, Streptococcus pneumoniae; double-stranded, circular
  misc_feature (B) LOCATION 1...2826
  hypothetical: NO
  anti-sense: NO
ggtctcttatggaatagaagaggaggacatgatttgtctaagaaaagattgtacgaaatcgcaaaagaacttggaaaagaaagtaaagaagttgtagcgcgtgcaaaagagttgggcttggatgtgaaaagccactcatcaagtgtggaagaagctgtcgctgcaaaaattgctgccagctttaagcctgcagctgctccgaaagtagaagcaaaacctgcagcaccaaaagtaagtgcagaaaagaaagccgaaaaatctgagccagctaaaccagctgtagctaaggaagaggcaaaaccggctgagccagttgctccgaaaacagaaaaagtagcagcgaaaccgcaaagccgtaatttcaaggctgagcgtgaagcccgtgctaaagagcaggcagaacgacgtaagcaaaataagggcaataaccgtgaccaacaacaaaacggaaaccgtcagaaaaacgacggacgtaatggtggaaaacaaggtcaaagcaaccgcgacaatcgtcgctttaatgaccaagctaagaagcagcaaggtcagcaaaaacgtagaaatgagcgccgtcagcaagaggacaaacgttcaaatcaagtggctccacgtattgactttaaagcccgtgcagcagccctaaaagcagagcaaaatgcagagtacgctcgttcaagtgaggaacgcttcaagcagtatcaggctgctaaagaagccttggctcaagctaacaaacgcaaggaaccagaggaaatctttgaagaagcggctaagttagctgaacaagcacagcaagttcaagcagtggttgaagtcgtccctgagaaaaaagaacctgcagtggatacacgtcgtaaaaaacaagctcgaccagacaaaaatcgtgacgattatgatcatgaagaagatggtcctagaaaacaacaaaagaatcgaagtagtcaaaatcaagtgagaaatcaaaagaatagtaactggaataacaacaaaaagaacaaaaaaggcaataacaagaacaaccgtaatcagactccaaaacctgttacggagcgtaaattccatgaattgccaacagaatttgaatatacagatggtatgaccgttgcggaaatcgcaaaacgtatcaaacgtgaaccagctgaaattgttaagaaacttttcatgatgggtgtcatggccacacaaaaccaatccttggatggggaaacaattgaactcctcatggtggattacggtatcgaagccaaacaaaaggttgaagtggataatgctgacatcgaacgtttctttgtcgaagatggttatctcaatgaagatgaattggttgagcgtccaccagttgttactatcatgggacacgttgaccacggtaaaacaacccttttggatactcttcgtaactcacgtgttgcgacaggtgaagcaggtggtattactcagcatatcggtgcctaccaaatcgtggaaaatggtaagaagattaccttccttgatacaccaggacacgcggcctttacatcaatgcgtgcgcgtggtgcttctgttaccgatattacgatcttggtcgtagcggcagatgacggggttatgcctcagactattgaagccatcaaccactcaaaagcagctaacgttccaatcatcgtagctattaacaagattgataaaccaggtgctaacccagaacgcgttatcggtgaattggcagagcatggtgtgatgtcaaccgcttggggtggagattctgaatttgttgaaatctcggctaaattcaaccaaaatatcgaagaattgttggaaacagtccttcttgtggctgaaatccaagaactcaaagcagacccaacagttcgtgcgatcggtacggttatcgaagcgcgcttggataaaggaaaaggtgcggtcgcaacccttcttgtacaacaaggtaccttgaatgttcaagacccaatcgttgtcggaaataccttcggtcgtgtccgtgctatgaccaacgaccttggtcgtcgtgttaaagttgctggaccatcaacaccagtctctatcacaggtttgaacgaagcaccgatggcgggtgaccactttgccgtttacgaggatgaaaaatctgcgcgtgcagcaggtgaagagcgtgccaaacgtgccctcatgaaacaacgtcaagctacccaacgtgttagccttgaaaacctctttgatacccttaaagctggggaactcaaatctgttaatgttatcatcaaggccgatgtacaaggttctgttgaagccctttctgcctcacttcaaaagattgacgtggaaggtgtcaaagtgactatcgtccactcagcggtcggtgctatcaacgaatcagatgtgacccttgccgaagcttcaaatgcctttatcgttggtttcaacgtacgccctacaccacaagctcgtcaacaagcagaagctgacgatgtggaaatccgtcttcacagcattatctacaaggttatcgaagagatggaagaagctatgaaagggatgcttgatccagaatttgaagaaaaagttattggtgaagcggttatccgtgaaaccttcaaggtgtctaaagtcggaactatcggtggatttatggttatcaacggtaaggttgcccgtgactctaaagtccgtgttatccgtgatggtgtcgttatctatgatggtgaactcgcaagcttgaaacactataaagacgacgtgaaagaagtgacaaacggtcgtgaaggtggattgatgatcgacggctacaatgatattaagatggatgatgtgattgaggcgtatgtcatggaagaaatcaagagataa

SEQ ID NO: 1483 - DNA (genomic), 273 bp, Streptococcus pneumoniae; double-stranded, circular
  misc_feature (B) LOCATION 1...273
  hypothetical: NO
  anti-sense: NO
aagcagttatgtactattttagattcacttttctatactaagatgagtagggaggaaaaggtaaaagtttatgcccaaactcttcacataagaactctagcttacccattctatggaatcttgcattatccattaaaacttccagactcatacccttctaaaatctattcaaaccacgtcagcttcacattatatatgttggttacctcacaagttttatctgcaacctcaaagctgttctttgagcagcctacagctagcttcctagtttaa

SEQ ID NO: 1484 - DNA (genomic), 234 bp, Streptococcus pneumoniae; double-stranded, circular
  misc_feature (B) LOCATION 1...234
  hypothetical: NO
  anti-sense: NO
caggttctatgttgtctaacaacgcttcgctatgaaatgaaaacagctattggtctcatggcactggatcagagccgatactttgatatgacagattacgaattggagcttgaagtggaaaatcatgagcaaggcaaacaggatttccgacaatttttagagaaaaatcagatttcctaccaaaaagctccttcaaaattggttcgatttgtcaaaagtatgaaaaatagctga

SEQ ID NO: 1485 - DNA (genomic), 1227 bp, Streptococcus pneumoniae; double-stranded, circular
  misc_feature (B) LOCATION 1...1227
  hypothetical: NO
  anti-sense: NO
gcttgtctatggattagaacacttattatgagattaacgcaaatgccttctgaatttcagaaggctttaccagtattagaaaaaattaaagaagcaggctttgaggcttattttgttgggggctctgttcgagatgcccttctccatagccctatccacgatgtggatattgcgacgtcttcttatccagaagagaccaagcagatttttccgcgaacagccgatatcggaatcgagcatggaaccgtcttggtcttagatggggatgaggagtatgaggtaacaacctttcggacagaggatgtctatgtggactatcgcagacccagtgcggtttcctttgtacgatcgctagaagaagacctcaaacgccgtgatttcacagtcaacgcctttgccttggatgagacaggagaaatcgttgacttgttccatggtttagaagatttggaaaagcaagtcttgcgagcagttggagtggctagtgagcgtttcaacgaagatgctttacggattatgcgtggtttccgttttcaggctagtcttggttttgcacttgagccagaaacatttaaagctatgaagaccttgacgccgcttttggagaaaatttctgtagagcgtaccttcgtcgagtttgataaactcttgctggctccattttggagaaggggcttggcttccatgattgagagtcaagcttatgactatctccctgatatggcatctagccaggacaagctcaacagactgtttgatttggagactgattttacttttgaatcctctgaacaagcctgggcggctttactatgggctttggagattgaaaatgcgcagtcatttttgaaatcttggaagacctcacgccagtttgccaagcaagttcaggatttgctgattattttggctctgcgtgaaaatggagaattgagcaagcgagattgttatcgctttgacatagatttgcttttacaggctgaaaatcttcgtcaagctcaaggaaaagaagtcaacccacaagccatcacagaaaaataccaaagcttgactatccatgacaagaaagagattcagattaatggcggtattttgatcaaggaatatggctatcagccaggcccagacttgggagagattttaacagagattgagtttgccattgtcgatggagaattggagaataatcgtgaagccatccatgcttacctgagggagaaaaaatga

SEQ ID NO: 1486 - DNA (genomic), 291 bp, Streptococcus pneumoniae; double-stranded, circular
  misc_feature (B) LOCATION 1...291
  hypothetical: NO
  anti-sense: NO
aatagtctatggaaagagggtgagagtatgtcaaagatgagtatgagcatccgtctggatagtgaggttaaggagcaggcccaacaggtgtttagtaatctgggaatggatatgacaacagctattaatattttccttcgtcaggcaattcaatatcagggattaccttttgatgttagactagacgaaaatcggaagttgctccaagtgttaacggatttagaccaaaatcgtaatatgagccagtcttttgaatcagtctcagatttgatggaggacttacgtgcttaa

SEQ ID NO: 1487 - DNA (genomic), 309 bp, Streptococcus pneumoniae; double-stranded, circular
  misc_feature (B) LOCATION 1...309
  hypothetical: NO
  anti-sense: NO
ttctgcctatgcgatagcagtccaaggtttaggagcaaggcgacgctaagcttggtaaactgcgaaccgctagaagcttatcgtcaactggaagaagctgaacttgttggatgttgggcacatgtgagaaggaagttttttgaagcgacccccaagcaagcagataaatcatccttaggagctaaaggtttagcttattgtgatcagttattttccctggaaagagactgggaggctttgccagctgatgaacgactacagaaacgtcaagaacatctccagcccttaatggaagacttctttgcttag

SEQ ID NO: 1488 - DNA (genomic), 1902 bp, Streptococcus pneumoniae; double-stranded, circular
  misc_feature (B) LOCATION 1...1902
  hypothetical: NO
  anti-sense: NO
agccatccatgcttacctgagggagaaaaaatgagtgattttatcgttgaaaaactaagtaaatccgttggtgacaagaccgtttttagggatatttcctttattatccatgacttagacagaattggtttaatcggtgtcaatgggactggcaagaccacccttttggacgtcctttctggtgtttctggatttgatggggatgtcagtcctttttcagctaaaaatgattaccagattggttacttgactcaggatcctgattttgatgatagaaagacagttttggatacggttctatctagtgaactcaaggaaatccagctcattcgtgagtatgaattgattatgctcgactatagtgaggacaagcaggcgcgtttggaacgtgtcatggcagagatggactctctccaagcttgggaaatcgaaagtcaggtcaagaccgttcttagcaaattgggcattcaagacttatctactcctgttggggaattgtcaggtggtctgagaagacgggtacagttggcacaagtcttacttggcaaccacgacctcttgcttttggatgagccgaccaaccatctggatattgcgattattgagtggctgaccctctttttgaaaaattctaagaagaccgtcctttttatcactcacgatcgttatttcttagacgctttgtcaacacggattttcgagttggatcgtgcaggcttgaccgagtaccagggaaattaccaggactatgttcgcctaaaggcggaacaggatgagcgcgacgcggctcttcttcacaaaaaagaacaactctacaaacaagaattggcctggatgcgcagacaaccgcaggcgcgtgcgaccaagcaacaagctcgtatcaatcgtttccatgatctgaaaaaggaagtttcaggcagtagtgctgagacagacttgactatgaactttgaaaccagtcggattgggaagaaagtcatcgagtttcaggctgtttcctttgcctatgaaaataagcccattttgcaaaattttaatctcttagttcaggctaaagaccgtattggaattgttggggacaatggtgttggaaaatcaaccctacttaacctgattgcaggaagtcttgagccgacagcaggacaagttgtgattggggaaactgttcgcatcgcctatttctctcaacaaattgagggtttggatgaaagcaagcgtgtgatcaattacctgcaggaagtggcagaggaggtcaagaccagtggtggttctacgacttccatcgctgagttgctggagcaattcctcttcccacgttcgacgcatgggactttgattgagaaattgtcagggggtgagaaaaaacgtctttatctcctcaaactgcttttggaaaaaccaaatgttcttcttttagacgagccaaccaatgacctagatattgcaactttgacagtcttagagaatttcttgcaaggttttgcaggtcccgttttaacagtcagtcacgaccgctatttcttggataaggtagcgaccaagattctcgcttttgaggatggcaagattcgtcctttctttggtcattacaccgactatcttgatgaaaaagcttttgaaacagatatggccaatcaagtgcaaaaggccgaaaaggaaaaagtggtcaaggttcgagaagacaagaaacgcatgacctaccaagaaaagcaggagtgggcaagtattgaaggtgatattgaaaccttggaaaaacgtatcgctgctattgaagaggaaatgcaggctaacggctctgactttggtaagctggctactctccaaaaagaattggatgagaaaaatgaagcactccttgaaaaatacgaacgctatgagtatctcagtgaatttgatagttaa

SEQ ID NO: 1489 - DNA (genomic), 819 bp, Streptococcus pneumoniae; double-stranded, circular
  misc_feature (B) LOCATION 1...819
  hypothetical: NO
  anti-sense: NO
aaatgtccatgtggtcaaagacttggaagaagtggaaatctagcagtcacagaaaggataagtatgcctactattctcattaccggagctagcggtggtctagctcaagaaatggtcaaactcctgcccaatgaccaactcatcttgcttggtagaaataaggaaaaattagcccaactctacggaaattattcccatgcagaattgattgaaattgatattaccgacgattcagccctagaagctctggtaactgatctttatctccgctatggcaagattgatgtcttgattaacaacgctggttacgggatttttgagggatttgaccagattgctgataaagatattcaccagatgtttgaggtcaatacctttgccctgatgaatctgtctcgtcaccttgcggctcgtatgaaggaaagcagcaaagggcatatcatcaacatcgtcagcatggcaggtctaatagctactggcaagtctagtctttactcagcgaccaagtttgcggctattggtttttcaaatgctctgcgactcgaacttatgccctatggagtctatgtgacaacagtcaatccaggtccaatccgaacaggattttttgaccaagctgacccagatggaacttatcttaaatcggttgaccgcttcctcttagaggcagatgcagtggctaaaaagattgtcaagattataggcaaaaataaacgagaactcaatctcccgattttgttgaacctagcccataagttttatactctctttcccaagctagctgataagttggcaggggaaacttttaattataagtaa

SEQ ID NO: 1490 - DNA (genomic), 1392 bp, Streptococcus pneumoniae; double-stranded, circular
  misc_feature (B) LOCATION 1...1392
  hypothetical: NO
  anti-sense: NO
agaggtaaatgtatgctaagatttccaaaggtatttgtctggggatcctctacttctggaccgcaaacagaaggacttgtagctggtgacggtaagggagacaatctctgggattactggttccaagtggagccaaatcgttactataatgggattggttcagataagacatcgactttttatgaaaattgggagcgggatattgagcttttgttagagactggtcacacagcctttcggacttctattcagtggtcacggatttttccacaaggctgtggaaaagtcaacactcaaggtgtggatttttatcgtaaggtctttgaggctattaaggctaaaggaattcgtctgttagtcaatctctatcattttgatttaccttttgcccttcaagaggatggtgatggttgggaaaataaggcgacagtctcagcctatgaagactatgctcgtttttgttttgagacttatggagatttagtggatcaatggattacctttaaagagcccatcgttcctgtagaatttggttatttttatgatgcccattatccacataaggtggatgcagagccagctgttaaggtagcctatcatacacaattggccagcagccgggctgttaaggcttgccatgaacttttgcctgattccaagattgggattgtcctcaacttgacaccggcttatccacgtagccagcatcctgctgatgtcaaggcagctcgtattgcggccctttttcaggcccaatctttcttagatccatctgtcttggggacttatccacaggagttggtagaaatcttgcatgaacacggtcttttacctgatgctacagaggaagagttggaactcattcgtgataatacggtggacttccttggtgtcaactactatcaacctttgcgtgttatggctcctcgatttgctaagcatccagagagtccactcttaccagaacatttttacgagccttatgtgatgcctggacgtaaaatcaattctcaccgtggttgggagatttatgagcaagggatttatgacatcgcccaaaatatcaaggaaaattatggcaatattgagtggatgttgactgagaatggtatgggtgttgaaggggaagaaaaattccgtcaagatggaatgattcaagatgattaccgtattgactttgtaaaaggtcatcttcgtgaacttcaccgtgccattgaagatggtgccaactgtaagggctacttgatttggacctttattgactgctggtcatggctcaacagctataaaaatcgctatggtttggtcgaattagacttggaaacgcaagaacgtcgtctgaagaaatcaggccactggttcaaagaattaagcgataataatggattttaa

SEQ ID NO: 1491 - DNA (genomic), 243 bp, Streptococcus pneumoniae; double-stranded, circular
  misc_feature (B) LOCATION 1...243
  hypothetical: NO
  anti-sense: NO
ttgccaaaatggaaaaaggtgaaaggaatatcacgaatggatttaagtaataaagcttcaaatcttagaaaaaagttgggagctgatggtgaatcgccgatagatatttttaaattggtacaaaagatagaaaatttgacgctggtattttatggactcggaaagaatattagcggagtctgttataaaggaactcagttcagtctcattgcagtcaattcagacatgccattaggaaggtaa

SEQ ID NO: 1492 - DNA (genomic), 861 bp, Streptococcus pneumoniae; double-stranded, circular
  misc_feature (B) LOCATION 1...861
  hypothetical: NO
  anti-sense: NO
gaggaaaaatggatgaaaaaatggatgaaaaaatggatgcttgtattagtcagtctgatgactgctttgttcttagtagcttgtgggaaaaattctagcgaaactagtggagataattggtcaaagtaccagtctaacaagtctattactattggatttgatagtacttttgttccaatgggatttgctcagaaagatggttcttatgcaggatttgatattgatttagctacagctgtttttgaaaaatacggaatcacggtaaattggcaaccgattgattgggatttgaaagaagctgaattgacaaaaggaacgattgatctgatttggaatggctattccgctacagacgaacgccgtgaaaaggtggctttcagtaactcatatatgaagaatgagcaggtattggttacgaagaaatcatctggtatcacgactgcaaaggatatgactggaaagacattaggagctcaagctggttcatctggttatgcggactttgaagcaaatccagaaattttgaagaatattgtcgctaataaggaagcgaatcaataccaaacctttaatgaagccttgattgatttgaaaaacgatcgaattgatggtctattgattgaccgtgtctatgcaaactattatttagaagcagaaggtgttttaaacgattataatgtctttacagttggactagaaacagaagcttttgcggttggagcccgtaaggaagatacaaacttggttaagaagataaatgaagctttttctagtctttacaaggacggcaagttccaagaaatcagccaaaaatggtttggagaagatgtagcaaccaaagaagtaaaagaaggacagtaa

SEQ ID NO: 1493 - DNA (genomic), 591 bp, Streptococcus pneumoniae; double-stranded, circular
  misc_feature (B) LOCATION 1...591
  hypothetical: NO
  anti-sense: NO
tgtagaaaatgcagaagcacgtttgcgtgcagctctataaacatcaaggctgggagcacttcccagtcttattctattttaatttcaaaaagaaagaagaaagaaatgaaaaaaatagttcttgttagtctagctttcctttttgtcctggttggttgcggacagaaaaaagaaactggaccagctacaaaaacagaaaaagatacgcttcagtcggcattgccagttattgaaaatgctgagaagaatacagttgtaactaagactttggtcttgcccaagtcagatgatggtagccagcagacacaaacaattacttacaaagacaagacttttttgagtctaactatccaacaaaaacgtccagtctctgatgagttgaagacttatattgaccaacatggagtggaggaaactcaaaaagctcttcttgaagcggaggagaaggataagtctatcattgaagctcgtaaattggcaggtttcaaacttgaaacaaaactattgagcgcaacggaacttcaaacaacgactagttttgattttcaagttctggatgtcaaagaaggttccccaagtgggaacatctga

SEQ ID NO: 1494 - DNA (genomic), 1005 bp, Streptococcus pneumoniae; double-stranded, circular
  misc_feature (B) LOCATION 1...1005
  hypothetical: NO
  anti-sense: NO
aaaggagaatgtttagagatgggaaaatcagttgcaattttaatgaccacttataatggtgagagatatttgtcacaacagattgatagtattaggtctcaaacatttaccaattggacgctttttattagagatgatggatcaaaagataagacagtagaagtaatacagaggtattctaagatagatgatagaattagattagttgaaaatccctcaaagtttcatggagcttattataatttttttaatctaattgaatacgttaaaaacaattatcaatttgattattactttttttgtgatcaagatgatatttggaaagagcacaagctagaaatacagctgttaagattttctaaggatgaaatgccagagatggtttactctgatatgtcaacgattgatgccaataataagttgatagatattagtataaataacataatggggattgaattaccgaacataaataatttgtattttattcatgcctatatctgggggtgtacggcaggctttaatcatgcattgttagagatggttccttcagttgatattgataaagattatttatatatagaaaaactgtctcatgataattattttgcaaagtttgcactagagtatgggaaggtgttgttctgccctgagcaactggtcttgtatcgaagacacggacataatgtaacaactagtcatcattttaaattatctccgctaaatattctcagaaaggctattttgggtttcaatgaattggcacttacacatgctggggtatataatcaaactctttatatgctaaaaaaagcttctgaaaaaagtcctttaagtgatagactgcttgaaattcaggaagtaatcaaaattggaggattaaaaggtgtgagatatttctgtcagaatcgaatttctcgaaagcaactcgtaagaaccatcggcttatataccatcatgctttttggcacctatanaaaatatattatgaaagagctctcataa

SEQ ID NO: 1495 - DNA (genomic), 2031 bp, Streptococcus pneumoniae; double-stranded, circular
  misc_feature (B) LOCATION 1...2031
  hypothetical: NO
  anti-sense: NO
aataaggaatgcactatgaaaaaattatttatactcatatccaacctgcttgctagtttgttctttgtttgggtatttaccatttggactgatacatatgtctcctattattactccaacgttgttgtacatgattcttcccctgaaacaacttttcagcatgttgctacacgcttggaaaaactagcagaagaaacagatagctttattgcgattcaacaccaagatcctaactcagaaggtactacagttttttcttatacgacctttggggacggaaagttgcctgatgggcttcaggaaaaaaaactagaagatgctcaaagtagtagtgttgaaacaaactattttgtattcgatggacacctagatattcacttgctaagggaggagctaagtcaacttggcttgactaacatgaacctgacaattccatctaaactatctacgttaatggctatctttagtaacggatttcagttaatcagtctattgattttcatcttaacctttgtagcactgactttaattagtcaaattagccaattacggtcgtcgggcattcgcctcatttcaggagagaaacggtggtccattttccttagaccagttggtgaggatttgaaagggatagctgttggtttcagtttagctggcgtgctcgccattcttatgcaaaaaattctgtcgcttccaacgcaatccctaatgaccataggagcaggcttgctcagttataatctcatcttgttgtcgatctccctgtttttcgctcaactcttcgcagttgggataaaaaagatacacctgatgcagattataaaagggcaagtgcctgtcagaggaatcattagtttgattttaatcggtcaactattagcgattattattgtaacgctgggaatagggagtagcttaaagtattcccaagcctggcaacagcatcggattggacaagaggcttggagtcaggaaaggcaactgattaccctatcaatcagccgtgaaggaacgagtcctggttttgatgaacaagctcaaaggaaactcagaacttggtatcaattgatggatctggctgtttcagaacaaaaggctttcttatctagacaccagttaattgaccgtactttgcaaaatggcatggcttcctccaaaaacttgataacctctacagaatggcacgattacaacccgaatggcaatgtccttatcgtcacaccgcaatacttggagcgtcaaaacattcctgtagatacaactattgagcaaaagatgaatcaccttgatgtaggggagtttgtcttattgctgcctgaacacctccgttcagaggaagaacattataaatctgtttttgaagacgacttaaccagtcgcatgtctagtcaagatgaacgacagcaaatgactgctacggtaggttatttagaatcaggtcaggatcgttttgtgtataatacgacccctatttcttaccagcagtttttgaaagatccaatcatcattgttataacaccccaatcaactggtccacagtccattttgttttggatagacgcagtacagaactacgttctctttaatcaattgtctgatgcccaggagcttatccagagacaaggcattgaaaattgggtctcagaaatgcaaacaggttaccacaactacatcacattattggataatatccagagggaacgttgggtaatgctagcaggagctgtgcttgggattgcaacttcaatcttgttgtttaacactatgaataggctctactttgaagaatttagacgtgccatttttatcaaacgcattgcaggtctcaggttcttagaaatccatcgcacttatctctttgctcaactgggtgtgtttttactgggatttgttgcgagtgtatttcttcaggtagagataggagttgctttcttagtcttgttactctttactggtctatctcttttacagttacatgtccaaatgcagaaagaaaacaagatgtccattcttgttttgaagggaggttaa

SEQ ID NO: 1496 - DNA (genomic), 219 bp, Streptococcus pneumoniae; double-stranded, circular
  misc_feature (B) LOCATION 1...219
  hypothetical: NO
  anti-sense: NO
tcttttagatgtttatcaaggcgggtcgaatgtcttggtaagacaggtcaactcttcagtttccatgacaatccgaatccaaattgccctgtaggagctcatattcatgatgttttggatcaaaaattggagagaattcagttgactatggaggcagaacttggtcaaaccagtctagaaaaagtcgtggccgatgcagagagtcagatgaaggattaa

SEQ ID NO: 1497 - DNA (genomic), 885 bp, Streptococcus pneumoniae; double-stranded, circular
  misc_feature (B) LOCATION 1...885
  hypothetical: NO
  anti-sense: NO
gaaactagatgtggatccactggatttaacggcattttacaaagaaaggagagagggatgcaagctaaattaatcggttaccagcatagagatactgtgattcatcgcttgtcaggagctgggaaacttctctttttcattctggtatcattggcggccatgattagctatgataccagaatgctcttgctgattgccatcttttcagtctttctcctctatttatcagaaattcgctttaaagatgtttcctttgtagccgtttttgcgacggtatttgccgttttaaacgttttgatggtctatctcttttctcccgagtatggggttggactttatggagagagaagtgtgatttggcagggaatcggtgtctacactctaaccagccaggagctcttttatctgctaaatttggccattaagtatctttgcaccattcctctggctattatctttttgatgacaacccatcctagtcagtttgcttccagtttaaatcaaattggtgtgccctataagattgcttattctgtcagcctgaccttgcgctatattccagatttgcaggaagaattctttactatcaagatgtctcaggaggcgcgtgggatggaattatccaagaaagcttctcttatgcaacgaatcaaaggcaatctgctcattattacgcccttgatttttagctcgctagaacgcattgataccattgcgactgccatggagcttcgccgctttgggaaagagaaaaaacgcacatggtatagttatcaggccttgaaaaaaggagactatattaccttgctcttggcaaccttgtttttagtagttagtttactacttatcttgcagaatcagggacgattttacaacccttggaaa

SEQ ID NO: 1498 - DNA (genomic), 549 bp, Streptococcus pneumoniae; double-stranded, circular
  misc_feature (B) LOCATION 1...549
  hypothetical: NO
  anti-sense: NO
actggtggatgtgaacaaatgacacttaattatatcgaaattttaatcaaactggtcttgactctcaaatggctcaacaacaatgttcactttgtgaaacgtttgattgatggtaagccaactctccttatcaaaaatgggaatattgacccagaagcctgtcgttcagttggtttgtctgcatcggatgtagccctcaaacttcgtagccaagggattttccagatgaagcaagtcaaacgagctgtgcaagagcaaaatgggcaacttatcgttgtgcaaatgggagatgaaaatcctaagtatccagttgtgactgacggtgtgattcaagtagatgtcttggaatcgattggtcgtagcgaagagtggttgcttgataacctcagtaaacaagggcatgacaatgtagccaatatctttattgctgaatatgacaagggtgctgttacagtcgtaacttatgaaaaagaaaaacctggggtcttgtactcttcgaaaatctcttcaaaccgcgtcaacgtcgccttgccgtatgtaggttactga

SEQ ID NO: 1499 - DNA (genomic), 267 bp, Streptococcus pneumoniae; double-stranded, circular
  misc_feature (B) LOCATION 1...267
  hypothetical: NO
  anti-sense: NO
ttggaaggatgtctatctgagctctttagcaaggaggaaatccttgaaagtgatatgcgagtagctatcatgagcgagttgattgaagccagaaataagcaaggaatcagtcagaaaaagctagaggaagtcagtggagtgagtcagcctgttatagctaggatggagacaggtaagactagtccacagttggacacagtcttaaaagtcctagctagtctaggaaagacactagcagtcgttccacttgaacagggaaaaagttga

SEQ ID NO: 1500 - DNA (genomic), 1731 bp, Streptococcus pneumoniae; double-stranded, circular
  misc_feature (B) LOCATION 1...1731
  hypothetical: NO
  anti-sense: NO
gaattgggatgtggcatttctttatcagtgatatgttggaacctgtctatgaaatcatccatgaaaaattggcgacaaaatagaatgaagcagttttggctacatacgcttctaagaacctatagttcagtgatgatcattatcattgcgagttttgcaatcttactctcttacgctgactgggattcacgtgaaaaggaagcccagagagtagcccagcgtgtaactgctagaacagtgagtgaaattgaatattaccatagagagtcaacccagatagctcaggctttagttgaaaatcaagctcgtattgagggaatctataaatactttagccttagcatgccagactatttttactggcaattagagcggaaagcttcgccttatatatcagtctctctgtatgaaaatgttgatgacctctatgttcgaaatgattttgtaactggggtggccattgcttttcaagattacaaggaagtctatgtttctactaaagacaaacgtagtggagaaaaaatcagggctgaggatttcaaaccagcaggaaatagttttgccattccggtgtcagatccagtgtcagatcaagatttaggagtgatttacatctccttggatcctgctgttttataccatgccattgataatactagaggtcatactccgatggcagtaacagtgacctcaccttttgatacggagatttttcatattggtgagacagttgatagggagagtgaaaattggctagttggcttaacttctcatggatatcaggttcaggtggcagttcctaaaaactttgttttacaaggaacagtgactagctctgctttgattgtgggtttgagccttctctttattgtcattctttatctgactttgaggcagacttttgctaattaccaaaagcaggtagtggatttagtagaatccattcaagtcattgctcaaggcgaagaggggcgtcggattgacatttccgagaaagatcaggaattactcctaatcgcggagacgaccaatgatatgttggatcgattggaaaagaatatccatgatatttaccagttagagcttagtcaaaaagatgccaatatgcgagccttgcaggcgcaaatcaatcctcattttatgtataatacgctggagttcttgcgcatgtatgcagttatgcagagtcaagatgagttggcagatatcatttatgaattcagtagtctcttgcgtaacaatatttccgacgaaagagagaccctcctcaaacaggaattagaattttgccgtaaatacagctatctctgcatggttcgctatcccaagtccattgcctatggtttcaagatagatccagagttagagaatatgaagattcccaagtttaccttgcaaccgctggtagaaaactatttcgcgcatggtgttgaccacaggcggacagataatgtgattagcatcaaggctcttaaacaggatggttttgtggaaattttggtggtcgataatggtagaggaatgtcggctgaaaagttggcaaatatccgagaaaaattaagtcagagatattttgaacaccaagccagctacagtgatcaaaggcagtctatcgggattgtcaatgtacacgagcgttttgtgctctattttggagaccgctatgccattactatagagtctgcagagcaagccggtgttcagtatcgtattacaattcaagatgagtag

SEQ ID NO: 1501 - DNA (genomic), 489 bp, Streptococcus pneumoniae; double-stranded, circular
  misc_feature (B) LOCATION 1...489
  hypothetical: NO
  anti-sense: NO
ctgtttttgtgtcgtttaagggaaaggacaagaatgactcaacaagactttcggacaaaagtagacaatacggtttttggtgttcgggcgacagctttgattcttcaaaatcgcaagcttctagtcaccaaagacaagggcaagtattacattatcggcggtgcgattcaagttaacgaaaaaacggaagacgcggtagtccgtgaagtgaaggaagaactgggtgttaaatctcaagctgggcagctagcttttgtggttgaaaatcgttttgaagtggacggcgtttcctatcacaatatcgagtttcattatctggtggatttgcttgaagatgccccgttgaccatgcaggaagatgagaaaaggcagccctgtgagtggattgacttggataagctccagaatatccagctagttccagcctttttaaaaacagccctaccagattgggaaggccaactaagacacattcatcttgaggaatag

SEQ ID NO: 1502 - DNA (genomic), 1257 bp, Streptococcus pneumoniae; double-stranded, circular
  misc_feature (B) LOCATION 1...1257
  hypothetical: NO
  anti-sense: NO
ctggtattgtggagctacaaaatgcttaaacgcttatggatgatcttcggaccggtcttgatcgctggtttgttggtttttctgctcattttcttttatcctactgagatgcatcataatctaggagctgaaaagcgttcagcagtggctactactatcgatagttttaaggagcgaagtcaaaaagtcagagcactatctgatccaaatgtgcgttttgttcccttctttggctctagtgaatggcttcgttttgacggtgctcatcctgcggtattagctgagaaatacaatcgttcctaccgtccttatcttttaggacaggggggagctgcatcgcttaaccaatattttggaatgcaacagatgttaccacagctggagaataaacaagttgtgtatgttatctcacctcagtggttcagtaaaaatggctatgatccagcagccttccagcagtattttaatggagaccagttgactagttttctgaaacatcaatctggagatcaggctagtcaatatgcagcgactcgcttactgcaacagttcccaaacgtagctatgaaggatctggttcagaagttggcaagtaaagaagaattgtcgacagcagacaatgaaatgattgaattattggctcgttttaatgaacgccaagcctccttttttggtcagttttcggttagaggctatgttaactacgataagcatgtagctaagtatttaaaaatcttgccagaccagttttcttatcaagcaatagaagatgttgtcaaagcagatgctgaaaaaaatacttccaataatgagatgggaatggaaaattatttctataatgagcagatcaagaaggatttgaagaaattaaaggattctcagaaaagctttacctatctcaagtcgccagagtataatgacttgcagttggttttaacacagttttctaaatttaaggtaaacccgatttttatcattccacctgttaataaaaaatggatggactatgctggtttacgagaggatatgtaccaacaaacggtgcagaagattcgctaccagttagaaagtcaaggttttaccaatatagcagatttttttaaggacggcggggagcctttctttatgaaggacaccattcaccttggttggttgggttggttggcttttgacaaggcagttgatcctttcctatccaatcccacaccagctccgacttaccatctgaatgagtttttttcagcgaccttggggcct

SEQ ID NO: 1503 - DNA (genomic), 1200 bp, Streptococcus pneumoniae; double-stranded, circular
  misc_feature (B) LOCATION 1...1200
  hypothetical: NO
  anti-sense: NO
aaccttctgtgttatactagagatatgttagatttgaaagaatacggtatcgtcatgtggccggaggagaaagtcatttctttccgtgagaaacttctcgcttggtatgatgaaaacaaaagagatttgccttggaggagaagtaaaaatccttatcacatctgggtatctgaaatcatgcttcagcagaccagggtggatacagttatcccttactacgaaagattcctggactggtttccaactgtcgaaagtctggcaactgcgcctgaggagagtttactgaaagcttgggagggcttgggctattattctcgagttcgcaatatgcaggctgcagcccagcagattatgactgactttggtggccaatttccaaatacctatgaaggaatttccagcttgaaagggattggaccttacacagcaggagccatttccagtattgcttttaacttgcctgagccagctgtagatggtaatgtcatgcgggtcttggcgcgtctgtttgaagtcaaccacgatattgggattccaagtaatcgaaaaatttttcaggcaatgatggagatcttgattaatccggatcgtccgggtgattttaatcaagccttgatggacttagggtctgatattgagtctcctgtaaatcccagacctgaagaaagcccagtcaaggactttagtgcggcatatcagaatggaaccatggaccgttatccaattaaatctcctaagaaaaagccggttcctatttatcttaaagccttagttgtgaaaaattctcaaggacaatttttacttgaaaaaaatgaaagcgaaaagctcttggcaggtttttggcatttcccctttatagaagttgataacttttcgcaagaagagcagtttgacctctttcatcaggttgcggaagaaagtgtgaactttggccccagtccagaagagagtttccagcaggactatgacctagatgttgattggcttgatgtttgttttgatacagtccagcatgtttttagtcatcgaaaatggcatgtacagattgtagcaggtcaggtgagtgacttccatgatttttcagatagggaagttcgttggctttcaccagaagaattcaagaattacccacttgccaaaccccaacaaaaaatttggcaggcttatgcacaagccaacttagacagtagccaagactag

SEQ ID NO: 1504 - DNA (genomic), 1104 bp, Streptococcus pneumoniae; double-stranded, circular
  misc_feature (B) LOCATION 1...1104
  hypothetical: NO
  anti-sense: NO
ataatcatgtggctacaacatctatctctcaagacttttcgtaattacaaagaaacgaaaatagactttaatcctaaattgaatgtctttttgggacgtaatgcacaaggaaaaacaaacatgttagaggctatctattttttagccttaacgcgtagtcatcgaactcgaacagataaaaatctcattcattttgatgaggaacaacttcatctttcaggtctcgttcagaaaaaaactggatccattcccctagaaatcgaactaacacaaaaaggccgtgtaacaaaagttaatcacttaaaacaggcacgcctttcagattatgtaggacacatgaatgttgtcttatttgctcctgaagatttacaactaattaaaggagcaccttcgattcgacgaaaattcattgatatggaacttgggcaaattaagccaatctatttatctgacttaaccaattataaccacatcctaaagcaaagaaacacttacctaaaatcagctcaaaaaatagatgaaacattcctttctgtgttagatgatcagctagttgattatggatgtcgtgtaatgaatcaccgcttagatttcataaaaaaactagaatcatttgggcgtaagaaacattttgaactctctaatcagatcgaagagttgtcaatatcctatcaatcttctgtcaatataactgacaaacaaaacttatccgaatctttcaaaattgctttagaaaaaagtagatccagagatttatttaaaaagaatactggtgtcggtcctcatcgagatgacatttctttttatataaatgggatggatgctagtttcggaagccaaggtcaacatcgtagtctcgtcctctcgataaaattagcagaaatcgaattaatggaaagcattaccacagaatctccgatattactgcttgacgatgtgatgagtgaacttgacaacactagacagttaaaattattagaaacgatttctcaatcaatccaaacctttatcacaacaacaagcttagaccatcttcaaaatctgccagaaaatctaagtatcttcactattcaggatggtaaagctgctgtaaatggaaattga

SEQ ID NO: 1505 - DNA (genomic), 354 bp, Streptococcus pneumoniae; double-stranded, circular
  misc_feature (B) LOCATION 1...354
  hypothetical: NO
  anti-sense: NO
tacacaatgtggtataatcttcttatggcatattcaatagattttcgtaaaaaagttctctcttattgtgagcgaacaggtagtataacagaagcatcacacgttttccaaatctcacgtaataccatttatggctggttaaagctaaaaaagaaaacaggagagctaaaccaccaagtaaaaggaacaaaaccaagaaaagttgatagagatagacttaaaaactatcttactgacaatccagacgcttatttgactgaaatagcttctgaatttggctgtcatccaactaccatccactatgcgctcaaagctatgggctacactcgaaaaaaagaaccacacctactatga

SEQ ID NO: 1506 - DNA (genomic), 354 bp, Streptococcus pneumoniae; double-stranded, circular
  misc_feature (B) LOCATION 1...354
  hypothetical: NO
  anti-sense: NO
tacacaatgtggtataatcttcttatggcatattcaatagattttcgtaaaaaagttctctcttattgtgagcgaacaggtagtataacagaagcatcacacgttttccaaatctcacgtaataccatttatggctggttaaagctaaaagagaaaacaggagagctaaaccaccaagtaaaaggaacaaaaccaagaaaggttgatagagatagacttaaaaactatcttactgacaatccagacgcttatttgactgaaatagcttctgaatttggctgtcatccaactaccatccactatgcgctcaaagctatgggctacactcgaaaaaaagaaccacacctactatga

SEQ ID NO: 1507 - DNA (genomic), 354 bp, Streptococcus pneumoniae; double-stranded, circular
  misc_feature (B) LOCATION 1...354
  hypothetical: NO
  anti-sense: NO
tacacaatgtggtataatctttttatggcatattcaatagattttcgtaaaaaagttctctcttattgtgagcgaacaggtagtataacagaagcatcacacgttttccaaatctcacgtaataccatttatggctggttaaagctaaaagagaaaacaggagagctaaaccaccaagtaaaaggaacaaaaccaagaaaagttgatagagatagacttaaaaactatcttactgacaatccagacgcttatttgactgaaatagcttctgaatttggctgtcatccaactaccatccactatgcgctcaaagctatgggctacactcgaaaaaaagaaccacagctactatga

SEQ ID NO: 1508 - DNA (genomic), 897 bp, Streptococcus pneumoniae; double-stranded, circular
  misc_feature (B) LOCATION 1...897
  hypothetical: NO
  anti-sense: NO
aagcggatgtggattaggagtagagagactatgaaaaaagtattacaaaaatattgggcatgggcttttgtggtcatccccctcttgttacaagcaattttcttctatgtgccgatgtttcaaggagccttttacagttttaccaactggacaggattgacttacaactacaaatttgtcggcttaaacaactttaagctcctcttcatggatccaaaattcatgaatgcgattggctttaccgcaatcattacgattgccatggtggttggtgagattgcactcgggatcttcattgcgcgtgtcttgaactctaaaatcaaaggccaaaccttcttccgtgcttggttcttcttcccagctgttttatctggtttgacagtggctttgatcttcaagcaagtcttcaactacggtcttccagcgattgggaatgcccttcatattgaatttctccaaaccagtcttttagggactaagtggggagcaatctttgcggctgtctttgtccttctttggcaaggggtggctatgcccatcatcatcttcctagctggtttgcaatctattccaactgagattacagaggcagcaaggattgatggtgcgactagcaagcaagttttctggaacattgaattgccttacttgctaccaagtgtctctatagtctttatcctagccctaaaaggtgggctgactgcctttgaccaagtctttgccatgaccggtggtggtccaaacaatgccacaacctcacttgggctcttggtttataactatgcctttaaaaacaaccaattcggttatgccaatgccattgccgtaatcttgttcttcttaattgtagtgatttcgatcatccaattgagagtatctaagaaatttgaaatttaa

SEQ ID NO: 1509 - DNA (genomic), 330 bp, Streptococcus pneumoniae; double-stranded, circular
  misc_feature (B) LOCATION 1...330
  hypothetical: NO
  anti-sense: NO
ttgctgcagtgcgcaaatggctctcttaatttagaaaaactagaagctatgacggctatctgttctgttggattggatatgattgccatcccagaagatacgcctgctgaaactattgcggctatgattgcggatgaagcagcaatcggtgttatcaacatgaaaacaacagctgttcgtatcattcccaaaggaagagaaggcgatatgattgagtttggtggtctattaggaactgcacccgttatgaaggttaatggggcttcgtctgtcgacttcatctctcgcggtggacaaatcccagcaccaattcatagttttaaaaattaa

SEQ ID NO: 1510 - DNA (genomic), 678 bp, Streptococcus pneumoniae; double-stranded, circular
  misc_feature (B) LOCATION 1...678
  hypothetical: NO
  anti-sense: NO
gaggttaagtgtatgaatcaagataggaataaactgctttctaaaattgcttatctgtattatattgaaaacttaaatcagtcacaaatagcagcaaaattaggaatttatagaacctctattagtagaatgttaacagaagcaaggaatgtaggaattgttaaaattgaaatagagaattttgatacaaatatgtttaagttggaaaattatgtaaaagaaaaatacagtttggaaagtttagaaattattccaaatgaatttgatgatactccaacaattttatctgaaagaatttctcaagttgcagcaggcgtccttaggaatctaattgatgataatatgaaaattggcttttcttgggggaaaagtttaagtaatttagtagatttaattcacagtaaaagtgtccgaaatgttcacttctatcctctagcaggtggtcctagtcacatacacgctaaataccatgtgaatacactgatttatgaaatatctagaaaatttcatggagagtgtacatttatgaatgcaacgattgtgcaagaaaataaattgttagcagatggtattttgcaatcaagatattttgaaaatttgaaaaatagttggaaagatttagatatagctgtagtcggaattggtgattttagcaataaaggaaaacatcaatggtag

SEQ ID NO: 1511 - DNA (genomic), 816 bp, Streptococcus pneumoniae; double-stranded, circular
  misc_feature (B) LOCATION 1...816
  hypothetical: NO
  anti-sense: NO
gattgcaagtggattatcagaaggatctgtgaagtagacgaaagaaggaaaaaaatgaataaaagaggtctttattcaaaactaggaatttctgttgtaggcattagtcttttaatgggagtccccactttgattcatgcgaatgaattaaactatggtcaactgtccatatctcctatttttcaaggaggttcatatcaactgaacaataagagtatagatatcagccctttgttattagataaattgtctggagagagtcagacagtagtaatgaaatttaaagcagataaaccaaactctcttcaagctttgtttggcctatctaatagtaaagcaggctttaaaaataattacttttcaattttcatgagagattctggtgagataggtgtagaaataagagacgcccaaaagggaataaattatttattttctagaccagcttcattatggggaaagcataaaggacaggcagttgaaaatacactagtatttgtatctgattctaaagataaaacatacacaatgtatgttaatggaatagaagtgttctctgaaacagttgatacatttttgccaatttcaaatataaatggtatagataaggcaacactaggagctgttaatcgtgaaggtaaggaacattacctcgcaaaaggaagtattggtgaaatcagtctatttaacaaagcaattagtgatcaggaagtttcaaatattcccttgtcaaatccatttcagttaattttccaatcaggagattctactcaagctaactattttagaataccgacactattgaaagttctataa

SEQ ID NO: 1512 - DNA (genomic), 936 bp, Streptococcus pneumoniae; double-stranded, circular
  misc_feature (B) LOCATION 1...936
  hypothetical: NO
  anti-sense: NO
gatatgaagtggacaaaaagagtaatccgttatgcgaccaaaaatcggaaatcgccggctgaaaacagacgcagagttggaaaaagtctgagttttatatctgtcttggtttttgccatttttttagtcaattttgcggtcattattgggacaggcactcgctttggaacagatttagcgaaggaagctaagaaggttcatcaaaccacccgtacagttcctgccaaacgtgggactatttatgaccgaaatggagtcccgattgctgaggatgcaacctcctataatgtctatgcggtcattgatgagaactataagtcagcaacgggtaagattctttacgtagaaaaaacacaatttaacaaggttgcagaggtctttcataagtatctggacatggaagaatcctatgtaagagagcaactctcgcaacctaatctcaagcaagtttcctttggagcaaagggaaatgggattacctatgccaatatgatgtctatcaaaaaagaattggaagctgcagaggtcaaggggattgattttacaaccagtcccaatcgtagttacccaaacggacaatttgcttctagttttatcggcctagctcagctccatgaaaatgaagatggaagcaagagcttgctgggaacctctggaatggagagttccttgaacagtattcttgcagggacagacggcattattacctatgaaaaggatcgtctgggtaatattgtacccggaacagaacaagtttcccaacgaacgatggacggtaaggatgtttatacaaccatttccagccccctccagtcctttatggaaacccaaatggatgcttttcaagagaaggtaaaaggaaagtacatgacagcgactttggtcagtgctaaaacaggggaaattctggcaacaacgcaacgacccgacctttga

SEQ ID NO: 1513 - DNA (genomic), 1038 bp, Streptococcus pneumoniae; double-stranded, circular
  misc_feature (B) LOCATION 1...1038
  hypothetical: NO
  anti-sense: NO
aataaggagtggaatatgacagtaacgattgattgggaaaacctcggtttttcctatatgaaattaccttatcgctatcttgctcatttcaaaaatggacaatgggatcaaggagagcttacagaggatgcaactttgcatatttcagagtcttctccaagtcttcactatggacaacaagcatttgaaggtttgaaagcttatcgtactaaggatggcagtgttcaactgttccgtcctgatgaaaatgctaaacgtctgcaacgtacatgtgaccgtctcttgatgccacaagttccgacagacatgtttgtagaagcttgtaaagcagttgtccgtgcgaatgaagaatacgtaccaccatacggaacaggtggaaccttatatcttcgccctcttttgattggtgtcggagatattatcggggtaaaaccggcagaagagtacattttcaccatctttgctatgccagttggaaattactttaaaggcggtttggtcccaaccaacttcttgattcaggatgagtacgaccgtgcagcaccaaatggtacaggtgcggctaaggttggtggaaactatgctgcaagtctcttaccaggaaaaatggccaagtcacgtcatttctcagatgttatctatctggacccatcaactcatacaaagattgaagaagtcggatcagctaacttctttggaattacagctgataatgaatttgtaacaccattgagtccatctatcttgccatctattaccaagtattccttgctttatttggcagaacatcgcttgggattaactcctattgagggtgatgttccaattgataatcttgaccgttttgtagaggcaggtgcctgtggtacagcagcggttatttctccaattggaggtattcaacatggtgatgatttccatgtattctatagtgaaacagaagtaggtcctgtgacgcgtaaattatataatgaattgacgggtattcagtttggcgatattgaagcgccagaaggttggattgtaaaagtagattaa

SEQ ID NO: 1514 - DNA (genomic), 501 bp, Streptococcus pneumoniae; double-stranded, circular
  misc_feature (B) LOCATION 1...501
  hypothetical: NO
  anti-sense: NO
gaaagttggtgtttgatgaaaattttagctattgatccaagtagtaataaaattgaaaccagcacaacaggagttgtcttgttggataatgcaagattagttgatagctgggttgtctcttatggtatgagaggtttcgctgattggtttcacgaaatcggaacaaatcttgaattcgatgtagttattgttgaagaatttaaggcgagggataacgacaagtcgaaagataatagcgtggcagaaaccatcgcctatatccaactttgctatccaggtgccattcttcaattcaatgcaggttacaagtcggatattccaaacgatcttttgaaaatcttagacctttggaaatttgaaaaaagtcatcatcaagatattcgagcagcagcaagacttggattattttgggcaatgagaaatgatattgaagaagtggttcatgatatcggaaaggtggtgagtgagtatcacaataacgctaagaaagtggcaagctga

SEQ ID NO: 1515 - DNA (genomic), 363 bp, Streptococcus pneumoniae; double-stranded, circular
  misc_feature (B) LOCATION 1...363
  hypothetical: NO
  anti-sense: NO
gggggccggtgtgggctggtggcggagtggggggggtgtgcgggggcggggtggggcggtgaggccggtgcggtgtgggcccggggtggggcggcggattcctgcgggggggggcgtgggggggttggcgtgcggcgggcggtggtgggggtggggggggggagttgctcgcgcgcggtgggggattggccgcgtggaggggggcggcatgcgggggaacggggggtggagggaagtggggtggccggggttgaggcgggggcggtccggggacgggtggagtggggtgagtggggggcagttggtgtgaggagggccgtgtcggcagggagatatgggctgcacggatgtgtgccgtggtga

SEQ ID NO: 1516 - DNA (genomic), 330 bp, Streptococcus pneumoniae; double-stranded, circular
  misc_feature (B) LOCATION 1...330
  hypothetical: NO
  anti-sense: NO
aagtctaggtgggccggacaagctctgctagttggttctcaaccggttgctgccaatgaacaccatgctattcttgcttttgagtctaacttcaatgctggtcaaactatgaaacgagacaatctcaataccatgtttggtaatatcctcagtcaggcggcaggtttttcacctgagattttagctatttccatggaggaatggaaagaagttcgcgcagccttttcagccaaagccaaatcttctcaaactgaaaaagaagtagaagaaagcctgattccagaaggatttgaatttttggctgataaagtgaaggtagaggaagactaa

SEQ ID NO: 1517 - DNA (genomic), 864 bp, Streptococcus pneumoniae; double-stranded, circular
  misc_feature (B) LOCATION 1...864
  hypothetical: NO
  anti-sense: NO
gaaaagaggtgtcctatgattaaaaaaatttaccccatttttaccattttactaggtgctgctatttatgcttttggactgacttattttgtagttccccatcatctctttgaaggaggggcgacaggtattaccctcatcacattttatctttttaaaatccctgtttccctcatgaacctgctgattaatattccccttttcatcctagcttggaagatctttggagccaaatccctctattctagtttactaggaaccttagctttgtccggctggttagctttttttgagcatattccccttcatattgatcttcaaggtgatttactaatcacagcccttatagcgggaatcctattgggaattggccttggaattatttttaatgctggaggtacaactggcggaactgatattctagctcgtattctcaacaaatacactcatatatccataggaaaactgctctttatcttagatttttgtattctcatgttgattctcctaatcttcaaggatttgagattggtttcctacacgcttttgtttgattttattgtttctcgtgttattgatttgattggtgaaggaggatatgccggcaaaggctttatgattatcacaaaacgtcctgaccaacttgctaaggcgattaatgatgacctcggaagaggtgttacttttatttctggtcaaggctactatagtaaagaaaatttgaaaatcatctactgtattgtcggaagaaatgaaattgtgaaaacgaaggaaatgattcatcgaatcgatcctcaagcctttataactattacagaagcccatgaaatcctaggagaaggcttcacctttgaaaaagaataa

SEQ ID NO: 1518 - DNA (genomic), 1128 bp, Streptococcus pneumoniae; double-stranded, circular
  misc_feature (B) LOCATION 1...1128
  hypothetical: NO
  anti-sense: NO
cctaggaggtgtcttatgaatgataagttaaaaatcttcttgttgctaggagtattttttctagccataaccggtttctatgttctattgatacgaaatgcagggcagacagatgcctcgcaaattgaaaaggcggcagttagccaaggaggaaaagcagtgaaaaaaacagaaattagtaaagacgcagacttgcacgaaatttatctagctggaggttgtttctggggagtggaggaatatttctcacgcgttcccggggtgacggatgccgtttcaggctatgcaaatggtagaggagaaacaaccaagtacgaattgattaaccaaacaggtcatgcagaaaccgtccatgtcacctatgatgccaagcaaatttctctcaaggaaatcctgcttcactatttccgcattatcaatccaaccagcaaaaataaacaaggaaatgatgtggggacccagtaccgtactggtgtttattacacagatgacaaggatttggaagtgattaaccaagtctttgatgaggtggctaagaaatacgatcaacctctagcagttgaaaaggaaaacttgaagaattttgtggtggctgaggattaccatcaagactatctcaagaaaaatccaaatggctactgccatatcaatgttaatcaggcggcctatcctgtcattgatgccagcaaatatccaaaaccaagtgatgaggaattgaaaaagaccctgtcacctgaggagtatgcagttacccaggaaaatcaaacagaacgagctttctcaaaccgttactgggataaatttgaatccggtatctatgtggatatagcaactggggaacctctcttttcatcaaaagacaaatttgagtctggttgtggctggcctagttttacccaacccatcagtccagatgttgtcacctacaaggaagataagtcctacaatatgacgcgtatggaagtgcggagccgagtaggagattctcaccttgggcatgtctttacggatggtccacaggacaagggcggcttacgttactgtatcaatagcctctctatccgctttattcccaaagaccaaatggaagaaaaaggctacgcttatttactagattatgttgattaa

SEQ ID NO: 1519 - DNA (genomic), 747 bp, Streptococcus pneumoniae; double-stranded, circular
  misc_feature (B) LOCATION 1...747
  hypothetical: NO
  anti-sense: NO
aattctgggtgcctatcctatttatccaatatcagaccatggaaaggagagaagatgagtaaagaaaatcccttaagtcatcatgagcagttgcgttatgattatttgctaaaaaatattcactatctcaatgagagagaaaaaaatgagtttgcctatttgcaagaaaagctaactcttgctaggggaaatagtagctctagcttggaacaagaaagagaagagcaggttgacttaccaagctatgcgaaccggagtcgctcacaatccaaatcacaagcactctctttccctccaaaaaagaaaagacggaagctccgtcttaaacgaatttttatggtgattttttcacttttggtctgtgtggctttggccatggtattcatgtttttgcgtggttaccaagatgctagcgcaaagaaaactgctgatgcccgggcagctcaagtagaagtctttaatggtcaggacactagagatggagttaatattttaatcatgggtactgatggtcgaatcggccagaacagtgttgagacacgaactgactctattatggtattaaatgtcgggggctcagataagaaaatgaagctagtcagtttcatgcgtgataatttggtctatatagatggttatagtcaagtgattaatggtagaaaacagacagataacaagttaaacgtagcctacgagttaggagaacaagagggcaaaaaggggcagaaatgtttcgccaagtcttga

SEQ ID NO: 1520 - DNA (genomic), 804 bp, Streptococcus pneumoniae; double-stranded, circular
  misc_feature (B) LOCATION 1...804
  hypothetical: NO
  anti-sense: NO
gggaggtttcggatgtcagcatatcaattaccgaccgtatggcaggatgaagctagtaatcaaggagcttttacggggctaaacagaccaacagtaggtgcccgtttcgaacaaaacttgccaaaaggagaacaagcttttcagctttattcactgggaacaccaaatggtgtgaaggttactatcttattggaagaattactagaagctggttttaaggaagcggcttacgacttgtataagattgctatcatggatggggatcaattcggatcagactttgtgaagctcaatccaaattccaagattccagccttattggaccagtcaggtactgaagatgtaagagtctttgagtctgctcatattcttctttaccttgctgagaaatttggagcctttttaccaagtaatcctgtggaaaaggtagaagttttgaattggctattctggcaagcaggtgcagcaccttttctaggtgggggatttggacatttcttcaattatgctcctgaaaaattggaatatcctattaaccgttttacaatggaagtgaaacgccagttggatttattggataaggaattggctcagaaaccttatattgcaggcaatgactatacgattgcagatattgctatctggtcttggtatggacagttagttcaaggaaatctttaccaaggttctgcaaaattcttggatgcctcaagttatcaaaatctagtaaaatgggcagaaaaaattgccaatcgtccagctgttaagcgtggcttggaagtaacttatacagaaattatatag

SEQ ID NO: 1521 - DNA (genomic), 1338 bp, Streptococcus pneumoniae; double-stranded, circular
  misc_feature (B) LOCATION 1...1338
  hypothetical: NO
  anti-sense: NO
gattttattttcgtgtacaatttcagctattcttgttataatcagcctataggaatcaaggaggtgactcttatggctgtttttgtgtctttggatggaattgtggtagaagtacttgatgtcttttcttcttttaatggggatagtgagtttttcttgtgtaaacgtcttaaagacaagagtcagtttgttatggaacgctctcagttcgaggagatgttccaacttcaaagtagtcgcttgacgacgcaagaaaaattacaattgtttacctctgtgtttgctggccgttatgatgtttatgctaagagttttatcaatgatcaagggaaaattcagtattttccttcctatgattgtggttggaagcagttgctacctgaaaaacggagtttccagacattgacggattccgttttgaaatctcattttcgtggggagacagctatcggtatctttcctatgcacttagatgatagctgtcattttttggtactggattttgatgaaggagattggaaagaagctggtttaaccattcgaagaatagccagggaacgccagatggaagcccatttagagatttctcgttcgggtcacggactccatatttggttcttctttgaggaagcgattccgagtcgagaggctcgcttgtttggaaagaaactgatagaactggcaatgcaggaaagtatgcaactgtcctttgattcttttgatcgcatgtttccaaatcaggatgtccttcctaaggggggatttggaaatttgattgccttgccttttcaaggagaagcttaccatcaagtgcgaacggtctttgtggatgaacattttcaaccttatggagaccaatggaggtatctgcaaggaattcagaagatttcaactgctaaagtggcactgttaatccaagaggagttaggcaagcaagaattggataaggagttgaaggtcgttttatccaatatgatccaacttaaaaaatcgtctgtgacacccaagacactgtttttcttgaaaaatatggcttcattttctaatcccgaattttatttaaagcaggctatgcgacagccaacctatcaaattcctgagcgaatgtatttatttggagaatccgattattatttatggctgccaagaggcttgttatatccattgcaagataaatttaagcaggtagttgtggaggataggagaaaggtacaaaggtctattagagtagcatttaagggagagcttactttggagcaagaattagccctgtcagatatgaattctaaagaaaatggtttacttcatgcgggacaggttttggaaagagcgttttag

SEQ ID NO: 1522 - DNA (genomic), 888 bp, Streptococcus pneumoniae; double-stranded, circular
  misc_feature (B) LOCATION 1...888
  hypothetical: NO
  anti-sense: NO
tgtgcgcttcgaancaaaggatccgtcatggcgaaaacattttttattccaaataaacagagcattttaggagaacaagagattttgaatgccaagtcgatcttggccttgctagacggtttggagtcacatagctatgatgtagtctatctccgtcagcctcttaatcgtctcgaatatatcgagtgtgcgatagtggggcaatcacaatttctctttaaggtcagttatgctgatggtcaaaaggcttaccgtgtcgatcttcctgacctactaacaaagacagactggcagattatcaagtcatttttagatgctttgcttgcttatacagggactgatattgaagggctagatggttttgattttgaagcttatttccaagcaagtattcaagcctatctagcagacgctgtagctcgttttacgatttgccaaggaatttttaatcctattttctttagtcgtgagaacttgaaaagctttttagaggcagatggcttggctcagtttgaagcgcgtgtgcgtgcggttcaagagacagatgcctattttgcaagagtttccttctatcaggatggagaaggaaaagtgcatggcgtttaccatttagctcaaggagtcaagacagttttaccgagagaaccgtttgttcctgcagcctatattgagcaattggtggataaggaagtccagtgggagattgacttggttcaaatcacaggagacggctctaaaccagaagactatgaatccatagctcgcttggactatgcaaaattcttagaggtattacccccatctttttaccaccagctagacgccaatcaaatagaaatacaccccatcttaggacaagattttaaaacattagcacaagaaaagtaa

SEQ ID NO: 1523 - DNA (genomic), 321 bp, Streptococcus pneumoniae; double-stranded, circular
  misc_feature (B) LOCATION 1...321
  hypothetical: NO
  anti-sense: NO
ggaaacttgctcatgtgtgaaaaaatccgtattcgcagggtatctgattatcctagtgccagaggtggtttagaagatatcctcatcatggaaaatatgaccaatcatctccttttggttcaaatccgagtgcatggctatttgcttgattttgctagtattgaagggcaaaggcaaaagcattatcgtttgaaaaatttacctcagacggttgaactgacagtggatgatgtggaggaggatgtggatttgaccctacccgaaaatcgaagttatcaagaagctgatttttttgaacgcatgtttcgagagaactgttaa

SEQ ID NO: 1524 - DNA (genomic), 888 bp, Streptococcus pneumoniae; double-stranded, circular
  misc_feature (B) LOCATION 1...888
  hypothetical: NO
  anti-sense: NO
cagcttgttcgaaaggtgtcagaaggggcagaccttatcagcatgaaaggggatgtcatcacagaacatcaattttatgagcaagtgaaaaacaacccttcagcccaacaagtcttgttaaatatgaccatccaaaaagtttttgaaaaacaatatggctcagagcttgatgataaagaggttgatgatactattgccgaagaaaaaaaacaatatggcgaaaactaccaacgtgtcttgtcacaagcaggtatgactcttgaaacacgtaaagctcaaattcgtacaagtaaattagttgagttggcagttaagaaggtagcagaagctgaattgacagatgaagcctataagaaagcctttgatgagtacactccagatgtaacggctcaaatcatccgtcttaataatgaagataaggccaaagaagttctcgaaaaagccaaggcagaaggtgctgattttgctcaattagccaaagataattcaactgatgaaaaaacaaaagaaaatggtggagaaattacctttgattctgcttcaacagaagtacctgagcaagtcaaaaaagccgctttcgctttagatgtggatggtgtttctgatgtgattacagcaactggcacacaagcctacagtagccaatattacattgtaaaactcactaagaaaacagaaaaatcatctaatattgatgactacaaagaaaaattaaaaactgttatcttgactcaaaaacaaaatgattcaacatttgttcaaagcattatcggaaaagaattgcaagcagccaatatcaaggttaaggaccaagccttccaaaatatctttacccaatatatcggtggtggagattcaagctcaagcagtagtacatcaaacgaatag

SEQ ID NO: 1525 - DNA (genomic), 273 bp, Streptococcus pneumoniae; double-stranded, circular
  misc_feature (B) LOCATION 1...273
  hypothetical: NO
  anti-sense: NO
tggcggtctcgctcccttggttatctttggagtagcagtatcttggaaggctattgcaggtggaacagcacttataggttctggtttggcagctggttattttttaggaggagattaactatgatgaaagatttgaacaactatcgtgaaatttctaataaggaattgcaagaaatcaagggtggctttggtgtaggtgttggtatcgctttatttatggcaggttataccattggaaaagaccttcgtaaaaagtttggtaagtcatgctag

SEQ ID NO: 1526 - DNA (genomic), 255 bp, Streptococcus pneumoniae; double-stranded, circular
  misc_feature (B) LOCATION 1...255
  hypothetical: NO
  anti-sense: NO
agatcaactcgtggtgaagaacacctaagatattttgctttttatcttgattattacctaagaactggggtagctggattcgaaccaacgcatgagggagtcaaagtcccttgccttaccgcttggctataccccattaatgaaatggagagagagggattcgaacccccgaacccgaaggagcggatttacagtccgccgcgtttagcctcttcgctatctctcctacaatcaacatggactattatatcatga

SEQ ID NO: 1527 - DNA (genomic), 518 bp, Streptococcus pneumoniae; double-stranded, circular
  misc_feature (B) LOCATION 1...518
  hypothetical: NO
  anti-sense: NO
aacaggctcgtatcgcagaagctgctggtgcggcagctgtgatggccttggaacgaattccggctgatattcgtgcagctggaggagtttcccgcatgagcgacccaaagatgattaaggaaatccaagaagcggttagtattccagtaatggctaaggtcagaatcgggcattttgttgaagctcagattttagaggctattgaaattgattatatcgacgagagtgaagttctatctccagctgatgaccgtttccatgtggataagaaagaattccaagttccttttgtctgtggtgctaaggatttaggtgaagccttgcgtcgtatcgctgaaggtgcttccatgattcgtaccaaaggagaaccagggacaggggatatcgtccaagctgttcgtcatatgcgtatgatgaatcaggaaattcgccgcattcaaaacttacgtgaggacgagctttatgttgctgccaaggattttgcaagtccctgtagaattggtccaatatgttcatga

SEQ ID NO: 1528 - DNA (genomic), 567 bp, Streptococcus pneumoniae; double-stranded, circular
  misc_feature (B) LOCATION 1...567
  hypothetical: NO
  anti-sense: NO
tcagtatatcgatcagctaggagaagcttaatggacaagaaaacagtaaaggtaattgaaaaatacagcatgccttttgtccaattggtacttgaaaaaggagaagaagaccgtatcttttcagacttgactcaaatcaagcaagttgttgaaaaaacaggtctgccttcttttttaaaacaagtggcagtagacgagtcggataaggaaaaaacaattgcttttttccaagattctgtgtcacctttattacaaaactttatccaggttctggcctacaatcacagagcaaatcttttttatgatgtgcttgtagattgcttgaaccgacttgaaaaagaaacaaatcgatttgaagtgacgattacgtctgctcatcctctaactgatgaacagaagactcgtttgctccctttgattgagaaaaaaatgtctctgaaagtaaggagtgtaaaagaacaaatcgatgaaagtctcattggtggttttgtcatttttgccaatcacaagacaattgatgtgagtattaaacaacaacttaaagttgttaaagaaaatttgaaatag

SEQ ID NO: 1529 - DNA (genomic), 1350 bp, Streptococcus pneumoniae; double-stranded, circular
  misc_feature (B) LOCATION 1...1350
  hypothetical: NO
  anti-sense: NO
tcccaacatcgtggtgaagactctgctagtcaattagaaaaagttttaaacatcgtcaaaagcgattcagagcgtcgttttgtagtcgtttctgcgcctggtaaacgcaatgctgaagatactaaggttacggatgccctgattaaatactaccgcgactatgttgcgggtaacgatattagcaagagccaaagctggattatcgaccgctatgctgctatggttagtgaattgggactaaaaccagctgtgctagaaaaaatttctaaaagcattcacaccttggccactcttcctattgaagaaaatgaatttctctacgatactttcctagcagccggtgaaaataacaatgccaaattgattgctgcctactttaaccaaaatggtatcgatgcacgctatatgcaccctagagaagctgggattgtggtcacaagtgaacctggtcacgctcgcatcattccatcaagttatgacaagattgaagaattgacaaacaccaatgaagtccttgtcattcctggtttctttggtgtcactaaggaaaatcaaatctgtactttctcacgtggaggatctgatattacaggttctatcattgctgctggtgtcaaagctgacctctatgaaaactttacggacgttgatggtatctttgcagcccaccctggtattatccaccaaccacactcgattcctgagttgacctaccgtgaaatgcgcgagttggcctatgcaggcttctcagtccttcatgacgaggctcttcttcctgcctaccgtggaaaaattcctctggttatcaagaataccaacaaccctgaccatccaggtactcgtatcgttctaaaacacagtaatgatgaatttccagttgtgggaattgctggtgactcaggctttgtcagcattaatatgtcgaaatacctcatgaaccgtgagattggatttggccgcaaggttctgcaaatcctggaagaacttaacatcggttgggaacatatgccaacaggtatcgacgatctttctatcattctccgttctcgccaactaactcccatcaaggaagaagaaatcctgcgtcagttggttcaaaaggctaaagtagatcatgcagaaatcgaacacgacctttctatcattatgattgttggtgaaaaaatgaagagccacatcggagtgactgctactgcgacacgcgctctatctgaaaacaaaatcaacatccagatgatgtctcaaggttctagtgaagtttctattatgtttgttgtcaataaagaccaagagaaagcagcaattaaagccctctacaatgccttttttggagaaagtaaggaagactaa

SEQ ID NO: 1530 - DNA (genomic), 1041 bp, Streptococcus pneumoniae; double-stranded, circular
  misc_feature (B) LOCATION 1...1041
  hypothetical: NO
  anti-sense: NO
tctgagaatcgaggaaaaaagatgcaagaaaagattttggtaactggtggtgccggttttattggaacccacactgttattgaattgatccaagcaggccatcaagttgttgtggtggataatcttgtcaatagcaatcgtaagagtttagaagttgttgaaagaatcacaggagttgagattcctttctatgaggcagatattcgtgacacagataccctcagagatattttcaagcaggaagaaccgactggtgtcattcactttgctggtttgaaggctgttggcgaatcaacacgtatccctcttgcctactatgacaacaatatcgctggaactgtcagccttttgaaagccatggaagaaaacaactgtaaaaacatcatcttcagttcttctgcgacagtttacggggatccgcacacagtgcccatcttggaagatttcccactttcagtgaccaacccatacggtcgtactaagctcatgctagaggaaattttgactgatatttacaaagcagactcagaatggaatgttgtcttgcttcgttactttaacccaatcggagcccatgagagtggtgatttgggagaaaatccaaacggtattccaaacaatctcttgccatatgtgactcaagtagccgttggaaaattagagcaagtgcaagtgtttggagacgattacgatacggaagatggaacaggtgttcgtgactatatccacgttgtcgatttggctaagggtcacgttgcagctttgaaaaaaatccaaaaaggttcaggactaaacgtttataaccttggaactggtaaaggttactcagttcttgaaattatccaaaacatggaaaaagcggtgggacgtcctattccttaccgcatcgtagaacgtcgcccaggtgatatcgctgcctgctactcagacccagcaaaagctaaagcagaactcggttgggaagcagaactcgacatcacccaaatgtgtgaagacgcatggcgttggcaaagcaagcatccaaatggatttgaagactaa

SEQ ID NO: 1531 - DNA (genomic), 213 bp, Streptococcus pneumoniae; double-stranded, circular
  misc_feature (B) LOCATION 1...213
  hypothetical: NO
  anti-sense: NO
atggagaatcgtcacatgaaacatttttttgcaggaattggtgagataaaacttgttggctacttattgtatatatgtgtaggactagcccctctttttcatatatatgtcataggttcggaactgagttttgtgaaaatagtgttatctattttgggagttatatttgtaagtatgttaactattgctcgaatttatcggacttttctataa

SEQ ID NO: 1532 - DNA (genomic), 219 bp, Streptococcus pneumoniae; double-stranded, circular
  misc_feature (B) LOCATION 1...219
  hypothetical: NO
  anti-sense: NO
agactttgtcgcctagaccctatatttcaagaattaagtgaccttgatgatctaaatgtattgtggtatactatttttgtcatcggttaccgattacgttcctatgggttcgtgagaggaggtgaaactaatgagccttatcatagagctcgctcttactattatagcggatgttatagctggaattatcttgtatttcgtctgcagatggctagatag

SEQ ID NO: 1533 - DNA (genomic), 1107 bp, Streptococcus pneumoniae; double-stranded, circular
  misc_feature (B) LOCATION 1...1107
  hypothetical: NO
  anti-sense: NO
cctgtgcgtcgatccggctggtgggcacctttcatcacgactttggtggccgatggttttaataacgtatcggacatcattggaaatgtggccctcttaatcgggattcggatggcgcgccagcctgcagaccgtgaccaccgttttggtcattggaagattgaagatttggcaagcttgatcacttctatcatcatgttctatgtcggtttcgatgttctaagagataccattcaaaagattctcagtcgggaagaaacggtcattgatcctcttggtgcaactctaggaatcatttctgcagcgattatgtttgtggtctatctctacaatactcgcctcagtaagaaatccaactccaaggcgctgaaggcagctgctaaggacaatctttctgacgctgttacctcacttggaaccgccattgccatcctagctagtagtttcaattatccgattgtggataaactggttgctatcatcatcactttctttatcttgaagactgcctatgatatcttcatcgagtcttcctttagtctttcagatggctttgacgaccgcctgctcgaggactaccaaaaggctatcatggaaattcccaaaatcagcaaggtcaaatcgcaaagaggtcgcacctacggtagcaacatctacctggatattacactagagatgaatcctgacttgtctgtttttgaaagccatgaaatcgcggatcaggtcgagtctatgctggaggagcgttttggcgtctttgataccgatgtccatatcgaaccagcacctatccctgaggatgaaattttagacaatgtctataaaaaattgcttatgcgtgaacaattgattgaccaaggaaaccaactagaagaactcttgactgatgattttgtctatattcgccaagatggagagcagatggataaagaggcttataagaccaaaaaagagttaaattctgctatcaaggacattcaaattacttccatcagtcaaaaaaccaaactcatctgctatgagttagatggtatcatccataccagtatctggcgtcgccacgaaacctggcaaaatatctttcatcaagaaaccaaaaaagaatag

SEQ ID NO: 1534 - DNA (genomic), 282 bp, Streptococcus pneumoniae; double-stranded, circular
  misc_feature (B) LOCATION 1...282
  hypothetical: NO
  anti-sense: NO
acacagctgctacaactcttaatggaggagctactgcaggggctttttcaggtgttgcctgtactcttgaatgccttgaagattgaaaatcttgttcttggtatcattgctattgtttactataaaggagataagcgtgtaggtgcagctccgtctgtactaatgattgtttctggtggagttagtctcattccattcttaggatgggttggggggattcttgctattatcggaggatctctattccttgcaacattgaagaaattcaaatcagaagaataa

SEQ ID NO: 1535 - DNA (genomic), 192 bp, Streptococcus pneumoniae; double-stranded, circular
  misc_feature (B) LOCATION 1...192
  hypothetical: NO
  anti-sense: NO
gccattatgctagtgtcgcaaatacagcaagtacctactccgtatcttctggaagtggaagttctggcggtggcttctctggaggcggaggtggcggcagtatcggagccttttaaagagagctaccatagactgaaaaagtatgatataatggaagatagaagaaagacaaactataagaaaagtcaatag

SEQ ID NO: 1536 - DNA (genomic), 1356 bp, Streptococcus pneumoniae; double-stranded, circular
  misc_feature (B) LOCATION 1...1356
  hypothetical: NO
  anti-sense: NO
gaaataatgcttgatttactgaaacaaaccatttttaccagagattttatctttatcctgattttgttaggtttcatccttgttgtgaccctcttattactggaaaatagacgtgataatattcagttgaagcaaatcaatcaaaaggttaaagatttgattgcaggagattattccaaggttcttgatatgcaaggtgggtctgaaatcaccaatattaccaataatttgaatgacttgtcggaggttattcgtctcactcaggaaaatctagaacaagagagtaagaggctaaatagtattctgttttatatgacagatggggttcttgcgaccaaccgtcggggtcagattatcatgattaacgatacagccaagaagcaactggggttggttaaggaagatgttctgaatagaagcattttggaattgctcaagatagaagaaaactatgaattgcgtgatttgattacccaaagtccagaattgttgctagattcccaagatatcaatggtgaatatttgaaccttcgagttcgctttgccttgatacgtcgagagtctggctttatttcaggtttggtggctgttttgcatgatacgacggagcaggagaaggaagaacgcgaacgaagactctttgtttccaatgttagccatgagttacggactcctctgactagcgtaaaatcctatcttgaagccttggatgagggggctttgtgtgaaactgtagcaccagactttatcaaggtttctcttgatgagaccaaccgtatgatgcgcatggtgacggatctcctccatctttcacgtattgataatgctaccagtcacctagatgtggaactgattaacttcactgcttttattacctttatcctcaatcgttttgacaagatgaaaggacaggaaaaggagaaaaaatatgagttggtgagagattatcccatcaattctatctggatggaaattgatacagataagatgacgcaggttgtcgacaatattttaaataatgctattaagtattcgccagatgggggtaaaatcactgtcagaatgaagacaactgaagaccagatgattttatccatttctgaccacggtttggggattcctaagcaggatttaccacgtatctttgaccgtttctatcgtgtggatcgtgctagaagtcgtgcacaaggtggtacaggtctaggactgtctatcgctaaagaaattatcaaacaacataagggctttatttgggccaagagtgaatacggcaagggttcaacctttaccattgtgctcccttatgataaggatgcagtgaaagaagaagtatgggaggatgaagtagaagactag

SEQ ID NO: 1537 - DNA (genomic), 297 bp, Streptococcus pneumoniae; double-stranded, circular
  misc_feature (B) LOCATION 1...297
  hypothetical: NO
  anti-sense: NO
ccatcattccgtcctggtgacactgttcgtgtacatgcgaaagttgtcgaaggtaaccgtgaacgtatccagatttttgaaggtgttgttatcgcacgtaaaggtgctggaatctcagaaaactacacagttcgtaaaatctctaacggtgtaggtgttgagcgtatcttcccaatccacactccacgtgttgaaaaaatcgaagttgttcgttacggtaaagtacgtcgtgcgaaattgtactacttgcgtgctcttcaaggtaaagcagctcgtatcaaagaaatccgtcgttaa

SEQ ID NO: 1538 - DNA (genomic), 729 bp, Streptococcus pneumoniae; double-stranded, circular
  misc_feature (B) LOCATION 1...729
  hypothetical: NO
  anti-sense: NO
ttgcctctccgcttgggaatggcgaaacagcacaagccgtggaacttttctatcccttgtgcatttttgacctatatttccatcgtttttggggaattatatcctaagagaatcgctcttaatctaaaggatgccttgcgaattcgtacagcgccggttatcattgggatcggaaaactagtcagtccttttgtttggcttttagctgcttcgaccaatttcttgagccatttgactcctatgtcattcgatgatgcggatgaaaagatgacccgtgatgaaattgcctatatgctgacaaatagtgaagaaacattggatgctgatgagattgagatgctacaaggtgtcttttcgctcgatgaactgatggcacgagaggttatggttcctcgaacggatgcctttatggtggatattcaggatgatagtcaagccattatccaaagtattttaaaacaaaattattctcgtatcccggtttatgatggggataaggacaatgtaattggaatcattcacaccaagagtctccttaaggcaggctttgtggacggttttgacaatattgtttggaagagaattttgcaagatccactttttgtacctgaaactatttttgtggatgacttgctanaagaactgcgaaatacccaaagacaaatggcgatcttgctggatgaatacagtggtatggctgggttggtgactttgggaaaactcttataa

SEQ ID NO: 1539 - DNA (genomic), 1734 bp, Streptococcus pneumoniae; double-stranded, circular
  misc_feature (B) LOCATION 1...1734
  hypothetical: NO
  anti-sense: NO
caagttatttttaagagaacagagcggggaacaatggagaaaatcagtttagaatctgctaagagggggtcggacctagttttggacacacttcgtgatttaggagtggataccatctttggttatcctggtggtgcggttttgcctttttatgatgcgatatataattttaaaggcattcgccacattctagggcgccatgagcaaggttgtttgcatgaagctgaaggttatgccaaatcaactggaaagttgggtgttgccgtcgtcactagtggaccaggagcaacaaatgccattacagggattgcggatgctatgagcgatagcgttccccttttggtctttacaggtcaggtggcgcgcaggggattggggaaggatgcctttcaggaggcagacatcgtaggaattaccatgccaatcactaagtacaattaccaagttcgtgagacagctgatattccgcgtatcattacggaagctgtccatatcgcaactacaggccgtccagggccagttgtaattgacctaccaaaagacatatctgctttagaaacagacttcatttattcaccagaagtgaatttaccaagttatcagccgactcttgagccgaatgatatgcaaatcaagaaaatcttgaagcaattgtccaaggctaaaaagccagtcttgttagctggtggtggaattagttatgctgaggctgctacggaactaaatgaatttgcagaacgctatcaaattccagtggtaaccagtcttttgggacaaggaacgattgcaacgagtcacccactctttcttggaatgggaggcatgcacgggtcattcgcagcaaatattgccatgacggaagcggactttatgattagtattggttctcgtttcgatgaccgtttgacggggaatcctaagactttcgctaagaatgctaaggttgcccacattgatattgacccagctgagattggcaagattatcagtgcagacattcctgtagttggagatgctaagaaggccttgcaaatgttgctagcagaaccaacagttcacaacaatactgaaaagtggattgagaaagtcactaaagacaagaatcgtgttcgttcttatgacaagaaagagcgtgtggttcaaccgcaagcagttattgaacgaattggtgaattgacgaatggagatgccattgtggtaacagacgttggtcaacaccaaatgtggacagctcagtattatccctaccaaaatgaacgtcagttagtgacttcaggtggtttgggaacaatgggctttggaattccagcagcaatcggtgctaaaattgctaacccagataaggaagtagtcttgtttgttggggatggtggtttccaaatgaccaaccaggagttggctattttgaatatttacaaggtgccaatcaaggtggttatgctgaacaatcattcactcggaatggttcgccagtggcaggaatccttctatgaaggcagaacatcagagtcggtctttgatacccttcctgatttccaattgatggcgcaggcttatggtattaaaaactataagtttgacaatcctgagaccttggctcaagaccttgaagtcatcactgaggatgttcctatgctaattgaggtagatatttctcgtaaggaacaggtgttaccaatggtaccggctggtaagagtaatcatgagatgttgggggtgcagttccatgcgtag

SEQ ID NO: 1540 - DNA (genomic), 975 bp, Streptococcus pneumoniae; double-stranded, circular
  misc_feature (B) LOCATION 1...975
  hypothetical: NO
  anti-sense: NO
gggacctcccggctcgtggtgaagacgacctgcaactggccatggccatgcaggacctgcacctccacggcgccgagctggggcagtcgcacctgcaggcgcgccgcatggctttcggctgcgctggcgacctggatgcgcccctgcacggcatctagcaggcgcgcgagatcggccagcggcagtggccggctcccgctcgatgccagcaggcgtgccagcaggcggtcgccgggggtttgcatggcaggcaatggcacaggcgcttggtcgtcggggggcagtgcggatggatcggtttctccgggttgccgacgctcctctccgcggccttcgccgcccgctgtcggcgcgggcggcgagacctggacactggcctgcgccgtggacgcgacctcggctgcggttttcgccgggaagccggggccgggctgtggccgctcatgcgtccgacctgcgatttgcgggtgggaggacaccggcaccagcggcggttcgtcgaccggaggcgccgaaacgctggccggctcccgggcttgcgtggacgccgcgacgcgcgcggaaaccgccggcgcttgccgtgctaccgatccggacggcaacactgttggcgttggcgttggcgttggcgttggcgttggcgttggcgttggcgttggcgttgcttccgcggcaactggcacgggggcttgccnattggtcggcggccggtcggcggcaggcgccgcgggctggtcggcgagaggcgtcgaggtcggcgcgtcgctgttcgcggcgggctcttcggcctctgtcgtttcgtcgcccttgtcgaacggtggcctgggcgccggcggtcggtgcgcgggcagggcctgttcgaaggcgatctgctgcgcgcgcagcggcggaaggggggcaggggtgtcggacgacacgagcggagccgtatccacggcgttcagcttgagcatggccaggtctcgtggcgggtga

SEQ ID NO: 1541 - DNA (genomic), 291 bp, Streptococcus pneumoniae; double-stranded, circular
  misc_feature (B) LOCATION 1...291
  hypothetical: NO
  anti-sense: NO
tgcctcccccgtcagttttcaggtattttggcagttgcagaaagctatccagatctgaaagctagtgctaactttgttaaattgcaagaggagttgacaaacacagaaaataaaatttcttactctcgtcaactctataacagtgttgtcagcaactacaatgtaaaattagaaactttcccgagcaatattatcgctggaatgtttggatttaaagcggcagatttccttcaaacacctgaagaggaaaagtcggttcctaaagttgattttagcggtttaggtgactaa

SEQ ID NO: 1542 - DNA (genomic), 252 bp, Streptococcus pneumoniae; double-stranded, circular
  misc_feature (B) LOCATION 1...252
  hypothetical: NO
  anti-sense: NO
gcaagcccccgtgccagttgccgcggaagcaacgccaacgccaacgccaacgccaacgccaacgccaacgccaacgccaacgccaacagtgttgccgtccggatcggtagcacggcaagcgccggcggtttccgcgcgcgtcgcggcgtccacgcaagcccgggagccggccagcgtttcggcgcctccggtcgacgaaccgccgctggtgccggtgtcctcccacccgcaaatcgcaggtcggacgcatga

SEQ ID NO: 1543 - DNA (genomic), 183 bp, Streptococcus pneumoniae; double-stranded, circular
  misc_feature (B) LOCATION 1...183
  hypothetical: NO
  anti-sense: NO
ttgccaccccgtggtgaagaagccgcaggctactcaaagtatagctttgaggttgcaaataaaactgacgaagtcagctcaaaacactgttttgagattgtggatagaactgacgaagtcagtaaccatacgcacggtaaggcgacgttgacgtggtttgaagagattttcgaagagtattaa

SEQ ID NO: 1544 - DNA (genomic), 660 bp, Streptococcus pneumoniae; double-stranded, circular
  misc_feature (B) LOCATION 1...660
  hypothetical: NO
  anti-sense: NO
acggactaccgcctttatatcgaactcttacgcaatctagcagatgaagcaggtttgccgaaaacgcttgatacagggagtttagctggaattaaaacgcacgagtattgcacgaataaccaaccaaacaaccactcagaccatgtggatccatacccttacttggcaaaatggggcattagcgctgagcagtttaagtatgatattgagaacggcttgacgattgaaacaggctggcagaagaatgacactggctactggtacgtacattcagacggctcttatccaaaagacaagtttgagaaaatcaatggcacttggtactactttgacagttcaggctatatgcttgcagaccgctggaggaagcacacagacggcaactggtactggttcgacaactcaggcgaaatggctacaggctggaagaaaatcgctgataagtggtactatttcaacgaagaaggtgccatgaagacaggctgggtcaagtacaaggacacttggtactacttagacgctaaagaaggcgccatggtatcaaatgcctttatccagtcagcggacggaacaggctggtactacctcaaaccagacggaacactggcagacaagccagaattcacagtagagccagatggcttgattacagtaaaataa

SEQ ID NO: 1545 - DNA (genomic), 561 bp, Streptococcus pneumoniae; double-stranded, circular
  misc_feature (B) LOCATION 1...561
  hypothetical: NO
  anti-sense: NO
ttcttgtaccgaaaattgcctcaaaggtatgcaagatacagaaggtgctngaacttatcccaaactcaattccaagaaggtaaaacagctgctatcatcgacggaccttggaaagctcaagcctttaaagatgctaaagtaaactacggagttgcaactatcccaattcttccaaatggaaaagaatatgctgcattcggtggtggtaaagcttggttcattcctcaagccgttaagaaccttgaagcttctcaaaaatttgtagacttccttgttgcaactgaacaacaaaaagtattatatgataagactaacgaaatcccagctaatactgaggctcgttcatacgctgaaggtaaaaacgatgagttgacaacagctgttatcaaacagttcaagaacactcaaccactgccaaacatctctcaaatgtctgcagtttgggatccagcgaaaaatatgctctttgatgctgtaagtggtcaaaaagatgctaaaacagctgctaacgatgctgtaacattgatcaaagaaacaatcaaacaaaaatttggtgaataa

SEQ ID NO: 1546 - DNA (genomic), 1224 bp, Streptococcus pneumoniae; double-stranded, circular
  misc_feature (B) LOCATION 1...1224
  hypothetical: NO
  anti-sense: NO
gaaatgtaccgttatcaaattggcattcccacattagaatatgatcagtttgtcaaagaacatgaattagccaatgtattacaaagtagtgcttgggaggaagttaagtctaattggcaacatgagaagtttggtgtttacagggaagaaaaattactggcgacagctagtattttgattagaactcttccgctaggctataaaatgttttacatcccaagaggacctatattggattatggggataaagaactcttgaattttgccattcagtctattaagtcctatgctcgcagtaagagagcggtttttgtgacttttgacccaagtatttgcctatctcaaagtttaatcaatcaggaaaagacagaatttcctgaaaatctggctattattgatagtttgcaacaaatgggagtaaggtggtcaggaaaaacggaggaaatgggagacaccattcaacctcgtattcaggcgaaaatatacaaggaaaattttgaagaagataaactttccaagtcaacaaaacaggctattcgaacagcacgaaacaaagggcttgagattcaatatggtggactggaactattagattcattttcggagttgatgaaaaaaactgagaagcgaaaagagattcatttgaggaatgaagcctattataaaaaattgttagataattttaaggacaaggcctatatcaccttggccaccttggatgtttctaaacgttcgcaagaattagaagaacagttagcgaaaaatagagccttggaagagacctttactgagtcgactcgaacttcaaaagtagaagcgcagaagaaggaaaaagaacgtttgttagaggaattgaccttcttgcaggaatatatagatgtaggtcaagcgagagttcctttagcggctactttgagtttggaatttggtactacctctgtcaatatatatgctggtatggatgatgattttaaacgttacaatgcaccaattttaacatggtatgaaacggctcgctatgcctttgagcgaggtatggtctggcaaaatttaggtggtgttgaaaactctctcaatggtggactttatcattttaaggaaaaatttaatccaacgattgaagaatacttgggtgaatttacaatgcccactcatcctctctatcctctgttaagacttgctcttgatttccgtaaaacattaagaaaaaaacatagaaagtaa

SEQ ID NO: 1547 - DNA (genomic), 864 bp, Streptococcus pneumoniae; double-stranded, circular
  misc_feature (B) LOCATION 1...864
  hypothetical: NO
  anti-sense: NO
ggtggaaaccgcgtttctgacgcccctaggttaaatcaacctaggattgtcggacgcggttcttttgcttatttagtctattgtgtgaaagaaaggagagccgtggacaacctttatcttgtaaaagacgatagtcaactagctgcatttcgtgattttgtagtaagaaatactgaaaagttgaaagattatcaatcttttttaaagaatgaacttgcagtctgtgatttaccgcaagccgttatttggtcaagttttaatgctgctacacagattattagggaaagcgctgttccagcctatacaaataatagacgaatggttatgacgcctgatttagctgtatggaaagagttgtatttgtatcagttgatggactacgagtgttctcagcaaactcaagcaatagaaagccattatcattctttatctgaaaatttcctcttacagattgtaggacatgagttagctcattggtcggagtattttttagatgattttgatggttacgactcttacatctggtttgaagaggggatggttgaatatattagtcgcaagtatttcttgacagaagaggaatttcaagcggaaaaaatttgtaatcagtctcttgtagaactttttcagaagaagtatggttggcattcattgaatgattttggttcttcgacttatgataagaattatgcaagtattttttacgaatactggcgtagttttttgacaatagataagttggtagaaaatctaggtagtgtacaagcggtcttcgattcttatcatttatgggcaaatacagataaaactcttcccttgttaaattggtttgttcagcagaaattaattgaaaaagagatataa

SEQ ID NO: 1548 - DNA (genomic), 771 bp, Streptococcus pneumoniae; double-stranded, circular
  misc_feature (B) LOCATION 1...771
  hypothetical: NO
  anti-sense: NO
aaaggaaaccgtatgacagatgcgattttacaggtatcagacctgtccgtttattataataaaaagaaggctttgaatagtgtttccctatctttccaacctaaggaaattacagccttgattggtccatctggatcagggaagtcaaccctcctcaagtctctcaaccgcatgggagatctcaatccagaggtgaccacaactggatccgtggtgtacaatggccacaacatctacagtccgcgtacagatacggttgaattacgtaaggaaatcggaatggttttccaacaacctaatcctttccctatgactatctatgagaatgttgtctacgggcttcgtatcaatggaattaaggataagcaggttctggatgaagccgtagaaaaagccttgcaaggtgcctctatctgggatgaggtcaaggatcgtctatatgattcagctattggattgtcaggtggtcaacagcagcgtgtctgcgtggcccgtgtcttggcaactagtcctaaaatcatcctcttggatgagccaacttcggctttggatccgatttcagctggtaaaattgaggaaaccttgtatggtctaaaagacaagtacaccatgcttctggtaacccgttccatgcagcaagcttcacgtatctctgataagacaggatttttcctagatggagatttgattgaatttaatgataccaagcagatgttccttgatccccaacacaaggaaacggaagactatattacaggaaaatttggataa

SEQ ID NO: 1549 - DNA (genomic), 498 bp, Streptococcus pneumoniae; double-stranded, circular
  misc_feature (B) LOCATION 1...498
  hypothetical: NO
  anti-sense: NO
ttctctatttttcttgtttcaatagctgagaatgatttttacattggattttaccattcctttcaacactccattatatcggattttagcatttttttcaatttctatttcttttcacttccccctcccttatttataggaaaatatggtaaaatagaacagactaaaaatcatcatttcacgaaaggatgcaagatgaaaattacgcaagaagaggtaacacacgttgccaatctttcaaaattaagattctctgaagaagaaactgctgcctttgcgaccaccttgtctaagattgttgacatggttgaattgctgggcgaagttgacacaactggtgtcgcacctactacgactatggctgaccgcaagactgtactccgccctgatgtggccgaagaaggaacaaaccgtgatcgcttgtttaaaaacgtacctgaaaaagacaactactatatcaaggtgccagctatcctagacgatggaggagatgcctaa

SEQ ID NO: 1550 - DNA (genomic), 195 bp, Streptococcus pneumoniae; double-stranded, circular
  misc_feature (B) LOCATION 1...195
  hypothetical: NO
  anti-sense: NO
gaagttagccgcaggttgctcaaagcagtgtttgaggttgtcgataaaactgacgaagtcagcttaaaacactgttttgaggttgcagatagaactgacgaagtcagtaaccatacctacgacaaggtgaagctgacgtggtttgaagagattttcgaagagtatcatacgaaaaagccctgttcctcaagatga

SEQ ID NO: 1551 - DNA (genomic), 198 bp, Streptococcus pneumoniae; double-stranded, circular
  misc_feature (B) LOCATION 1...198
  hypothetical: NO
  anti-sense: NO
caaggtagccgtatcggaaggtgcggctggatcacctcctttctaaggataaggaactgcgcattggtcttgtttagtcttgagaggtcttgtggggccttagctcagctgggagagcgcctgctttgcacgcaggaggtcagcggttcgatcccgctaggctccattggtgagagatcatcaagtaatgcacattga

SEQ ID NO: 1552 - DNA (genomic), 4962 bp, Streptococcus pneumoniae; double-stranded, circular
  misc_feature (B) LOCATION 1...4962
  hypothetical: NO
  anti-sense: NO
aaggtcttacgtattcgtaagttatcagtaggagcctgctcgctgatgattggtgctgttttatttgctggtccagccttggctgaagaaactgcagttcctgaaaatagcggagctaatacagagcttgtttcaggagagagtgagcattcgaccaatgaagctgataagcagaatgaaggggaacatactagagaaaacaagctagaaaaggcagaaggagtagcgacagcatctgaaactgcagaagcagctagcgcagctaaaccagaggaaaaagcaagtgaggtggttgcagaaacaccatctgcagaagcaaaacctaagtctgacaaggaaacagaagcaaagcccgaagcaactaaccaaggggatgagtctaagccagcagccgaagctaataagactgaaaaagaagtccagccagatgtccctaaaaatacagaaaaaacattaaaaccaaaggaaatcaaatttaattcttgggaagaattgttaaaatgggaaccaggtgctcgtgaagatgatgctattaaccgcggatctgttgtcctcgcttcacgtcggacaggtcatttagtcaatgaaaaagctagcaaggaagcaaaagttcaagccttatcaaacaccaattctaaagcaaaagaccatgcttttgttggtggagaagagttcaaggcctatgcttttgactattggcaatatctagattcaatggtcttctgggaaggtctcgtaccaactcctgacgttattgatgcaggtcaccgtaacggggttcctgtatacggtacacttttcttcaactggtctaatagtattgcagatcaagaaagatttgctgaagctttgaagcaagacgcagatggtagcttcccaattgcccgtaaattggtagacatggccaagtattatggctatgatggctatttcatcaaccaagaaacaactggagatttggttaaacctcttggagaaaagatgcgccagtttatgctctatagcaaggaatatgctgctaaggtaaaccatccaatcaagtattcttggtacgatgccatgacctataactatggacgttaccatcaagatggtttgggagaatacaactaccaattcatgcaaccagaaggagataaggttccggcagataacttctttgctaactttaactgggataaggctaaaaatgattacactattgcaactgccaactggattggtcgtaatccttatgatgtatttgcaggtttggaattgcaacagggtggttcctacaagacaaaggttaagtggaatgacattttagacgaaaatgggaaattgcgcctttctcttggtttatttgccccagataccattacaagtttaggaaaaactggtgaagattatcataaaaatgaagatatcttctttacaggttatcaaggagaccctactggccaaaaaccaggtgacaaagattggtatggtattgctaacctagttgcggaccgtacgccagcggtaggtaatacttttactacttcttttaatacaggtcatggtaaaaaatggttcgtagatggtaaggtttctaaggattctgagtggaattatcgttcagtatcaggtgttcttccaacatggcgctggtggcagacttcaacaggggaaaaacttcgtgcagaatatgattttacagatgcctataatggcggaaattcccttaaattctctggtgatgtagccggtaagacagatcaggatgtgagactttattctactaagttagaagtaactgagaagaccaaacttcgtgttgcccacaagggaggaaaaggttctaaagtttatatggcattctctacaacttcagactacaaattcgatgatgcagatgcatggaaagagctaaccctttctgacaactggacaaatgaagaatttgatctcagctcactagcaggtaaaaccatctatgcagtcaaactatttttcgagcatgaaggtgctgtaaaagattatcagttcaacctaggacaattaactatctcggacaatcaccaagagccacaatcgccgacaagcttttctgtagtgaaacaatctcttaaaaatgcccaagaagcggaagcagttgtgcaatttaaaggcaacaaggatgcagatttctatgaagtttatgaaaaagatggagacagctggaaattactaactggctcatcttctacaactatttatctaccaaaagttagccgctcagcaagtgctcagggtacaactcaagaactgaaggttgtagcagtcggtaaaaatggagttcgttcagaagctgcaaccacaacctttgattggggtatgactgtaaaagataccagcctaccaaaaccactagctgaaaatatcgttccaggtgcaacagttattgatagtactttccctaagactgaaggtggagaaggtattgaaggtatgttgaacggtaccattactagcttgtcagataaatggtcttcagctcagttgagtggtagtgtggatattcgtttgaccaagccacgtaccgttgttagatgggtcatggatcatgcaggggctggtggtgagtctgttaacgatggcttgatgaacaccaaagactttgacctttattataaagatgcagatggtgagtggaagctagctaaggaagtccgtggcaacaaagcacacgtgacagatatcactcttgataaaccaatcactgctcaagactggcgcttgaatgttgtcacttctgacaatggaactccatggaaggctattcgtatctataactggaaaatgtatgaaaagcttgatactgagagtgtcaatattccgatggccaaggctgcagcccgttctctaggcaataacaaggtacaagttggctttgcagatgtacaggctggagcaactattaccgtttatgataatccaaattctcaaactccgctcgcaaccttgaagagcgaagttggaggagacctagcaagtgcaccattggatttgacaaatcaatctggtcttctttattatcgtacccagttgccaggcaaggaaattagtaatgtcctagcagtttccgttccaaaagatgacagaagaatcaagtcagtcagcctagaaacaggacctaagaaaacaagctacgccgaaggggaggatttggaccttagaggtggtgttcttcgagttcagtatgaaggaggaactgaggacgaactcattcgcctaactcacgcaggtgtatcagtatcaggttttgatacgcatcataagggagaacagaatcttactctccaatatttgggacaaccggtaaatgctaatttgtcagtgactgtcactggccaagacgaagcaagtccgaaaactattttgggaattgaagtaagtcaggaaccgaaaaaagattacctagttggtgatagcttagacttgtctgaaggacgctttgcagtggcttatagcaatgacaccatggaagaacattcctttactgatgagggagttgaaatttctggttacgatgctcaaaagactggtcgtcaaaccttgacgcttcgttaccaaggtcatgaattcaattttgatgttttggtatctccaaaagcagcattgaacgatgagtacctcaaacaaaaattagcagaagttgaagctgctaagaacaaggtggtctataactttgcttcaccagaagtaaaagcagctttcttgaaagcaattgaagcggccgaacaagtgttgaaagaccatgaaactagcacccaagatcaagtcaatgaccgacttaataaattgacagaagctcataaagctctgaatggtcaagagaaatttaaggaagaaaagacagaacttgatcgcttaacaggtgaggttcaagaactcttggctgccaaaccaaaccatccttcaggttctgccctagctccgcttcttgagaaaaacaaggccttggttgaaaaagtagatttgagtccagaagagcttgcaacagcgaaacagagtctaaaagatctggttgctttattgaaagaagacaagccagcagtcttttctgatagtaaaacaggtgttgaagtacacttctcaaataaagagaagactgtcatcaagggtttgaaagtagagcgtgttcaagcaagtgctgaagagaagaaatactttgctggagaagatgctcatgtctttgaaatagaaggtttggatgaaaaaggtcaagatgttgatctctcttacgcttctattgtgaaaatcccaattgaaaaagataagaaagttaagaaagtatttttcttacctgaaggcaaagaggcagtagaattggcttttgaacaaacggatagtcatgttatctttacagcaccacactttactcattatgcctttgtttatgaatctgctgaaaaaccacaacctgctaaaccagcaccacaaaacaaagtccttccaaaacctacttatcaaccggcttctgatcaacaaaaggctcctaaattggaagttcaagaggaaaaggttgcctttcatcgtcaagagcatgaaaatactgagatgctagttggggaacaacgagtcatcatacagggacgagatggactgttaagacatgtctttgaagttgatgaaaacggtcagcgtcgtcttcgttcaacagaagtcatccaagaagcgattccagaaattgttgaaattggaacaaaagtaaaaacagtaccagcagtagtagctacacaggaaaaaccagctcaaaatacagcagttaaatcagaagaagcaagcaaacaattgccaaatacaggaacagctgatgctaatgaagccctaatagcaggcttagccagccttggtcttgctagtttagccttgaccttgagacggaaaagagaagatcaaagattaaatatcgaaaaatcttgtgaaatctttccttatatttccaaagtgtga

SEQ ID NO: 1553 - DNA (genomic), 678 bp, Streptococcus pneumoniae; double-stranded, circular
  misc_feature (B) LOCATION 1...678
  hypothetical: NO
  anti-sense: NO
aaggaattacgactaagttctatgaaggagatgttgtttgtatcatcggtccttcaggttctggtaatgtacaacanactccgtagcctcaatcttttagaagaagtcactagcggtcacatcactgtgaacggctatgatttaactgaaaaaacaaccaatgttgaccacgtccgtgaaaatatcggcatggtattccaacacttcaacctcttccctcatatgtctgtattggacaacatcacctttgctcctattgtgcacaagttgatgactaaggaagaagctgagaaattgggaatggagttgcttgaaaaggttggactagcagataaagctaatgccaatccagatagcctatcaggtggtcaaaaacaacgtgtggccatagctcgtggcctagcaatgaatccagacatcatgctcttcgatgaaccaacttctgcccttgaccctgagatggttggagacgtacttaacgttatgaaggaattggctgagcaaggcatgaccatgattatcgtaacccatgagatgggatttgctcgtcaggttgccaaccgcgttatctttactgcagatggcgagttccttgaagacggaacacctgaccaaatctttgataacccacaacaccctcgtctgaaagagttcttagataaggtcttaaacgtctaa

SEQ ID NO: 1554 - DNA (genomic), 657 bp, Streptococcus pneumoniae; double-stranded, circular
  misc_feature (B) LOCATION 1...657
  hypothetical: NO
  anti-sense: NO
aagatgttacgatctcaatttgaagaagatttagagaaattacataaccagttctacgctatgggacaagaagtgctctcacaaatcaatcgtacggtacgtgcttttgtcacgcatgaccgtgacctggcaaaagaggtcatcgaagatgatgcagaagtaaatgaatacgaagtgaaactggaaaagaaatcatttgaaatgatcgcactccaacaaccagtctctcaagatttgcgtacagtcttgactgtccttaaggctgtatcagatgtggagcgtatgggggatcacgctgtagccattgcccaggcaaccatccgtatgaagggggaagaacgcatcccagctgtagaggaagaaattaaaaaaatgggacgtgaagttaaaagcgttgttgaagcagcacttgatctttatcttaatggttctgttgacgacgcataccgggtggcctccatggatgagcaaattaaccactattttgaaactatccgtgaccttgcgactgaagagattaagaaaaatccagaagccattgttacgggtcgtgattatttccaagttatttcctacttggagcgtatcggtgactatgctaaaaatatctgtgaatgggttgtctactttgaaacaggtaagattgtcgaactataa

SEQ ID NO: 1555 - DNA (genomic), 213 bp, Streptococcus pneumoniae; double-stranded, circular
  misc_feature (B) LOCATION 1...213
  hypothetical: NO
  anti-sense: NO
aagtttatacgaccattgttagggattttatcatgtgcatcccaagctacagcaatattgttggcaaaattaccatatacatcagctgcgagcacagctattcgtaaaatccatccaaaaatcttagtcaataatcctactcttgctgccgcagttgcagctgccctatttaagatagaacgcgccatactaataccatacttagccgcataa

SEQ ID NO: 1556 - DNA (genomic), 867 bp, Streptococcus pneumoniae; double-stranded, circular
  misc_feature (B) LOCATION 1...867
  hypothetical: NO
  anti-sense: NO
atcatggtacgtccaattggaatttatgaaaaggcaaccccaacacactttacttggctagaacgtttaaattttgccaaggagttaggctttgattttgtcgagatgtctattgacgaacgtgacgagcgtttagcaagacttgactggagtaaggaagaacgcttggaagttgtcaaagcaatctatgaaactggtgttcgtattccttctatctgtttttcaggccatcgtcgctacccattgggttcaaaagatccagttctagaggaaaaatctctagaactcatgaaaaaatgtatcgaattagctcaagacttgggagttcgtacgattcaattagctggttacgatgtttactatgaggaaaagtcaccccagacacgccaacgttttatcaaaaatttgagaaaagcctgtgactgggctgaagaagctcaggtggtacttgctattgaaattatggatgatcctttcatcagtagcatcgaaaaatatttggctatagaaaaagagattgactctcccttcctctttgtatatccagatattggtaatgtgtctgcatggcataatgatatctatagtgagttttatcttggtcatcatgccatcgcagctctccatctcaaggatacttatgcagtgacagaaagttcaaagggccagttccgagatgtacctttcgggcaaggttgtgtcaaatgggaagaagctttcgatattttaaaggaaaccaattataatggacctttcctaatcgaaatgtggtctgaaaattgtgaaacagtagaagaaacacgcgcagccattcaagaggcgcaagcttttctctatccactcattaagaaagcaggtttgatgtaa

SEQ ID NO: 1557 - DNA (genomic), 471 bp, Streptococcus pneumoniae; double-stranded, circular
  misc_feature (B) LOCATION 1...471
  hypothetical: NO
  anti-sense: NO
ctcgtatcgctagcgcccttcaacaagaaaaggaaaatgctgagcaagattctcagacacttgtactctatcaaaaactctacgatattctcatgtcgcttagaaagtaataatggatctgatgcggactttgataaggtggatgcattattagatcaactttctgctaatagtaaagacaaaacagctttacttgaatcgacaaaagctattctagttttgaatcatcaaatccagtcaaaagctagcgcaagtgaagaaacaagtccagcaagaaatgctgaagcaaatggtgataacaccagtgctgagaaccaaccaaacgcaactgcagaatctaacattgaaactgctagcgacgaaaacaaaccaagcaatacaagagattctaaacctgctgaatcaacttcagaaaataaaacaacagaatcttctacaactactggaaatcaagaaaaaccagtagaataa

SEQ ID NO: 1558 - DNA (genomic), 783 bp, Streptococcus pneumoniae; double-stranded, circular
  misc_feature (B) LOCATION 1...783
  hypothetical: NO
  anti-sense: NO
tggcaatcgctgatgcaggttgagaatcgtttggacctccttcatactattactcgtaagtatggtgggactgttgatgatgttttgctttattttgccaagattacggaagaatacaatctcttgacaggcaataatctttcgtctgaggacatggaagcagagcttaagaagttggaagtcaatcttgtcaatttggcaggtcaacttgcttctgctcgtcataatttggctcagcaactcgaagctgagattaaacaagaactgcaagatctttatatggaaaaagcccagtttcaggttcgttttagtaagggaaaattcagtcgtgagggaaatgaaatggttgagttttatatttcaaccaaccctggagaagactttaaacccttggttaaggttgcttctggaggggaattatctcgtctcatgttagccattaagtctgccttttcacgtaaagaaggcaagactagcattgtctttgatgaggtggatacgggagtttcaggtcgtgttgctcaagctattgctcagaaaattcataaaattggtcagtatggtcaggttttggctatctcccatttgccacaagtaattgcgattgcagattatcaattctttattgagaagattagtaatgaccattcaacggtttcgactgttcgtctcttgacagtcgaagagcgagtggaggaagttgccaagatgttggcaggtgatgatgtgacagaagcagccctgacgcaagccagagaattgttgagaaacagggagaaataa

SEQ ID NO: 1559 - DNA (genomic), 189 bp, Streptococcus pneumoniae; double-stranded, circular
  misc_feature (B) LOCATION 1...189
  hypothetical: NO
  anti-sense: NO
tcacttgcacgagcagcctgctgcatattatgcgttacaatgatgatggtaaagtttttcttgagctcaaacatggtctcttctagttgcatggtcgcaatcggatccaaggctgaggctggctcatccattaagaggatatctggcttaacagagatggcacgagcgatacagagacgttgttgctga

SEQ ID NO: 1560 - DNA (genomic), 483 bp, Streptococcus pneumoniae; double-stranded, circular
  misc_feature (B) LOCATION 1...483
  hypothetical: NO
  anti-sense: NO
agaactcaacgcccaaaaagcccgcttgaaactcctcatcgccctcaatgccggactaacaggacaggctttgaaagactatatggaaggctaatactcttcgaaaatctctgcaaaccacgtcacgtcgccttaccgtatgtatggttactgacttcgtcagtttcatccacaacctcaaaaacatgttttgagctgacttcgtcagtttcatccacaacctcaaaaacatgttttgagctgacttcgtcagtttcatccacaacctcaaaaacatgttttgagctgacttcgtcagtttcatctgcaacctcaaagcagtgctttgagctgacttcgtcagttctatctacaacctcaaagcagtgctttgagctgacttcgtcagttctatctgcaacctcaaaacagtgtgttgcacagcctttaaccagccgcctagtccgctctatggtattcattaagtcaacatctcttgtttaa

SEQ ID NO: 1561 - DNA (genomic), 3210 bp, Streptococcus pneumoniae; double-stranded, circular
  misc_feature (B) LOCATION 1...3210
  hypothetical: NO
  anti-sense: NO
ctttgtccgcttgacgcccttaatatcttatatatgcctaaacgtactgatattcaaaaaattatggtgattggttctggtccgattattattggtcaggctgctgagtttgattacgctgggacccaggcttgcttgtcgttgaaagaggaaggttatgaggttgttttggttaactcaaatcctgcaaccatcatgacggacaaggaaattgctgacaaggtttacattgaaccgattacacttgagtttgtgacacgtattcttcgtaaggaacgtccagatgccttgctaccaacactcggtggtcagacaggtctcaacatggccatggaattgtctaaaaatggtatcttagatgagcttggcgttgaacttctgggtactaaattgtctgccattgaccaagcggaggaccgtgacctctttaaacaattgatggaagagcttgagcaacccattccagaatctgaaattgttaacacagtagaagaagcaattgcctttgcagcgacaattggctacccagtcatcgttcgtccagcctttacccttggtggtactggtggtggtatgtgtgccaacgagaaagaattgcgtgaaatcactgaaaatggtttgaaattgtcacctgttacccaatgtttgattgagcgttcgattgccggtttcaaggaaattgaatacgaagtgatgcgtgactcagctgacaatgccttggttgtttgtaacatggaaaactttgacccagttgggattcacacaggggattccattgtatttgcccctgcgcaaaccatgtcagactatgaaaaccaaatgcttcgtgatgcgagcttgagcattattcgtgccctcaagattgaaggtggatgtaatgttcagctagctcttgatcctaacagcttcaagtattatgttatcgaagtaaaccctcgtgtatcacgttcgtcagcccttgcttctaaagcgacaggatatccgattgctaagttggctgccaagattgcagtaggtttgaccttggatgaggttataaacccagttacaggttcaacctatgccatgtttgaaccagcccttgactacgtagttgctaagattccacgtttcccatttgacaagtttgaaaagggtgaacgccgtctcggtacacaaatgaaggcgactggagaagtcatggcaatcggtcgtaacatcgaggaatctcttctcaaggcctgccgctcccttgaaattggggtgcaccacaatgaaatacctgaacttgcagcagtttctgatgatgccttgattgaaaaggttgtcaaagcccaagatgaccgtctcttctatgtgtcagaagccattcgccgtggttacacacctgaagaaattgcagagcttacaaaaattgatatcttctatcttgataaactcttgcatatctttgaaattgagcaagaattgggtgctcatccacaagatctagaagttttgaaaacagccaaacttaatggtttttcagaccgtaagattgctgaactctggggaacgactgatgatcaagttcgccaacttcgtttggaaaacaagattatcccagtttataagatggtagacacttgtgcggcagagttcgactctgaaacgccatatttctattcaacctatggttgggaaaatgaatctatcagatctgataaagaatctgtacttgtcctaggttcaggtccaatccgtatcggtcaaggggttgagtttgactacgcaaccgttcactctgttaaggctatccaggcagctggttatgaagctattatcatgaactcaaacccagagaccgtttcaacagacttctctgtatcagataagctttactttgagccattgacattcgaagatgttatgaacgtcattgacttggaacaaccaaagggagttatcgttcagttcggtggtcaaacagccatcaaccttgcggagccattggcaaaagcaggtgtgaccatccttggtacacaggttgctgacctagaccgtgccgaagaccgtgacctcttcgagcaagctctcaaagaattggatattccacagccaccaggacaaacggctaccaatgaagaagaagcagctcttgcagctcgtaagattggcttcccagttcttgtccgcccatcttatgtacttggtggacgtgccatggaaatcgttgaaaacgaagaagaccttcgttcttacatgcgaactgctgttaaggctagtccagaccacccagttcttgtcgactcttacatcgttgggcaagagtgcgaagttgatgccatttcagatggtaaaaatgtactcattcctggtattatggagcatatcgaacgtgctggtgtccactcaggtgactcaatggctgtttacccaccacaaaccttgtcgcaaaaggttcaggagaccatcgcagactacaccaaacgcttagcaatcggtcttcactgccttggaatgatgaacatccagtttgttatcaaggatgaaaaagtctacgttattgaggtcaatccacgtgccagccgtacagttccattcctatctaaggtaaccaatatttctatggctcaagtagcgaccaagctcattcttggtcaaagtttatcagaacttggctaccaaaatggactttaccctgaaagcacccgtgttcatatcaaggcacctgtcttctcctttaccaaactagctaaggtagacagcttgctcggtcctgaaatgaagtcaacaggtgaagttatgggttctgatgctactttggaaaaagctctctataaagcctttgaagcttcttatctacacttgccaacttttggtaatgtcgtctttaccatcgctgatgatgccaaagaagaagccttgaacttggctcgtcgtttccaaaacattggttatggaatccttgcgacagaagggacagcagccttctttgctagtcatggcttgcaagcccaacctgttggtaagattggtgatgatgataaggatatcccaagttttgtacgcaaaggaagaattcaagctatcattaacacagtaggaacaaaacgaactgctgacgaagatggtgagcaaattcgtcgttcagccattgaacacggggtgcccctcttcacagcgctagatacagctaatgccatgcttaaggtacttgaaagtcgtagctttgttacagaagcgatttaa

SEQ ID NO: 1562 - DNA (genomic), 1158 bp, Streptococcus pneumoniae; double-stranded, circular
  misc_feature (B) LOCATION 1...1158
  hypothetical: NO
  anti-sense: NO
atgcaacaacggttccgtactatccttgataatcaaggtgatttacagaatattggtggcttgtcttacttggttgagattgttaattctgtgccaacttctgctaatgcggagtattatgctaagattgttgcagaaaaagcaatgctacgtcgtttaattgccaagttgacagagtctgtcaaccaagcttacgaagcgtcacaaccagctgatgaaattattgctcaggcagaaaaagggttgattgatgtcagtgaaaatgcaaatcgaagcgggtttaagaacattcgagatgtgttgaatctcaactttggaaatctggaagctcgctcgcaacaaacgaccgatattacaggtattgcgacaggttatcgtgatttggatcatatgacaacaggacttcatgaggaggagttgattatcttagcagctcgtccagcagttggtaagacagcatttgccttgaatatcgctcagaacattgggactaagttggacaaaacggttgctattttttcactcgaaatgggtgcggaaagcttggtagatcgtatgttagctgcagaaggcttggtggagtcacattctatccgtacagggcaattgacagatgaggagtggcaaaaatatactattgctcagggtaatctagctaacgccagtatctatatcgatgatacgccaggtattcggattacagagattcgttctcgttctcgtaaattggctcaagaaactggaaatcttggtttgattgtgatagactatttgcaacttatcacgggaactggtcgagaaaatcgtcaacaagaagtttctgaaatttctcgtcagttgaaaatactagccaaggaattgaaggttccagtaatcgctctgagtcagctttctcgtggtgtagaacaacgtcaggacaagagaccggtcttgtctgatattcgtgaatctgggtctattgagcaggacgctgatatcgtagcttttctctatcgcgatgactactatgaacgtggtggtgaagaagaggagggtatcccaaataataaggtggaagttattatcgagaaaaaccgtagtggagctcgtggaacagtggaattgattttccaaaaagaatacaataaattttcaagtatctcaaagagggaggcataa

SEQ ID NO: 1563 - DNA (genomic), 858 bp, Streptococcus pneumoniae; double-stranded, circular
  misc_feature (B) LOCATION 1...858
  hypothetical: NO
  anti-sense: NO
attaccaaacggaaggaaaccacaatgaaccataaaatcgcaattttatcagatgttcatggcaatgcgacggcgctagaagcagtgattgcagatgctaaaaatcaaggggccagtgaatattggcttctgggagatatttttcttcctggtccaggcgcaaatgacttagtcgccctgctaaaggaccttcctatcacagcaagtgttcgaggcaattgggatgatcgtgtccttgaggtcttggatggcgaatatggtttggaatatccgaaagaaatccagtcaatgcgcatgacccagtttttgatggagcgaatggatcctgcaacgattgtctggctacgaagcttgcctttgctggaaaagaaagaaattgacggattgcgcttttctatctctcataatttacctgacaaaaactatggtggtgacttgctagttgagaatgatacagagaaatttgaccaactgctagatgcggaaacggacgtggcagtttatggtcatgttcacaagcagttgcttcgttatggaagtcaagggcaacaaatcatcaatccagggtcgattggcatgccctattttaattgggaggcgttaaaaaatcaccgtgcccagtatgccgtgatagaggttgaagatggggaattggtaaatatcctatttcgtaaagtcgcttatgattacgaggctgagttagaatttgccaaatccaagaggcttccctttatcgaaatgtatgaagaactgcgtcgtgaagataactatcagaggcacaatctggaactattagcaagcttaatagaaaagcataggtatgtagaggatgtgaagaatttttttgattttttgtaa

SEQ ID NO: 1564 - DNA (genomic), 291 bp, Streptococcus pneumoniae; double-stranded, circular
  misc_feature (B) LOCATION 1...291
  hypothetical: NO
  anti-sense: NO
ttgataccgctggaacgatttgtcatgcggcagatgctcttgcggaagctggtgctgttgaagtctatgcaagctgtacgcacccagttctttctggtcctgctacggacaatatccaaaaatcagctattaagaaagtggttgttttggataccatctatctgccagaagagcgctctgattgataagattgagcagatctcaatcgctcatctcctaggggatgctatcgtacgtattcatgaaaaacgaccactttctccacttttcgatattgagaaaaaaatttaa

SEQ ID NO: 1565 - DNA (genomic), 450 bp, Streptococcus pneumoniae; double-stranded, circular
  misc_feature (B) LOCATION 1...450
  hypothetical: NO
  anti-sense: NO
cgaatacgacgatgttttcaaagctttggtggaaaaatgacaatctatctgacagaaaagcaaattgaaaaaataaatgctttagcaattcaacggtattctccaaatgagaaaattcaaacagttagttcttctgccttaaatatgattgtgaacttaccagaacaatttgtctttgggaagtctctttatccaacaatttttgataaagcaacgatactatttgtccaattgataaagaagcatgtttttgctaatgctaataaaagaactgctttcttcgttttggtcaaatttttacaattaaacggctatcgtttttctgtaacggtagaagaagcagtaaaaatgtgtgtaaccatcgcagtagaagctttaactgatgaaaaaatgacaagctattccaaatgggtttctgaacattctgttagagaaaaggtcaaaaagtaa

SEQ ID NO: 1566 - DNA (genomic), 1221 bp, Streptococcus pneumoniae; double-stranded, circular
  misc_feature (B) LOCATION 1...1221
  hypothetical: NO
  anti-sense: NO
ttgaaaacgcttaaaaaggggtatcatgttatgacaaaaacaattgcaatcaatgcaggaagttcaagtttgaaatggcaattatacttaatgccagaagaaaaagtattggcgaaaggtttgattgaacgtatcggtttgaaagattcaatttcaactgtaaaatttgacggccgttctgaacaacaaattttggatattgaaaatcatacacaagccgttaaaattttattggatgacttgattcgtttcgatattatcaaggcttatgacgagattacaggtgttggacatcgtgttgttgctggtggagaatatttcaaacaatcaacagttgttgagggagatgttttagaaaaagttgaagagttgagtttgtcggctcctctacacaacccggccaatgcagcaggtgttcgtgccttcaaggaattgttgccagacattaccagtgtagttgtttttgatacttccttccacacaagtatgccagagaaagcttatcgctaccctctaccaacaaaatattacacagaaaacaaggttcgtaaatacggtgctcatggtacaagtcaccagtttgtagcaggagaagctgcaaaactcttgggacgtccattagaagacttgaagttaattacctgtcatattggtaacggaggctcaattacagctgtgaaagccggcaaatctgtagacacttctatggggttcactcctcttggtggtattatgatgggaacgcgtacaggggatattgatccagctatcattccttatttaatgcaatatacagaggattttaacacaccagaagatatcagtcgtgttcttaaccgtgaatcaggtcttttgggagtttctgctaattctagcgatatgcgcgatatagaagcagctgtagcagaagggaatcacgaggctagcttggcttatgaaatgtatgttgaccgtatccaaaaacatatcggtcagtaccttgcagtgctaaatggagcagatgccattgttttcacagcaggtgtcggtgaaaatgcagagagtttccgtcgtgatgtaatctcagggatttcgtggtttggttgtgatgttgatgatgaaaagaatgtctttggcgttacaggagacatctcaacagaggcagctaaaatccgtgtcttggttattccaacagatgaagaattagtcattgcccgtgacgttgaacgcttgaaaaaataa

SEQ ID NO: 1567 - DNA (genomic), 564 bp, Streptococcus pneumoniae; double-stranded, circular
  misc_feature (B) LOCATION 1...564
  hypothetical: NO
  anti-sense: NO
ggaaaattgcgaaaaaaagttaagaaaaagaccagaatggcgattgaaaattatataccagattttgctgtggaagcagtctatgatctgacagtcccaagcctgcaggcgcagggaatcaaggctgttttggtcgatttggataataccctcattgcttggaacaaccctgatggaacgccagagatgaagcaatggctacatgaccttcgggacgcgggtattggcattatcgtagtgtcaaataacaccaaaaaacgcgttcaacgagcagttgagaaatttgggattgattacgtttactgggccttgaagcccttcacatttggtattgaccgtgctatgaaggaattccactatgacaaaaaggaagtggtcatggttggtgaccagctcatgacagatatacgagcagcccaccgtgcagggattcggtcaattttagtcaaacccttggtccaacatgactcaatcaaaacgcagattaaccgaactcgtgagcgtcgtgttatgagaaaaatcactgaaaagtacggaccgattacatataaaaaaggaatttaa

SEQ ID NO: 1568 - DNA (genomic), 294 bp, Streptococcus pneumoniae; double-stranded, circular
  misc_feature (B) LOCATION 1...294
  hypothetical: NO
  anti-sense: NO
cggtccatgcggtttaattttcttcatcgttatatatctccttctttagcaacttctcttgttcacaaggttatccacaggttgtggataataaaccatgatctaaccgccagctctttccaactccaactggtaggctcaggatttttctcctcaatattccctcttcaaacagctctgtcatatggttctgctaacacctctcagaatgctactctccataattattctcaggcttctttcaggtcattgtgtgaagaccattcactctccagacttttccacagattgtga

SEQ ID NO: 1569 - DNA (genomic), 549 bp, Streptococcus pneumoniae; double-stranded, circular
  misc_feature (B) LOCATION 1...549
  hypothetical: NO
  anti-sense: NO
ttattgatgcgacggaagtataaatcaatcgccctaaaaaaagaattagcgaattattctggtaaaaagaaatgccacgctatgaaggctcaagcgattgtcacaagtcaagggagaattgtttctttggatatcactgtgaactattgtcatgatatgaagttgttcaaaatgagtcgcagaaatatcggacaagctggtaaaatcttgactgacagtgattatcaagggcccatgaagatatatcctcaagcacaaactccacgtaaagccagcaaactcaaaccgctaacagctgaagataaagcctgtaaccatgcactatctaaggatagaagcaaggttgagaacatccttgccaaagtaaaaacgtttaaaatgttttcaacaacctatcgaaatcatcgtaaacgcttcggattacgaatgaatttgattgctggtattatcaatcatgaactaggattttggtttcgcaggaagtctaatgtaatttttgcaattcaagacgtttcgatgactattcaagatctggatgaaaaattttaa

SEQ ID NO: 1570 - DNA (genomic), 1023 bp, Streptococcus pneumoniae; double-stranded, circular
  misc_feature (B) LOCATION 1...1023
  hypothetical: NO
  anti-sense: NO
agggcatcgcgacaaagaccgcagaaaggaaacggtaaaccgttcatgagaaaaccaaagataacggtgattggtggagggactggaattcccgtcattctaaaaagtctgcgggaaaaagatgtggaaatcgcagctatcgtgacggtggcagatgatggtggttcttcaggtgaactccgaaaaaatatgcaacagttgacaccgccaggtgatcttcgtaatgtccttgtggccatgtcggatatgcctaagttttatgagaaggtctttcagtatcggttctctgaggatgccggagcctttgctggccatccattgggaaatctcatcattgctggcttgtcagaaatgcagggttcaacctataatgccatgcagttattgagcaaatttttccatacaacagggaaaatttatccttccagtgaccatcctttgacccttcatgcagtctttcaggatgggacagaagtggctggagagagtcatattgtagaccatcgaggcataattgacaatgtctatgtgaccaatgccctaaacgatgatacgcctctggccagccgtcgagtagtgcagaccatccttgaaagtgacatgattgtcctagggccaggttccctctttacctctattttgcccaatatcgtgattaaggaaattgggcgggctcttttggaaaccaaggcagaaattgcctatgtctgcaatatcatgacccaacgtggggagacggaacactttacagatagcgaccacgtggaagtcttgcatcgtcaccttggtcgcccttttatcgacactgtcttggtgaatattgaaaaagtgcctcaggaatacatgaattccaaccgttttgatgaatacttggtgcaagtggaacacgattttgtaggtctttgtaagcaagtttcgcgcgtgatttcatctaacttccttcgtctggaaaatggcggtgccttccacgatggagatttgattgtggacgagttgatgcgcattatacaggtgaaaaaatga

SEQ ID NO: 1571 - DNA (genomic), 276 bp, Streptococcus pneumoniae; double-stranded, circular
  misc_feature (B) LOCATION 1...276
  hypothetical: NO
  anti-sense: NO
tatagtaagcgcgtcataacaaggtatctatcattcatggagctcctcctgtatactattagtaaagtaaaactattggaggatattttaatgccacaacctattgttcctgtagagattccacaatctcgtctttttgattctaaaaagagaaatgatattctgcttaaaattcgtattggcaagcttgaagtaagtttttttcaatctctcaatctcgaaatggtagaacagcttttggataaggtgttgctctatgacaattcatctatctag

SEQ ID NO: 1572 - DNA (genomic), 429 bp, Streptococcus pneumoniae; double-stranded, circular
  misc_feature (B) LOCATION 1...429
  hypothetical: NO
  anti-sense: NO
cacggcaagcgccggcggtttccgcgcgcgtcgcggcgtccacgcaagcccgggagccggccagcgtttcggcgcctccggtcgacgaaccgccgctggtgccggtgtcctcccacccgcaaatcgcaggtcggacgcatgagcggccacagcccggccccggcttcccggcgaaaaccgcagccgaggtcgcgtccacggcgcaggccagtgtccaggtctcgccgcccgcgccgacagcgggcggcgaaggccgcggagaggagcgtcggcaacccggagaaaccgatccatccgcactgccccccgacgaccaagcgcctgtgccattgcctgccatgcaaacccccggcgaccgcctgctggcacgcctgctggcatcgagcgggagccggccactgccgctggccgatctcgcgcgcctgctag

SEQ ID NO: 1573 - DNA (genomic), 648 bp, Streptococcus pneumoniae; double-stranded, circular
  misc_feature (B) LOCATION 1...648
  hypothetical: NO
  anti-sense: NO
tttcactggcgatcacgtggtgtaaagctcaattccgatttcgtcgccaccagcatcgccgagtatatccgcgaccagggacgccgcgtcctgctgctgatggactcgctgacccgcttcgccagggcccagcgcgaaatcggcctggcggccggtgaaccgcccacccgccgcggctatccgccatcggtgttcgccgcgctgccacgcttgatggagcgtgccgggcaatccgagcggggctcgatcaccgcgctctacaccgtgctggtggaaggcgacgacatgagcgagccggtggccgacgagacccgctcgattctcgacgggcacatcgtgctgtcgcgcaagctggccgccgccaaccactatccggccatcgacgtgctgcactcggtgagccgggtcatgaaccagatcgtcgacgacgatcagcgccatgcggccggacgcttgcgcgaatggctggcgaagtacgaggaagtcgagttgctgctgaagatcggcgaataccagaaaggccaggacagcgaagccgaccaggccatcgagaagatcgcggcgatccgccagtggctgcgccagggtacccacgaaaccagcgattacgcacaggcctgcgcgcagttgcggagcctctgcgcatga

SEQ ID NO: 1574 - DNA (genomic), 363 bp, Streptococcus pneumoniae; double-stranded, circular
  misc_feature (B) LOCATION 1...363
  hypothetical: NO
  anti-sense: NO
ctagactggcgggagagagtcgtcgatagtggacaccatatccgattccaaaatcgttgctatatccctaccgagcaaggaaaagaagtctatttcatcagaaagacaaaagcattagttataaaagcatttgatggtgacatctacctcaatatcgctgacaaaatctatcacacaaaggagctactaaatcatgaactctattcgaaaaactttgaacaagaaccagaacaaaaaaaagaaagacgcaagtatatccctccacaaacccatccgtggaaactcacatctttcaaacaatatcttcataaaaataaaaaggattatgaagagtttaaaggaggatttttcagtacgtgctga

SEQ ID NO: 1575 - DNA (genomic), 252 bp, Streptococcus pneumoniae; double-stranded, circular
  misc_feature (B) LOCATION 1...252
  hypothetical: NO
  anti-sense: NO
acactacggcgtttacctttacgaccctacacgagttgtaaaattcggtggcgcgtaagaggtgacgatatgagtttattgctacgacgtcattatattcaagaagagcaggttaaccagtattctgatttagagaataaaactctagaagagttgaaggatctagcgaaagaagcaggtgtagcaggcgcttataagttgacaaaagccgaaattgtagaagttttggaggaactaaaaagtgaaatttaa

SEQ ID NO: 1576 - DNA (genomic), 192 bp, Streptococcus pneumoniae; double-stranded, circular
  misc_feature (B) LOCATION 1...192
  hypothetical: NO
  anti-sense: NO
ttccgcgggcgcgtcaacagctctagagatccgcctacctttcacgagttgcgcagtttgtctgcaagactctatgagaagcagataagcgataagtttgctcaacatcttctcgggcataagtcggacaccatggcatcacagtatcgtgatgacagaggcagggagtgggacaaaattgaaatcaaataa

SEQ ID NO: 1577 - DNA (genomic), 234 bp, Streptococcus pneumoniae; double-stranded, circular
  misc_feature (B) LOCATION 1...234
  hypothetical: NO
  anti-sense: NO
gctaaagggcgtattacagggattcagccctacggtgcctttgttgagttagagacgggtgatacggggctgattcacatttcagaaattcggacaggatttattgaaaatattcacgaaaccttgaaagtcgatgaagaagttcaagttcaggtagtggatttagatgaatttacgggggaaagccagtctttctatccgcactttggaggaagaaaagtaccagtttcctag

SEQ ID NO: 1578 - DNA (genomic), 924 bp, Streptococcus pneumoniae; double-stranded, circular
  misc_feature (B) LOCATION 1...924
  hypothetical: NO
  anti-sense: NO
tacaatatttttaacaaaattttattgtttgttaacttttttcacgaaaaggagaaaatcatgcgttatgatttcggaaaggtctataaagaaatacgtgagtcaaaggggctgacccaagaagaggtctgtgggggtgttctctcaagaaccagcttatcaaaaatcgaaagtggcaagacaaccccaaaatatgaaaatatggaatttcttctccgtcaaatcaatatgagttttgaagagtttgaatatatctgtcaactttatcaaccaagtcaacgcacagagattatgcaaacctatctcaatatgcgttccattatcgggaccagcgatcttgtcaatttatttcaaaaatgccaagactacctcaagacccaccacgatctccctatagaagaaatcagagatatgcttgaagttgttatttatctccgtcaacacggggcaggggaactatcaaaacacgcagaacaggttgtcaaaaaactttggaaaaaaattgaaaaacaagatacatggtatgagagtgatctaaaaatcctcaataccattcttttcagttttcccattgaatacctccatctcatcactggaaaaatattgcaacgcctagaagtctataaaaactatcaacatttatatgacttgcgaatgacaattctattaaacctttccacactctatctatacaatcaagataaaaacatgtgtaagcaaatctgctacactttactagaggacgccaagaataagaaaagctacgataggctggctatctgctatgtccgtattgggatttgtacagacgattctaaacttatccaaaaagggttctcccttctggagctaaccgaggaaacttctatgctgtctcatctcaaaaaagaagtagagatctattaccaagcgaaggaaagataa

SEQ ID NO: 1579 - DNA (genomic), 402 bp, Streptococcus pneumoniae; double-stranded, circular
  misc_feature (B) LOCATION 1...402
  hypothetical: NO
  anti-sense: NO
atgtcacagctgctcctggtagagaagctagaagtacacgacgaagagagttaccaagagttgtaccgtagccacgttcaagtggttcgattacaaacttgccataatctttattttcatcaatttttgttatatttggtttttcaaactcgatcatttagttactccctcttaaacgaaaagcagtgtaatgcgatgattatacacggcgacgttttggaggacgagcaccattgtgtgggcactggagtcacatcacgaattgctgttacttcaagaccagcggcagcaagcgcacgaatagctgactcacgaccagaacctggaccttttacagtaacttcaactgatttaagaccgtgttcttgtgcagatttagcagcagcttcagaagccatttga

SEQ ID NO: 1580 - DNA (genomic), 198 bp, Streptococcus pneumoniae; double-stranded, circular
  misc_feature (B) LOCATION 1...198
  hypothetical: NO
  anti-sense: NO
aaaaataagctagtaagaatcactcttattttagcgaaaaattacagaaatgaatggtttttcttgatgaaacagagaaaagaattgtacctctttcttggtcggacagccttgtattttcttatctttctagggctgctttacttctttagctatcttggtcagggtcaaggaagctttatctataatgaattttaa

SEQ ID NO: 1581 - DNA (genomic), 1518 bp, Streptococcus pneumoniae; double-stranded, circular
  misc_feature (B) LOCATION 1...1518
  hypothetical: NO
  anti-sense: NO
agagtcaagctcaaaaagaaagagatgaggaaacttcgaatgtctaattgggacactaaatttttgaaaaaaggttttacctttgatgatgtattgcttattccagctgaaagtcatgtgttgcctaacgatgcagatttaacaactaaattggcagataatttgactttaaatatcccaattattaccgctgccatggacacagttacagagagtcaaatggccattgctattgctcgtgcaggcggtctcggagttatccataaaaacatgtcaattgctcaacaagcagacgaggttcgtaaggtaaaacgttctgaaaatggagttattattgatccgttcttcttgacgcctgaacatacaattgctgaagcagatgagcttatgggtcgttaccgcatcagtggtgttccagttgttgaaacacttgaaaatcgtaaattggttggtattttgacaaaccgagatcttcgttttatttcagattataatcaaccaatttcaaaccatatgactagtgaaaatcttgttactgctcctgtgggtacggatcttgcaacggctgagagtattcttcaagagcatcgtattgaaaaacttccgttggtcgatgaagaaggcagtctttctggtttgatcactatcaaagatattgaaaaagttattgagtttccaaatgcggctaaagatgagtttggtcgtcttctagttgcaggtgcagtaggtgttacttcagatacatttgaacgtgcagaggctctttttgaggcaggagcggatgcgattgttattgatactgcacatggtcattctgcaggtgtcttgcgtaaaattgccgagattcgtgctcatttcccagatcggactttgattgctggaaatattgctactgctgaaggtgcacgtgccctttatgaagcgggtgtagacgttgttaaggttggtattggaccaggttctatctgtactactcgtgtgattgctggtgttggtgttccgcaagtaacagctatctacgatgctgcagctgttgcgcgcgaatatggtaaaacgattattgctgacggtgggatcaagtattctggagatattgtaaaagcacttgctgcaggtggaaatgctgttatgcttggatctatgtttgctggaactgatgaagctccaggcgaaactgaaatcttccaaggacgtaaattcaagacttaccgtggtatgggatcaattgctgctatgaagaaaggttcaagcgaccgttatttccaaggttctgtcaatgaagcaaacaagcttgttccagaaggaattgaaggtcgtgttgcttataaaggagcggcagctgatattgttttccaaatgattggtggtattcgctctggtatgggttactgtggtgcagctaaccttaaagaactacacgataatgctcaatttattgaaatgtctggtgctggtttgaaagaaagccatcctcatgatgtgcaaattactaatgaggcaccaaattattctatgtaa

SEQ ID NO: 1582 - DNA (genomic), 228 bp, Streptococcus pneumoniae; double-stranded, circular
  misc_feature (B) LOCATION 1...228
  hypothetical: NO
  anti-sense: NO
tctttttttagcaagtggaaaagcgagcgccatgcaaggacaaatcttgacaatagatggtggctggtctttgaagtaggaggagttggatggaaatcaaaaatcactttggggtctactgtgtttgctttgaaaatggaaagttactttgtattgaaaaaacgagaggcccttatcaacatcggtatgatctacctggaggcagtcagcaacttggtgaaggactga

SEQ ID NO: 1583 - DNA (genomic), 486 bp, Streptococcus pneumoniae; double-stranded, circular
  misc_feature (B) LOCATION 1...486
  hypothetical: NO
  anti-sense: NO
agatattttagaagagtattaatgatagataaagtggtcaggaacttactcctgacctttttcttttgcaaaatgacaaaaatcataaactttttgacaactatacttgtcaaaaagaaaaagatgtgttacaatgtaagcaagttaagagaaaagaagaaaggagctatgatgtgggtactagggtttatactatttctgattttcttttattctaatgattctaaaaaaatcaagaaactagagaagaaaatcaaaagacttgagcgaaaagagaaaggaaatgcagaaatgtcgagattattacaagaaatgattggaaaggaaccaattataacgggagtgtatattgggccagataactgggaagttgtggatgttgatgaggaatgggtaaagctacgacgtgtagataatacgggaaaagaaaaattcaagttgcaacgtattgaggatatccaaaccgttgaatttgacggagagtag

SEQ ID NO: 1584 - DNA (genomic), 1290 bp, Streptococcus pneumoniae; double-stranded, circular
  misc_feature (B) LOCATION 1...1290
  hypothetical: NO
  anti-sense: NO
ggacattttagaagaagaggaaggaaaaaaatgagtcgtttactagttattggttgtgggggcgttgcccaagttgctatttcaaagatttgtcaagatagcgaaacatttacagagattatgattgctagccgtaccaagtcaaaatgcgatgacttgaaagcgaagctagaaggcaaaacaagtactaaaattgaaactgcagcacttgatgctgacaaggttgaagaagtgattgccctgattgaaagctacaaaccagaagctgttttgaatgtagctctgccttatcaagatttaaccattatggatgcttgtttggcaacaggtgttcactatatcgatacagccaactacgaagcagaagacacagaagaccctgagtggcgtgctatctacgaaaaacgttgtaaggaacttggttttacagcctactttgactactcatggcagtgggcttatcaagagaaattcaaagaagcaggcttgactgctcttcttggttctggttttgacccaggtgtaactagtgtcttttcagcttatgccctcaaacactattttgatgaaatccattatatcgacattttagactgtaatggcggtgaccacggttatccatttgcaaccaactttaatccagaaattaatctccgtgaggtttctgcgccaggttcttactgggaagatgggaaatgggtcgaagtcgaagctatgtctatcaagcgtgagtatgatttccctcaagttggacaaaaagatatgtatctccttcaccatgaagaaatcgaatcattggccaagaacattccaggtgtcaaacgcattcgtttctttatgacttttggtcaatcttacttgacgcacatgaaatgtcttgaaaatgttggactccttcgtacggataccattaactttaacggccaagaaattgttccaattcaatttttgaaagccttgcttccagatcctgctagccttggcccacgtacagtcggaaaaaccaatattggatgtatctttacaggtgtcaaagatggcgttgaaaagactatctacatctacaatgtttgcgaccatcaagagtgctatgcagaagtcgggtcacaagcaatttcatacacgacaggcgttccagccatgattgggacaaaattagtcatgaacggaacttggaaacaagctggagtgtataaccttgaggagttagatccagatccattcatggaagctttgaatgagtatggtttgccatgggttgtggttgaaaatccacaaatggtggactaa

SEQ ID NO: 1585 - DNA (genomic), 297 bp, Streptococcus pneumoniae; double-stranded, circular
  misc_feature (B) LOCATION 1...297
  hypothetical: NO
  anti-sense: NO
aacgattttagcacacggaaaaagctgtttagccaagtcatagtaaggactaaacatatccatcgtaatgattttcacttgacaacgaacggctctatcgtagcgaagaaagtgatttcggatgacagcttgtgttctgccttcaagaacagtgataatattaagattatcaaaatcttgcgcaatgaaactcatctttcccttagtgaaggcatactcatcccaagacataatctttggaagccgagaaaaatcatgctcaaagtgaaagtcattgagcttgcgaatgacagttga

SEQ ID NO: 1586 - DNA (genomic), 858 bp, Streptococcus pneumoniae; double-stranded, circular
  misc_feature (B) LOCATION 1...858
  hypothetical: NO
  anti-sense: NO
ggttggaagctgtattccaacctcttattttgggagaaaagaatgaaatttttaacactcaatactcacagttggatggagaaagaagcagaggaaaaattccagattttgcttgaagatattcttgaaaaggactatgatttgatttgttttcaagaaatcaatcaggagatgacctcgtcagaggtggaggttaatgacctttatcaagctttgccagcagctgagcctattcaccaagaccattatgttagactcttggttgaaaagttgttagagcaagggaaaaattactactggacctgggcttataaccatatcggctatgaccgctaccacgaaggtgtggctatcttgtctaaaacacctattgaagccagagaaattttggtttcagatgtggatgatccaacagactatcatactcgccgtgttgccctagctgaaactgtagtcgatggcaaggagctagcagttgccagtgttcatctctcttggtgggataaaggtttccaagaagaatgggcacgatttgaggctgtcttgaaaaaattgaacaagccacttttactagctggagattttaacaacccagcaggtcaggaaggttaccaagctattttagctagtccattagacttacaagacgcatttgaagttgctcaagagaaaagtggtagctatactgttccgcctgaaattgatggctggaaagggaacactgaaccccttcgaatcgattatgtctttactaccaaagagttagcggtggaaaatttacatgtcgtatttgatggtaacaagagtccacaagtgagtgatcactatggcttgaatgctatgttaaactggaaataa

SEQ ID NO: 1587 - DNA (genomic), 252 bp, Streptococcus pneumoniae; double-stranded, circular
  misc_feature (B) LOCATION 1...252
  hypothetical: NO
  anti-sense: NO
cagaggaagctgttcaaaatcttccacctattccagaagaaaagtgggtggaaccagaaatcatcctgcctcaagctgaacttaaattccctgaacaggaagatgactcagatgaccaagatgttcaggtcgatttttcagccaaagaagcccttgaatacaaacttccaagcttacaactctttgcaccagataaaccaaaagatcagtctaaagagaagaaaattgtcagagaaaatatcaaaatcttag

SEQ ID NO: 1588 - DNA (genomic), 744 bp, Streptococcus pneumoniae; double-stranded, circular
  misc_feature (B) LOCATION 1...744
  hypothetical: NO
  anti-sense: NO
aataggattagaattattaagaaagttggttctttattggaaacgatagtatttttaatctctgtttttctagcaggtgttttatcctttttttctccttgtatttttcctcttctgccagtctatgctgggattttattggatgatcaagaaagtgcaaaaagcttttctttgtttgggagaaaggttctctggtcaggcttgattcgaacactttgctttatcgctggtatctctctcattttctttattctaggctttggtgctggttactttggtcatattctctatgcaaattggtttcgatatggcatgggagctattattatcattttgggtcttcaccagatggaaatttttcatttgaagaaattagaagttcaaaaaagttttacctttaaaaaatcagattctaatcgttattggtcagcttttttacttggtattacctttagctttggttggacaccttgtattggtccagttttaagttctgttttagcacttgcggcttctggaggcaatggcgcttggcaaggagcgatttatactctcatttacactctgggcatggcccttcctttcttggtattggcactagcttcaggtctagtcatgccatattttagtaaaatcaagcgtcatatgatgctactaaagaaaattggtggtttcctcattgttttaatgggaattttgttactattaggacaagtaaatgttctagctggaatttttgaataa

SEQ ID NO: 1589 - DNA (genomic), 1230 bp, Streptococcus pneumoniae; double-stranded, circular
  misc_feature (B) LOCATION 1...1230
  hypothetical: NO
  anti-sense: NO
agaagagttagaagcgattgttgccgagtttcccgactccctttcacttgtatgatgagaangggaatcgtgagaaggcaanaaccgtcnaccaagctttttcgtggaaacaagggctttaaggaatattttgcagttaaggctactccaactccagctattttgaaaattctccaagaagaaggttgtggtgtggactgctctagttatgtagagcttttgatgagccataaactggactttctgggttctgagattatgttctcttccaacaacacgccagacaaggaatacgcctatgcacgtgaattgggtgcgaccattaacttggatgcctttgaagatattgaacatctggagagagcagcaggtattccagaaatcatctcttgtcgttataatcctggaggcgtttttgaactggggacagacattatggacaatcctggggaggctaagtttggcatgaccaaggaccagctctttgaagcctttgctatcttgaaggaaaaaggagccaagacttttgggattcactccttcctagcgtccaataccgtgacccatctctattatccagagttggctcgtcagctctttgaactggctgttgaaatcaaggaaaagttgggcatttggctagactttatcaatctttctggcggtattggtgttaattatcgtccagaccaggagccgaacgatatcgccttgattggtgagggagttcgtaaggtgtatgaagaagttcttacgtcagcaggtcttggtcaggtcaagattttcaccgaattgggtcgttttatgctggcacctcacggtgctctagtcacaagagtgactcataagaaggaaacctaccgtacctatctaggtgtggatgcctcagcagtcaacctcatgcgtccagctatgtacggagcttaccatcatattagcaacgtgacccatccagatggaccagctgaagcggtagatgtggttggttcactctgtgaaaacaatgataaatttgcagtcaatcgcgaactgcctcatacagaaatcggtgatttgctggtaattcatgatacaggtgcccacggattttcaatgggctaccagtataatgccaaattacgttctgcggaaatcctctataccgaagaaggtaaagcccgtcaaatccgccgtgcagagcgccctgaggactattttgcaaccttatatggcttcgattttgaagaataa

SEQ ID NO: 1590 - DNA (genomic), 2163 bp, Streptococcus pneumoniae; double-stranded, circular
  misc_feature (B) LOCATION 1...2163
  hypothetical: NO
  anti-sense: NO
atgggagttaggatagagaataatctattttatgttgagagtaaaaatctaagtttgattattgaaaatcgaaatggctacttacttttgaaacatttaggaaagactattaagaactataaaggttccaatagtgtttatgaacgagaccatgccttttcaggaaatccaacggctactaatcgaacctttagtttagatactcagcgacagatttttggacaacatggcttaggagattttaggaaaccaaccatacaggttcagcatagtgtaactgaagtaacagactttcgatttgtagaagcaaagattttaaaaggtcagaatggtccacagggcttaccttctccacatagcatggacgatacagagactcttgtcttaatgttagaagattctaaggctcaacttagtctgactttgtattatactacttttaataatgatgcgactattgctagctacagtaaattagataataatagtaatcaggaagttgtcatccataaagatttttcttttatggctgattttccagctgcagattacgaaatagtaactctgcagggtgcttatgctcgtgaaaagactgttagacgtcaacaggtagaacaaggaatcttttcgattagctcaaaccgaggtgcttctggtcatgctcaaacaccagctcttctactatgcgaacaaggagtcacagaggatgctgggaatgtgtttgctattcaactaatgtatagtggcaactttgaagcttttgttcaaaaaaatcaattgaatgaagttcgggtggctattggcattaatccagaaaacttttcttggaagttagcccctgaggaatactttgaaacaccggtagctttagtgactcattcagatcagggattaactggtattagtcatgaaagtcagaattttgtactgaagcacattattctaagtgaattttctaaaaaagaacgtccaattctaatcaataactgggaagctacttactttgactttcagagagaaaaactgttagagttagcagatgaagctaagaaagttggcattgaactttttgtattagatgatggttggtttggcaatcgttttgatgataatcgtgctttaggtgattgggttgttaatgaggaaaaactgggtggaagtctagaaagtctgatttcagctatccatgaaagaggtttgcagtttggactttggttagaacccgaaatgatttctgtagatagtgatttgtatcgtcaacatcctgactgggctattcaggttcctgattatgagcatacttattctcggaatcaattagtacttaatcttgccaatcctcaggtagtagaatacttgaaaagtgtcttagatcaactcctatcttatcatgagattgattacattaaatgggatatgaaccgcaatatcactaagctagggaatggattaacttatctagagacacagatgcaatctcatcagtacatgctggggctttacgaactcgtttcttatctgacagagaagcacagccatattctctttgagtcctgctctggtggtggtggacgaaatgatcttggtatgatgcgctatttcccacaagtctgggctagtgataatacagatgctattgcacgtttaccaattcaatacggttcatcctatctctatccaaccatttctatgggggctcatgtgtcagcagtaccgaatcatcagatggggcgaacgacaccattagaaacacgtggacatgtagcaatgatgggaaatttgggctatgagcttgatttgacaagtttatcagatgaagagaaagctgagattgctaatcaggtgaacttgtataaagaattacgaccagtagttcagttaggacaacagtatagactaattaatcctgatactgcatccaatgaagctgctgtacaatttaattacaaaaatcaaacgattgtaacctacgttcgcgttttgtcagttgtagagaccatggaaacaactttaaagttaaaagatttggatgaagagggactatatgaattacaggaaaatggcgaagtttactcaggtgcagaactcatgtatgcgggtttaactgttattttatcccaaggagattttttgagtaaacagtatatttttagaagactataa

SEQ ID NO: 1591 - DNA (genomic), 255 bp, Streptococcus pneumoniae; double-stranded, circular
  misc_feature (B) LOCATION 1...255
  hypothetical: NO
  anti-sense: NO
gcttgttctagtggattgaaattgactttaagtgagtttggaaataatatccaagctcattttttctcagactgcaagcagttcatcaataagatttatactcttcgaaaatctcttcaaactacgtcagcttcaccttgccgtaggtatatgatactgactctgtcagttctatccacaacctcaaaacagtgttttgagcaacctgcggctagcttcctagtttgctctttgattttcattgagtataagtag

SEQ ID NO: 1592 - DNA (genomic), 504 bp, Streptococcus pneumoniae; double-stranded, circular
  misc_feature (B) LOCATION 1...504
  hypothetical: NO
  anti-sense: NO
actgtatctagaaaggggaaaattatgattaaagaattgtatgaagaagtccaagggactgtgtataagtgtagaaatgaatattaccttcatttatgggaattgtcggattgggaccaagaaggcatgctctgcttacatgaattgattagtagagaagaaggactggcagacgatattccacgtttaaggaaatatttcaaaaccaagtttcgaaatcgaattttagactatatccgtaagcaggaaagtcagaagcgtagatacgataaagaaccctatgaagaagtgggtgagatcagtcatcgtataagtgagggaggtctctggctagatgattattatctctttcatgaaacactaagagattatagaaacaaacaaagtaaagagaaacaagaagaactagaacgcgtcttaagcaatgaacgatttcgagggcgtcaaagagtattaagagacttacgcattgtgtttaaggagtttactatccgtacccactag

SEQ ID NO: 1593 - DNA (genomic), 639 bp, Streptococcus pneumoniae; double-stranded, circular
  misc_feature (B) LOCATION 1...639
  hypothetical: NO
  anti-sense: NO
aacattcctagaagttgctttgatttacctaatctatttatgcaaattttatgttattttactataacagttgttgctaatccaaataatagtggggaagttcatttagatgtaagcattgaagataatcagggaggtagtgggtataatttcagttctgtttcaagtagctcacaaacagctaaatatgaaggagctggttataataacaattcatcattatatataacgattgataaaacgtctgatgcaacagctcttttgaaattaaagttgaataatgttaataatcaacctgctactgaagttcctagttcaggaattactgtaaaattaaatgctaaagataatgctggaaactggacaagtgcttcgaataaaaaagaagtaacagtaaaaattgtttctgctaaaccgacatatccagacaaaattttagtgaaaaatcctgataatataaaagatacagaaaaaaatgccattattgaaaaattgaaagaggcaaataaaaatcatccagcaggagctccaacctttgctaaaggtgaaggagagcatgcaaatgatattgtagcaacttattcagatggtacaacttattatgtaccgttaaatgatgtgacaaaatatgcgaggtag

SEQ ID NO: 1594 - DNA (genomic), 618 bp, Streptococcus pneumoniae; double-stranded, circular
  misc_feature (B) LOCATION 1...618
  hypothetical: NO
  anti-sense: NO
accgatcctagaaacagcctagaggtgactatggaacttaatacacacaatgctgaaatcttgctcagtgcagctaataagtcccactatccgcaggatgaactgccagagattgccctagcagggcgttcaaatgttggtaaatccagctttatcaacactatgttgaaccgtaagaatctcgctcgtacatcaggaaaacctggtaaaacccagctcctgaacttttttaacattgatgacaagatgcgctttgtggatgtgcctggttatggctatgctcgtgtttctaaaaaggaacgtgaaaagtgggggtgcatgattgaggagtacttaacgactcgggaaaatctccgtgcggttgtcagtctagttgaccttcgtcatgacccgtcagcagatgatgtgcagatgtacgaatttctcaagtattatgagattccagtcatcattgtggcgaccaaggcggacaagattcctcgtggtaaatggaacaagcatgaatcagcaatcaaaaagaaattaaactttgacccaagtgacgatttcatcctcttttcatctgtcagcaaggcagggatggatgaggcttgggatgcaatcttagaaaaattgtga

SEQ ID NO: 1595 - DNA (genomic), 222 bp, Streptococcus pneumoniae; double-stranded, circular
  misc_feature (B) LOCATION 1...222
  hypothetical: NO
  anti-sense: NO
acactacctagaatcaaaccatttacgagttgttggagcataagattcactctctctatttataattccgagggttttccctcactttttgataggttcttatactcaatgaaaatcaaagagcaaactaggaaactagccgcaggttgctcaaagcactgctttgaggttgtagataagactgacgaagtcagtcacatatataatccaaggcgacgttga

SEQ ID NO: 1596 - DNA (genomic), 474 bp, Streptococcus pneumoniae; double-stranded, circular
  misc_feature (B) LOCATION 1...474
  hypothetical: NO
  anti-sense: NO
cccttgcctaggttgggaaaatacagaggccttggtagaagagatttatgttaccttgacaaaataagtgaaaaggatggagttggggaatctcaactccttttgatgagaatgatagttggacacggaattgacatcgaagaattggcttcgatagaaagcgcagttacacgacatgaaggatttgctaagcgtgtactgaccgctcaggaaatggagcgcttcaccagtctcaaaggacgcaggcaaatagaatatttagctggtcgctggtcggctaaggaggccttttccaaggctatgggaacgggcattagcaagctcggttttcaggatttggaagtcttgaacaatgaacgtggggcgccttattttagtcaggcaccattttcaggaaagatttggctgtctatcagccacaccgatcagtttgtgacagccagtgtcattttggaggaaaatcatgaaagctag

SEQ ID NO: 1597 - DNA (genomic), 660 bp, Streptococcus pneumoniae; double-stranded, circular
  misc_feature (B) LOCATION 1...660
  hypothetical: NO
  anti-sense: NO
attaagcctagaagaccttcttatggccactcttcatatgtgcgagaatatcgaacttatgaacaaattgcggctgattttggtattcacgaaagcaactttatccgtcggagccaatgggttgaagtaactcttgttcaaagtggtgttacgtntcaagcactcctctcagctctgaggacacggtatgatatgatgcgacggaagtacaaatcaatcgccataaaaaaagaattagcgaatgattctggtaaaaagaaatgccacgctatgaaggctcaagcgattgtcacaagtcaagggagaattgtttctttggatatcactgtgaactattgtcatgatatgaagttgttcaaaatgagttgcagaaatatcggacaagctggtaaaatcttggctgacagtggttatcaaggactcatgaagatatatcctcaagtacaaactccacgtaaatccagcaaactcaagtcgctaatagctgaagataaagcctataaccatgcgctatctaaggagagaagcaaggttgagaacatctttgccaaagtaaaaacgtttaaaatgttttcaacaacctatcgaaatcatcgtaaacgcttcggattacgaatgaatttgagtgctggtattatcaatcatgaactaggattctag

SEQ ID NO: 1598 - DNA (genomic), 294 bp, Streptococcus pneumoniae; double-stranded, circular
  misc_feature (B) LOCATION 1...294
  hypothetical: NO
  anti-sense: NO
cccgagcctagaaacgaaaaagcgagggttccaaaagcgcttgagcgcccgatactccaaggattttcggtcaaattggttcatgatttggattcgtactcggttcatagctcggctcagatgttggacaatgtggaagcggtcaagaacaatcttcgcctttggaaagagttgcttagcgagccgataataagggctgtacatgtccatggtgatgacctcgaccagctcccgaacctctctctgatagcgttggaaatggtttcgaatcaccgcatgagttcgcccgtctaa

SEQ ID NO: 1599 - DNA (genomic), 812 bp, Streptococcus pneumoniae; double-stranded, circular
  misc_feature (B) LOCATION 1...812
  hypothetical: NO
  anti-sense: NO
acagttgctagaaatgtagaggtattgaccatgtatcaagatttactaagaaaaatagcagaagaaaaaccaaattataaccaggaagaaatccagtggttgtttgatcatttgggaaatccttctccagaaattcgtgatgaccttatttttacaagctttgctaaggggattcaggaagagctatttatacaggagcaatttcatttcattgctgaaggggtttcatctgatgtaggactagataaagagattgataaggtaggcctgccaacactggaacgttcttttagggcacttgtttatgcaaatctcttgtctgcagatgctaaccagcaatcggttttttatcagggattacaatcagaaattcgtgatgatctttcaaatcaaggcttgcactatctttcaaaagaaaaggatacaacaggtttctcaagtcagtatggttgggttcattcttttgcacatggagccgatttactgacagaggtggtttgtcatccagactttcctaaaaacagagttcatgaagtatttgatatacttggccaactatttaaaagaatgtcgattcgctttacagatgatgaggattggcgtttagcaagagtgatctatgaacctattttacaagggaagttggagcaagaacaagtagcttcttggataaaaactgttgattttccgatagaagaaagggaggatttttccaaattttccaactttagatcctgtctggtggaagtctatgtccaacttgaccagagaaatagtttacaagatgagttgaaagaagctatccagtcttt

SEQ ID NO: 1600 - DNA (genomic), 210 bp, Streptococcus pneumoniae; double-stranded, circular
  misc_feature (B) LOCATION 1...210
  hypothetical: NO
  anti-sense: NO
agaaatgctagaagacttttagatgacagttaccaagagggtctaattttcactgctacttatgcagtgggaattggacctttttatataagcaaattctatttcaaaattggttaccaagaaagacttcttttcactgttaagtataagagggtaatttatagaattttgttacatcaagataaatattttctgatggtcaaattttaa

SEQ ID NO: 1601 - DNA (genomic), 756 bp, Streptococcus pneumoniae; double-stranded, circular
  misc_feature (B) LOCATION 1...756
  hypothetical: NO
  anti-sense: NO
ttggaggctagcatgcagcagtattttgtaaaaggcagtgctatctctcctgtcactatcgaggacaaggaaaccagtaagcatatgtttcaggttatgcgcttgaaagaagaggatgaggttaccttagtctttgatgatggcatcaagcgcttggcgcgcgtgctggatatggaaaatcgtcagtttgagttggtccaagaattaaatgacaatgtggaactaccagtccaagtgaccatcgcatctggatttcccaagggagacaagctggagttcatcgctcaaaaagtaaccgaactgggtgctagccaaatctgggcctttcctgcagactggtcagttgccaagtgggatggcaagaaattgggtaaaaaagttgaaaaactagaaaaaattgcccttggagcagccgagcaaagcaagcgtaatattgtaccaagtattaaacttttcgagaaaaaagcagattttctagctcagctggaccagtttgactctatcatagtagcctatgaagaatcagctaaagaaggagaagccgctgcgcttctgcaagcagtcactggtcttgaaacaggagccaaactgctctttatctttggtccagaaggtggtctgtcacctgcagaaatcgaaagttttgaagctaaaggagcagttttggcaggcctaggtcctcgtattttgcgagcagaaacagcaccgctttacgccttatcagcccttagtgttttagtagaattagagaaataa

SEQ ID NO: 1602 - DNA (genomic), 231 bp, Streptococcus pneumoniae; double-stranded, circular
  misc_feature (B) LOCATION 1...231
  hypothetical: NO
  anti-sense: NO
atacaagagctgctaaacactactatgcaagagctcaaaaaaacggaacagttgaacaacagtattttaattgatcttgagaaattttaccaacccaccagtcctttgattggactgggtagcctaaaactaaacaatcaagcacgcactgcttggcgaaactatgataaaatccattacgagcatgtcaaacacgtactaagtttttatggacctgtttttggattttag

SEQ ID NO: 1603 - DNA (genomic), 1701 bp, Streptococcus pneumoniae; double-stranded, circular
  misc_feature (B) LOCATION 1...1701
  hypothetical: NO
  anti-sense: NO
attttttataggaggagttttatggataagctagtcgctgccattgaaaagcaacaagggaaatttgaaaaaatttctactaataactatatgatggctattaaagatggattcattgctactatgcctttaattatgttttcaagctttttgatgattattattatgattcctaaaaatttcggagtagagttaccgagtccagctattgtctggatgagaaaagtgtatatgttaaccatgggagttttgggtattattgtttcagggactgttggaaagtcattagttggaaatgttaacagaaaaatgcctcacggaaaggtaataaatgatacttctgcaatgttggcagccatatgtagttatctggtattaactgtaacgcttgtagttgatgagaagacgggatctacaagtttgtcgacaaactatttaggatctcaaggattgataacttcgtttgtcagtgcctttattactgtaaatgtttaccgattctgtattaagcgagacattactattcatttacctaaggaagttcctggggctatatcacaagcttttagagatatttttcctttttcttttgttttacttattagtggtttgttagatattgtatctcggtttagtttagatgttccttttgcccaagtatttcaacaactattgactcctatttttaagggggcagaatcatatcctgctatgatgttgatttggtttatgtgtgctttgctttggtttgttggaattcatggaccatctattgtcttacctgctgttacagctttacaactgagcaatatggaagagaatgctcaacttcttgcaaatgggcagttcccttatcattctttaacacctaatttcgggaattatatcgctgctattggaggaacgggggctacctttgttgtaccatttattttgattttctttatgcggtctaaacaattaaaatcggtaggtaaagctacaattactcctgttttatttgcggtaaatgaacctcttctatttggtatgcctgttattttgaatccctatctttttgtcccttttttgatgactccaccagtaaatgtatttctaggaaaggtatttattgatttctttggaatgaatggattttatatccagttaccttgggcttttcctggtcccttgggattgttaattggaacgaattttcaacctatctcctttgtgcttttatctttgatgttagttgtcgacatattgatttatttgccattctgtagagcgtatgatagacagttactgatgaaagaagatgttgcaagctcaaatgatattattttagaggaggatacaagtgaaataatgcctggtgagatagatgtaataaaaagtaaggagttgaaagtactggttctttgtgcagggtctggaacaagtgcgcaattagccaatgcaattaacgagggcgctcaattagcagaagttagagtgattgcgaattcaggagcgtacggagctcattatgatattatgggtgtttatgatttaattattctggctccacaagttcggagttattatagagagatgaaggtggatgcagaaagattaggtattcagatagttgctaccagaggaatggaatatattcatttaacaaagagtccaagtaaatccttacaatttgtattggagcattaccaagctgtgtag

SEQ ID NO: 1604 - DNA (genomic), 849 bp, Streptococcus pneumoniae; double-stranded, circular
  misc_feature (B) LOCATION 1...849
  hypothetical: NO
  anti-sense: NO
ttcttatatagatgcttggaagtacggcttccgaacagggtaatctttcaaaaaagtacgatgagaaacacaaagaaactaagacaatttggaatatttttgcttattattttactatctacctatttaccacaaacaattagattgtatgtgacgatcattttagggttaggagctgatgtctattctcttattttaacaatgggattagtgggaagtttccttctattaatttggaggttaaaaaagaaaaagatgctctttatctttgagaaaaagagctggaactggtcatttgtcttctacttatttgcaacttatgtggtttatcagattctcggtaatttttgggcacgctatgctcatttgattaatcataggaatattcatgatgagtattttaccgtggttctttcaaatggacaaccaacctttttatcgactatcttatcttttgtcctgcctgtaatcatcgatcctgtttttgaggagactcttgatagagggtattttatgaataccttctttcctaagtcaaagtactatttagatgtcatcttatcaggccttatctttgggcttagtcatttgatactatctcacagagatccaattagtttattatattatagtttgattggtttcttttttgcccttgtttatcgttctaccgacaatctgagattaacgattctctgccatagttttttaactttctcaatcatgcaaaacctatctggatttttgtttacaattatatctattatcatttttttagatagtgggaggcaaagaaaaaagtgtttgatatctatcaaacactttttctttttattgttggctctataa

SEQ ID NO: 1605 - DNA (genomic), 246 bp, Streptococcus pneumoniae; double-stranded, circular
  misc_feature (B) LOCATION 1...246
  hypothetical: NO
  anti-sense: NO
acaacatatagaaccggactgacgaatagaaacataaattcaattggttctgtaataccggtaataaaagatgttaaagcaactccaaaaaacaaacccgcgtattttttacgacgatttttaggaacactatggtacatcgctaaacaggcagccggtaaaccgaacatcattgttgagaaacgacctgcaaaaaaccttgttccttctgtaaataatccagaatgggccggatcggctaattga

SEQ ID NO: 1606 - DNA (genomic), 204 bp, Streptococcus pneumoniae; double-stranded, circular
  misc_feature (B) LOCATION 1...204
  hypothetical: NO
  anti-sense: NO
aaagcatatagagtagctggcgttaaaagctcctgtcttgcttttttgacctatagtcacatctatcaagtattgttcttgcctaagctatcaataaaaaggtggcattttttaggcttggtgttagtgaattttgccttatcctatctaagtcatttcgagctttttatggtacaatggaaacatgttattcaaattatctaa

SEQ ID NO: 1607 - DNA (genomic), 684 bp, Streptococcus pneumoniae; double-stranded, circular
  misc_feature (B) LOCATION 1...684
  hypothetical: NO
  anti-sense: NO
aagcaatataggagaaaatctatgtcagatttgaaaaaatacgaaggtgtcattccagccttctacgcatgttatgatgatcaaggagaagtaagcccagaacgtacgcgtgccttggttcaatacttcattgataaaggtgttcaaggtctttatgtcaatggttcttctggtgaatgtatctaccaaagcgttgaagatcgcaagttgattttggaagaagtcatggcggtagccaaaggtaaattgaccattattgctcatgttgcctgcaacaatactaaagacagtatggaacttgctcgccatgctgaaagcttgggagtagatgctattgcaacgattccaccaatttatttccgcttgccagaatactcagttgccaaatactggaacgatatcagttctgcagctccaaacacagactacgtgatttacaacattcctcaattggcaggggttgctttgactccaagcctttacacagaaatgttgaaaaatcctcgtgttatcggtgttaagaactcttctatgccagttcaagatatccaaacctttgtcagccttggtggggaagaccatatcgtctttaatggtcctgatgagcagttcctaggaagacgcctcatgggtgctagggtggtatcggtggtacttatggtgctatgccagaactcttcttga

SEQ ID NO: 1608 - DNA (genomic), 1725 bp, Streptococcus pneumoniae; double-stranded, circular
  misc_feature (B) LOCATION 1...1725
  hypothetical: NO
  anti-sense: NO
ggtatgcatagaaaaacagtgattgattttaggactttgggggagagatatacctttaccaagcctattaaagagttgaaaacgagaaatgtagaagaagtggcagatttgctggcacaagtggaaagctaccaagagcaaggttattatgtggtggggtatgtcagctacgaggctgcacctgcttttgaggaaaaattagcagttcacaaggatcccctactgggagagtacctgctttattttactgttcatgatagcgtagaaacttcctctattcctctgacttatgaggatattgatttgccctcaaattggcaggaagtaacgtctgcagcagactatgaaaaggccattgcccaaattcaccatcatttacggcagggagatacctatcaggtcaactacaccgtccaacttaagcaaaagttaaatgccaatccttttgccatctacaatcgtatggtggtagagcaggaggcgggctacaatgcctatgtggaacatgacgagatggcagtgatttccatgagcccagagctcttttttgagcaaaatgatcgcgagttgacaacacgaccaatgaaggggacgactcagcgtggggtaactgaccaagaagatcttgaacaggccagttggttggaacaggatcccaaaaatcgctctgaaaatatgatgattgtggacctcttgcgcaatgatatgaaccgtatttctgaagttgggagcgagcacgtggagcgtctgtgtcaggtagagcagtattcaactgtttggcagatgacttcgaccatcaagagtcagttgcgagaggatgtggaccttgttgaaatcttccgctcactctttccttgtggttccataacgggtgcaccgaaaattgcgacaatggagattatcaaggacttggagcctcaaccgcgtggagtctactgtggaacgattggtctcttgcttccaaatggacgacggatttttaatgtggccattcgtaccattcaacttcacaaaggtcaagccatttatggagttggcggagggattacttgggatagcacatgggaatctgaataccgagaggttcatcaaaaggcagcagttctttatcgtaaacaagctcgcttccaactgattacgacaggggaaatcagccagaagaacctgttgtttgaagatcaacatctggaaagactgagaaaagctagtcgttattttgcctttccttttgatgcagaagacttgggacacaagattgaggaagagtgtcaggattgtgaagctaatcgagattaccgcttgcgaatcagccttagcaaatctggagagatagaagtcaatcgtcaagtattaacccctctcagtacaagcttttgtcaggcccaagtctgccttcaggaagctgctttgaatcaatcctttacctactttaaaaccactcaccgaccgcatttgagcctaggagaacaagagaagatttaccacaataagtcaggagaactgcttgaaacctctataggaaatttggttctgaaaatcgctggaaaactctacacaccgcctatccgacttggaatcttgccaggaatttaccgtcagtatttgctagaaacaggacaggtagaagagaaagtcttgaccttggcagatttagcccaagcagaagctatttacggctgtaatgcagtgagaggcttgtatgagttgcaagtgataggattgtga

SEQ ID NO: 1609 - DNA (genomic), 225 bp, Streptococcus pneumoniae; double-stranded, circular
  misc_feature (B) LOCATION 1...225
  hypothetical: NO
  anti-sense: NO
gatagtattttaaaacgaaaggactataaaagctcatttccttcgcacttattttatagagatctatcattatactctttagaaatcaaaaagcaacacaccttgtcatcgttttatcgtaaacctgttaatgaggggctagtcttatctgcaatctcaaatcagtgttttgagctgaatggcactcgttttctagtttgctctttgattttaattgggccttag

SEQ ID NO: 1610 - DNA (genomic), 1191 bp, Streptococcus pneumoniae; double-stranded, circular
  misc_feature (B) LOCATION 1...1191
  hypothetical: NO
  anti-sense: NO
gagaacaatagaaaggaagtatttatggagcaaaaagagaaacattttagcctatcttggtttttcaagtggtttttagataacaaggcaattacggtatttttagtaaccttattattgggactgaatctttttattttaagtaagattagttttctattttcacctgttttagactttttagcagttgtgatgttgccagtcattttgtctggtttgttatattatttgttgaatcctattgttgattggatggagaagcataaggttaatcgtgttatagctatcactattgtctttgttatcatcgctctctttatcatttggggcttggcagtcgccattccaaatctgcaacgtcaggttttgacctttgcaagaaacgttcctgtttacttagaagatatagataggattgttaatggattggtagcccagcacctgccagatgatttcagacctcaattagagcaagttttgaccaatttttctagccaggctacagttttggcaagtaaggtttcatctcaggcagtcaactgggtgagtgcctttattagcggggcttctcaagtgattgttgccttgattatcgttcctttcatgctcttttatctcttgcgtgatgggaaaggcttgcgtaactatttgacccaattcattccaagaaaattgaaggaacctgttggacaagttttatcagatgtgaatcaacagttgtccaactatgttcgagggcaagtgacagtggctattattgtagcagtaatgtttatcatcttcttcaagattattggtctacgctatgcggttacgctgggggttactgctggtattttaaatctggtcccttatcttggtagctttctagccatgcttcctgctctagtattgggtttgattgctggtccagtcatgcttttgaaagtagtgattgtctttatcgtagaacaaactattgaaggccgttttgtctctccattgattttgggaagtcaattaaacatccaccctattaatgttctctttgttttgttaacttcaggatctatgtttggtatctggggagttttacttggtattccggtttatgcctctgctaaggttgtcatttcagccattttcgaatggtataaggtagtcagtggtctatatgaattagagggtgaggaagtcaagagtgaacaatag

SEQ ID NO: 1611 - DNA (genomic), 4392 bp, Streptococcus pneumoniae; double-stranded, circular
  misc_feature (B) LOCATION 1...4392
  hypothetical: NO
  anti-sense: NO
atgtcaaatagttttgaaattttgatgaatcaattggggatgcctgctgaaatgagacaggctcctgctttagcacaggctaatattgagcgagttgtggttcataaaattagtaaggtatgggagtttcatttcgtattttctaatattttaccgattgaaatctttttagaattaaagaaaggtttgagcgaagaattttctaagacaggcaataaagctgtttttgaaattaaggctcggtctcaagaattttcaaatcagctcttgcagtcctactatagggaagctttctctgaaggtccatgtgctagtcaaggttttaagtccctttatcaaaatttgcaagttcgtgctgagggtaatcagctatttattgaaggatctgaagcgattgataaggaacattttaagaagaatcatcttcctaatttagccaaacaacttgaaaagtttggttttccaacttttaactgtcaagtcgagaagaatgatgtcctgacccaagagcaggaagaggcctttcatgctgaaaatgagcagattgttcaagctgccaatgaggaagcgctccgtgctatggaacaactggagcagatggcacctcctccagcggaagagaaaccagtctttgattttcaagcgaaaaaagctgcagctaaacccaagctggataaggcggagattactcctatgatcgaagtgacgacagaggaaaatcgtctggtatttgaaggggttgtttttgatgtggagcaaaaagtgactagaacaggtcgtgttttaatcaactttaaaatgacggactatacttcaagtttttctatgcaaaagtgggttaaaaacgaggaagaggcccagaagtttgacctcatcaagaagaattcttggctccgagttcgagggaatgtggagatgaataacttcacacgcgatttgactatgaacgtacaggatctgcaggaagttgttcactatgagcggaaggatttgatgccagaaggtgagcgtcgggttgagtttcatgctcatactaacatgtcgactatggatgctttgccagaggtcgaagagattgttgcaacagctgctaagtggggacacaaggcggttgctatcacggaccatgggaatgtccagtcctttccacatggctataaggcggctaagaaagcgggaatccagctgatctatgggatggaagccaatatcgtggaggaccgtgtccctatcgtctataacgaagtggagatggacttgtcagaagcaacctacgtggtctttgacgtggaaacgacgggactttcagctatctataatgacttgattcaggttgcggcctctaagatgtacaaggggaatgttattgctgaatttgatgaatttatcaatcctgggcatcccttgtcagcctttactacagagttaactggaattacagatgatcatgtcaaaaatgccaaaccactagaacaagttttgcaagaattccaagaattttgcaaggatacggtcctagttgcccacaatgctacctttgacgttggctttatgaatgctaattatgagcggcatgatcttccaaagattagtcagccagttattgatacgctggagtttgctagaaacctctatcctgagtataaacgccatggtttggggcctttgaccaagcgttttggtgtggccttggaacatcatcacatggccaactacgatgcggaagcgactggtcgtctgcttttcatctttatcaaagaggtagcagaaaaacatggtgtgaccgatttagctagactcaacattgatctaatcagtccagattcttacaaaaaagctcggatcaagcatgcgaccatctatgtcaagaatcaggtaggtctaaaaaatatctttaagctggtttccttgtctaataccaagtattttgaaggagtgccacggattccgagaacggttctagatgcccatcgagagggcttgattttaggttcagcctgttcagagggtgaagtttttgacgtggtcgtttctcaaggtgtggatgcggcggttgaggtggccaagtattatgactttatcgaggtcatgccaccggctatctatgcgcccttgattgccaaagagcaggtcaaggatatggaggaactccagaccattatcaagagtttgatagaggttggagatcgccttggcaagcctgttctggctacgggaaatgttcactatatcgaaccggaagaagagatttatcgtgaaattatcgtccgtagtttgggacagggtgcgatgattaaccgaactatcggtcatggtgaacatgcccaaccagcaccacttccaaaggctcattttcgaacgactaatgagatgttggatgaatttgcctttttgggagaggaactggctcgtaaactggttattgaaaacaccaatgccttggcagaaatatttgaacccgttgaagtcgttaagggtgatttgtatacgcctttcatcgacaaggctgaagaaacagttgctgagttgacctataagaaagcttttgagatttatggaaatccgctgccagatattgttgatttgcggattgaaaaagaattaacatccatactggggaatggatttgctgtgatttatctggcatcgcagatgctggtgcaacgttctaatgaacggggttatttggttggttctcgtgggtctgtcggatctagtttcgttgcgaccatgattgggattacggaggtcaatcctctctctcctcactatgtctgtggtcagtgtcagtacagtgagtttatcacagatggttcgtacggttcaggatttgatatgccccataaggactgtccaaactgtggtcacaaactcagtaaaaacggacaggatattccgtttgagaccttccttggttttgatggggataaggttcctgatattgacttgaacttctcgggagaagatcagcctagcgcccacttggatgtgcgtgatatctttggtgaagaatatgccttccgtgcgggaacggttggtacggtagctgccaagactgcctatggatttgtcaagggttacgagcgagattatggcaagttttatcgtgatgcagaagtagaacgcctcgctcaaggagcggcgggtgtcaagcggacaacaggccaacacccggggggaatcgttgttattccgaactacatggatgtctacgattttacgcctgtccagtatccagcagatgatgtcacggctgaatggcagaccactcactttaacttccacgatatcgatgagaacgtcctcaaactcgatgtactgggacatgatgatccgaccatgattcgaaaacttcaggatttgtctggtattgaccctaataaaattcctatggatgacgaaggcgtgatggcactcttttctgggactgatgtgctaggggtaacacctgaacaaattggaacgcctacgggtatgttggggattccagagtttggaacaaatttcgtacgtggaatggtagacgaaacccatccgacaacctttgcggaattgcttcagctgtctggtctgtcccacggtactgacgtttggttggggaatgctcaggatctgattaagcaaggaatagcggacctatcgactgttatcggttgtcgggacgacatcatggtttacctcatgcatgcgggtctggaacctaagatggcctttaccattatggaacgggtacgtaagggtttgtggctaaagatttcagaagaggagagaaatggctatatcgaagccatgaaggctaataaggtgccagagtggtatatcgaatcctgtgggaaaattaagtacatgttccctaaggcccatgcggcagcctacgttatgatggccttgcgtgtagcttacttcaaggttcaccatcctatttattactactgtgcttacttctccattcgtgctaaggcttttgatatcaagaccatgggtgcgggcttggaggccatcaagcgcagaatggaagaaatctctgaaaaacggaagaacaatgaagcctctaatgtggaaatcgatctctatacaactcttgagattgtcaatgagatgtgggaacgaggtttcaagtttggcaaattagatctctaccgtagtcaggcgacagagttcctcatcgacggggatacccttatcccaccatttgtagcaatggatggtctgggagagaacgttgccaagcaactggtgcgggcgcgtgaagagggagaattcctctctaaaacagaactacgcaagcgtggtggactctcatcaaccttggttgaaaagatggatgagatgggtattcttggaaatatgccagaggataaccagttgagtttgtttgatgagttgttttaa

SEQ ID NO: 1612 - DNA (genomic), 654 bp, Streptococcus pneumoniae; double-stranded, circular
  misc_feature (B) LOCATION 1...654
  hypothetical: NO
  anti-sense: NO
aaggaaaataggatgattgaactaaagaatatatctaaaaaatttggaagccgtcaactattttcagatacaaatcttcattttgaaggtgggaaaatttatgccttaatcggtacaagtggctgtggtaagacaacattcttgaatatgattggacgattagagccatatgacaaaggacaaatcatctatgatggtacttctcttaaggacatcaagccttctgttttctttagagattacttgggatatttatttcaagattttggcttaattgaaaaccaaaccgtcaaagagaatctcaatctgggtttagttggtaaaaagttgaaggaaaaagagaaaatctctttgatgaaacaagctctaaaccgtgtaaacctctcttatttggatttgaagcaacctatatttgagttatcaggaggagaagcacaacgtgttgcattagcgaagataattttaaaggatccacctttgattctcgcagatgaaccaaccgcttcactagaccccaaaaactctgaggaattactttccatcctagaatctctaaaaaatccgaatcggaccattattattgcgacccacaatcctctgatttgggagcaagtggatcaggtcattcgagttaccgatttatcacatagatga

SEQ ID NO: 1613 - DNA (genomic), 546 bp, Streptococcus pneumoniae; double-stranded, circular
  misc_feature (B) LOCATION 1...546
  hypothetical: NO
  anti-sense: NO
atctggaatagtccatcgagctttctaatactcttcgaaaatctcttcaaaccacgtcaacgtcgccttgccgtgcgtatggttcatactacgtcagatctatccacaacctcaaaacagtgttttgagcaacctgaggctagtttcctagtctgctctttggttttcattgagtataacacattgttagaagttggtttaaattccctaatcagtttgttcacatttaccttcgatatattatatcccatagttaaggttggtcatacagatgattatagtcatggagccgtaaaacttagtgtttctttagttgacaaagatgtcatgaaaaaaatatctgtaactgtaataggatattttgaaataaatatagatgaaaatatcaccgatattctatacgtaaatggtactgctattctttatccttatttacgttctattgtttcaatagtttcggcaattgatagcagtgaagcaatgttgctacctaccattaatgttttagagttactagataaatctcaaccttttgaagaagaataa

SEQ ID NO: 1614 - DNA (genomic), 663 bp, Streptococcus pneumoniae; double-stranded, circular
  misc_feature (B) LOCATION 1...663
  hypothetical: NO
  anti-sense: NO
gtgaggaatagaatgccaattacatcattagaaataaaggacaagacttttggaactcgattcagaggttttgatccagaagaagtcgatgaatttttagatattgtggttcgtgattacgaagatcttgtgcgtgcgaatcatgataaaaatttgcgtattaagagtttagaagagcgtttgtcttactttgatgaaataaaagattcattgagccagtctgtattgattgctcaggatacagctgagagagtgaaacaggcggcgcatgaacgttcaaacaatatcattcatcaagcagagcaagatgcgcaacgcttgttggaagaagctaaatataaggcaaacgagattcttcgtcaagcaactgataatgctaagaaagtcgctgttgaaacagaagaattgaagaacaagagccgtgtcttccaccaacgtctcaaatctacaattgagagtcagttggctattgttgaatcttcagattgggaagatattctccgtccaacagctacttatcttcaaaccagtgatgaagcctttaaagaagtggttagcgaagtacttggagaaccgattccagctccaattgaagaagaaccaattgatatgacacgtcagttctctcaagcagaaatggcagaattacaagctcgtaattga

SEQ ID NO: 1615 - DNA (genomic), 186 bp, Streptococcus pneumoniae; double-stranded, circular
  misc_feature (B) LOCATION 1...186
  hypothetical: NO
  anti-sense: NO
aaacttgatagtatgccttttatgatggaaaaatcttctaatactcttcgaaaatctcttcaagccacgtcaacgtcgccttaccgtaggtatatgatactgactctgtcaattctatccacaacctcaaaacagtgttttgaggttgtggatagcttcctagtttgctctttgattttcatttag

SEQ ID NO: 1616 - DNA (genomic), 321 bp, Streptococcus pneumoniae; double-stranded, circular
  misc_feature (B) LOCATION 1...321
  hypothetical: NO
  anti-sense: NO
aaaattgatagagataaattaaaaatctatattgaaactcatcccgatgcttatttgactgaaatagctgctgaattcaactgtcctccaacaactattcattacgctctaaaggctatgggatatagtctaaaaaagagccgtacctactgcgaacaagacccagaaaaagtaaatcggttccttaaagaattgaatcacttaagctacctgactcctatttatatttatgagacaggggttgagacctatttttatctcgaatatgatcgagccttgagcaggcagttagtctctctgaaagaagatataattatttga

SEQ ID NO: 1617 - DNA (genomic), 726 bp, Streptococcus pneumoniae; double-stranded, circular
  misc_feature (B) LOCATION 1...726
  hypothetical: NO
  anti-sense: NO
agaaaagatagaaatgaagtgaaaaatatgctacctgcttatatgaaaatccatgatcagataaaaaaggatattgacgagcaccgttgggctattggtgagaggcttcccagtgaaagagatttagctgagcagtttgcggtcagtcgcatgaccctccgccaagccgtatctctattagtcgaagaaggcgtcttagagcgccgtgtaggaagcggcacctttgtttccagtactcgagtacaagaaaagatgcgagggacaaccagttttactgaaattgtcaaatcccaaggtaaagttccctctagccagctcatttcctacaaaaaaaccattcccaatgagcaagaagttgccaagctaggaatttttccaacggacaatattatccgaatggagcgggtccgctatgccgaccaagttcccctagtttatgaagttgcttctattcctgaaaaattcattaaggactttaaaaaagaagaaatcaccagtcatttcttccaaaccttgcaaaaacatggctatcgtatcggcaaatctcaacagaccatctatgctcgccttgctaaagaaaagattgcccactatttggaagttgaaaaaggacatgctattcttggattgacacaggtttcctacctagaagatggtactgcttttgaatacgtaaaaagtcaatatgtaggcgaacgctttgaattttatcttgaaaataattag

SEQ ID NO: 1618 - DNA (genomic), 1011 bp, Streptococcus pneumoniae; double-stranded, circular
  misc_feature (B) LOCATION 1...1011
  hypothetical: NO
  anti-sense: NO
atgaaggatagatatattttagcatttgagacatcctgtgatgagaccagtgtcgccgtcttgaaaaacgacgatgagctcttgtccaatgtcattgctagtcaaattgagagtcacaaacgttttggtggcgtagtgcccgaagtagccagtcgtcaccatgtcgaggtcattacagcctgtatcgaggaggcattggcagaagcagggattaccgaagaggacgtgacagctgttgcggttacctacggaccaggcttggtcggagccttgctagttggtttgtcagctgccaaggcctttgcttgggctcacggacttccactgattcctgttaatcacatggctgggcacctcatggcagctcagagtgtggagcctttggagtttcccttgctagccctcttggtcagcggcggacacacagagttggtctatgtttctgaggctggcgattacaagattgttggggagacacgagatgacgcggttggcgaggcctatgataaggtcggccgtgtcatgggcttgacctatcctgcaggtcgtgagattgacgagctggctcatcaggggcaggatatttatgatttcccccgtgccatgattaaggaagataatctggagttttcattctctggtttgaagtcagcctttatcaatcttcatcacaatgccgagcaaaagggagaaagcctgtctacagaagatttgtgtgcttccttccaagcagcagttatggacattctcatggcaaaaaccaagaaggctttggaggaatatcctgttaaaaccctatttgtggcaggtggtgtggcagccaataaaggtctcagagaacgcttagcagccgaaatcacagatgtcaaggttatcatcccccctctgcgactctgcggagacaatgcaggtatgattgcctatgccagcgtcagcgagtggaacaaagaaaacttcgcaggctgggacctcaatgccaaaccaagtcttgcctttgataccatggaataa

SEQ ID NO: 1619 - DNA (genomic), 873 bp, Streptococcus pneumoniae; double-stranded, circular
  misc_feature (B) LOCATION 1...873
  hypothetical: NO
  anti-sense: NO
tgttatcgtagcgcgatgcttcctgatgttcgagatggcttaacacctgttcaccgtcgcattctctacggaatgaatgaattgggtgtgacccagaacaaaccccataatacatctgctcgtattacaggggatgtcatgggtaaatatcacccacacggggattcctctatttatgaagccatggtccgtatggctcaatggtggagctaccgttacatgcttgtagatggtcatgggaattttggttccatggatggagatagtgctgccgctcaacgttataccgaggcacgtatgagcaagattgctctggaaatgcttcgtgatatcaacaaaaatacagttgatttcgttgataactatgatgccaatgaacgggaacccttggtcttgccagcgcgttttccaaaccttttggttaatggagcaactggtatcgcggttgggatggcaaccaatattccacctcataatctgggtgaaaccattgatgcagtgaagttggtcatggataatcctgaagtgactaccaaggacttgatggaagtcttgcctggaccagattttccaactggtgctcttgtcatggggaaatcaggtatccataaggcttatgaaacaggtaaaggttcgattgtcctacgttctcgtacagagattgaaacgactaagactggtcgtgagcgcatcgttgtaacagaatttccttacatggtcaataaaaccaatgtgcatgagcatattgttcgcttggttcaggaaaaacgcattgagggtatcacagcagtacgtgatgagtcaaaccgtgaaggtgttcgatttgttattgaagtcaagcgcgacgcctcagccaatgttattctcatataa

SEQ ID NO: 1620 - DNA (genomic), 858 bp, Streptococcus pneumoniae; double-stranded, circular
  misc_feature (B) LOCATION 1...858
  hypothetical: NO
  anti-sense: NO
ttcaatagtagaattgatataatagtagttatggagaaaaagaaattacgcatcaatatgttgagttcaagtgagaaagtagcaggacagggagtttcaggtgcttaccgtgaattagttcgtcttcttcaccgtgctgccaaggaccaattgattgttacagaaaatcttccaatcgaggcagatgtgactcactttcatacgattgattttccctattatttatcaaccttccaaaagaaacgctcagggagaaagattggctatgtgcatttcttgccagctacacttgagggaagtttgaaaattccatttttcttaaagggaattgtgaaacgctatgtattttctttttacaaccggatggagcacttggttgtggtcaatcctatgtttattgaggatttggtagcagctggtattccacgtgaaaaagtgacctatattcctaactttgtcaacaaggaaaaatggcatcctctaccacaagaagaggtagttagactgcgcacagatcttggtcttagtgacaatcagtttatcgtagtaggtgctgggcaagttcagaaacgtaaagggattgatgactttatccgtctggctgaggaattgcctcagattacctttatctgggctggtggcttctcttttggtggtatgacagatggttatgaacactataagaaaattatggaaaatccccctaaaaatttgatttttccaggcattgtatcgccagagcggatgcgcgaattgtatgctctagcggatcttttcttgttgcctagctacaatgagctctttcctatgactattttagaagctgcgagttgtgaggctcgctattatgttgcgtga

SEQ ID NO: 1621 - DNA (genomic), 789 bp, Streptococcus pneumoniae; double-stranded, circular
  misc_feature (B) LOCATION 1...789
  hypothetical: NO
  anti-sense: NO
gatagtagtaggaaacgaggtgataatatgctcaaacaagaaaaattaaccaaaattttagagatagtaaatagtaaaggaaccataacagttaaacagattatggacgaaatagccgtttcagatatgactgcaaggcgctatttacaggaattagctgataaagatttgctgattcgtgtgcatggtggagctgaaaaacttcgaaccaactcccttttgactaatgagcgatcaaatattgaaaaacaagccctccaaacggcagaaaaacaagaaatagcccattttgcaggcagtctagtagaagaaagagaaactattttcattggaccaggaacaacattagagttttttgcgcgtgagttgcctattgacaatatccgcgtcgtaaccaacagtctacctgtttttctgattttaagcgaacgaaaattaacagatttgattttaataggtggaaattatcgcgatattacaggtgcttttgttggtacattgaccctacaaaatctctctaatctccaattttctaaagctttcgttagctgtaatggtattcaaaacggagctctagctacttttagcgaggaagagggagaggctcaacgcatcgctttaaataattctaataaaaaatatttactcgcagatcatagtaagttcaataagtttgatttttatactttttataatatatcaaatcttgatactattgtttcagattctaaactaagtgattcaatcctttttaagctatctaaacacattaaagtcatcaagccttaa

SEQ ID NO: 1622 - DNA (genomic), 753 bp, Streptococcus pneumoniae; double-stranded, circular
  misc_feature (B) LOCATION 1...753
  hypothetical: NO
  anti-sense: NO
actttaagtaggatgaagttctccggtgcttgtgttaagattcaattttttaagcttgttgttaaaaccattgctcgcaaacacggactttacgcaacatttatggcgaagccaaaatttggtattgctggatcaggtatgcactgtaatatgtccttgtttgatgcagaaggaaataacgctttctttgatccaaatgatccaaaaggaatgcagttgtcagaaacagcttaccatttcctaggcggtttgatcaagcatgcttacaactatactgccatcatgaacccaacagttaactcatacaaacgtttggttccaggttatgaagcgcctgtttacattgcttgggctggtcgtaaccgttcgccacttgtgcgcgtacctgcttcacgtggtatgggaactcgtcttgagttgcgttcagtggatccaatggcgaacccttacgttgctatggctgttcttttggaagttggtttgtatggtattgaaaataaaatcgaagcaccagctcctatcgaagaaaatatctacatcatgacagcagaagagcgcaaggaagctggtattacagaccttccatcaactcttcacaacgctttgaaagctttgacagaagatgaagtggttaaagctgctctcggagatcacatctatactagcttccttgaagccaaacgaatcgaatgggcaagttatgcaaccttcgtttcacaatgggaaattgataattatttagacctttactaa

SEQ ID NO: 1623 - DNA (genomic), 834 bp, Streptococcus pneumoniae; double-stranded, circular
  misc_feature (B) LOCATION 1...834
  hypothetical: NO
  anti-sense: NO
tataaaggtagggatatgaaccgttttaaaaaatcaaaatatgtcattattgtttttgtcactgttctgcttgtgtcagctctcttagcgacgacttattcaagtacaattgtgacaaaattaggagatggaatctcattggttgatagagttgtacaaaaaccttttcagtggtttgattctgtcaaatcagatttggctcatttgacacgaacatataatgaaaatgaaagtttgaagaaacagctttaccaattagaagttaaatcaaatgaggtggaaagtttaaagacagaaaatgaacaactgcgccaattgcttgatatgaagtctaaattgcaagccacaaagactttagcagcagatgttattatgcgttctccggtatcttggaagcaggagttgaccttagatgcaggtagatcaaaaggtgcttctgagaacatgttagctattgcaaatggtggcttgattgggagtgtttcaaaagtagaggagaaatctactatagtcaaccttctgacaaatacggaaaatgctgataagatttctgttaaaattcaacatggctctactacaatttatggaattattattggctatgacaaggaaaatgacgttcttaaaattagccaattaaatagtaatagcgatattagtgcgggagataaggtgactactggtggattaggaaactttaacgttgctgatattcctgttggtgaagtggttgccacaacgcatagtacagactatttgacacgagaagtaactgttaaattgagtgcagatactcataatgtagatgtgatagaattagtggggaattcataa

SEQ ID NO: 1624 - DNA (genomic), 1338 bp, Streptococcus pneumoniae; double-stranded, circular
  misc_feature (B) LOCATION 1...1338
  hypothetical: NO
  anti-sense: NO
aagatgttcagtaaacttaaaaaaacatggtatgcggatgactttagttattttatccgcaacttcggtgtcttcaccctgattttttctacaatgactctgattattttacaagtcatgcattcgagtctttatacttcggtggacgataagcttcatggactgagtgaaaatcctcaagcagttattcagctggctataaatagggcaacagaagagattaaagatttagaaaatgctagggcggacgctagtaaagtagaaataaaacctaatgtcagttccaatacggaagtcattctctttgataaagactttactcaacttctttctggaaatcgatttttgggcttggataagattaagttagaaaagaaagaactaggacatatctaccagattcaggtttttaatagctatgggcaggaagaaatctatcgtgtgattttgatggagaccaatattagttcggtttcaaccaatatcaagtatgctgctgtcttgattaataccagtcagttggagcaggctagtcaaaagcatgagcaattgattgtggtcgtgatggctagtttctggattttgtctttacttgccagtctctatctagctagggtcagtgttaggcccctgcttgagagtatgcaaaagcaacagtcttttgtggaaaatgccagtcatgagttacgaactccactcgcagttttgcaaaatcgcttagagaccctttttcgtaagccagaagctaccattatggatgtgagcgaaagcattgcatcgagtttggaagaagtccgaaatatgcgttttttaacgacaagcttgctgaacttagctcggagagatgatgggattaagccggagcttgcagaagttccaactagcttttttaatacaactttcacaaactacgagatgattgcttcggaaaataatcgtgtcttccgttttgaaaatcgtatccatcgaacaattgtcacagatcagcttcttctgaaacaactgatgaccattcttttcgataatgccgtcaagtatactgaggaggatggtgaaattgattttcttatctcggcgaccgatcgcaatctttatttacttgtttctgataatggaatcggtatttcgacagaagataaaaagaaaatttttgaccgtttttatcgagtagacaaagctagaacccggcaaaaaggtggttttggtttaggattatccctagccaagcaaattgtagatgctctaaaaggaactgttactgtcaaagataataaacccaagggaacaatctttgaagtgaagattgccattcagacaccatctaaaaagaaaaaataa

SEQ ID NO: 1625 - DNA (genomic), 342 bp, Streptococcus pneumoniae; double-stranded, circular
  misc_feature (B) LOCATION 1...342
  hypothetical: NO
  anti-sense: NO
tctggactcagttggcatgtgggacatcgagacaaacgcttgggttctctatctgggggacaaaagcagcgagcggtgattgcgcgtatgtttgcttctgaccctgatgtgtttatcctagacgagccgacaacggggatggatgcaggaagtaaaaatgaattttacgaactcatgcaccacagcgcccatcatcatggcaaggctgttttgatgattacccatgaccctgaagaagttaaggattatgcggatcgcaatattcatctagtccgtaaccaagactcgccatggcgttgtttcaatgttcatgagaatggccaggaggtgggccatgcttag

SEQ ID NO: 1626 - DNA (genomic), 234 bp, Streptococcus pneumoniae; double-stranded, circular
  misc_feature (B) LOCATION 1...234
  hypothetical: NO
  anti-sense: NO
cctaagctcagtttaaaaaagcgagggtggttattttctcaaagttttgaaggagctaaagcaagagctattattatgagtttgttggaaacagctaaacgtcatcaactaaatagtgagaaatatctatcctatcttctagaatgtcttccaaacgaggaaactctcgtaaacaaagaggttttagaggcctatttaccatggactaaagttgtacaagaaaagtgcaaatga

SEQ ID NO: 1627 - DNA (genomic), 690 bp, Streptococcus pneumoniae; double-stranded, circular
  misc_feature (B) LOCATION 1...690
  hypothetical: NO
  anti-sense: NO
aagtggctcagaaatccatcgtgtagaagataccatgattcgaatcgcgattcgcaggggattgtggattgcaatgtccttgccatgcctgccgctatctttttctctattgaaaataccaatatttcgcgcatgaagcgcgtgacctcctcttcttataacatcgaaaaagtctgcgatgtgaaccagatttctcgtcagctagttggggggcagattgacttagaaacagcctttaagcaattgacggccttgcaagctcaaccccttccctatactaagttgcaggtaactctggctgcgacctttagtgctcctttcttttcagttatgtttagcggaaatatctacgacgcacttggggcaggagtggcgaccttatttggttttgccttttccctctatgtggaaaaatttatccgaattccctttgtgacagcctttgctggagcctttgtctttgggataattgcccagttttgggctcgctacacaggttttccttcaacggcagatttgattatagctggtgcggtcatgccgtttgtaccaggtattgccttgaccaatgcggtccgtgatattatgaccaaccacataaactctggtatgagtaagatgtttgaatccctgctcattaccctcgctttaggggcaggaacttctgtcgccttggtattgatgaactaa

SEQ ID NO: 1628 - DNA (genomic), 2127 bp, Streptococcus pneumoniae; double-stranded, circular
  misc_feature (B) LOCATION 1...2127
  hypothetical: NO
  anti-sense: NO
gtgcctatcagtggaactggttctacagtttctacaaatgcaaaacctaatgaagtagtgtctagtctaggcagtctttcaagcaatccttcttctttaacgacaagtaaggagctctcttcagcatctgatggttatatttttaatccaaaagatatcgttgaagaaacggctacagcttatattgtaagacatggtgatcatttccattacattccaaaatcaaatcaaattgggcaaccgactcttccatacaatagtctagcaacaccttctccatctcttccaatcaatccaggaacttcacatgagaaacatgaagaagatggatacggatttgatgctaatcgtattatcgctgaagatgaatcaggttttgtcatgagtcacggagaccacaatcattatttcttcaagaaggacttgacagaagagcaaattaaggctgcgcaaaaacatttagaggaagttaaaactagtcataatggattagattctttgtcatctcatgaacaggattatccaggtaatgccaaagaaatgaaagatttagataaaaaaatcgaagaaaaaattgctggcattatgaaacaatatggtgtcaaacgtgaaagtattgtcgtgaataaagaaaaaaatgcgattatttatccgcatggagatcaccatcatgcagatccgattgatgaacataaaccggttggaattggtcattctcacagtaactatgaactgtttaaacccgaagaaggagttgctaaaaaagaagggaataaagtttatactggagaagaattaacgaatgttgttaatttgttaaaaaatagtacgtttaataatcaaaactttactctagccaatggtcaaaaacgcgtttcttttagttttccgcctgaattggagaaaaaattaggtatcaatatgctagtaaaattaataacaccagatggaaaagtattggagaaagtatctggtaaagtatttggagaaggagtagggaatattgcaaactttgaattagatcaaccttatttaccaggacaaacatttaagtatactatcgcttcaaaagattatccagaagtaagttatgatggtacatttacagttccaacctctttagcttacaaaatggccagtcaaacgattttctatcctttccatgcaggggatacttatttaagagtgaaccctcaatttgcagtgcctaaaggaactgatgctttagtcagagtgtttgatgaatttcatggaaatgcttatttagaaaataactataaagttggtgaaatcaaattaccgattccgaaattaaaccaaggaacaaccagaacggccggaaataaaattcctgtaaccttcatggcaaatgcttatttggacaatcaatcgacttatattgtggaagtacctatcttggaaaaagaaaatcaaactgataaaccaagtattctaccacaatttaaaaggaataaagcacaagaaaactcaaaacttgatgaaaaggtagaagaaccaaagactagtgagaaggtagaaaaagaaaaactttctgaaactgggaatagtactagtaattcaacgttagaagaagttcctacagtggatcctgtacaagaaaaagtagcaaaatttgctgaaagttatgggatgaagctagaaaatgtcttgtttaatatggacggaacaattgaattatatttaccatcaggagaagtcattaaaaagaatatggcagattttacaggagaagcacctcaaggaaatggtgaaaataaaccatctgaaaatggaaaagtatctactggaacagttgagaaccaaccaacagaaaataaaccagcagattctttaccagaggcaccaaacgaaaaacctgtaaaaccagaaaactcaacggataatggaatgttgaatccagaagggaatgtggggagtgaccctatgttagatccagcattagaggaagctccagcagtagatcctgtacaagaaaaattagaaaaatttacagctagttacggattaggcttagatagtgttatattcaatatggatggaacgattgaattaagattgccaagtggagaagtgataaaaaagaatttatctgatttcatagcgtaa

SEQ ID NO: 1629 - DNA (genomic), 480 bp, Streptococcus pneumoniae; double-stranded, circular
  misc_feature (B) LOCATION 1...480
  hypothetical: NO
  anti-sense: NO
ttaactatcagaaacgaaggaaagagtatgatttttgacgatttgaaaaacatcaccttttacaaagggattcatcctaatttagacaaggctatcgactatctctaccaacatcgtaaggattctttcgaattaggaaagtatgatattgatggagataaagtctttctagttgttcaggaaaatgtcctcaatcaagctgaaaatgatcaatttgagtatcataagaactatgcagatttgcatttgctggtagaaggacatgaatattcgagctacggttcacgtatcaaagacgaggcagtagcattcgacgaagcgagtgacattggctttgttcattgtcatgaacactacccactcttgttgggttatcacaattttgcgattttcttcccaggtgagccacatcagccaaatggttatgcaggcatggaagaaaaggttcgaaaatatctctttaaaattttgattgattaa

SEQ ID NO: 1630 - DNA (genomic), 759 bp, Streptococcus pneumoniae; double-stranded, circular
  misc_feature (B) LOCATION 1...759
  hypothetical: NO
  anti-sense: NO
atcgaaatcagtagatcgtataaagtgaaaaggaaggatttcaatatgacaagtttaaaattattaaaagaaaaagcaccattggtcatttgtataaccaatgatgtagtaaaaaatttcacagcaaatggattagtagcactgggcgtctcaccagccatgagtgagtttccagcagatttagaggatttgttaaagtatgctggtggtttattaataaacataggaacattgacagatgaaaattggaaattataccaagctgctctgaaaattgcggagaaatataatgtcccagcagttttagatcctgtagcctgtggagcaggagaatatagaaaaaaagtagcagatgatctaatcaacaattataaactagcagcgattagaggaaatgctggcgagattgcctctttagtaggaatagatgtggcatctaaaggagtagatagtgcgggcgtagataatattgacgaaattgctctagcagcaaatgagaagttcaatattccaatagtagtaacaggtgaagtggatgccattgctgttaatggagaagtggtaacgattcataatggtagtgctatgatgccgaaagtcatttgggacaggatgcttattaggagctgtagtagcaagctttatcggactagaaaaaggtcaagaattgaaatcattagaaacagcaatgttagtttacaatatcgctggagaaatggcagaaaaacgtccaaatggacatcttcctgggacatttaa

SEQ ID NO: 1631 - DNA (genomic), 1221 bp, Streptococcus pneumoniae; double-stranded, circular
  misc_feature (B) LOCATION 1...1221
  hypothetical: NO
  anti-sense: NO
actagaatcaggagtggaagtatgagaaatatgtgggttgtaatcaaggaaacctatcttcgacatgtcaagtcatggagtttcttctttatggtgatttcgccgttcctctttttaggaatctctgtaggaattgggcatatccaaggttcttctatggctaaaaataataaagtggcagtagtgacaacagtgccatctgtagcagaaggactgaagaatgtaaatggtgttaacttcgactataaagacgaagcaagtgccaaagaagcaattaaagaagaaaaattaaaaggttatttgaccattgatcaagaagatagtgttctaaaggcagtttatcatggcgaaacatcgcttgaaaatggaattaaatttgaggttacaggtacactcaatgaactgcaaaatcagcttaatcgttcaactgcttccttgtctcaagagcaggaaaaacgcttagcgcagacaattcaattcacagaaaagattgatgaagccaaggaaaataaaaagtttattcaaacaattgcagcaggtgccttaggattctttctttatatgattctgattacctatgcgggtgtaacagctcaggaagttgccagtgaaaaaggcaccaaaattatggaagtcgttttttctagcataagggcaagtcactatttctatgcgcggatgatggctctgtttctagtgattttaacgcatattgggatctatgttgtaggtggtctggctgccgttttgctctttaaagatttgccattcttggctcagtctggtattttggttcacttgggagatgctatctcactgaataccctgctctttattttgatcagtcttttcatgtacgtagtcttggcagccttcctaggatctatggcttctcgtcctgaggactcagggaaagcattgtcgcctttgatgattttgattatgggtggtttttttggagtgacagctctaggtgcagctggtgacaatctcctcttgaagattggttcttatattccctttatttcgaccttctttatgccgtttcgaacgattaatgactatgcggggggagcagaagcatggatttcacttgctattacagtgatttttgcggtggtagcaacaggatttatcggacgcatgtatgctagtctcgttcttcaaacggatgatttagggatttggaaaacctttaaacgtgccttatcttataaatag

SEQ ID NO: 1632 - DNA (genomic), 258 bp, Streptococcus pneumoniae; double-stranded, circular
  misc_feature (B) LOCATION 1...258
  hypothetical: NO
  anti-sense: NO
ctggattccagcagtgtattggctgtctttaaaaaacagtcaattagtcctcacaaacataatatactactattgtttgaagaagtcaatagtttgtgtttgtttttgttatttattttttacttttttataaaacttctatctcaaaccctaattcttcaacctgattggcttctaagagacaaacattcttcttatcttctaaatgatctccttcttcaaggaatgttgacaagccagaccatggttcaaaggtaa

SEQ ID NO: 1633 - DNA (genomic), 189 bp, Streptococcus pneumoniae; double-stranded, circular
  misc_feature (B) LOCATION 1...189
  hypothetical: NO
  anti-sense: NO
gtcatccccagagcaagagcttcatctcgtaatttttcaacatcactaaccgtaggtcgccatccttcaatcatatttgtacttaaagcataccaaacactcttaaaaacggatcggttttcaaaagctattcccatgattgtcatcttttctttatctatatctaaggacatatgctacctcctttag

SEQ ID NO: 1634 - DNA (genomic), 1152 bp, Streptococcus pneumoniae; double-stranded, circular
  misc_feature (B) LOCATION 1...1152
  hypothetical: NO
  anti-sense: NO
gaatcgtggctggtcgtttattggaagaattggggacagacagtcattgttcttaatatagatgacggtcgtgccaagggcagtgctcgtattgtggaaccggtcgatatttttgaagctctggatccccatcgagacctcttcatcgcctttggaggtcatgcaggtgcagcgggtatgacgctggaagttgagcaactctcagatttatctcaggttttggaagattatgttcgtgaaaaaggtgcagatgctggtggcaagaataagttaaacctagatgaagagttggatttggaggcacttagcttggaaacggtcaaaagttttgaacgtttagctccttttggaatggataatcagaaacctattttttatatcaagaattttcaggtcgaaagtgctcgtactatgggggcaggtaatgcccatctaaagctgaaaatttccaagggtgaggcgagttttgaagtggtagcctttggtcaaggcagatgggcgacagagttttctcaaaccaagaatctagagttagcggttaaattgtctgtcaaccaatggaatggccaaactgccctccagttgatgatggtggatgcgcgagtggaaggtgttcaactttttaacattcgtggaaaaaatgcagtcttgccagaaggtgttccagtcttggattttcctggagaactgccaaatcttgcggctagtgaagctattgtcgtaaaaaacattccagaggatattactcagctgaagaccatttttcaggaacagcatttctctgctgtctatttcaaaaatgatattgacaaggcctattatctgacaggttatgggactagagatcagtttgccaaattgtacaagactatttaccagttcccagagtttgatattcgctacaagctgaaagatttggctgcatatcttaatattcaacaaatcttgctggtcaagatgattcaagtatttgaagaactaggctttgtgacgataaaagatggtgtgatgacagtcaataaagaggcgccaaagcgggagataggagaaagtcaaatttaccaaaatctcaaacaaaccgttaaagaccaagaaatgatggcgctgggtacggtgcaagaaatttatgattttttgatggaaaaagagtag

SEQ ID NO: 1635 - DNA (genomic), 729 bp, Streptococcus pneumoniae; double-stranded, circular
  misc_feature (B) LOCATION 1...729
  hypothetical: NO
  anti-sense: NO
aaaaagtggctcttaacagcaggagtggtcctgagcacgtcagctattttagtggcttgtggaaaaactgataaagaagcagatgcaccgacaacattttcttatgtctatgcagtagatccagcatcattgggctacagtatagcgactcgaacatcgaggacagacgttattggaaatgttattgatggtttgatggaaaatgataaatacggcaatgttgctccttctcaaaaagactatgatttgaacagtacaggatgggctccaagctatcaagatccagcgtcttacttgaatattatggatccaaaatctggttctgccatgaaacaccttggcattacgaaaggaaaagataaggatgttgtagctaaacctggtttggataaatataagaaattgttagaagatgctgtttctgagatcactgacctagagaagagatatgaaaaatatgccaaagctcaagcttggtcgacagatagttcattattgatgccaacagcttcatctggtggttttccagttgtaagtaacgtagtaccattctcaaaaccatactcacaagttggtattaagggggaaccatatatctttaaaggaatgaaattgcaaaaagatattgttacaacaaaagaatataacgaggtttttaaaaaatggcaaaaagaaaaattggaatccaatagcaaataccaaaaagaactagaaaaatacattaaataa

SEQ ID NO: 1636 - DNA (genomic), 780 bp, Streptococcus pneumoniae; double-stranded, circular
  misc_feature (B) LOCATION 1...780
  hypothetical: NO
  anti-sense: NO
cgctctaccagcagcattgatggatatgaaagatcagaatggcgttataaaggctcaagcaggtgttgctctagtaatgattgttattcacatattcttaatgtactttctcgcattttagtaaaggaaaataaaatgaaaatattggttacaggttttaatccttttggaggtgaaaagattaatccagctttggaggctgtaaaattattaccatctgagattaatggggctgaagttcgctgggtagaaattccaacggttttttataagtcgtcagaagttttagaggcagaaatattacgatatcaaccagatgctgtactttgtattggacaagcaggcggcaggaccggcttaacacctgaacgagtggctattaatcaagatgatgctcgcatacctgataacgaaggcaatcaaccaattgatacaccgattcgtattgatggagcatcggcctattttagtagtttacctatcaaagcgatggtacaagctatcaaaaaacagggacttccggcagttgtatccaatagtgcaggaacctttgtttgcaatcatttgatgtaccaagctctttatttagtggataaaaaattccctaatatgagagcaggtttcatgcatattccatatatgatggaacaagtagtaaataagccgaatactgcaggaatgagtctatgtgatattgtaagaggcatagaggtagctattgaagctattgtagactacaaagataaggatttgcagttagtaggcggtgagactcactga

SEQ ID NO: 1637 - DNA (genomic), 243 bp, Streptococcus pneumoniae; double-stranded, circular
  misc_feature (B) LOCATION 1...243
  hypothetical: NO
  anti-sense: NO
cttggcaccagctgtcttggtaggcggcgcagcccttcaacaagtttggattttcatccttgcaccaatcgctggtggagttcttgcagcccttgttgcaaaaaatttccttggaacagaagaataattgaaactcaaaaagccttgctcctcatcttgaggaacagggctttttcgtatgatactcttcgaaaatctcttcaaaccacgtcagcttcaccttgtcgtaggtatggttactga

SEQ ID NO: 1638 - DNA (genomic), 273 bp, Streptococcus pneumoniae; double-stranded, circular
  misc_feature (B) LOCATION 1...273
  hypothetical: NO
  anti-sense: NO
aagacaaccagtcctacttctctaaataaaagagagggtagaaaaaataaatacaaaggaggtgaggaaatgagaccaagacgatatccgtatagtgggaaaaaagagtccacctttgtaaaggcagaccctgagttagttgaaaaacttttaagaaacactagttttcttgagcgtttacaaaaaaagcctatcaattttcagatagactcagaagaatttaagcgtcttagctatgaagccattcatgatacttctcaagtaactcaatag

SEQ ID NO: 1639 - DNA (genomic), 516 bp, Streptococcus pneumoniae; double-stranded, circular
  misc_feature (B) LOCATION 1...516
  hypothetical: NO
  anti-sense: NO
gagtgtgccagaagtttactctgtcaaacggaccaacggctagttgtcctagctcttactagaaaggctattatgaaaatcattatccaacgggttaaaaaagcccaagtgagtatagaaggccagattcagggaaaaatcaatcagggacttttattgctggttggtgttggaccagaggaccaagaggaagatttggactatgctgtgagaaaactggtcaatatgcggattttttcagacgcagaaggcaagatgaacctgtctgtcaaagatattgaaggagaaatcctctctatttctcagtttaccctctttgcggatactaagaaaggcaatcgtccagcctttacaggggcagctaaacctgatatggcatcagacttctatgatgctttcaatcaaaaattagcgcaagaagtgcccgttcagacaggcatctttggagcagatatgcaggttgagctggttaataacggacctgttaccattatcctagatactaaaaagagataa

SEQ ID NO: 1640 - DNA (genomic), 546 bp, Streptococcus pneumoniae; double-stranded, circular
  misc_feature (B) LOCATION 1...546
  hypothetical: NO
  anti-sense: NO
ttagattacagtaagaaaggtaagttaaaaatgagaattgcaattggatgcgaccacatcgtaacagatgaaaaaatggcggtttcagaatttttgaaatcaaaaggatatgaagtcattgactttggtacatatgaccatacacggactcactacccaatctttggtaaaaaagtaggggaagctgtaactagcggccaagctgatcttggggtatgtatctgtggtactggtgttggtatcaacaacgctgtaaataaagttccaggtgttcgttctgccttggttcgtgatatgacaacagccctttatgctaaagagcaattgaacgctaacgttatcggctttggtggtaagattactggtgaattgcttatgtgtgatatcatcgaagctttcattcatgctgaatacaaaccatctgaagaaaacaagaaattgattgcgaaaattgaacaccttgaaagtcacaatgctcaacaaacagacgcaaacttctttacagaattccttgaaaaatgggatcgcggagaataccacgactaa

SEQ ID NO: 1641 - DNA (genomic), 276 bp, Streptococcus pneumoniae; double-stranded, circular
  misc_feature (B) LOCATION 1...276
  hypothetical: NO
  anti-sense: NO
ccaattcggctcatatctataaaggagattcttatgaaactattcaaaccactcttaactgttttagcacttgcctttgcccttatctttatcactgcttgtagctcaggtggaaacgctggttcatcctctggaaaaacaactgccaaagctcgcactatcgatgaaatcaaaaaaagcggtgaactgcgaatcgccgtgtttggagataaaaaaccgtttggctacgttgacaatgatggttcttaccaaggctacgctacgatattgaactag

SEQ ID NO: 1642 - DNA (genomic), 309 bp, Streptococcus pneumoniae; double-stranded, circular
  misc_feature (B) LOCATION 1...309
  hypothetical: NO
  anti-sense: NO
gtcttatacagaatacaagggagaatatggtggctaaaaaaaaaatcttattttttatgtggtcttttcctcttggaggtggtgcagagaagattctatcaaccattgtttcaaatctggatccagaaaagtatgatattgatattcttgaaatggagcactttgacaagggatatgaatcttttccaaagcatgtacgcattttatgatccctatcaggattatcgccaaaccagatggttacgagcttttttgtggagaatgagaattttattttccaagactggctcgtcgtttgcttgtaaatga

SEQ ID NO: 1643 - DNA (genomic), 738 bp, Streptococcus pneumoniae; double-stranded, circular
  misc_feature (B) LOCATION 1...738
  hypothetical: NO
  anti-sense: NO
gataggcacagtatgcgtttagataatttattagcccaagaaaaaatcagccgaaaggccatgaagcaagcactcctcagaggggaaattctagtcgatggttgcccagcccgctccctagctcaaaatatcgatacaggactacaagaactcctttttcaggatcgaatcattcaaggctatgaacacacctatcttatgcttcataaacctgctggtgtcgttacagccaacaaagacaaggaacttccgaccgtcatggacctgcttccatctgacatccagtctgacaagctctatgccgtcggccgactggaccgagatacaacaggactccttctcttgaccgataacggtcccttgggcttccaactcctccatccccaatatcatgtcgataagacttaccaagtccaggttaatggacttctaacacctgaccatatccaaacctttcaaaaaggaattgtctttttagatggcactatctgtaaacctgcaagactagagattctatcagcaagtccttccttcagtcaagcctctatcaccatttcagaaggaaaatttcatcaaatcaagaaaatgttcctctcggttggtgttaaggtgactagcctcaagagaatccaatttggggacttcacattgaacccagatttagcagaaagtaactaccgccctttgaaccaaaaagagttacaaatcattaaaaactatttagagatgagtcgataa

SEQ ID NO: 1644 - DNA (genomic), 231 bp, Streptococcus pneumoniae; double-stranded, circular
  misc_feature (B) LOCATION 1...231
  hypothetical: NO
  anti-sense: NO
ttacataacagcttcatatcaatccagctcaaccaaactggattaaccgcgaccgctttattctttcagcaggtcatggttcaatgctcctttatgctcttcttcacctttctggttttgaagatgtcagcatggatgagattaagagcttccgtcaatggggttcaaaaacaccaggtcacccagaatttggtcatacggcagggattgatgctacgacaggtcctctag

SEQ ID NO: 1645 - DNA (genomic), 312 bp, Streptococcus pneumoniae; double-stranded, circular
  misc_feature (B) LOCATION 1...312
  hypothetical: NO
  anti-sense: NO
aaagcaaacagccttgaaatcaatgttgactgcgattatgaacctgaatcagcccctcaaaagggactgtatatgaatgaacgttaccagtgtttaaaaactaaagaatatcaggcacttttatcttccaagggtagacaaattttcgctaaacgtaagattgatatgaaatctgtctttgggcagataaaggtttgtttgggttataagagatgtcatctgagaggtaagcgtcaagtgagaattgacatgggattcgtactcatggccaacaacctgctgaaatataataagagaaagaggcaaaattaa

SEQ ID NO: 1646 - DNA (genomic), 780 bp, Streptococcus pneumoniae; double-stranded, circular
  misc_feature (B) LOCATION 1...780
  hypothetical: NO
  anti-sense: NO
agaaaaaacagaggtgttcaaatgtcagaagcaggtcataagtttttagcaaaattggggaaaaaacgcttacgtccaggtggaaagcgtgctacagattggttaattgcagaaggaggattgtcaaaagaaaagagaatactagaggttgcgtgtaataggggaactacagcaattgagttggcacagcgttttggttgcaagataactgctgttgatatggatgctcaagctttagaagtggctaaaaaatctgctggaacggcaggtgttgctcatttaatcagttttgaaagagcaaatgcaatgaaacttccttatcaagatgctagttttgatattgttataaatgaagctatgctgactatgcaagccgatcaagctaataaaaaatgtgtaatggaatatctaagggtattaaaacctggaggtcttcttttgacacatgatgtgcttcttaaggaagctaaagagtctatcagacaggaattatcacaagcaattcatgtaaatgtaggtcctttaactcaagatggttgggaacaggtgatgatagaatcaggttattgtgatgtgaaagtattgactggtgaaatgacattaatgaaattatcgggtatgatttatgacgaaggttggctaggaactttgaaaatttgtgtaaatgcttgtaaaaaggagaatagaaagcagtttttaactatgtataaaatgtttgctaagaataaacagaaattgggctttattgcgatggctagttataaatcgtcaaaacgttag

SEQ ID NO: 1647 - DNA (genomic), 459 bp, Streptococcus pneumoniae; double-stranded, circular
  misc_feature (B) LOCATION 1...459
  hypothetical: NO
  anti-sense: NO
agaatgaacagaagagaggcagtcgaatttgttaacatgtgtatgattaaaaacggagataaggtcctggtccaagaccgagttagtcccgactggtctggcattacttttcctggtggtcatgttgaacgtggcgaatcctttgtcgatgctgtcattcgtgaagtgaaagaagaaactggtctgatcatttccaaaccccaactctgtggtatcaaaaactggtatgacgacaaggattatcgttatgtcgtccttttttacaagacagaacactttactggtgaactccagtcttcagacgaagggaaagtttggtgggaggactttgaaaatctttctcatctaaaacttgcaaccgatgatatgtctgatatgcttcgtgtgtttctagaagaagatctcagtgaattcttttactacaaaaacggtgacgactggctttatgatttgaagtaa

SEQ ID NO: 1648 - DNA (genomic), 462 bp, Streptococcus pneumoniae; double-stranded, circular
  misc_feature (B) LOCATION 1...462
  hypothetical: NO
  anti-sense: NO
tgccttgacagagtaaggtctgcatactgcagtagagtctgtgaaggctgggctgccttggactctctcaaagatgtgaaagcaaatgctagcgacagcaagcctgcacaggacaagaaggatgcaaaacaaggaacggaagatagtaaggattcagataagatgactgaaacaaactcagttccggcaggagtgattgtggtcagtctacttgccctcctaggcgtgattgccttctggctgattcgccgtaagaaagagtcagaaatccagcaattaagcacggaattgatcaaggttctaggacagctagatgcagaaaaagcggataaaaaagtccttgccaaagcccaaaaccttctccaagaaacccttgatttcgtgaaagaagaaaatggctcagcagagacagaaactaaactagtagaggagcttaaagcaatccttgacaaactcaagtaa

SEQ ID NO: 1649 - DNA (genomic), 1101 bp, Streptococcus pneumoniae; double-stranded, circular
  misc_feature (B) LOCATION 1...1101
  hypothetical: NO
  anti-sense: NO
gcaaaggacagagcctctactacaaatgaaatgaccgcaactactagtaacgaaacaaagcctgaagcaggaaaggcgatagaaagtattcaagagacagcactaacgcaggctaccgaaagtcctgagcaacctccattaaaggcgcaacctactggtccgttagtgccaccaacacctggtcgggggtttaatacaccgatttatcaaagcgttcataaaggagaacttttttcaacgggaaataccaacttaaaaattgcgaatgaaaatacggcggctgcacaaacatttttaaacacacgaggagcaagtagtggttatgcaattaacaattttcctttagaatttgcagatgttgacaatgatccaaatacgtataactctagtcgggcttatattgatttaaatggtgcaaaagagattgcttgggcgggcttattttggagtgcatctagatataaaggccctgcttacggaacaaatctttctgatgaagaaattagtgcaccagttcaatttactacaccaaatggaaccgtacagcgtgtttcgccccaaaggtaccatcgtatcgatcaagatgcaacaaacccaggacaacgtttcgggtacaataacactggattttctaattatgcagatgtaacttcaattttacaaggggataaaagtgcgacagggagttatacgttggcagatattcctatgacaagtagtttaaatggtcaatatcaatattataactttagtggttggagtttgtttgttgttacaaaggatcaggcaagtaagtcaagagcttttagtatttactatggagcacgtggtaatgctgctggaaccaataatgaatttactatgagcaactttttaacagcaaaacaaggaaatcttgatccaattgtgacctggtttactgttcaaggagataaatactggactggagacaacgcacaaattaaaaatagcgcaggaacttgggtaaatatttcgaacacgctcaatccagttaacaatgctatgaacgcaactgtgaccgataacgatgaacatttggtaaaacaatatccagggatatttgcgccgggatcatcctaa

SEQ ID NO: 1650 - DNA (genomic), 210 bp, Streptococcus pneumoniae; double-stranded, circular
  misc_feature (B) LOCATION 1...210
  hypothetical: NO
  anti-sense: NO
ccattttgcaggactaaaatcaaatctgcatggacaactgcactgaggcgatgggcagtgataatggttgtcttgtcctttcgcgtctccttgaggttgtcgataatcgcatactctgtcttggcatctacggcggataaggaatcatccaaaatcaagatatcagggtctaaaatcatagcccgactcatagccaaccgttgcttttga

SEQ ID NO: 1651 - DNA (genomic), 1035 bp, Streptococcus pneumoniae; double-stranded, circular
  misc_feature (B) LOCATION 1...1035
  hypothetical: NO
  anti-sense: NO
ttccctagcagactggggacaattactaaaagaggaaaagaaatgaaaaaaatcgcagtagatgccatggggggcgattacgcacctcaggccattgttgagggtgtcaatcaagccctatctgacttttcagatatcgaggttcaactttacggagatgaagctaaaatcaagcaatatctgacagcgacagagcgcgtcagcattatccatacggatgagaagattgattcggatgatgaacctacgagagctattaggaataagaaaaatgccagtatggtattggcagccaaggctgtcaaagatggtgaagcagacgctgtcctttcggctgggaatacaggtgccttgttggctgctggattcttcatcgtgggtcgtatcaagaatatcgaccgtcctgggcttatgtcgactttgccgactgtagatgggaagggatttgacatgctagacctcggtgccaatgcggaaaatacagcccagcacctccatcaatacgcggttctaggatccttctatgctaaaaatgttcgtggcattgcgcaaccacgtgttggcttgctcaataacggaacagagagtagcaagggcgatccgcttcgtaaggaaacttatgaattactagtggctgatgaaagtttgaactttatcggaaatgtggaagcgcgtgatttgatgaatggtgttgcagatgttgttgtggcagatggtttcacgggaaacgctgtgctcaaatccatcgaagggacagctatgggaatcatgggcttgctcaagacagctattacaggtggtggtcttcgagcgaaactaggtgccctccttctcaaggacagcctcagaggtttgaaaaaacagctcaattattcagatgttggtggagcggtcttgtttggtgttaaggcacctgttgtcaagactcatggctcaagcgatgccaaggctgtttatagtacgattcgccagattcgtaccatgctagaaacagacgtagttgcccagactgcgcgtgaattttcaggagaataa

SEQ ID NO: 1652 - DNA (genomic), 3651 bp, Streptococcus pneumoniae; double-stranded, circular
  misc_feature (B) LOCATION 1...3651
  hypothetical: NO
  anti-sense: NO
ttgacaaggcttggaacttatttacaaaggagaatcatcttggcaggacatgacgttcaatacgggaaacatcgtacccgtcgtagtttttcaagaatcaaagaagttcttgacttaccaaatttgattgaaattcaaactgactcattcaaagctttcctagaccacggtcttaaggaagtgtttgaagatgtattgccaatttcaaacttcacagacacaatggagttggaatttgttggatatgaaatcaaggaaccaaaatatacgctagaagaagctcgtatccacgatgctagctactcagcaccaatttttgtaaccttccgtttgatcaataaagaaacaagcgaaatcaagacccaagaagttttctttggtgatttcccaatcatgacagaaatgggtactttcatcatcaatggtggtgaacgtattatcgtttctcagttggtccgctcaccaggtgtttactttaacgacaaagtagacaaaaatggtaaggtgggctatggttcaactgttatccctaaccgtggagcttggttggaacttgaaagcgactcaaaagatatcacctacactcgtatcgaccgtactcgtaagattccatttacaaccttggttcgtgctcttggtttctcaggtgatgatgaaatctttgatatctttggtgacagcgaattggttcgcaacactgttgaaaaagatatccacaagaatccaatggactctcgtacagacgaagccttgaaagaaatttacgaacgccttcgtccaggtgagcctaagacggctgaaagctcacgtagcttgcttgtagctcgcttctttgacccacgtcgttatgacttggcagcagttggtcgttacaaaatcaataaaaaactcaatgttaaaacacgtttgctcaaccaaaccattgcagagccattggtagaccctgaaactggagaaatcttggtagaagctggtacgattatgactcgtagcgtgattgaaagcattgaaagccatttggatggcgacttgaacaagattgtctacatcccaaacgatgcagccgttgtgactgagcctgttgttcttcaaaaattcaaggttattgctccaactgatccagatcgcgtcgtaacgatcattggtaatgctaacccagatgacaaggttcgtacggtgactcctgcagatatccttgctgagatgagctacttcctcaacttggctgaaggacttggccgtgtagatgatatcgaccaccttggaaatcgtcgtatccgtgcggttggtgaattgcttgccaaccaagtacgtttgggactttctcgtatggaacgtaatgtccgtgaacgtatgtctgttcaggacaatgaagtcttgacaccacaacaaattatcaatattcgtcctgtaacagctgcagttaaagaattctttggttcatcacagttgtcacagttcatggaccaacacaacccgctttctgagttgtctcacaaacgccgtttgtcagccttaggacctggtggtttgactcgtgaccgtgccggatatgaagtgcgtgacgtgcactacactcactatggtcgtatgtgtccaatcgagacacctgaaggacctaacatcggtttgatcaataacttgtcatcttacggacacttgaacaaatatggttttgttcaaacaccataccgtaaggttgaccgtgaaacaggtgttgtcacgaacgaaattgtttggttgacagctgatgaagaagatgaatatactgtagctcaggctaactctcgtctgaatgaagatggaacctttgctgagaagattgtcatgggacgtcaccaaggggtcaaccaagagtatccagctaatattgttgactacatggacgtttcaccaaaacaggtagttgccgttgcgacagcatgtattcctttcttggaaaacgatgactccaaccgtgccctcatgggagccaatatgcaacgtcaggctgtgccattgattaatcctcaggcaccttacgttggtactggtatggaataccaagcagcccacgattctggtgcggctgtgattgctcagtatgatggtaaagttacttacgcagatgctgacaaggtagaagttcgtcgtgaagatggttcattggatgtttaccacatccaaaaattccgtcgttcaaactcaggtactgcttacaaccaacgcactctcgtaaaagttggtgatgtcgttgaaaaaggcgatttcatcgctgacggaccttctatggaaaatggagaaatggcgcttggacaaaacccaatcgttgcctacatgacttgggaaggctacaacttcgaggatgccgttatcatgagcgaacgcttggtgaaggacgatgtctacacatctgttcaccttgaagaatacgaatcagaaacgcgcgatacaaagcttgggcctgaagaaatcactcgcgaaattccaaacgttggtgaagatgccctcaaagaccttgacgaaatggggattatccgtattggtgctgaggttaaagaaggtgatattcttgtagggaaagtaacacctaagggtgagaaagatctttcagctgaagaacgtctcttgcacgctatctttggagacaagtctcgtgaagtgcgtgatacttctcttcgtgtaccacacggtgccgatggtgtcgttcgtgatgttaagatctttacacgtgtaaatggagatgagttgcaatcaggtgttaacatgttggttcgtgtttacatcgctcaaaaacgtaagattaaggtcggagataaaatggccggacgtcacggaaacaaaggggttgtctctcgtatcgttcctgtagaagacatgccttaccttccagacggaactccagtcgacatcatgttgaacccacttggggtgccatcacgtatgaatatcggtcaggttatggagcttcaccttggtatggcagctcgtactcttggtattcacattgcgacaccagtctttgatggagcaagttctgaagatctttggtcaactgttaaagaagcaggtatggatagcgatgccaagacaatcctttacgatggacgtacaggtgaaccatttgataaccgtgtttctgttggagtcatgtacatgatcaaactccaccacatggttgacgataaattgcatgcgcgttcagtcggaccttactcaactgttacccaacaaccactcggaggtaaagctcagtttggtggacaacgtttcggtgagatggaggtttgggctcttgaagcctacggtgcgtcaaatgtccttcaagaaatcttgacttacaagtcggacgatatcaacggacgtttgaaagcctatgaagctattacaaaaggcaaaccaattccaaaaccaggtgttccagaatccttccgagttcttgtcaaagaattgcaatctcttggtcttgacatgcgtgtcctagacgaagatgaccaagaagtggaacttcgcgacttggatgaaggaatggacgaagatgtcatccacgtagatgaccttgaaaaagcccgcgaaaaagcagcccaagaggctaaagcagcctttgaagctgaagaagctgagaaagcaacaaaagcggaagcaacagaagaagctgctgaacaagaataa

SEQ ID NO: 1653 - DNA (genomic), 1308 bp, Streptococcus pneumoniae; double-stranded, circular
  misc_feature (B) LOCATION 1...1308
  hypothetical: NO
  anti-sense: NO
aaaattttaaggagaaatgacagaatgtctgtatcatttgaaaacaaagaaacaaaccgtggtgtcttgactttcactatctctcaagaccaaatcaaaccagaattggaccgtgtcttcaagtcagtgaagaaatctcttaatgttccaggtttccgtaaaggtcaccttccacgtcctatcttcgataaaaaatttggtgaagaatcactttaccaagacgttatgaacgctcttttgccaaacgcttatgaagcagctgtaaaagaagctggtcttgaagtggttgcccaaccaaaaattgacgtaacttcaatggaaaaaggtcaagactgggttatcgctgctgaagtcgttacaaaacctgaagtaaaattgggtgactataaaaaccttgaagtatcagttgatgtagaaaaagaagtaactgacgctgatgttgaagagcgtatcgaacgcgaacgcaacaacctggctgaattggttatcaaggaagctgctgctgaaaacggcgacactgttgtgatcgacttcgttggttctatcgacggtgttgaatttgacggtggaaaaggtgaaaacttctcacttggacttggttcaggtcaattcatccctggtttcgaagaccaattggtaggtcactccgctggcgaaaccgttgatgttatcgtaacattcccagaagactaccaagcagaagaccttgcaggtaaagaagctaaattcgtgacaactatccacgaagtaaaagctaaagaagttccagctcttgacgatgaacttgcaaaagacattgatgaagaagttgaaacacttgctgacttgaaagaaaaataccgcaaagaattggctgctgctaaagaagaagcttacaaagatgcagttgaaggtgcagcaattgatacagctgtagaaaacgctgaaatcgtagaacttccagaagaaatgatccatgaagaagttcaccgttcagtaaatgaattccttgggaacttgcaacgtcaagggatcaaccctgacatgtacttccaaatcactggaactactcaagaagaccttcacaaccaataccaagcagaagctgagtcacgtactaagactaaccttgttatcgaagcagttgccaaagctgaaggatttgatgcttcagaagaagaaatacaaaaagaagttgagcaattggcagcagactacaacatggaagttgcacaagttcaaaacttgctttcagctgacatgttgaaacatgatatcactatcaaaaaagctgttgaattgatcacaagcacagcaacagtaaaataa

SEQ ID NO: 1654 - DNA (genomic), 1107 bp, Streptococcus pneumoniae; double-stranded, circular
  misc_feature (B) LOCATION 1...1107
  hypothetical: NO
  anti-sense: NO
aaatatttaaggagaaaatatatgttgaaacacttaaacttaaaaggtcacttattgacagccatttcctatatgattccaattgtttgtggtgcaggattcttagttgccattggtttagcaatggggggtggtgttcctgacgctcttgtagcaggaaaattcactatctgggatgctttagcaactatgggtggtaaagcccttggtctcttgccagttgttattgctacaggtttgtcttactcgattgctggtaagccagggattgcaccaggttttgttgttggtctaattgccaattctgttggttcagggtttatcggtggtatcttgggaggttatatagctggtttcttggttcaagcgattattaaaaaggtcaaagtaccaaactggattaaaggtttaatgccaaccttgattattccttttgtagcctctttggtaagtagtttgattatgatttatattattggagcgcctatcgcagcctttaccaactggttgacgagcttattacaaagcttgggaagtgcttcaaatggtttgatgggggcagttattggagttctcagtgctgttgactttggtggcccacttaataaaacagtctatgcctttgtgttgactttacaggctgaaggtgtgaaagaaccattgactgctttgcaattggtgaatactgctacaccagttggatttggattggcctattttatcgcgaaattactcaaaaaaaatatctatactcaagaggaaatcgaaacattgaaatcggctgttcctatggggattgtcaatattgttgaaggtgtaattccgattgttatgaataacttggttccaggtctcattgcaacaggtatcggtggtgctgttggtggtgctgtttctttgacaatgggtgctgattctgccgtgccatttggtggagtgcttatgttaccaaccatgactcgtccagtagctggtatttgtgctttgttagccaacattgtagtcacaggacttgtctacgcgattttgagaaaaccaataaaacatacagaaccagttatgactgttgaagaagagattgatttgtcagatattgaaattttgtaa

SEQ ID NO: 1655 - DNA (genomic), 342 bp, Streptococcus pneumoniae; double-stranded, circular
  misc_feature (B) LOCATION 1...342
  hypothetical: NO
  anti-sense: NO
ttggatttaagaaaaggagaaaatattatggcaaaagctttaattatttgtgcagcaggaatgtcttcatcacttatggcacagaaaacaacagagtttctaaaaggaaaagggaaagatattgtagttgatgctattagtgctactgaaggagggaaagctatcgcagcagcagcttttgatttgtatcttgtcagccctcaaacaaaaatgtactttaagcaatttgaagaggctggttctaaagcaggaaaaccagttgtacaaatacctcctcaagcctatattcctattccaatgggaattgaaaaaatggctaatttgattcttgagaatatttga

SEQ ID NO: 1656 - DNA (genomic), 561 bp, Streptococcus pneumoniae; double-stranded, circular
  misc_feature (B) LOCATION 1...561
  hypothetical: NO
  anti-sense: NO
agtacattaagattgaaatcattaaaggaggcgaacatggcccaagatataaaaaatgaagaagtagaagaagttcaagaagaagaagttgtggaaacagctgaagaaacaactcctgaaaagtctgagttggacttggcaaatgaacgtgcagatgagttcgaaaacaaatatcttcgcgctcatgcagaaatgcaaaatatccaacgccgtgccaatgaagaacgtcaaaacttgcaacgttatcgtagccaggacttggcaaaagcaatcttaccatctcttgacaaccttgagcgtgcacttgcagttgaaggtttgacagatgatgtgaagaagggcttggggatggtgcaagaaagcttgattcacgctttgaaagaagaaggaattgaagaaatcgcagcagatggcgaatttgaccataactaccatatggccatccaaactctcccagcagacgatgaacacccagtagataccatcgcccaagtctttcaaaaaggctacaaactccatgaccgcatcctacgcccagcaatggtagtggtgtataactaa

SEQ ID NO: 1657 - DNA (genomic), 2076 bp, Streptococcus pneumoniae; double-stranded, circular
  misc_feature (B) LOCATION 1...2076
  hypothetical: NO
  anti-sense: NO
aaaagattaaggaggacgtgcgtggaattactgatttacctcatcctatttttactggttttgattgtctcaagtacaaccaataagctcctgccctttttgcctctccctttggtgcagattcttttaggaattgtgattggtctctttttacccaatactgactttcaccttaatacggagttgtttttggcactggttatcggacccttgcttttccgagaggctgaagatacagatgttacggctattttaaaacactggcgaatcattgtttatctcatatttccagtgatttttatctcgaccctgagtttgggtggcttggcccatcttctttggttcagccttcccttggcagcttgcttggctgttggtgcagcccttggtcctacggacttggtggcctttgcctctctttcggagcgttttagctttcctaagcgcgtgtccaatattcttaagggcgaaggactcttgaatgatgcttctggtttggtggcttttcaggtagctttgacagcttggacaactggagctttttctctggggcaagctagcagttcgctcatcttttcaatcctaggcggttttttaattggatttttaacagccatgaccaaccgcttcctccataccttcttgctaagtgtgcgcgcaacggatattgccagtgaacttttattagaattgagtttgcctctagtgaccttctttctggcagaagaagtccatgtttcagggattattgccgtcgtagttgctggaattttaaaggcaagtcgcttcaagaaaatcacgctcctcgaagcccaagtggatacggtgaccgagacggtctggcatacagtgacctttatgctcaacggttctgtctttgtgattttagggatggagttggaaatgatagcagaacctatcttgaccaatccaatctataatcctctacttttattgctatctctcatcgcccttacctttgtcctctttgtcattcgttttattatgatctatggctattatgcctatagaacccgacgcctcaagaaaaagctaaataagtatatgaaggacatgtttctcttgaccttttcaggtgttaagggaacggtgtcgattgctacgattctcttgataccaagtaatctagaacaggagtatcctctcttgcttttccttgttgcaggtgtgacgcttgtcagctttttaacaggtctcttggtcttgcctcatctttctgatgaagaggaagaaagcaaggattatctcatgcatatcgccattttgaatgaagtaacgctagagttggaaaaagagttggaagacaccagaaataaacttcccctctatgcggctattgacaattatcatggacgtattgaaaatctcattttaagccaagaaaaccaggatgatcaagaagattgggctgctttgaaactcttgattcttagtattgaaagtgatggtttggagcaggcctatgaagaggggaacattagcaatcgtgtttaccgagtttaccaacgttatctgaaaaatatagaacaaggaatcaatcgtaaacttgcctcaagactgacctattatttccttgtttctttgcggattttacgttttctccttcatgaagtttttactctcggaaagaccttccgtagctggaagaacaaggagcaaagccgtctccgtgctcttgattatgaccaaattgcagagctctatcttgccaatacggagatgattattgaaagtttggaaaacctgaagggagtctacagccgctctttgattagttttatgcaggagtctcgtcttcgagaaacaactattattagcagtggtgcctttgtcgaacgggttatcaatcgtgtcaaacccaacaatatcaatgaaatgctgagaggctattatctggagcgcaagttgattttcgaatacgaagaaaaacgattgattacgactaagtatgccaagaaattacgacaaaatgtaaataacttagagaactattccttgaaggaagctgccaataccctgccgtatgatatggtggaattggtaagaagaaattag

SEQ ID NO: 1658 - DNA (genomic), 618 bp, Streptococcus pneumoniae; double-stranded, circular
  misc_feature (B) LOCATION 1...618
  hypothetical: NO
  anti-sense: NO
agcatgttaagtttatcggtcttacccactgtggacgaatctgggaaggatggggtgttccaanagaacgtatcatcgttgttaaaccaggtgaccatattggaattaaaagatatgaagattcatgcagtagaatcatttgaccgtacttgcttggtnactctcccagtgaacggtgctgatgagacaggcggtgaacttgctggcttggctgttacagatgaagaaatggctcaaaaggctgttaactatatctttgaaacaccaggtggaaccatctatcatggtgcagattctcacttctcaaactattttgcaaaacatggtaaagactttaaaattgatgttgctttgaataactatggtgaaaatccggtaggtatccaagacaaaatgacatctatcgaccttcttcgtatggcagaaaatctgcgtaccaaagtcattatcccagttcactatgatatctggtctaacttcatggcttctactaatgagattctagaactttggaaaatgcgaaaagatcgcttgcaatacgatttccatccatttatctgggaagttggcggtaagtacacttatcctcaagatcaacacttagtagaataccatcat

SEQ ID NO: 1659 - DNA (genomic), 873 bp, Streptococcus pneumoniae; double-stranded, circular
  misc_feature (B) LOCATION 1...873
  hypothetical: NO
  anti-sense: NO
gagtatctaagaaatttgaaatttaagaggagaagcatgatgaaacaagatgaaagaaaagccctgattggcaaatacattctattgattctaggatcggttctgcttttagtgccgctccttgctaccctctttagttccttcaaacccactaaggatattgtagataatttctttggctttccaaccaacttcacatgggacaactttagccgtctcttagctgatgggattggaggctattattggaactctgtcgtcatcactgtcttgtctttacttgcagtaatgatctttatccctatggcagcctactccatcgctcgcaatatgagtaaaagaaaagcctttaccatcatgtataccctcttaatcctcggaatcttcgtacctttccaagtcatcatgattccgattacggttatgatgagtaaactcggtttggctaatacctttggtttgatcttgctctacttgacctatgcgattccacagaccctctttctctatgttggctatatcaaaatctcgattccagaaagtctggatgaagcagcagagatcgatggggctaatcaatttacaacctatttccgcatcatcttcccaatgatgaaaccgatgcatgcgacaaccatgatcatcaatgccctttggttctggaatgacttcatgttgccactccttgtcttgaaccgggattccaaaatgtggactctgcctttgttccaatacaactacgcaggccaatatttcaacgactacggaccaagctttgcctcttacgtggtcggcattatcagtatcaccattgtctatctcttcttccaacgccatatcatttcaggaatgagcaacggggcagtgaagtaa

SEQ ID NO: 1660 - DNA (genomic), 384 bp, Streptococcus pneumoniae; double-stranded, circular
  misc_feature (B) LOCATION 1...384
  hypothetical: NO
  anti-sense: NO
ggaagactaagcatggcccaatcacttaacaaaacagtactcctcagtacgacaggcacttcctacctctctatcgctgggaaagttgggaaattccttgtcggagatcaggctttggaattttacccagatgtcaatgtcgaacaatttatccagattccttggagccatatcaatcagattggagccaatgtcactggatgcaaaatcagccgccacttcgaagtctttacagacaaaggaaaattcctctttgcttcaaaagactcaggtgccattctcaaaattgcacgcgacaaattgggcaatgacaaggtcgtcaaacttccgaccctgattcagacaattagccaaaaatttaaaaatctatttgcaaaaaaatag

SEQ ID NO: 1661 - DNA (genomic), 366 bp, Streptococcus pneumoniae; double-stranded, circular
  misc_feature (B) LOCATION 1...366
  hypothetical: NO
  anti-sense: NO
aaaaggaggcttgtgatggaacacttgtttaaaatgataatcttattaccctgtttttactttttcagctggattgacaaggataatagagaaagtaaatttttcccaattttttactatttttactggatttacatcaccctctatgctctttttagccttgcttggacagttttttcagttctgtttttcaatatcgtcttgagaaatttgacagatatcaagttatggggtatttggctattattactacttatcgcttttgctagtgactggttagactatatctgtttcaaaaaaatgcttgacttgagacgggaactagggaagtctaaaggtgtgcataaaggaaggtgtaggaactaa

SEQ ID NO: 1662 - DNA (genomic), 765 bp, Streptococcus pneumoniae; double-stranded, circular
  misc_feature (B) LOCATION 1...765
  hypothetical: NO
  anti-sense: NO
actaaaataagtagaagttttgaaaggaaaaaaatgaaactagaacataaaaatatctttattacaggttcgagtcgtggaattggtcttgccatcgcccacaagtttgctcaagcaggagccaacattgtcttaaacagtcgtggggcaatctcagaagaattgctcgctgagttttcaaactatggtatcaaggtggttcccatttcaggagatgtatcagattttgcagacgctaagcgtatgattgatcaagctattgcagaactgggttcagtagatgttttggtcaacaatgcagggattacccaagatactcttatgctcaagatgacagaagcagattttgaaaaagtgctcaaggtcaatctgactggtgcctttaatatgacacaatcagtcttgaaaccgatgatgaaagccagagaaggtgctatcattaatatgtctagtgttgttggtttgatggggaatattggtcaagctaactatgctgcttctaaggctggcttgattggctttaccaagtctgtggcacgcgaggtcgctagtcggaatatacgagtcaatgtgattgctccaggaatgattgagtctgatatgaccgctatcttatcagataagattaaggaagctacactagctcagattccgatgaaagaatttgggcaggcagagcaggttgcagatttgacagtatttttagcaggccaagattatctaactggtcaagtggttgccattgatggtggcttaagtatgtag

SEQ ID NO: 1663 - DNA (genomic), 711 bp, Streptococcus pneumoniae; double-stranded, circular
  misc_feature (B) LOCATION 1...711
  hypothetical: NO
  anti-sense: NO
cgaaaaataagtaggtcagccatggggaaacggattttattacttgagaaagaacgaaatctagctcattttttaagtttggaactccagaaagagcagtatcgggttgatctggtagaggaggggcaaaaagccctttccatggctcttcagacagactatgatttgattttattgaacgttaatctgggagatatgatggctcaggattttgcagaaaaattgagtcgaactaaacctgcctcagtcatcatgattttagatcattgggaagacttgcaagaagagctggaagttgttcagcgttttgcagtttcatacatctataagccagtctttatcgaaaatctggtagcgcgtatttcggcgatcttccgaggtcgggacttcattgatcaacactgcagtctgatgaaagttccaaggacctaccgcaatcttaggatagatgttgaacatcacacggtttatcgtggtgaagagatgattgctctgacccgccgtgagtatgaccttttggcgacacttatgggaagtaagaaagtattgactcgtgagcaattgttggaaagtgtttggaagtatgaaagtgcgaccgagacaaatatcgtagatgtctatatccgctatctacggagcaagcttgatgttaaaggccaaaaaagctacattaaaaccgtgcgtggtgttggttacaccatgcaagaatag

SEQ ID NO: 1664 - DNA (genomic), 3720 bp, Streptococcus pneumoniae; double-stranded, circular
  misc_feature (B) LOCATION 1...3720
  hypothetical: NO
  anti-sense: NO
acaagaataagcagttcacttagaatagaaagggaagaaatagtggttgatgtaaatcgttttaaaagtatgcaaatcaccctagcttctccaagtaaagtccgttcatggtcttatggagaagtcaaaaaacctgaaacaatcaattatcgtaccttgaaaccagaacgtgaaggactctttgatgaagtgatctttggtcctacaaaagactgggaatgtgcttgtggtaagtacaaacgcattcgttacagaggaattgtttgtgaccgctgtggggttgaagtaacgcgtacgaaagttcgtcgtgagcgtatgggacatatcgaattgaaagctcctgtatctcacatctggtacttcaaggggattccaagccgtatgggcttgacccttgatatgagccctcgtgccctcgaggaagttatctactttgcggcttatgtggtgattgatcctaaggatacaccacttgagcacaagtctatcatgacagagcgcgaataccgagagcgcttgcgcgaatatggttatggttcatttgttgccaagatgggtgcggaagccatccaagaccttttgaagcaagtagatcttgaaaaagaaattgctgaactcaaagaagaattgaaaacagctactggacaaaaacgtgtcaaagccatccgtcgtttggatgttttggatgccttttacaagtctggaaacaaacctgaatggatgattcttaacattcttccggttatcccaccagatcttcgtccaatgttgcagttggatggtggccgttttgcctcatctgacttgaatgacctttaccgccgtgttatcaaccgtaacaaccgtttggctcgtttgcttgagttaaatgcaccaggtatcatcgttcaaaatgagaagcgtatgcttcaagaagcagttgacgctttgattgacaatggtcgtcgtggtcgtccaatcacaggaccaggtagccgtccattgaaatcattgagccacatgcttaaaggtaaacaaggacgcttccgtcaaaacttgctcggtaaacgtgttgacttctcaggacgttccgttatcgccgttggtccaactcttaagatgtaccaatgtggtgtgccgcgtgaaatggcgattgaactctttaaaccatttgtcatgcgtgaaatcgttgcccgtgatatcgtgcaaaacgtcaaagcagctaaacgcttggtggaacgcggagatgagcgtatctgggatatccttgaagaagtgattaaagaacacccagtgcttttgaaccgcgcaccgacccttcaccgtttgggtatccaagccttcgagccagtcttgattgatggtaaggctcttcgcttgcacccacttgtctgtgaagcctacaatgctgactttgacggggaccaaatggccatccacgtaccactttcagaagaagcacaagcagaagctcgtatcctcatgctagctgctgagcacatcttgaacccgaaagatgggaaaccggtagttactccatctcaggacatggttttgggtaactactacttgaccatggaagaagctggtcgcgaaggtgaaggaatggtcttcaaagaccgtgacgaagcggttatggcttaccgcaatggttatgttcacctccactcacgtgttggtatcgcaacagacagcctcaacaagccttggacagaagagcaaagacataaggtcttgcttacaacagttggtaaaattctcttcaacgatatcatgccagaggggctaccatacttgcaagaaccaaacaatgccaacttgacagaaggtgttccagctaaatacttcttgccacttggtggagatatcaaggaagctatcagcaatcttgagctcaaccctccattcaagaagaaaaaccttggaaatatcatcgctgaaatcttcaaacgtttccgtacgacagaaacttctgccctacttgaccgcatgaagaacctcggttaccaccactcaactcttgcaggattgacagtgggtattgccgacatcccagtcgttgatgacaaggctgaaatcattgaagaatcacacaaacgtgtcgaacaaatcaccaaacaattccgtcgtggtatgatcacagacgacgagcgttacaatgctgttacagctgaatggcgtgctgcccgtgaaaaacttgagaaacgcttgattgctaaccaagatcctaagaacccaatcgttatgatgatggactctggagcccgtggtaacatctcaaacttctcacagcttgccggtatgcgtggtctgatggctgctccgaatggacgtatcatggaattgccaatcctttcaaacttccgcgaaggtttgtcggtattggaaatgttcttctcaactcacggtgctcgtaaaggtatgaccgatacggcccttaagacagccgactcaggttacttgactcgtcgtttggtcgacgttgcccaagacgttatcatccgtgaggacgactgtggaactgaccgtggtctcttgatccgttctatcgcagaaggaaaagagatgatcgagtctctcgaagagcgtctcaacggtcgttacactaagaaaactgttaaacatccagaaactggtgcagtgattattggtccaaatgaattgattacagaagacaaggcgcgtgaaattgtcaatgctggtgtggaagaagtgactatccgttctgtatttacatgtaacactcgtcacggtgtctgccgtcactgttacggtatcaacttggcgactggtgatgcggttgaagttggtgaagcagttggtacaatcgctgcccaatctatcggggaacctggtacacagcttacaatgcgtaccttccacacaggtggggttgcctcaaataccgatatcactcagggtcttcctcgtgtccaagaaatctttgaagcccgcaatcctaaaggggaagcggttatcacagaggttaaaggacaagttactgctatcgaagaggatgcatcaactcgtaccaagaaagtctttgttaagggtgaaactggcgaaggtgaatatgtcgttccatttacagctcgtatgcgtgtcgaagttgggggccaagtagcgcgtggtgctgctctgacagaaggttctatccaaccaaaacgtctccttgcagttcgtgatgtcttgtcagttgaaacgtaccttctcggtgaagtacaaaaagtttaccgtagccaaggggtagaaatcggtgacaaacacatcgaggtaatggttcgtcaaatgatccgtaaagtccgtgtcatggatccaggtgatacagatcttctcatgggtaccctcatggatatcaatgactttacagatgccaacaaagatgtccttatcgcaggtggagttccagcgacaggtcgcccagtccttatgggaattaccaaagcctcacttgaaacaaacagtttcttgtcagcggcttccttccaggaaacaactcgtgtccttactgacgcagctatccgtggtaagaaagaccatctccttggacttaaagaaaatgttatcatcggtaagatcatcccagctggtactggtatggcccgttaccgtaaccttgaaccacatgctgtcaacgaagaagaataccttaatcctccagtagaggaagaaggaaatgaagaaacaacagaagtagttgtggatactgccgttgaaactgtggaagaaacagtagaataa

SEQ ID NO: 1665 - DNA (genomic), 261 bp, Streptococcus pneumoniae; double-stranded, circular
  misc_feature (B) LOCATION 1...261
  hypothetical: NO
  anti-sense: NO
gtcatagtaagggctaaacatatccatagtaataattttgacgcgacatcggacggctctatcatatttaagaaagtgatttcgaatgatagcttgtgttcttccctcaagaacagtgatgatattgagattgttaaaatcttgcgcaatgaagctcatctttccctttgtaaaagcatactcatcccaagacataatctcaggaagacaagaaaaatcatgtttaaagtgaaaatcattgagcttacgaataacagttga

SEQ ID NO: 1666 - DNA (genomic), 252 bp, Streptococcus pneumoniae; double-stranded, circular
  misc_feature (B) LOCATION 1...252
  hypothetical: NO
  anti-sense: NO
gtcatagtaaggactaaacatatccatagtaatgattttgacgcgacatcggacggctctatcatatttaagaaagtgatctcggatgacagcttgtgttctaccttcaagaacagtgatgatatcgagcttttcaaaatcttgcgcaataaagctcatctccatctcccgattgaaacagtcactccccggactgtttcaacgtcccaggacataatctcaggaagacgcgaaaaatcatgctcaaagtga

SEQ ID NO: 1667 - DNA (genomic), 915 bp, Streptococcus pneumoniae; double-stranded, circular
  misc_feature (B) LOCATION 1...915
  hypothetical: NO
  anti-sense: NO
agaagagtaaggagagacatgtcaaatagtttaaaagggactttactaacagttgtggctggtattgcttggggggtgtcaggaacgagtggccaatacctaatggcacacggaatttcggctctggtcttgaccaacttgcgtcttttaatcgctggtggaattctcatgatcttggcttatgctactgcaaaggataaaatactggtctttttaaaggatagaaagagtttgctgtctcttcttatttttgctctgattggtctttttctcaaccaattcgcctatctgtctgctattcaggagaccaatgcgggaacagcgacggtgcttcagtatgtttgtcctgtcggaattttaatttatagctgtatcaaggatagggtggcaccgacactgggagagatagtttccatcatattcgccatcggaggaaccttcctgattgcaacacatgggcagttggaccagttatccatgacacctgctggcctgttctggggtctcttttctgccttgacttatgctctatatatcattttacccatagccttgattaaaaagtgggggagcagcttggtcattggtgtgggaatggttatagcaggtttggtcgcccttccttttacaggggttctacaggccaatatcccgactagtcttgattttctccttgcgtttgcaggtattatccttatcgggactgtctttgcctatacagctttccttaaaggagccagtctgataggaccggtcaagtcaagcttgttggcttcaattgagccaatatcggcggttttctttgccttcttaataatgaatgaacaattttatcccattgattttcttggtatggcaatgatattgtttgctgtaactttgatttctttgaaagatttattcttagaaaaataa

SEQ ID NO: 1668 - DNA (genomic), 519 bp, Streptococcus pneumoniae; double-stranded, circular
  misc_feature (B) LOCATION 1...519
  hypothetical: NO
  anti-sense: NO
tgggaggtaaggatggaattacgcagaccaagattagcggataagaaagctgttttagatatgatgacagagtttgaaaagagccaatcagcccatgatggaggattttgggatgttgaggatttttcttacgaggagtggctagaaggtaaccgtaataaagaaatgggaatatggctacctgaaaatcgcgttccatcgatacagttcgtattgtttggtgaatcaggttgtgctctaggatttttgaatctgcgattgagactgaatgaggggttactgaattatgctggccacattggctactccatccgtccatctgaaagaggcaagggttatgcaaaagagactctccgtcagggcttgcaagttgctaaggaaaagaacatcaagaaagctctggtgacctgtagcgtgaataatcttgctagcagagcagtcattctagcaaatggtggaatatttgaggatgctcgcaatggagtcgagcgttattggatagaggtagcgaatgaataa

SEQ ID NO: 1669 - DNA (genomic), 462 bp, Streptococcus pneumoniae; double-stranded, circular
  misc_feature (B) LOCATION 1...462
  hypothetical: NO
  anti-sense: NO
aaaaattcaagcctatcattcttagaaaggaaaactatggcaaacattctcttggctgtaacgggttcaatcgcctcttataagtcggcagatttagtcagttctctaaaaaaacaaggccatcaagtcactgtcttaatgactcaggctgctacagagtttatccaacctttgacactacaggtactctcacagaatcctgtccacttggatgtcatgaaagaaccctatcctgatcaggtcaatcatatcgaacttggaaaaaaagcagatttatttatcgtggtacctgcaactgctaacactattgcaaaactagctcacggatttgcggacaacatggtaaccagtacagctctagccctaccaagtcatattcccaaactaatagctcctgctatgaatacaaaaatgtatgaccatccagtaactcagaataatctgaaaacattagaaacctac

SEQ ID NO: 1670 - DNA (genomic), 582 bp, Streptococcus pneumoniae; double-stranded, circular
  misc_feature (B) LOCATION 1...582
  hypothetical: NO
  anti-sense: NO
agctgttcaagaaaaaaccggattgatttgattatcacagatgtcatgatgcctcggatgggatggtatgatctaatcagtgaggttcaatacttatcaccagagcagcctttcctatttattactgctaagaccagtgaacaggacaagatttacggcctgagcttgggagcagatgattttattgctaagccttttagcccacgtgagctagttttgcgtgtccacaatattttgcgccgccttcatcgtgggggcgaaacagagctgatttcccttggcaatctaaaaatgaatcatagtagtcatgaagttcaaataggagaagaaatgctggatttaactgttaaatcatttgaattgctgtggattttagctagcaatccagagcgagttttctccaagacagacctctatgaaaagatctggaaagaagactacgtggatgacaccaataccttgaatgtgcatatccatgctcttcgacaggagctggcaaaatatagtagtgaccaaacgcccactattaagacagtttgggggttgggatataagatagagaaaccgagaggacaaacatga

SEQ ID NO: 1671 - DNA (genomic), 552 bp, Streptococcus pneumoniae; double-stranded, circular
  misc_feature (B) LOCATION 1...552
  hypothetical: NO
  anti-sense: NO
cccgtctcaagcacgcgtcaactctggctcatgctgattatccttcctacctggatcaatttgctccttaaagcctatgcttttatcgggatttttggtcaaaatggctctattaaccaattcttggaatttatcggaattggttcacaacagttgctttttaccgatttttcctttatctttgtcgcaagctacatcgagctcccctttatgattttgccgattttcaatgtcttagacgacatggataataatctcatcaatgctagttatgaccttggtgcaactaagtgggagaccttccgtcatgtcatcttccctctatctatgaacggtgtgcgaagtggggttcagtcggtctttatcccaagtttgagtctcttcatgctgacccgtttgattggtgggaaccgcgttatcaccttggggacggctattgagcagaattttctaaccaatgacaactatggtatgggttcaactatcggtgtgattctcatcctgaccatgttcatcaccatgtgggtgactaaggaaaggagagaacgatga

SEQ ID NO: 1672 - DNA (genomic), 285 bp, Streptococcus pneumoniae; double-stranded, circular
  misc_feature (B) LOCATION 1...285
  hypothetical: NO
  anti-sense: NO
acttcatcaagactcaggcagatgcagactacgatgagagttttgatccaggtgaggtttctgaaaatgaaggagaattttcggatggagatgctggtggtgatccgctttttgaagaagctaagtctttggttatcgaaatacagaaagcagttggaatccatgattcagcgtcgtttgtcagttggatttaaccgtgcgacccgtctcatggaagagcttgagatggcaggtgtcattggtccagctgaaggtaccaagccaagaaaagtattgcagcaataa

SEQ ID NO: 1673 - DNA (genomic), 510 bp, Streptococcus pneumoniae; double-stranded, circular
  misc_feature (B) LOCATION 1...510
  hypothetical: NO
  anti-sense: NO
acaaaatcaagaattttctgtctattttttgaatatttatggagaatgagactgatgaaaatatggtataatgaaataaaggagttttatatgcaaaaatttattcaggcttatattgaaaagctagatgtgacaaccattatcgagaatattctaaccaaggtcatttctcttttactgcttttgattgtattttatattgctaaaaaaatgcttcataccatggtgcagagaattgtcaaaccttctctaaaaatgtctcgtcatgatgtcggacgccaaaaaaccatctcacgtttactagaaaatgtgtttaattatacgctatatttctttttactctactgcattttgtcgattttaggtttgccagtttctagtttgctggctggagctggtattgctggggtancgattggtatgggaaccaaggctttctgtctgatgtcatcaatggctttttcatcctctttgaacgtcaactggatgtgggagatgaggtcgttctga

SEQ ID NO: 1674 - DNA (genomic), 327 bp, Streptococcus pneumoniae; double-stranded, circular
  misc_feature (B) LOCATION 1...327
  hypothetical: NO
  anti-sense: NO
gaaaaatcaaggagaaacctaatgtttgtaaaaaaaggcgacaaagttcgcgtaatcgctggtaaagataagggaacagaagctgttgtccttactgcccttccaaaagtaaacaaagttatcgttgaaggtgttaacattgttaagaaacaccaacgtccaactaacgagcttcctcaaggtggtatcatcgagaaagaagcagctatccacgtatcaaacgttcaagttttggacaaaaatggtgtagctggtcgtgttggttacaaatttgtagacggtaaaaaagttcgctacaacaaaaaatcaggcgaagtgcttgattaa

SEQ ID NO: 1675 - DNA (genomic), 909 bp, Streptococcus pneumoniae; double-stranded, circular
  misc_feature (B) LOCATION 1...909
  hypothetical: NO
  anti-sense: NO
cggaatgggcttggccaaatgaaacaagatcaactaaaggcttggcaaccagctcagtttgaccgttttgtccgtatcttagaacaagaccagctcaatcacgcctatctcttttcaggtttctttggaagcttggaaatggcgcaatttttagctaagagcctcttttgtacggataaagttggcgtcttaccatgtgagaaatgccgaagttgcaagctgattgaacaggaagagtttccagatgtcaccttgattaagccagtcaatcaggtcatcaagacagaacgcattcgggaattggtgggacagttttctcaagcagggattgaaagccagcaacaggtctttattatcgagcaagcggataaaatgcatcccaacgcagccaattctctgctcaaggtcatcgaagaaccccagagtgaagtttatattttcttcttgactagcgatgaggaaaagatgttaccgacaatccgaagtcggactcagatcttccactttaaaaagcaagaagaaaaacttatcttactcttagaacaaatgggacttgttaagaaaaaagcgactcttttagctaagtttagtcaatcgcgagctgaagcagaaaagttggctaatcaggcaagtttttggaccttggtcgatgaaagtgaacgcctgctgacttggttagtagctaagaaaaaagaaagttatctacaggttgccaaattagccaacttggcagatgataaggaaaaacaggatcaggttttacggattcttgaagttctctgtgggcaggacctcttgcaggtaagagtaagagtgattctacaagatttactagaagctagaaaaatgtggcaagctaatgtcagctttcaaaatgccatggaatatctggtcttgaaagaaatataa

SEQ ID NO: 1676 - DNA (genomic), 186 bp, Streptococcus pneumoniae; double-stranded, circular
  misc_feature (B) LOCATION 1...186
  hypothetical: NO
  anti-sense: NO
atgcctccaagaaagagaataacagccatcagagaggtccaaccagatgtcggattgcccaaaatgagggtccgaaccacaacaaaaaaggtcatcagcagagaaagaaaacaagataggagaccagctacaaaggctatagtcaaagggaaatctgaaaaattaacaatcccttcaatggagtaa

SEQ ID NO: 1677 - DNA (genomic), 477 bp, Streptococcus pneumoniae; double-stranded, circular
  misc_feature (B) LOCATION 1...477
  hypothetical: NO
  anti-sense: NO
aaaaagccaagacactctctgcctcagctaatagttctcgcaaagactattatatcacaaaggagacagagagtgaacaaggctaaagagctcttgaaagagttgcaggatctggacatggacatccaaagccgtatagacgaaattaacgagcttgaggcaggtttgctctcaagccctaaatggtccgaggttaaagtccaaggtggacagactagaaaagttgatgatgtctatactcagttggtagtgatgaaagaggctatagagcaggatactaaagaggtcattaacagaaaacttgaattaggtagaatgatcaataggcttaaaaatccaaagtacagggcagtattaagaatgacttacatcaacaaaggcaccgctgatagcgtttgttatgatttgaatatgagtcgtacaacctactacaggttaaaaaatgaggcggtcttagctttggaagaagttatctaa

SEQ ID NO: 1678 - DNA (genomic), 1179 bp, Streptococcus pneumoniae; double-stranded, circular
  misc_feature (B) LOCATION 1...1179
  hypothetical: NO
  anti-sense: NO
aggtcaacaagaagtctaaatttcgaattgtgccatcttgtactatttataatgaatgcggaggctgcgcaaatcatgcacctgcattatgataagcagctggagttcaagacggacttacttcatcaagcgctgaaaaaatttgctcctgcaggatatgaaaattatgaaattcgtccaactattggaatgcaggaaccaaaatattacagagctaagttacaatttcagactcgaaaatttaaaaatcaggtcaaggcgggcttatatgcacaaaactctcactatttagtagagttgaaagactgcctggtacaagataaggaaacccaagtgattgctaatcgcttagcagaattacttacttatcaccagattccaatcacggatgagagaaaagttctaggtgtccgtactattatggtccgacgcgcgagaaagaccggacaggttcagattattattgttacaaaccgccagcttaatttaactcaattggtaaaagagttggttaaagatttcccagaagttgtgacagtagctgttaatacaaatacagctaaaaccagtgagatatatggtgaaaagacagagattatctgggggcaagagagtattcaagaaggtgtactcaattatgaattttcactatcccctcgagctttttatcaactaaatcctgagcaaacagaagtcctctatagcgaagcagtaaaagcgctggatgttgataaagaagaccatttgattgacgcttattgtggagttggaacgattggatttgcctttgcaaagaaagtaaaaacactcagaggtatggatattattccagaagctattgaagatgccaagcgaaatgctaaaagaatgggatttgacaatactcattatgaagctggaacggcagaagagattattcctcgttggtacaaggaaggctaccgagcagatgctttgattgttgacccaccacgtacaggtctggatgataagttattagatactattcttacttatgtaccagaaaaaatggtttatatttcttgtaatgtttcgaccttggctcgtgatttggtacgcttagtagaagtctatgatcttcattatatccagtcggtcgatatgttcccacatacagctcgaactgaagctgttgtaaaattaataaaaaaagtttaa

SEQ ID NO: 1679 - DNA (genomic), 966 bp, Streptococcus pneumoniae; double-stranded, circular
  misc_feature (B) LOCATION 1...966
  hypothetical: NO
  anti-sense: NO
ttacagacaagaaaatttccaacatccaagaaatcttgccacttttggaaagcattctccaagagcattgttccatttgggattatgccggatgatgtggatggtgaggctcttccaactcttgttttgaacaatattcgtggaaccttcaacgtagtagcagtcaaggcacctggttttggtgaccgtcgcaaagccatgcttgaagatatcgccatcttaacaggcggaacagttatcacagaagaccttggtcttgagttgaaagatgcgacaattgaagctcttggtcaagcagcgagagtgaccgtggacaaagatagcacggttattgtagaaggtgcaggaaatcctgaagcgatttctcaccgtgttgcggttatcaagtctcaaatcgaaactacaacttctgaatttgaccgtgaaaaattgcaagaacgcttggccaaattgtcaggtggtgtagcggttattaaggtcggagccgcaactgaaactgagttgaaagaaatgaaactccgcattgaagatgccctcaacgctactcgtgcagctgttgaagaaggtattgttgcaggtggtggaacagctcttgccaatgtgattccagctgttgctaccttggaattgacaggagatgaagcaacaggacgtaatattgttctccgtgctttggaagaacccgttcgtcaaattgctcacaatgcaggatttgaaggatctatcgttatcgatcgtttgaaaaatgctgagcttggtataggattcaacgcagcaactggcgagtgggttaacatgattgatcaaggtatcattgatccagttaaagtgagtcgttcagccctacaaaatgcagcatctgtagccagcttgattttgacaacagaagcagtcgtagccaataaaccagaaccagtagccccagctccagcaatggatccaagtatgatgggcgggatgatgtaa

SEQ ID NO: 1680 - DNA (genomic), 414 bp, Streptococcus pneumoniae; double-stranded, circular
  misc_feature (B) LOCATION 1...414
  hypothetical: NO
  anti-sense: NO
aaatttgcaaggtctaatattacaggcattttcgaagaaagagctgaaaaaattgcttcagatattgacagagctgaagaagcccgtcaaaaagcagaagtattggctcaaaaacgcgaagatgaattggctggtagccgtaaagaagctaagacaatcattgaaaatgcaaaggaaacagctgagcaaagtaaggctaatatcttagcagatgctaaactagaagcaggacacttaaaagaaaaagccaatcaagaaattgctcaaaataaagtagaagctttacagagtgttaagggtgaggtcgcagatttgaccatcagcttagctggtaaaatcatctcacaaaaccttgacagtcatgcccataaagcactcattgatcagtatatcgatcagctaggagaagcttaa

SEQ ID NO: 1681 - DNA (genomic), 822 bp, Streptococcus pneumoniae; double-stranded, circular
  misc_feature (B) LOCATION 1...822
  hypothetical: NO
  anti-sense: NO
cttatcgcaaggaatattgattccctaaacgctgccctaactagtgactcagctcgtgccaaattgtcccaagaagtcctacaaaccttggtcgctgaaaatgctgatatcattgctatccaagaaaccaagctttctgccaaaggacctacaaagaaacacgtggaaattttagaagaactcttcccaggctacgaaaacacatggcgctcttcccaagagcctgcccgtaaaggctatgctggaaccatgttcctttataagaaagaacttacgcctacgatcagttttccagaaatcggtgccccttctaccatggacttggaaggccgtatcatcactctagaatttgatgcatttttcgtaacccaagtttacactccaaacgctggtgacggtctcaaacgcttggaaaaacgccaagtctgggatgttaaatatgctgagtatttggctgaactagacaaagaaaaaccagtccttgcgaccggtgactacaacgtagcccacaatgaaatcgaccttgcaaatcctgctagcaaccgccgttcacctggatttactgacgaggaacgtgctggatttaccaaccttttggcaactggatttacagacaccttccgccatgttcatggcgatgttcctgaacgctacacttggtgggcacaacgcagcaaaacttctaaaatcaacaatacaggctggagaatcgactactggctcacaagtaaccgtatcgctgacaaggtcactaaatctgatatgattgactcaggtgctcgccaagaccatacaccgattgtcttggaaattgacttgtaa

SEQ ID NO: 1682 - DNA (genomic), 294 bp, Streptococcus pneumoniae; double-stranded, circular
  misc_feature (B) LOCATION 1...294
  hypothetical: NO
  anti-sense: NO
gcaaccgcaagtagtcatagattaaggagaaaacttatgccaatcacagctgcagatattcgtcgtgaagtcaaggaaaaaaatgttacctttattcgtcttatgttctcagatattttgggaaccatgaaaaacgtcgaaattcctgctacagatgaacagttagataaggtcttgtcgaacaaggttatgtttgatggatcttctattgaaggttttgtacgtatcaatgagtcggatatgtacttgtacccggacttggatacatggacagtcttcccttggggaagatga

SEQ ID NO: 1683 - DNA (genomic), 249 bp, Streptococcus pneumoniae; double-stranded, circular
  misc_feature (B) LOCATION 1...249
  hypothetical: NO
  anti-sense: NO
aatcaagcaagaccagtttgggacagagttgatttagggaggcttatgagaaaatcattttacacttggctcatgaccgagcgcaatcctaaaagtaacagtcccaaagcaattttggcagacctcgcttttgaagagtcagcctttccaaaacatacagatgattttgatgaggtcagtcgctttttggaggagcatgccagtttctcttttaacctaggagattttgacagctcttggcaggagtct

SEQ ID NO: 1684 - DNA (genomic), 858 bp, Streptococcus pneumoniae; double-stranded, circular
  misc_feature (B) LOCATION 1...858
  hypothetical: NO
  anti-sense: NO
aattatcaaagatttaccaggaaggaaatgggagtgaaaaagaaactaaagttgactagtttgctaggactgtctctgttaatcatgacagcctgtgcgactaatggggtaactagcgatattacagccgaatcggctgatttttggagtaaattggtttacttctttgcggaaatcattcgctttttatcgtttgatattagtatcggagtggggattattctctttacggtcttgattcgtacagtcctcttgccagtctttcaggtgcaaatggtggcttctaggaaaatgcaggaagctcagccacgcattaaggcgcttcgagaacaatatccaggtcgagatatggaaagcagaaccaaactagagcaggaaatgcgtaaagtatttaaagaaatgggtgtcagacagtcagactctctttggccgattttgattcagatgccggttattttggccctgttccaagccctatcaagagttgactttttaaagacaggtcatttcttatggattaaccttggtagtgtggatacaacccttgttcttccgattttagcagcagtattcacctttttaagtacttggttgtccaacaaagctttgtctgagcgaaatggcgctacgactgcgatgatgtatgggattccagtcttgatttttatctttgcagtttatgcgccaggtggagtcgccctatactggacagtgtctaatgcttatcaagtcttgcaaacctatttcttgaataatccattcaagattatcgcagagcgcgaggccgtagtacaggcacaaaaagatttggaaaatagaaaaagaaaagccaagaaaaaggctcagaaaacgaaataa

SEQ ID NO: 1685 - DNA (genomic), 258 bp, Streptococcus pneumoniae; double-stranded, circular
  misc_feature (B) LOCATION 1...258
  hypothetical: NO
  anti-sense: NO
acttgtcaaagttgcaacaagacaaaaattaaaaataaaaaaggagtatttgtcatgaatacaaaaatgatggaacaattttctgttatggataatgaaatgcttgataggatagagggaggaatatttggagttgacgatgctttgttttgggcagggttaggctatgttgcaggtagcattgttgatacagcaattgatgattttacgaatcaatgccggaaaaatcctcatcagtggttctgtgttcgtgtatag

SEQ ID NO: 1686 - DNA (genomic), 207 bp, Streptococcus pneumoniae; double-stranded, circular
  misc_feature (B) LOCATION 1...207
  hypothetical: NO
  anti-sense: NO
tggggccaaaggttcagctcatcgatagtggggcagagtgcgtacgggatatctcagttcttactcaattattttgaaatcaatcgtggtcgcgatgctggaccactccatcaccgtttttacacaacagccagtagccaaattttgccccaattggtgaagaatggctgggaaaaagagattcatgtggagcatgtagaattatga

SEQ ID NO: 1687 - DNA (genomic), 1158 bp, Streptococcus pneumoniae; double-stranded, circular
  misc_feature (B) LOCATION 1...1158
  hypothetical: NO
  anti-sense: NO
ggattcaaaagtgaagaaaacatgagtaaagaaatgctagaggccttccgcattttggaagaagacaagggaatcaaaaaagaagatatcatcgacgcagtagtagagtcgcttcgttccgcttatcgcagacgctatggtcagtcagacagcgtagctattgacttcaacgaaaaaacaggtgactttacagtttatactgtccgtgaagttgttgatgaagtatttgatagccgtttggaaatcagcttgaaagatgctcttgccattaattcagcttatgaacttggagacaaaatcaagtttgaagaagcaccagctgagtttggtcgtgtagcagcccaatctgccaaacaaaccatcatggaaaaaatgcgcaagcaaacacgtgccatcacttacaatacttacaaagaacatgagcaagaaatcatgtctggtacagtagaacgctttgacaaccgctttatctatgtcaaccttggtagcatcgaagcccaattgtcaaaacaagaccaaattcctggagaagtttttgcttctcatgatcgtatcgaagtttatgtttacaaggttgaagacaaccctcgtggtgtgaacgtctttgttagccgtagccatccagaaatgatcaaacgtttgatggagcaagaaattccagaagtttatgatggaactgttgaaatcatgagcgtggctcgtgaagcaggtgaccgtacgaaggttgctgttcgtagccacaatccaaacgtggatgctatcggtacaatcgttggacgtggtggtgctaatatcaagaagattactagcaaattccacccagctcgttacgatgctaaaaatgaccgcatggtaccaatcgaagaaaatatcgatgttatcgagtgggtagcagatccagctgaatttatctacaatgccatcgctcctgctgaggttgaccaagttatctttgatgaaaacgacagcaaacgtgccttggtggttgttccagataacaagctttctcttgccattggtcgtcgtggacaaaacgtgcgcttggcggctcacttgactggttaccgtatcgatatcaagtctgctagcgaatttgaagccatggaagacgctgcttcagtagagttggaagtagaaaacgatactgtagaagaataa

SEQ ID NO: 1688 - DNA (genomic), 216 bp, Streptococcus pneumoniae; double-stranded, circular
  misc_feature (B) LOCATION 1...216
  hypothetical: NO
  anti-sense: NO
cgaacaaaaagtgatgtaatttctgaaattaacacaggattacctttgaaaaaatggactttttcaagggctttttgccgtgctctaaaatcatcgccaaatcatcaaattgaaataagaaatagtttagataaaactattgacttttcttatagtttgtctttcttctatcttccattatatcatactttttcagtctatggtagctctctttaa

SEQ ID NO: 1689 - DNA (genomic), 291 bp, Streptococcus pneumoniae; double-stranded, circular
  misc_feature (B) LOCATION 1...291
  hypothetical: NO
  anti-sense: NO
cgaacaaaaagtgatgtaatttctgaaattaacacaggattacctttgaaaaaatggactttttcaagggctttttgccgtgctctaaaatcatcgccaaatcatcaaattgaaataagaaataatttagataaaactattgacttttcttatagtttgtctttcatttctgtgtttcatagatttcacggtaaacggcattgttggcaaccaagtctgcatgcgtgccttgaccaatcaatcgtccttgatttagaaccaagatcttgtctgcatggacaaccgagctaa

SEQ ID NO: 1690 - DNA (genomic), 579 bp, Streptococcus pneumoniae; double-stranded, circular
  misc_feature (B) LOCATION 1...579
  hypothetical: NO
  anti-sense: NO
tggcaaaaaagaaagaatttattgaaagttcaagaaaaattgaaattattaaaagagtttataaaaatatgttctaaaaataaaatgaagtattttgcttctggaggtagtctattggaagctgcaagatacaaaggttttattccttggaatgatgatatggctctaggtttaccaagaaagcattttgaaaagtttataaatgaaatagattttgaaaaatataataaaaattatattttagaaagttcggaaatgaatttaggtatttttcaatataaattaaaatctgctattttaattttagggaaatcgtatgacgtatgtttgaatttatttctgttagacaggatgtcagaattggttattgatggtgagtcaggttttaaagtcccactatataatttagaagtggctgtagatagaagtagaagtattattgagaatagagaactagccaatgagttaggtagtgttgctttccaaagagttcaatctatatttgaaataaaagaaaaagtgtcagagctagagaatatattcatgagtttaggagaagatgataatgtcaatatataa

SEQ ID NO: 1691 - DNA (genomic), 951 bp, Streptococcus pneumoniae; double-stranded, circular
  misc_feature (B) LOCATION 1...951
  hypothetical: NO
  anti-sense: NO
ttgaaaaaaaggagtttgtttatggcacaaaaaattatgagcctacaaaataggaagaatcaaaaaagacgatttatctttttatttcttttgccaacgttgatttgtttctttctattttatttttattctgtagtaacaatctttttaacttcatttgctaaatgggattatacaaatttaaacacccctgagtttcttggatttgataaattatttgaaaattataggtatgtttttaaagaatacccattttttacagaagctctaattaattctgttcgttgggctgtaattggtgttattattcaagttcctttagctgtatctgttgcaattacattatctaagaaattaaaaggctggaagatatctaggaatctttatattgtaccaagtatcatttctagtgctgctatgggcttgatttttcttcaaatctataatccaaactatggtgttgttaaccaaattattcatctatttaatccatcgtttaaagattcagtactgttgactccaggattaaatatagtagctatgactggcgcttatatcttctttgcaggagcatcaaccattatgattcttgggcaaatttttgctattccagaagaagttcaagaagctgctattttagacaatattactggttggaggaaagagtggtatattacgattccgatgattaaggggacaattaaaactgtttcaattatggcagcaacttcagggtttttgctctataacgaagtattctttttgacaaatggtgctgcaggaacaaaaagtatcagttttgttattcgagaattagcagtggctagctcacgaactcagtatgctcgtgcaaatacaattggagttatacaaattttaggtggaatgttgattatcgtttgtattaatattttattcagagaaagaaaaagactgaaaggtgggaaatga

SEQ ID NO: 1692 - DNA (genomic), 828 bp, Streptococcus pneumoniae; double-stranded, circular
  misc_feature (B) LOCATION 1...828
  hypothetical: NO
  anti-sense: NO
gaggaaaaaaggatgaaagtgattaatcaaaccttattagaaaaagttattattgaacgttctcgttcaagtcataaaggagattatggtcgtctgctgctgcttggtggtacttatccttatggtggtgctatcatcgtggctgctttggcagctgtgaaaagtggggcaggattggtgactgttggaacggatagggaaaatatccctgctctgcacagtcatttacctgaggctatggcctttgctcttcaagacaagcaattgttaaaagagcagttggagaaggcagaagttgttttgctgggacctggtttaggagacgatgcttctggagaagatttagttaaacaggtctttgctggcttaaaacagaatcagattttgattgtagacggaggtgccttgactattcttgctaggacaagtctgtcatttccttctagccagcttatcctaactccccaccaaaaggagtgggaaaaactgtctggaattacgattgaaaagcaaaaggaagatacaacggttagtgccctgacttctttccctaaaggaacaattttggtggagaaaggtccggctactcgtgtttggcaagctggccagtctgattattaccagttacaggttggcggtccctatcaggcaactgggggaatgggagatactctggctgggatgatcgcaggatttgtaggccaattccgacaggccagtctctacgagcgtgtagcagtagcgacccatcttcattcagccatagcccaagaactatctcaagaaaattatgtggtcttaccgacggaatcagcagtgcttctcaca

SEQ ID NO: 1693 - DNA (genomic), 258 bp, Streptococcus pneumoniae; double-stranded, circular
  misc_feature (B) LOCATION 1...258
  hypothetical: NO
  anti-sense: NO
aatagaaaaagtgaagagaggtatgaaatgagcaagaaagataaaaaaatcgaaattcaagtagcggatgccaaagttaatgttggtaaagacagttttgaaggttatacattgactatcggtaaaaaagttatcggagaaattgccgaattagacggacaatttgccattataaagaatgggaatgtcgatagtttttataaaaaattggaaaaagctgtggaaattttgattgaaaattataatttagcaaaataa

SEQ ID NO: 1694 - DNA (genomic), 1380 bp, Streptococcus pneumoniae; double-stranded, circular
  misc_feature (B) LOCATION 1...1380
  hypothetical: NO
  anti-sense: NO
aataagaaaagaacgatcctaaagtcaggaatttttaaggaatttctggctttttatgataaaataggtaaaagtattgcaagtatgaggtccagtatgaaactaaaaacaaacattcgccatttacatggtagtatccgcgtcccaggtgacaagtctatcagccaccgttccattatctttggaagtttggctgagggtgagaccaaggtttatgatattctgcgaggcgaagacgttctttcgaccatgcaggtttttcgtgaccttggtgttgaaattgaggataaagatggggttattaccattcaaggtgtaggcatggctggcttaaaagcgccgcaaaatgcccttaatatgggaaattctggcacctcgattcgcctgatttcaggtgtccttgctggtgcagatttcgaagtagagatgtttggagatgatagtctttccaaacgtcctatggaccgtgtgacccttccactgaaaaaaatgggcgtcagcatttcagggcaaactgaacgagacttgcctccccttcgcttaaaagggacgaaaaacctaagacctattcattatgagttgccaattgcctctgcccaagtcaagtcagccttgatgtttgcagccttacaagctaagggggagtcagttattatcgaaaaagagtgcactcgtaatcatactgaagatatgttgaaacaatttggtggtcatttaagtgtggacggtaagaaaatcatagtccaagggccacaaaaattgacaggacagaaggtggtcgtaccaggagatatttccagtgcagccttttggttagtcgcaggtttgattgttccaaattctcgtctagtgctgcagaatgtggggatcaacgaaactcgcaccggtattattgatgtcattcgtgccatgggtggaaaattggaaataactgaaatcgatccagtcgctaaatctgcaaccttgattgttgagtcttctgacttgaaaggaacagagatttgtggcgctttgattccacgtttgattgatgaattgcctattattgccctacttgcgacccaagcccaaggtgtaacagttatcaaggatgctgaggagctcaaggtcaaggaaacagaccgtattcaggttgtggcagacgccttaaatagtatgggagcagatattactcctacggcagatgggatgattatcaaaggaaaatcagctcttcacggtgctagagtcaatacgtttggtgaccaccgtatcggcatgatgacagctatcgcagccctcttggttgcagatggagaggtggagcttgaccgtgcagaagccatcaataccagctatcctagtttctttgatgatttggagagcttgattcatggctaa

SEQ ID NO: 1695 - DNA (genomic), 351 bp, Streptococcus pneumoniae; double-stranded, circular
  misc_feature (B) LOCATION 1...351
  hypothetical: NO
  anti-sense: NO
gggaatgaaagtgtgaaaaattacggagaagcttttcgatattttagaaaattaaacggatattctttagagtatgctgcagctgattttatatcaaaatctcaactttctagatttgaaaggggagaaaatgaaatttctctttcaacattttttgaattattatcaaatatcaatgtttcgatagagaatttttgtaatcacttagaatattataaaagatcggagcgtgatgattttttggttaatttatctccaaatttttatagtttgaatattaaaggattggaggtaataaaaaataagcaacaaaaactttttgagaagagtgggaaaaaactcataaaataa

SEQ ID NO: 1696 - DNA (genomic), 276 bp, Streptococcus pneumoniae; double-stranded, circular
  misc_feature (B) LOCATION 1...276
  hypothetical: NO
  anti-sense: NO
gcttgtgaaagcttggctgacagtggttatcaagggctcatgaagatatatcttcaagcacaaactccacgtaaatccagcaaactcaagccgctaacagctgaagataaagcctataaccatgcgctatctaaggggagaagcaaggttgagaatatttttgccaaagtaaaaacgtttaaaatgttttcaacaacctatcgaaatcatcgtaaacgcttcggattacgaatgaatttgattgctgatattatcaatcatgaactaggattctag

SEQ ID NO: 1697 - DNA (genomic), 1290 bp, Streptococcus pneumoniae; double-stranded, circular
  misc_feature (B) LOCATION 1...1290
  hypothetical: NO
  anti-sense: NO
aagtgtgaaagaatgagagcagttgatttaatacaaaaaaaacgagacggtcaagaactgacttcaagtgaaattgaatggctggtagaaggctatgtgtcaggaactgttcctgattatcagatgtctgcctttgctatggctgtttattttaaaggaatgacgactcgagaaatctctgatttaacgatgaatatggttaagactgggcaagagtttgacctgtcagccattgatggtgtgaaagttgacaagcattctactggtggtgtcggcgataaggtaaccttgattttagctcctcttgttgctagcttcggtgtgcctgtagcaaaaatgagtggtcgtggtcttggccatacaggcggaacaattgataaattggagtccattaagggctatcaagtagaacgtagtcaagaggattttattcgtcaggttcaggatattggagtatctgtcattgggcaatcagaccagctggtcaaagcagataagcttctctatgcccttcgtgatgtgaccgcaactgtcgacacgattcctttgattgcgagttcggtgatgagcaagaaaattgcggcaggggcggatgctattttgctagacgtgactgtcggtgagggtgccttcatgaagacggttgatgaggcgcgtgagttggctcaaactatggtagatcttggtaaggttgttggacggaagacagtagcagtgattacggatatgagccagcctttgggacgagcgattggaaatcgtctggaaatccttgaagcattggagattttgcaaggtcaaggacgtcaggatattacccactttatttgtgaattggctcaaattatgcttggtttggcaaatgttaacaagactgttgaagaagttcaccaacatcttgaaaatggtcaagcactggctaagtttgaggaaatggtgcaagcccaaggtggagacttggaagacctctatcgtcctgtaaatgtagctcatgtggtggaaatccctgctcaggaaacgggtgtcatttcagctcttccagctatggactttggtctttatgccatgaggctgggtgctggtcgtgcagttaagtctgatgtcttggactatgaaacaggaattgtttttgaaaagaagattggagactccgttcaaaagggtgaaattgttgcaaaagtatacacaaatgaaaaaattccacctcaactagttacagatttccaaaaatgtgttaaaataagtgatgaagtgaaaaaaatccgtgaaattgtagaaatcatctcctaa

SEQ ID NO: 1698 - DNA (genomic), 1257 bp, Streptococcus pneumoniae; double-stranded, circular
  misc_feature (B) LOCATION 1...1257
  hypothetical: NO
  anti-sense: NO
gagaccgaaagaatgaaatttgttggacttgttggatcaaactacgatcaatcatataaccgcaaactcttggaatttatccgtcgcaatttcaaattcaaatttgaattagaagtacttgaaatcgacgaagttccaatgtttaaccaagacgaaaaatgggacgaaagcttccaattgcgtttcttgtataacaagattacacgtgctgatggtgtcattatcgccactcctgagcacaaccacactatctcagcttcactcaaatctgtacttgaatggctttcatacgaagttcatccatttgaaaacaagcctgttatgattgtgggtgcatcatactatgaccaaggaacatcacgtgctcaagttcaccttcgtaaaatccttgatgctccaggtgttaatgcctacacgcttccaggtaacgaattccttcttggtaaagctaaggaagcttttgataacaacggaaatatcaccaacgaaggcactgttaaattccttgaaacttgcttagataactttgttaaatacgtaggagtcgtttcgaaattgaaaaaaccaaaaccaatcgaatcagaagacttggattgtggaaaaccaatcgctacaaccatcacagaagttgaccctgacgatccagaatgggtagaaaaagttgcagcaatcactggtgctgtttctggtgatacctatgtcaaattggaccacggtatcctaacagttaaccaaattgatatgttcttgaaagctatgccatttgaattgacatacgctgacgacaacaaccaattcctctactacaacaacgctcaccaagatccagacactatgttcgctaaacgtgtaccacctcaatcaggtagccgtatgtcgactgttcatggttctcttccaccagcacgtatgaagaacgtagagtgggttatcggaacacttcgcaacggaaaccaagaatacgtccgtacgatcgttccaggttctcctgcaggtgttatcaacactcacaactaccaagcaatgtactatcctgatggatcatacgctggtatcaatgaaatcgtctttaacttccaaccatggcttgactggtacctaaaagagactggtcaacgtttggtgggtggtagcggaccatttgctcctgctgccggaggtcatggagacgccgatgctacttctggcgcttctgattcaggggatgttggaggccacggtggtgacgcagacgctacagccggtgcaagttactaa

SEQ ID NO: 1699 - DNA (genomic), 1053 bp, Streptococcus pneumoniae; double-stranded, circular
  misc_feature (B) LOCATION 1...1053
  hypothetical: NO
  anti-sense: NO
aacttagaaagaatgaacaaatatatgaatacagctgattttgatttccacttgccagaggaattgattgcccaaacgccccttgaaaaacgtgatgcctccaaactcctcatcgtcaaccgtgagacaggagaaatgcaagataaacatttccactctattattgatatgctggaacctggtgatgcccttgtcatgaacgacacccgagttctccctgcccgcctctatggtcaaaaagtggagacaggaggtcatgtggaacttctcctccttaagaacactagtggagacgagtgggaagttctggctaaacctgccaaacgcctcaaggtcggtactcgtatcagctttggtgatggccgcctcagcgctgtcgttacagaagaattgacccacgggggacgcattgtccgctttgaataccaaggaattttcctagaagtcttggaaagtctgggagaaatgcctctgccaccttatatccacgaaaaattagatgaccgtgaacgttatcaaaccgtctacgccaaggaaagcggctctgctgcagcaccgactgctggtcttcacttcaccaaagaactgctggcagaaatccaagctaagggtgttcatctagtctatctgactctccatgtcggactcggaacctttagacctgtttctgtggataatctggacgaacacgaaatgcactcagagttctatcaactttctgaggaagctgctgccacccttcgctctgtcaaagaaaatggtggtcgtgtcatcgctgtcggaaccacttctatccgtaccttggaaactattggttccaagtttgatgggcaaatccaagcagattctggttggaccaatatctttatcaaacctgggtatgagtggaaggttgtggatgccttctcaaccaacttccatctgccaaaatcaactctggtcatgttggtttctgcctttgcaggccgtgaattagtcttagatgcctaccaccatgccatccaagaacactaccgcttcttcagttttggtgacgccatgtttatttattga

SEQ ID NO: 1700 - DNA (genomic), 411 bp, Streptococcus pneumoniae; double-stranded, circular
  misc_feature (B) LOCATION 1...411
  hypothetical: NO
  anti-sense: NO
tctctagaaagaggtcattctatgggaattgaagaacaacttggcgaaatcgttatcgccccacgtgtacttgaaaaaatcattgctatcgctactgcaaaggtagagggtgttcactctttttcaaacagatcagtgtctgataccctttcaaaactttcactcggccgtggcatttatcttaaaaacgtggacgaagaactcacagcagatatctatctctaccttgagtacggagtaaaagttcctaaggtagcggttgctatccagaaagctgtcaaagatgccgtccgtaatatggctgatgtagaactcgctgctatcaatattcacgttgcaggtatcgtcccagataaaacaccaaaaccagaattgaaagatctatttgacgaggacttcctcaatgactag

SEQ ID NO: 1701 - DNA (genomic), 411 bp, Streptococcus pneumoniae; double-stranded, circular
  misc_feature (B) LOCATION 1...411
  hypothetical: NO
  anti-sense: NO
tcgctagaaagatatctcttgtcccagtacaaagggattgaggttcaaaagattcatatcaaggatttggtcaaggaaggcaaaaatttctatgaaatggaccatccctatgtcgcttttttgccgacctatctcgaaggtgggaatggcgtggataacggagatgttgagattttgacgacaccggtgggagattttattgcctatggtaacaatgctagtaagtgttttggtgtggttgggtcaggaaatcgtaactttaataaccaatactgcctaacagccaagcaatacagtcaacgctttggcttccctgtattggctgactttgaaatgcgaggcatgctggaagatatcaaacatgtcgcagctattatcgcagatttgtatgagttggaaaaggagaattaa

SEQ ID NO: 1702 - DNA (genomic), 1041 bp, Streptococcus pneumoniae; double-stranded, circular
  misc_feature (B) LOCATION 1...1041
  hypothetical: NO
  anti-sense: NO
aaaatagaaagaggaaataataaaatgacaaattcagtattccaaggacgcagcttcttagcagaaaaagactttacccgtgcagagttagaataccttattggtctttcagctcacttgaaagatttgaaaaaacgcaatattcaacaccactaccttgctggcaagaatatcgctctcctatttgaaaaaacatctactcgtactcgtgcagcctttacaactgcggctatcgaccttggtgctcacccagaatacctcggagcaaatgatattcagttgggtaaaaaagaatctactgaagatactgctaaagtattgggacgtatgtttgacgggattgaattccgcggattcagccaacgtatggttgaagaattggcagaattctcaggcgttccagtatggaacggtctaactgacgaatggcacccaactcaaatgctcgctgactacttgactgttcaagaaaacttcggtcgcttggaaggcttgacattggtatactgtggtgatggacgtaacaacgttgccaacagcttgctcgtaacaggtgctatccttggtgtcaatgttcacatcttctcaccaaaagaactcttcccagaaaaagaaatcgttgaattggcagaaggatttgctaaagaaagtggcgcacatgttctcatcactgaagatgctgatgaagcagttaaagatgcagacgttctttacacagacgtttgggtatcaatgggtgaagaagacaaattcgcagaacgtgtagctcttcttaaaccttaccaagtcaatatggacttagttaaaaaagcaggcaatgaaaacttgatcttcctacactgcttgccagcattccacgatactcacactgtttatggtaaagacgttgctgaaaaatttggtgtagaagaaatggaagtaacagacgaagtcttccgcagcaagtacgctcgccacttcgatcaagcagaaaaccgtatgcacactatcaaagctgttatggctgcgacacttggtaacctttatattcctaaagtataa

SEQ ID NO: 1703 - DNA (genomic), 555 bp, Streptococcus pneumoniae; double-stranded, circular
  misc_feature (B) LOCATION 1...555
  hypothetical: NO
  anti-sense: NO
attgtagaaagttggttagttatgaagcttccaaaagaaggcgactttattacaattcaaagttataagcatgatgggagtctccaccgaacttggcgggacaccatggtactaaaaacaacagaaaacgccattattggtgtcaacgatcatacacttgttaccgaaagtgatggtcgtcgttgggtcactcgagaaccggctattgtttactttcacaagaaatattggtttaatatcattgccatgattcgtgataatggaacttcttactattgcaatatggctagcccctactatctggatgaagaagcactgaagtatattgattacgatttggatgttaaaatttttacagatggggaaaaacgtctcttggacgttgaagagtacgagcgtcacaaacgcaaaatgaattattctgatgacttggactatattttaaaagaacatgtcaaaattcttgttgattggattaacaatggacgtggtcctttctcagaagcctatgtaaacatttggtacaagcgctatgtagaactaaagaatcggtaa

SEQ ID NO: 1704 - DNA (genomic), 717 bp, Streptococcus pneumoniae; double-stranded, circular
  misc_feature (B) LOCATION 1...717
  hypothetical: NO
  anti-sense: NO
atggaagaaagtattaatccaatcatctctattggtcctgttatcttcaatctgactatgttagccatgactttgttgattgtgggagttatttttgtctttatttattgggcaagccgcaatatgaccttgaaacccaaaggaaagcaaaatgtacttgagtatgtctatgactttgttattggatttacagaacctaacattggttcgcgctacatgaaagattactcactctttttcctttgtttattccttttcatggtgattgccaataaccttggcttaatgacaaagcttcaaacgatcgatgggactaactggtggagttcgccaaccgctaatttaccgtatgacttaaccttatcttttcttgtcattttgttgacacatatagaaagcgttcgtcgtcgtggatttaaaaaaagtataaaatcttttatgagtcctgtttttgtcataccgatgaatatcttggaagaatttacaaacttcttatctttggctttgcggatttttgggaatatctttgcaggagaggtcatgacgagtttgttacttcttctttcccaccaagctatttattggtatccagtagcctttggagctaatttggcttggactgcattttctgtctttatttcctgcatccaagcttatgtttttactcttttgacatctgtgtatttagggaataagattaatattgaagaagaatag

SEQ ID NO: 1705 - DNA (genomic), 672 bp, Streptococcus pneumoniae; double-stranded, circular
  misc_feature (B) LOCATION 1...672
  hypothetical: NO
  anti-sense: NO
caaagagaaagaacttttggaagtctaaaaataaacagaaaaactcagttggcattgctggctgagttttattcgaaagaaggaaatatgaatacaaatcttgcaagttttatcgttggactgatcatcgatgaaaatgaccgtttttactttgtgcaaaaggatggtcaaacctatgctcttgctaaggaagagggccaacatacagtaggggatacggtcaaaggttttgcatacacggatatgaagcaaaaactccgcctgacaaccttagaagtgactgccactcaggaccaatttggttggggacgtgtcacagaggttcgtaaggacttgggtgtctttgtggatacaggccttcctgacaaggaaatcgttgtgtcactcgatattctccctgagctcaaggaactctgtcctaagaagggcgaccaatctacatccgtcttgaagtggataagaaagaccgtatttggggcctcttggcttatcaagaagacttccaacgtcttgctcgtcctgcttacaacaacatgcagaaccaaaactggccagccattgtttaccgtctcaagctgtcaggaacttttgtttacctaccagaaaataatatgcttggttttattcatcctagcgagcgttacgcagagccacgtttggggcaagtattag

SEQ ID NO: 1706 - DNA (genomic), 2493 bp, Streptococcus pneumoniae; double-stranded, circular
  misc_feature (B) LOCATION 1...2493
  hypothetical: NO
  anti-sense: NO
agtgaggaaagaatgaaaatcaataaaaaatatctagcaggttcagtggcagtccttgccctaagtgtttgttcctatgaacttggtcgtcaccaagctggtcaggttaagaaagagtctaatcgagtttcttatatagatggtgatcaggctggtcaaaaggcagaaaatttgacaccagatgaagtcagtaagagagaggggatcaacgccgaacaaattgttatcaagattacggatcaaggttatgtgacctctcatggagaccattatcattactataatggcaaggttccttatgatgccatcatcagtgaagaacttctcatgaaagatccgaattatcagttgaaggattcagacattgtcaatgaaatcaagggtggctatgtgattaaggtagacggaaaatactatgtttaccttaaagatgcggcccatgcggacaatattcggacaaaagaagagattaaacgtcagaagcaggaacacagtcataatcataactcaagagcagataatgctgttgctgcagccagagcccaaggacgttatacaacggatgatgggtatatcttcaatgcatctgatatcattgaggacacgggtgatgcttatatcgttcctcacggcgaccattaccattacattcctaagaatgagttatcagctagcgagttagctgctgcagaagcctattggaatgggaagcagggatctcgtccttcttcaagttctagttataatgcaaatccagttcaaccaagattgtcagagaaccacaatctgactgtcactccaacttatcatcaaaatcaaggggaaaacatttcaagccttttacgtgaattgtatgctaaacccttatcagaacgccatgtagaatctgatggccttattttcgacccagcgcaaatcacaagtcgaaccgccagaggtgtagctgtccctcatggtaaccattaccactttatcccttatgaacaaatgtctgaattggaaaaacgaattgctcgtattattccccttcgttatcgttcaaaccattgggtaccagattcaagaccagaacaaccaagtccacaatcgactccggaacctagtccaagtctgcaacctgcaccaaatcctcaaccagctccaagcaatccaattgatgagaaattggtcaaagaagctgttcgaaaagtaggcgatggttatgtctttgaggagaatggagtttctcgttatatcccagccaaggatctttcagcagaaacagcagcaggcattgatagcaaactggccaagcaggaaagtttatctcataagctaggagctaagaaaactgacctcccatctagtgatcgagaattttacaataaggcttatgacttactagcaagaattcaccaagatttacttgataataaaggtcgacaagttgattttgaggttttggataacctgttggaacgactcaaggatgtctcaagtgataaagtcaagttagtggatgatattcttgccttcttagctccgattcgtcatccagaacgtttaggaaaaccaaatgcgcaaattacctacactgatgatgagattcaagtagccaagttggcaggcaagtacacaacagaagacggttatatctttgatcctcgtgatataaccagtgatgagggggatgcctatgtaactccacatatgacccatagccactggattaaaaaagatagtttgtctgaagctgagagagcggcagcccaggcttatgctaaagagaaaggtttgacccctccttcgacagaccatcaggattcaggaaatactgaggcaaaaggagcagaagctatctacaaccgcgtgaaagcagctaagaaggtgccacttgatcgtatgccttacaatcttcaatatactgtagaagtcaaaaacggtagtttaatcatacctcattatgaccattaccataacatcaaatttgagtggtttgacgaaggcctttatgaggcacctaaggggtatactcttgaggatcttttggcgactgtcaagtactatgtcgaacatccaaacgaacgtccgcattcagataatggttttggtaacgctagcgaccatgttcaaagaaacaaaaatggtcaagctgataccaatcaaacggaaaaaccaagcgaggagaaacctcagacagaaaaacctgaggaagaaacccctcgagaagagaaaccacaaagcgagaaaccagagtctccaaaaccaacagaggaaccagaagaagaatcaccagaggaatcagaagaacctcaggtcgagactgaaaaggttgaagaaaaactgagagaggctgaagatttacttggaaaaatccaggatccaattatcaagtccaatgccaaagagactctcacaggattaaaaaataatttactatttggcacccaggacaacaatactattatggcagaagctgaaaaactattggctttattaaaggagagtaagtaa

SEQ ID NO: 1707 - DNA (genomic), 744 bp, Streptococcus pneumoniae; double-stranded, circular
  misc_feature (B) LOCATION 1...744
  hypothetical: NO
  anti-sense: NO
aatcttagaagatgggttcacactgttgtcttgactggggatattcctgccatgtggcttcgggattcgacagcccaactcagaccctaccttcatgtagctaaaagagatgccctcctgcgtcagaccattgcaggtttggtcaaacgtcagatgaccttggtactcaaggatccctatgctaactccttcaacattgaggagaactggaaagggcaccacgagactgatcacacagaccttaacggctggatctgggagcgcaagtatgaggtggattcactttgctatcctttgcagttggcttatctcctctggaaagagactggcgagactagtcagtttgatgagatttttgtcgtagcgactaaggaaattctccatctatggacagttgaacaagaccacaagaactctccttatcgttttgtccgagatacggaccgtaaggaagacaccttggtaaatgatggctttggacctgactttgcagtgacaggtatgacttggtcagcctttcgtccgagtgatgactgttgccagtatagttacttgattccgtcaaatatgtttgctgtagtagtcttgggttatgtgcaagaaatcttcgcagcattaaacctagctgatagccagagtgttattgctgatgccaagcgtcttcaggatgaaatcaagaaggaatcgaaaactacgcttacaccaccaacagcaagggcgaaaagatttacgcttttgaagtag

SEQ ID NO: 1708 - DNA (genomic), 855 bp, Streptococcus pneumoniae; double-stranded, circular
  misc_feature (B) LOCATION 1...855
  hypothetical: NO
  anti-sense: NO
attatcagaagaccaagttgtcggaacaccgttcgacccagcgaaacactggactgcctaggaacttgtcagcatctgatagaaggaaataagatggcaaaaaatgtagtgattacgggagcaacctcaggaatcggtgaagcgattgcgcgtgcttatctggagcagggtgaggatgtcgttctaacaggacgacggatagacagattagaaatcctcaagtcggagtttgcagtaagctttccaaatcaaaccgtctggacttttccactagatgtgacggatatggtcatggtgaagactgtttgctctgatattctagaaacgatagggaggattgatatcttggtcaacaacgccggactggctcttgacttggctccctatcaagactatgaggagttggatatgttgaccatgttggataccaatgttaaaggtctgatggcggttactcgctgtttcttgccagcaatgataaaagtcaatcaaggtcacgttatcaatatggggtcaaccgcaggaatctacgcctatgctggtgccgctgtttactcagctaccaaggcagcggttaagaccttttcggatggactgcgaattgataccatcgcaacggatatcaaggtgacaaccattcagcctgggattgtcgaaacagatttctcaactgttcgttttcatggtgataaagagcgggctgcgtccgtttaccaaggaatagaagccttgcaagctcaggatattgcagacacagtagtctatgtgaccagtcagcctcgccgtgttcagattacagatatgaccattatggccaatcaacaggcgacaggtttcatgattcataaaaaataa

SEQ ID NO: 1709 - DNA (genomic), 1230 bp, Streptococcus pneumoniae; double-stranded, circular
  misc_feature (B) LOCATION 1...1230
  hypothetical: NO
  anti-sense: NO
tataacagaagaataaaccatcaccatctccggacggactatgtatctggggatggtgatttttatctggaatctagtctttgtggtataataattactatgcagaaaaaaccaacgtcagcctatgtgcacatcccattttgtacccagatttgttattattgtgatttttcaaaggtcttcatcaaaaatcagccagtcgacagctatttagagcatctgctggaagagttccgttcttatgatattgaaaagttgtcaaccctttatatccgtggttggaacacgacagccctgtcggctccgcaactggacgtgttactgaatggcttgactattaacttggatttgtctgtcttggaagagttgaccattgaagccaatccaggcgatttggatgcggataagatagctgttttgaaaaattcggctgtcaatcgtgtttcgctaggtgtccagacctttgatgataagatgttgaaaaagattgggcgcagtcatttggagaaggatatttatgaaaatatcgatcgcctgaaactggctggttttgacaacatctccattgatttgatttatgctctgcctggtcagaccatggagcaagtaaaggaaaatgtggctaaagccattggattggatattccccacatgagtttgtatagtttgattttagaaaaccatacggtctttatgaaccggatgcgacgtgggaaattgcctctgcctaaggaggaactagaagcggagatgtttgagtacatcattgcagagctggagcgagcgggttttgagcattatgagatttctaatttctccaaacccggctttgaaagtcgtcataatctcatgtactgggacaatgctgaatactatggtattggtgcaggggcatctggttatgtcaatggagtacgctataaaaatcatggtcccattcgtcattatctcagtgcggttgaggaaggcaatgcttgtattacagaagatcacctgagtcaaaaggagcaaatggaagaagaaatgttcttgggactccgcaagaaatccggggtttccatggcgcgatttgaggaaaaatttggacagtcttttgctggactttatggagaaattgtcagagatttggttcaacaaggcctcatgcagattgagggtgaccacgttcgcatgacaaagagaggtctctttttgggagatactgtagcagaacgatttattttggagtag

SEQ ID NO: 1710 - DNA (genomic), 507 bp, Streptococcus pneumoniae; double-stranded, circular
  misc_feature (B) LOCATION 1...507
  hypothetical: NO
  anti-sense: NO
acaggcagaaggcttaatatcccgctcaagtctattgaccaagtagactttgtcgatgtgacggttgatggcgcggatgaagtggatagtcagtttaatggaatcaaaggcggtggtggtgcccttctcatggaaaaggtggtcgcaacaccatcaaaagaatacatttgggtggtggatgaaagcaagctggtcgaaaaactaggtgcttttaaattgccagtagaagtggttcagtatggtgcagagcaagtctttcgtcattttgaacgagctggctacaaaccaagtttccgtgaaaaagacggccaacgttttgtgacggatatgcagaattttatcattgacctcgccttggatgttattgaaaatccaattgcttttggacaagaattggaccatgtcgttggtgttgtggagcatggtttattcaaccaaatggtggataaggtaatcgttgctggacgagatggagttcagatttcaacttcaaaaaaaggaaaatag

SEQ ID NO: 1711 - DNA (genomic), 645 bp, Streptococcus pneumoniae; double-stranded, circular
  misc_feature (B) LOCATION 1...645
  hypothetical: NO
  anti-sense: NO
ggacaaagaagaccgagttatcacaaggaaaacaacatacaccttggtagcaactcctgcaaatgcgtaccagaagacggtgcaacagttgactattactaccgtgagaatgttgaggaaacagtggttcccaaaacagcaacctctactgagacgaagactataacgcgtatcattcattacgttgataaagttacgaaccaaaatgtaaaagaagatgttgttcaacctgtaaccttaagccgtacaaaaactgagaacaaggtcacgggagttgtaacctacggtgaatggacaacaggaaactgggacgaggttgtatctggtaagattgacaagtacaaagatccagatattccaacagttgaatcacaagaagttacgtcagactctagtgataaagaaataacggtaaggtatgaccgtttatcaacaccagataaaccaactccagacccaggtactccaaaaactgaaactccagtgaatccagacccagaagttccgacttatgagacaggtaagagagaggaattgccaaacacaggtacagaagctaatgctaccttggctagtgctggtatcatgaccttgttagctagtctaggattaggattcttcaagaaaaaagaagatgaaaaataa

SEQ ID NO: 1712 - DNA (genomic), 204 bp, Streptococcus pneumoniae; double-stranded, circular
  misc_feature (B) LOCATION 1...204
  hypothetical: NO
  anti-sense: NO
gtcaaaagaagttgtaaaaaatctttaaaattaaaaaaacgcatagtatcaggtgttgaatgtactgacccccaaaagttagattttttctgtctaacttttggggtgcagttcataagaaccttggtaatatgcgttttattatgtagagacttatactcttcgaaaatctcttcaaaccacgtcagcttcaccttgccgtag

SEQ ID NO: 1713 - DNA (genomic), 318 bp, Streptococcus pneumoniae; double-stranded, circular
  misc_feature (B) LOCATION 1...318
  hypothetical: NO
  anti-sense: NO
aatcgaagaagtacttgcataatgaatgtgtatgatgttatcaaaaaacctgtcatcactgacagctcaatggctcaacttgaagcagggaaatatgtatttgaagttgacactcgtgcaaacaaacttttgatcaagcaagctgttgaagctgctatcgaaggtgttaaagttgccaatgttaacacaatcaacgtaaaaccaaaagctaaacgtgttggacgttacactggttttactaacaaaactaaaaaagctatcatcacacttacagctgattctaaagcaatcgagttgtttgctgctgaagctgaataa

SEQ ID NO: 1714 - DNA (genomic), 837 bp, Streptococcus pneumoniae; double-stranded, circular
  misc_feature (B) LOCATION 1...837
  hypothetical: NO
  anti-sense: NO
aggagaagaagaatgagtttgcaagaaacgattatccaagagctgggtgtcaaaccagtgattgatgcccaggaagaaatccgtcgttctattgatttcttaaaaagatatctgaaaaaacatcccttcctaaaaacctttgtactagggatttctgggggacaagactcaaccttggcagggcgtttggcgcaattagctatggaagaactgcgagctgaaacgggagacgatagctacaaatttatcgctgtccgcctgccatacggagtgcaagctgatgaagcagatgctcaaaaagccctagccttcatccagccagatgtcagcttggttgtgaatatcaaggaatcagctgatgccatgacagctgcagttgaagcgacaggtagtcctgtttcagacttcaacaaggggaatatcaaggcacgttgccgtatgattgctcagtatgcccttgctggttcccatagcggagcggtcattggaacagaccacgccgcggaaaatatcacaggtttctttaccaagtttggtgacggcggtgcggatattctccctctttaccgcctcaataaacgccaaggaaaacagctcttgcagaaacttggcgcagagccagccctttatgaaaaaatcccaacggcagacctagaagaagataaaccaggcctagctgacgaagtcgcacttggagtcacctacgcagagattgacgactacctagaaggcaaaacaatcagcccagaaactcaagcgaccattgaaaactggtggcacaaaggccaacacaaacgccacttacccatcaccgtatttgatgacttttgggagtaa

SEQ ID NO: 1715 - DNA (genomic), 672 bp, Streptococcus pneumoniae; double-stranded, circular
  misc_feature (B) LOCATION 1...672
  hypothetical: NO
  anti-sense: NO
aaaaggagaagtctcatggcagttaaagattttatgacccgcaaggtagtttatattagtccagatacaacagtatctcatgcagcagatttgatgagagagcaaggtttgcaccgtctgcctgttatcgaaaatgatcaattagttggtttggtgactgagggaaccattgcacaagcaagtccatctaaagcaacaagtctttctatatatgagatgaattatcttctgaataagacaaaagtaaaagatgtcatgattcgcgatgttgtcactgtctcaggctatgctagtctagaagatgcaacttatctgatgttgaaaaataagattggtattctccctgtcgtagataaccatcaagtatacggagttattactgaccgtgatgttttccaagcctttcttgaaattgcaggttatggcgaagaagggattcgtgtacgctttgttacagaagatgaagttggtgttcttggaaaaattgtttctttgattgtagaagaaaatttgaatatctcccatacagtcaatattccgcgtaaggatggtaaggtgattatcgaagtgcaaatcgatgaatcaattgatttaccagccttgaaagaaaaatttgaagcaaatggtattcaagtggaagaaatcgctcgcacttcagcaaaagtcttgtaa

SEQ ID NO: 1716 - DNA (genomic), 573 bp, Streptococcus pneumoniae; double-stranded, circular
  misc_feature (B) LOCATION 1...573
  hypothetical: NO
  anti-sense: NO
gaagggagaagaccgatgaagcgttcttctcttttagttagaatggttatttccatctttctggtctttctcattctcctagctctggttggaactttctactatcaatcaagttcttcagccattgaggccaccattgagggcaacagccaaacgaccatcagccagactagccactttattcagtcttatatcaaaaaactagaaaccacttcgaccggtttgacccagcagacggatgttctggcctatgctgagaatcccagtcaagacaaggtcgagggaatccgagatttgtttttgaccatcttgaagtcagataaggacttgaaaactgttgtgctggtgaccaaatctggtcaggtcatttctacagatgacagtgtgcagatgaaaacttcctctgatatgatggctgaggattggtaccaaaaggccattcatcagggagctatgcctgttttgactccagctcgtaaatcagatagtcagtgggtcatttctgtcactcaagaacttgttgatgcaaagggagccaatcttggtgtgcttcgtttggatatttcttcatga

SEQ ID NO: 1717 - DNA (genomic), 1134 bp, Streptococcus pneumoniae; double-stranded, circular
  misc_feature (B) LOCATION 1...1134
  hypothetical: NO
  anti-sense: NO
aactctggaagcctatctcaatcaactccagttggggcagcaggctttgccttcattatcaatgaaaaccatgaatttgtctaccatcctcaacacacagtttatagttcgtctagcaaaatggaggctatgaaaccctacatcgatacaggtcagggttatactcctggtcacaaatcctacgtcagtcaagagaagattgcaggaactgattggacggtacttggcgtgtcatcattggaaaagttagaccaggttcggagtcagctcttgtggaccttgcttggggccagtgtcacatctcttcttgtctgtctctgcttagtgtggttcagtcttaaacgctggattgctcctttgaaggatttgagagaaaccatgttggaaattgcttctggtgctcaaaatcttcgtgccaaggaagttggtgcctatgaactgagagaagtaactcgccaatttaatgccatgttggatcagattgatcagttgatggtagctattcgtagccaggaagaaacgacccgtcagtaccaacttcaagccctttcgagccagattaatccacatttcctctataacactttggacaccatcatctggatggctgaatttcatgatagtcagcgagtggtgcaggtgaccaagtccttggcaacctatttccgcttggcgctcaatcaaggcaaggacttgatttgtctctctgacgaaatcaatcatgtccgccagtatctctttatccagaaacaacgctatggagataagctggaatacgaaattaatgaaaatgttacctttgataatttagtcttacccaagctggtcctacaaccccttgtagaaaatgctctttaccatggcattaaggaaaaggaaggtcagggccatattaaactttctgtccagaaacaggattcgggattggtcatccgtattgaggatgatggcgttggcttccaagatgctggtgatagtagtcaaagtcaactcaaacgtgggggagttggtcttcaaaatgtcgatcaacggctcaaacttcattttggagccaattaccagatgaagattgattctagaccccaaaaagggacgaaagttgaaatatatataaatagaatagaaactagctaa

SEQ ID NO: 1718 - DNA (genomic), 2253 bp, Streptococcus pneumoniae; double-stranded, circular
  misc_feature (B) LOCATION 1...2253
  hypothetical: NO
  anti-sense: NO
cagtctggaagaactccgtcaggaagtaaaagagtctctgaggtaaactgcaatcaatctgttcttgattttttattagtttgtaatatgaatttaggagaattttggtacaataaaataaataagaacagaggaagaaggttaatgaagaaagtaagatttatttttttagctctgctatttttcttagctagtccagagggtgcaatggctagtgatggtacttggcaaggaaaacagtatctgaaagaagatggcagtcaagcagcgaatgagtgggtttttgatactcattatcaatcttggttctatataaaagcagatgctaactatgctgaaaatgaatggctaaagcaaggtgacgactatttttacctcaaatctggtggctatatggccaaatcagaatgggtagaagacaagggagccttttattatcttgaccaagatggaaagatgaaaagaaatgcttgggtaggaacttcctatgttggtgcaacaggtgccaaagtaatagaagactgggtctatgattctcaatacgatgcttggttttatatcaaagcagatggacagcacgcagagaaagaatggctccaaattaaagggaaggactattatttcaaatccggtggttatctactgacaagtcagtggattaatcaagcttatgtgaatgctagtggtgccaaagtacagcaaggttggctttttgacaaacaataccaatcttggttttacatcaaagaaaatggaaactatgctgataaagaatggattttcgagaatggtcactattattatctaaaatccggtggctacatggcagccaatgaatggatttgggataaggaatcttggttttatctcaaatttgatgggaaaatagctgaaaaagaatgggtctacgattctcatagtcaagcttggtactacttcaaatccggtggctacatggcagccaatgaatggatttgggataaggaatcttggttttacctcaagtttgatggcaaaatggctgaaaaagaatgggtttacgattctcatagtcaagcctggtactacttcaaatccggtggttacatgacagccaatgaatggatttgggataaggaatcttggttttacctcaaatctgatgggaaaatagctgaaaaagaatgggtctacgattctcatagtcaagcttggtactacttcaaatccggtggttacatgacagccaatgaatggatttgggataaggaatcttggttttacctcaagtctgatggcaaaatggctgaaaaagaatgggtctacgattctcatagtcaagcctggtactacttcaaatctggtggctacatggcgaaaaatgagacagtagatggttatcagcttggaagcgatggtaaatggcttggaggaaaagctacaaatgaaaatgctgcttactatcaagtagtgcctgttacagccaatgtttatgattcagatggtgaaaagctttcctatatatcgcaaggtagtgtcgtatggctagataaggatagaaaaagtgatgacaagcgcttggctattactatttctggtttgtcaggctatatgaaaacagaagatttacaagcgctagatgctagtaaggactttatcccttattatgagagtgatggccaccgtttttatcactatgtggctcagaatgctagtatcccagtagcttctcatctttctgatatggcagtaggcaagaaatattattcggcagatggcctgcattttgatggttttaagcttgagaatcccttccttttcaaagatttaacagaggctacaaactacagtgctgaagaattggataaggtatttagtttgctaaacattaacaatagccttttggagaacaagggcgctacttttaaggaagccgaagaacattaccatatcaatgctctttatctccttgcccatagtgccctagaaagtaactggggaagaagtaaaattgccaaagataagaataatttctttggcattacagcctatgatacgaccccttacctttctgctaagacatttgatgatgtggataagggaattttaggtgcaaccaagtggattaaggaaaattatatcgataggggaagaactttccttggaaacaaggcttctggtatgaatgtggaatatgcttcagacccttattggggcgaaaaaattgctagtgtgatgatgaaaatcaatgagaagctaggtggcaaagattag

SEQ ID NO: 1719 - DNA (genomic), 648 bp, Streptococcus pneumoniae; double-stranded, circular
  misc_feature (B) LOCATION 1...648
  hypothetical: NO
  anti-sense: NO
cgtgtaggaagtctgtttgttgaggaggataattttatggagttttttgataaatttcatgccttgtgttttggatttttagtactaataattgtcattacagttccttatacgattaaccatggggatttttttcaaaatgaatctgcattgattattgtaagtcttcttgtaacctcgctgagtgttgcttatgctagaaagtttgaaatgatttcttttgggatgttaagcaagaaacaacttttgcttttcattgcaatctttcttctaagtgtacttgagacgctggtttatattcatttcttcgctgtttcttctggctcaggggtccaacacttggcggaagtcagcagaggaatttccctgtctttgattttgactacctcagtttttggccccatccaggaggaactcattttcagaggacttcttcaaggtgcggtttttgacaattcttggttagggcttgtgctaacttcctctctcttttctttcatgcatggaccttctaatgtcccttcgtttattttttatctacttgggggcttgttgctgggccttgcttataaaaagagccaaaacctatgggtttctactctagtccacatgttttacaacagttggccactcctatattatttatag

SEQ ID NO: 1720 - DNA (genomic), 573 bp, Streptococcus pneumoniae; double-stranded, circular
  misc_feature (B) LOCATION 1...573
  hypothetical: NO
  anti-sense: NO
tggagaggaagaacgagaatggatacacaaaagattgaagcggctgtaaaaatgattatcgaggctgtaggagaggacgctaatcgcgagggcttgcaggaaacacctgctcgtgtagcccgtatgtatcaagagattttttcaggtcttggtcaaacagcagaggaacatttgtcaaaatcctttgaaattattgacgataatatggtggtagaaaaggatatctttttccataccatgtgtgaacaccacttcttgccattttatggtagagcgcacattgcctacattccagatggtcgtgtggcaggcttgtctaagctagcccgtacggttgaagtttattcgaaaaaaccacaaattcaagaacgtttgaatatcgaagtggccgatgccttgatggactatctaggtgctaaaggagcctttgttgtcattgaggcggaacatatgtgtatgagtatgcgtggtgttagaaaaccaggcactgcaaccttgacgacagtagctcgtggtctatttgaaacagataaggacctccgcgaccaagcttatcgtttaatggggctataa

SEQ ID NO: 1721 - DNA (genomic), 888 bp, Streptococcus pneumoniae; double-stranded, circular
  misc_feature (B) LOCATION 1...888
  hypothetical: NO
  anti-sense: NO
gatggaggaaggttcgatgcgtgtggatgccaacatctccctcgtccttatggtcaagagaaattcggtaccaagactgaattgaagaacctcaactccttctcaaacgttcgcaaggggcttgaatacgaagtccaacgccaggctgaaattcttcgctcaggtggtcaaatccgccaagaaacacgccgttacgatgaagctaacaaaacaaccatcctcatgcgtgtcaaggaaggggctgctgactaccgctacttcccagaaccagacctacccctctttgaaatttctgacgagtggattgaggaaatgcggactgagttgccagagtttccaaaagaacgtcgtgcgcgttatgtatctgaccttggtttatcagactacgatgctagtcagttgactgctaataaagtcacttctgacttctttgaaaaagctgttgccctaggtggtgatgccaaacaagtctctaactggctccaaggggaagtcgctcagttcttgaatgctgaaggtaaaacactggaacaaatcgaattgacaccagaaaacttggttgaaatgattaccatcatcgaagacggtactatttcatctaagattgccaagaaagtctttgtccatctagctaaaaatggcggtggcgcgcgtgaatacgtggaaaaagcaggtatggttcaaatttcagatccagctatcttgatcccaatcatccaccaagtctttgccgataacgaagctgctgttgccgacttcaagtcaggcaaacgtaacgccgacaaggcctttacaggattccttatgaaggcaaccaaaggccaagccaacccacaagttgcccttaaactacttgcacaggaattggcgaagttgaaagaaaactag

SEQ ID NO: 1722 - DNA (genomic), 885 bp, Streptococcus pneumoniae; double-stranded, circular
  misc_feature (B) LOCATION 1...885
  hypothetical: NO
  anti-sense: NO
ataggaggaagcatgttttattctatcaaagaattggtcgagcaagcagatctggactttcaaggaaatgtcgcagaactcatgattacaacagagtttgaattgaccggtcgcgaacgtgaagaagtcttccttctcatggaacgcaatctggaagttatgaaagcctctgtccaacttggcctcaatgaaaataaatctcgtagtggcctgacaggtggagatgctgccaaattggatcactacatcaaaaacgaaaaaactttatcagattacacgattctctctgctgcccgaaatgctatcgcagtcaatgaacacaatgccaaaatgggcttggtctgtgccactccaaccgctggaagtgctggctgtctcccttccgttctcactgctgctattgaaaaattagacctcagccacgagcaacaattggatttcctctttgctgctggtgcctttggactagtcatcgcaaacaatgcctccatctcaggtgctgagggtgggtgtcaagctgaagttggttcagcctctgctatgagtgctgccgccttgactctggctgcaggtggaacaccttatcaggccagtcaagctattgcctttgtcattaaaaatatgctaggcctcatctgtgaccctgttgcaggtttggtcgaagttccctgtgtcaaacgtaatgccatgggagctagctttgctttcatcgcagcagacatggccttggcaggtatcgaatctaaaatccctgtggatgaagtgatcgatgccatgtaccaagtaggagcaagcatgccaactgcctttcgtgaaacagctgaaggtggactcgctaccacccctactggtcgtcgcctccaaaaagaaattttcggagaataa

SEQ ID NO: 1723 - DNA (genomic), 308 bp, Streptococcus pneumoniae; double-stranded, circular
  misc_feature (B) LOCATION 1...308
  hypothetical: NO
  anti-sense: NO
ccatctttgagaaaaatcctcaggctcaggttactattttcggtgccttgggtggccgtattgaccatatgttggccaatgtctttctgcctagcaatcctaagttnnnnnnnnnnnnnnnnnnnnnnnnnnnnnnnnnnncaaaaaaannnnnnnnnnnngnnnnnnnnnnnngngggnnnnnggggngnggggngnnggggggggggggggggggggggngggggggggggggggggggggggggggngggnngggggggggggggggnggggggggggggnggggngggnggggggggggggggg

SEQ ID NO: 1724 - DNA (genomic), 1785 bp, Streptococcus pneumoniae; double-stranded, circular
  misc_feature (B) LOCATION 1...1785
  hypothetical: NO
  anti-sense: NO
cacgatttgagatacgagatgatttctatctcgaatggaaaatcatttaagattttatctggtgccattcattattttagggttcctccagaggattggtatcattcgctctataacttgaaggctcttggttttaatacggtagagacttatgttgcttggaatttacacgagcctcgtgaaggtgagtttcattttgaaggtgatctggatttagagaaatttctccaaatagcgcaggatttgggtctctacgcaattgtgcgtccgtctccatttatctgtgcggaatgggaattcggtggcttaccagcttggctcttgaccaagaacatgcgaattcgctcatccgacccaacatatatcgaggcagttggtcgctactatgatcagttattgccaagactggttcctcgtttgttggacaatggtggcaatattctcatgatgcaggttgaaaatgagtatggttcttacggagaagataaggcttacctgagagcgattcgacagctaatggaagagtgtggcgtaacctgtcccctctttacatcagatggtccatggcgagctactctgaaagctggaaccttaattgaggaggacctctttgtaacaggaaactttggttctaaggcaccttacaacttttcgcagaggcaggaattctttgatgaacatggtaagaaatggccactcatgtgtatggagttctgggatggttggtttaatcgctggaaagaaccgattatcacacgggatcctaaggaattggcagatgcagttcgagaggttttggaacaaggctctatcaatctttacatgttccacggtggtacaaactttggtttcatgaatggttgctcagctcgaggaactttggacctgccacaagttacgtcttatgattacgatgcccttctggatgaaaaaagaaatccaactgctaaatatcttgcagtcaagaagatgatggcaacacatttttcagagtatccgcagttggaaccactctacaaagagagtatggagttggatgctattccactagttgaaaaagtttctttgtttgaaaccttagatagcttgtcaagtcctgtagaaagtctctatcctcaaaagatggaggagctgggacaaagttatggctacctactttatcgaacagaaacaaactgggatgcagaagaagaaagacttcgtatcattgatggtcgagatagggcccagctgtatgtcgatggtcagtgggttaaaactcaatatcagacagagattggggaagatattttttatcaaggtaaaaagaaagggctatctaggttagatatcttgatagaaaatatggggcgtgtcaactatgggcataagttcttagcggatacgcaacgtaagggaattcggacaggggtctgtaaggatctgcatttcttactaaactggaaacactatccactcccactagacaatcctgagaaaattgatttttcaaaaggatggactcaaggacaaccagccttttacgcttatgactttacagtcgaagagccaaaagatacttacctagacttgtctgagtttggtaagggggttgcctttgtcaatgggcagaatctaggacgtttttggaacgttggcccaactctctcactttatatccctcatagctatctcaaggaaggtgccaaccgcatcattatctttgaaacagaaggtcaatataaagaagagattcatttaactcgtaaacctacactaaaacatataaagggggaaaacttatga

SEQ ID NO: 1725 - DNA (genomic), 384 bp, Streptococcus pneumoniae; double-stranded, circular
  misc_feature (B) LOCATION 1...384
  hypothetical: NO
  anti-sense: NO
agactcttgaggtgtgttcttagttcaatgatggtaaatcatctatcttataccttcatcactcataccaaacatttggtgattaatttgctacaaaatcagcctaaactaaaggttttggttatgagtaattttgatcagtatcatgcaaaattcgttgcagagacactttcttattactgtagcaataattttgaactggaagtttggaccgaattagaattatcaaaggaatctttagaagattcaccttatgatatcattatttccaattttattattcctcctattgaaaataagagactcatctattcaaataatataaacacggtctcactcatatatttgttaaatgccatgatgtttattcgattagatgagtaa

SEQ ID NO: 1726 - DNA (genomic), 279 bp, Streptococcus pneumoniae; double-stranded, circular
  misc_feature (B) LOCATION 1...279
  hypothetical: NO
  anti-sense: NO
ttttcattgagtataaaatggagcctattagataatatctggctgagacgtgtcgctattgaccaccagttgttaagaaaagagaagaccaatactcaattaatggaaaaaattctacttcataacttgaaccaaacagaattttttatcaataaagccattggctggactctgcgagcctactccaaaacgaaccccacttgggtagcatgctttattgatgaaaacaaggaaagaatggctgaacttagtatcaaagaagcaagcaagtacctctag

SEQ ID NO: 1727 - DNA (genomic), 2187 bp, Streptococcus pneumoniae; double-stranded, circular
  misc_feature (B) LOCATION 1...2187
  hypothetical: NO
  anti-sense: NO
ttttcattgagtattagggaaaaggagatgaatatgaaatttgggaaacgtcactatcgtccgcaagtggatcagatggactgcggtgtagcttcattagccatggtttttggctactatggtagttattattttttggctcacttgcgagaattggctaagacgaccatggatgggacgacggctttgggcttggtcaaggtggcagaggagattggttttgagacgcgagccattaaggcggatatgacgctttttgacttgccggatttgacttttccttttgttgcccatgtgcttaaggaagggaaattgctccactactatgtggtgactgggcaggataaggatagcattcatattgccgatccagatcccggggtgaagttgactaaactgccacgtgagcgttttgaggaagaatggacaggagtgactctttttatggcacctagtccagactataagccttataaggaacaaaaaaatggtctgctctcttttatccctatattagtgaagcagcgtggcttgattgccaatatcgttttggcaacactcttggtaaccgtgattaacattgtgggttcttattatctgcagtctatcattgatacctatgtgccagatcagatgcgttcgacactagggattatttctattgggctagtcatcgtctacatcctccagcaaatcttgtcttacgctcaggagtatctcttgcttgttttggggcaacgcttgtcgattgacgtgattttgtcctatatcaagcatgtttttcacctccctatgtcctttttcgcgacacgcaggacaggggaaattgtgtctcgtttcacggatgctaacagtattatcgatgcgctggcttcgaccattctttcgattttcctagatgtgtcaacagttgtcattatttcccttgttttattttcacaaaataccaatctctttttcatgactttattggcgcttcctatctacacagtgattatctttgcctttatgaagccgtttgaaaagatgaatcgggacaccatggaagccaatgcggttctgtcttcttctatcattgaggacatcaacggtattgagactatcaagtccttgaccagtgaaagtcagcgttaccaaaaaattgacaaggaatttgtggattatctgaagaaatcctttacctatagtcgagcagagagtcagcaaaaggctctgaaaaaggttgcccatctcttacttaatgtcggcattctctggatgggggctgttctggtcatggatggcaagatgagtttggggcagttgattacctataataccttgctggtttactttaccaatcctttggaaaatatcatcaatctgcaaaccaagcttcagacagcgcaggttgccaataaccgtctaaatgaagtgtatctagtagcttctgagtttgaggagaagaaaacagttgaggatttgagcttgatgaagggagatatgaccttcaagcaggttcattacaagtatggctatggtcgagacgtcttgtcggatatcaatttaatcgttccccaagggtctaaggtggcttttgtggggatttcagggtcaggtaagacgactttggccaagatgatggttaatttttacgacccaagtcaaggggagattagtctgggtggtgtcaatctcaatcagattgataaaaaagccctgcgccagtacatcaactatctgcctcaacagccctatgtctttaacggaacgattttggagaatcttcttttgggagccaaggaggggacgacacaggaagatatcttacgggcggtcgaattggcagagattcgagaggatatcgagcgcatgccactgaattaccagacagaattgacttcggatggggcagggatttcaggtggtcaacgtcagagaatcgctttggcgcgtgctctcttgacagatgcgccggtcttgattttggatgaggcgactagcagtttggatattttgacagagaagcggattgtcgataatctcatggctttggacaagaccttgattttcattgctcaccgcttgactattgctgagcggacagagaaggtagttgtcttggatcagggcaagattgtcgaagaaggaaagcatgctgatttgcttgcacagggtggcttttacgcccatttggtcaatagctag

SEQ ID NO: 1728 - DNA (genomic), 876 bp, Streptococcus pneumoniae; double-stranded, circular
  misc_feature (B) LOCATION 1...876
  hypothetical: NO
  anti-sense: NO
atggctatgagaaatcaacttgcccttagtggcgaaaaaattcttgaaaaaatttatcctcaactatttcaccacgtcggcatgattcgtggggaatatttgttgagagagcttaatcaaaacatcatattagcaagttgtcagcaatttgtaaaagattatctagagactatctgctccctgtactcagatgaagaagtttggtatcgtttttctgaattaacgaatacagaagccaattgtttagtggggactagagagttttttgacgaagggcatcccttgtttggctatagaggaaccaggcgtttactggcgtgtttggatgaatttcaggctgaagcacatgtcgttacagaagtttatcaaaccaaccccaatctatctgttatctttccttttgtcaatgatgacgaccaattaaaacaagctattacagtattgcgtcagcagggttttactgggaaagtcggaacgatgattgaattaccgtcagcgtattttgacttatctagtatactggaaacgggcatttcaaagattgtagttggaatgaatgatttgacttcctttgtttttgcgactatgagaaacagtcaatggcatgatatggaaagtccaataatgttagatatgctaagagatatgcaggataaagcaagaaagaacaagattgattttgctgtagcaggctatctgaatacttctttcatacaaaaaatgaatcagttgggtatcaagtgcattatccactacagttctattccagagatttttgatttagagattgaccatccagatcatcttaaacacataaaagaagaaagtaaaaaattacaaaggagtacccatgataccgcaagaaatgtggaataa

SEQ ID NO: 1729 - DNA (genomic), 354 bp, Streptococcus pneumoniae; double-stranded, circular
  misc_feature (B) LOCATION 1...354
  hypothetical: NO
  anti-sense: NO
tacacaatgaggtataatcttcttatggcatattcaatagattttcgtaaaaaagttctctcttattgtgagcgaataggtagtataacagaagcatcacacgttttccaaatctcacgtaataccatttatggctggttaaagctaaaagagaaaacaggagagctaaaccaccaagtaaaaggaacaaaaccaagaaaagttgatagagatagacttaaaaactatcttactgacaatccagacgcttatttgactgaaatagcttctgaatttggctgtcatccaactaccatccactatgcgctcaaagcgatgggttacactcgaaaaaaagaaccacacctactatga

SEQ ID NO: 1730 - DNA (genomic), 765 bp, Streptococcus pneumoniae; double-stranded, circular
  misc_feature (B) LOCATION 1...765
  hypothetical: NO
  anti-sense: NO
gtattgatgagaaacttgaaaagtatactgagacgacacattagtctattgggctttctcggagtattgtcaatctggcagttagcaggttttcttaaacttctccccaagtttatcctgccgacacctcttgaaattctccagccctttgttcgtgacagagaatttctctggcaccatagctgggcgaccttgagagtggctttactggggctgattttgggagttttgattgcctgtcttatggctgtgctcatggatagtttgacttggctcaatgacctgatttaccctatgatggtggtcattcagaccattccgaccattgccatagctcctatcctggtcttgtggctaggttatgggattttgcccaagattgtcttgattatcttaacaacaacctttcccatcatcgttagtattttggacggttttaggcattgtgacaaggatatgctgactttgtttagtctgatgcgagcaaacccttggcaaatcctgtggcattttaaaatcccggttagcctgccttacttttatgcaggtctgagggtcagtgtctcctacgcctttatcacaactgtggtatctgagtggttgggaggttttgaaggtcttggtgtttatatgattcagtctaaaaaactgtttcagtatgataccatgtttgccattattattctggtgtcgattatcagtcttttgggtatgaagctggtcgatatcagtgaaaaatatgtgattaaatggaaacgtacttaa

SEQ ID NO: 1731 - DNA (genomic), 2880 bp, Streptococcus pneumoniae; double-stranded, circular
  misc_feature (B) LOCATION 1...2880
  hypothetical: NO
  anti-sense: NO
aaaatgatgagcgtggtcaggaaatcttgtggagtctggaagaaggtcatgaagaaaaagaggctgttgaaaccaaggtgcaccttgggtggcaagtttttggatcgaattttatctccaaaatcagaatgcgcctatgagttatcagctgtgggtcaggtggaagcaggaaccaatcatatcttgtggactctgagaatcggtcaaatcaatagccaaaaatactatgtcattcgggatattccactttttttaaggattgtcgagcagagaaagtcgtatatgattggcaagatttatgaggagtctctttcttgggaagcctttgatgatgccagccaagaacttttgactttcttgcacggactaacggaggaagggctggtttcagacctcttttgccaaaaccaaggtcggcacctctttttccctctgaccttttttgagcagggtgtgaatttactgatggccttgccccattttcaatttgaccatcaagtggatagctaccaaaccctgctttttcaggatatgcatgctgatgccaatctatttgcctttacagtaacagaatactcggactattttgaaatggaaatcagtgagagtcctagggtcaatgtcttttatcagggagcagtacttttccataaaggtcaggtttattttttaacagaccagcagatgcgtcttctcaaggaaattaaagcgttacctgtgggtcaacaaggaaagaaatacctgcaatttgatagcagtgatcgagacaaattggcctcctgtctgactctttttatccagatgggcaccgtttcagctccagaacgtctacaaatcaaaacttttgcgccctctttttactttgacagggaagaagataatcggattcgtttagaaattcagtttgattatggaaatagacaggtatctagccgacaagagctagaagaattaccattttcaagtgacgcggacttagaagaaagaattttccaagtctgtttggctgcgggctttgaagccgattttcaatcttggcgtcaggccttaaaagcggagtctgtctatcatttttttcatgatatcattccagtctttgaaaaactcgggcatgttgacctatcagataaactagaagagctttatagcctagcgagtcctcaggtgcagattgcctccaagggaggtctcttggaaatccagtttgattttcaagatattgcccaggaggaaatcgaccaagccatgcaggccttggttgccaatcaggatttttatattgattcgtctaatcaagtttactttttcgatgaagaaaccaagaaaattcgccaaaatctacaggaactggggcaatttgaattaaaagatgggaccttgcaggctcggaaatccttggcctacagtttagctcatctctttgaagggcgagaccgtgtttctttttcacaagaattccagaatctggcccaggatttgacacatccagaggactttcctcgacaggcaactcaggttcaggctgacttgcgagattatcaggaaaagggaattggctggttgcagatgctccatcattatggttttggtgggattttggctgatgatatgggacttgggaaaacccttcagaccattgcttttttgactagtcaagtgacaaaagaaagtcgggttttgattctcgctccgtcaggtttgatttacaactgggcagatgagtttcagaaatttgccccacagttggatgtggctgttgttcatggtttgaaagcaagtcgtgaggagattcttgccgagagccatcaaatctatgtgactagctatgccaccttccgtcaggacagtgagttttatcaggggatggccttttacttccttttcttagatgaggctcaggtcatgaaaaatgcccagaccaagattgcccagaccttgagacaatttgtggtgccgtcggtctttgccttgtcaggaactccgattgaaaaccatctgggtgagttgtggtctattttccaaatcgtcatgcccggacttttgccaagcaagaaagaatttatgaaattgccagcagagcgagtggctcagtttatcaagcctttcgtgatgcgacgcaagaaagaagaagttctgactgaattgccagacttgattgaggtggtttataaaaatgaactggaagaccagcaaaaggctatttaccttgcccagttacaacagatgcgagaccatctggctcaagtgtcagaacaggaatttcagcgaagtcgtgtggaaattttatctggtttgatgcgcttgcgtcaaatatgtgacactcctgccctgtttatggaagattatcagggagccagcggcaaactagatagtctccgagacctactggtacaggtggcagacggcagacaccgtgtcttgattttctctcagttcaagggaatgttggaaaaaattgaacaagaactgccagacttgggcctgacatcctttaaaattacgggttcaaccccagccaaggaaagacaagacatgaccaaggcctttaaccaaggagaaagagatgcctttctgatttccctcaaggctggtggggtcggtctgaacctgacaggtgcagatacagtgatcttggttgacctttggtggaatcctgcggtggaagcgcaagccattggccgtgcccatcggatgggtcaggaagaaacggttgaggtctatcgcttggtgaccaagggaaccattgaagaaaaaattcaggaactccaagaacaaaagaaacatctggtgtcacaagtattggatggcacagagtcacgtggtagtctgaccctagcagaaattagagaaattttgggaatttctgaagccaacacttga

SEQ ID NO: 1732 - DNA (genomic), 774 bp, Streptococcus pneumoniae; double-stranded, circular
  misc_feature (B) LOCATION 1...774
  hypothetical: NO
  anti-sense: NO
tttacgatgagaaggaagtgtcactcagagagattttactttattatttccgagttatcgatcctctcatctatcaatcaacaagggaatgaccgtggtcgccaatatcgaactgggatttattatcaggatgaagcagatttgccagctatctacacagtggtacaggagcaggaacgcatgctgggtcgaaagattgcagtagaagtggagcaattacgccactacattctggctgaagactaccaccaagattatctcaggaagaatccttcaggttactgtcatatcgatgtgaccgatgctgataagccattgattgatgcagcaaactatgaaaagcctagtcaagaggtgttgaaggccagtctatctgaagagtcttatcgtgtcacacaagaagctgctacagaggctccgtttaccaatgcctatgaccaaacctttgaagaggggatttatgtagatattacgacaggtgagccactcttttttgccaaggataagtttgcttcaggttgtggttggccaagttttagccgtccgatttccaaagagttgattcattattacaaggatctgagccatggaatggagcgaattgaagttcgttctcgttcaggcagtgctcacttgggtcatgttttcacagatggaccgcgggagttaggcggcctccgttactgtatcaattctgcttctttacgctttgtggccaaggatgagatggaaaaagcaggatatggctatctattgccttacttaaacaaataa

SEQ ID NO: 1733 - DNA (genomic), 225 bp, Streptococcus pneumoniae; double-stranded, circular
  misc_feature (B) LOCATION 1...225
  hypothetical: NO
  anti-sense: NO
aagcagatgagtataagtcctcgttttgaaaccttagagcaggccattgcctccaaagatttggaaaaagtccgagaagcttttaagaaaatgatttccacttggaccatcaatgaaagtgtggttcgtgacaatagtacagctcattatggacgtgttgaaacagntatttccttcctgcctagtagcatggaaaccgaacctacagatgagtttggaacatga

SEQ ID NO: 1734 - DNA (genomic), 924 bp, Streptococcus pneumoniae; double-stranded, circular
  misc_feature (B) LOCATION 1...924
  hypothetical: NO
  anti-sense: NO
aaaaagatgagttatttgaaaggctttaacctaatcaaatcagctgacctgaggcaaactcgagctgggaaaaactacctagcctttaccttccaagatgatagtggcgagattgatgggaagctctgggatgcccaacctcataacattgaggcctttaccgcaggtaaggttgtccacatgaaaggacgccgagaagtttataacaatacccctcaagtcaatcaaattactctccgcctgcctcaagctggtgaacccaatgacccagctgatttcaaggtcaagtcaccagttgatgtcaaggaaattcgtgactacatgtcgcaaatgattttcaaaattgaaaatcctgtctggcaacggattgtccgaaatctctacaccaagtatgataaggaattctactcctatccagccgccaagaccaaccaccatgcctttgaaacgggcttggcttatcatacggcgaccatggtacgtttggcagacgctattagcgaagtttatcctcagctcaataagagcttactctatgcggggattatgctgcatgacttagctaaggttatcgagttgacggggccagaccagacagagtacacagtgcgaggtaatcttcttggacatatcgctctcattgatagcgaaattaccaagacagttatggaactcggcatcgatgataccaaggaagaagtcgttttgcttcgtcatgtcatcctcagtcaccacggcttgcttgaatatggaagtccagtccgtccacgtattatggaggcagagattatccatatgattgacaatctggatgcaagtatgatgatgatgtcaacagctctggctttggtggataaaggagagatgtccaataaaatcttcgctatggataatcgttccttctataaaccagatttagattga

SEQ ID NO: 1735 - DNA (genomic), 729 bp, Streptococcus pneumoniae; double-stranded, circular
  misc_feature (B) LOCATION 1...729
  hypothetical: NO
  anti-sense: NO
aagaagatgagaatcaataagtatattgcccacgcaggtgtggccagtaggagaaaagcagaagagctgattaagcaaggcttggtgacggttaacggccaagtggtgcgtgaactagcaaccactatcaagtcaggcgacaaggtcgaagttgaaggtcaacctatctacaacgaagaaaaggtctactatctgcttaacaaaccacgcggtgtgatttccagtgtgacagatgataagggtcgcaagacggttgtcgacctcttgcccaatgtcaaagagcgtatttaccctgtgggtcgtttggactgggatacatcaggtgtcttgattttgaccaatgatggggactttacagacgagatgattcaccctcgtaatgagattgacaaggtttatgtcgcgcgtgttaaaggtgtggccaataaggacaatctccgccccttgacccgtggtcttgagattgatggtaagaaaaccaagccagctgtttatgaaattctcaaagtggacccagtcaaaaatcgctctgtggtgcagttgaccatccatgaagggcgtaaccatcaggttaaaaagatgtttgaagctgttggtctccaagtagataagttgtctcggactcgtttcggacacctagacttgacaggactccgtccaggagaatcccgtcgtcttaataaaaaagaaatcagccaactacacaccatggctgtaactaagaaataa

SEQ ID NO: 1736 - DNA (genomic), 1266 bp, Streptococcus pneumoniae; double-stranded, circular
  misc_feature (B) LOCATION 1...1266
  hypothetical: NO
  anti-sense: NO
actatggtgagtagacaagaacaatttgaacaggtacaggctgttaaaaaatcgattaacacagctagtgaagaagtgaaaaaccaagccttgctagccatggctgatcacttagtggctgctactgaggaaattttagcggctaatgccctcgatatggcagcggctaaggggaaaatctcagatgtgatgttggatcgtctttatttggatgcagatcgtatagaagcgatggcaagaggaattcgtgaagtggttgccttcccagatccaatcggtgaagttttagaaacaagtcagcttgaaaatggtttggttatcacaaaaaaacgtgtagctatgggtgtcatcggtattatctatgaaagccgtccaaatgtgacgtctgatgcggctgctttgactcttaagagtggaaatgcggttgttcttcgtagtggtaaggatgcctatcaaacaacccatgccattgtcacagccttgaagaagggcttggagacgactactattcacccaaatgtgattcaactggtggaagatactagccatgaaagtagttatgctatgatgaaggccaagggctatctagacctcctcattcctcgtggaggagctggcttgatcaatgcagtggttgagaatgccattgtacctgttatcgagacagggactgggattgtccatgtctatgtggataaggatgcagacgaagacaaggcgctgtctatcatcaacaatgctaaaaccagtcgtccttctgtttgtaatgccatggaggttctgctggttcatgaagacaaggcagcaagcatccttcctcgcttggatcaaatgctggttgcagagcgtaaggaagctggactggaaccaattcaattccgcttggatagcaaagcaagccagtttgtttcaggtcaagcagctgagacccaagactttgacaccgagtttttagactatgtccttgctgttaaggttgtgagcagtttagaagaagcggttgcgcacattgaatcccacagcacccatcattcggatgctattgtgacggaaaatgctgaagctgcagcatactttacagatcaagtggactctgcagcggtgtatgttaatgcctcaactcgtttcacagatggaggacaatttggtcttggttgtgaaatggggatttctactcagaaattgcacgcgcgtggtccaatgggcttgaaagagttgaccagctacaagtatgtggttgctggtgatgggcagataagggagtaa

SEQ ID NO: 1737 - DNA (genomic), 900 bp, Streptococcus pneumoniae; double-stranded, circular
  misc_feature (B) LOCATION 1...900
  hypothetical: NO
  anti-sense: NO
ttattttcgaggagaaaaacagtgaaaaaaagaaaaaagcttgctctgtctcttatcgctttttggctgacggcttgtttagtaggctgtgctagctggattgatcgtggagaatccataacggctgttggctcaactgccttgcaacccttggttgaagtagcggcagatgaatttggcacgatccatgttggaaaaacggtcaatgtccaagggggaggttctggtacaggcttgtcccaggttcagtctggggcagttgatataggaaactcagatgtatttgctgaggaaaaagacggaattgatgcttctgctcttgttgaccacaaggtcgcggtacgtggcttggctctgattgtcaataaggaggttgatgttgataacctaacgacagagcaacttcgtcaaatcttcataggtgaggtaaccaattggaaagaggttggtggtaaggacttacccatctctgttatcaatcgggcagccggctctggttctcgtgctacctttgatactgtcattatggaaggtcagtctgccatgcaaagtcaggagcaggattcaaatggagcggtaaaatcaatcgtatcaaaaagtccaggagctatctcttatttatctcttacctatatagatgattcggtcaaaagcatgaagttgaatggctatgacttaagtccagaaaatataagtagcaataattggcccttgtggtcttatgagcatatgtatacattggggcagcccaatgagttggctgcagaatttctcaattttgttctctcggatgagacccaagaagggattgtcaaaggattgaagtatattccgattaaggaaatgaaggttgaaaaagatgctgccggaactgtgacagtgttggaagggagacaataa

SEQ ID NO: 1738 - DNA (genomic), 1413 bp, Streptococcus pneumoniae; double-stranded, circular
  misc_feature (B) LOCATION 1...1413
  hypothetical: NO
  anti-sense: NO
gtcatttcgagctttttatggtacaatggaaacatgttattcaaattatctaaggaaaaaatagagctaggcttatctcgtttatcgccagcccgtcgtatttttttgagttttgccttggtcattttactaggctctcttcttttgagcttgccctttgtccaagttgaaagctcacgagcgacttattttgatcatcttttcactgctgtctctgcagtctgtgtgacaggtctctcaacccttccagtagctcacacctataatatatggggccaaataatctgtttgctcttgattcagatcggtggtctagggctcatgacctttattggggttttctatatccagagcaagcaaaagcttagtcttcgtagccgtgcaactattcaggatagttttagttatggagaaactcgatctttgagaaagtttgtctattctatttttctcacgacctttttggttgagagcttgggagctattttgcttagttttcgccttattcctcaacttggctggggacgtggtctttttagttccatttttctagcgatctcagccttctgtaatgccggttttgataatttagggagcaccagtttatttgcttttcagaccgatttactggtcaatctggtgattgcaggcttgattattacaggcggccttggttttatggtctggtttgatttggctggtcatgtaggaagaaagaaaaaaggacgtctgcactttcatacgaagcttgtactattgttgactataggtttgttgttatttggaacggcaactactctctttcttgagtggaacaatgctggaacgattggcaatctccctgttgccgataaggttttagttagcttttttcaaacagtgacgatgcgaacagctggcttttctacgatagattatactcaggctcatcctgtgactcttttgatttatatcttacagatgtttctaggtggggcacctggaggaacagctgggggactcaagattacgacattttttgtcctcttggtctttgcacgaagtgagcttctaggcttgcctcatgccaatgttgcgagacgaacgattgcgccgcgaacggttcaaaaatcctttagtgtctttattatctttttgatgagcttcttgataggattgattctgctagggataacagccaaaggcaatcctccctttatccacctcatatttgaaaccatttcagctcttagtacagttggtgtaacggcaaatctgactcctgaccttgggaaattggctctcagtgttatcatgccacttatgtttatgggacgaattggtcccttgaccttgtttgttagcttggcagattaccatccagaaaagaaagatatgattcactatatgaaagcagatattagtattggttaa

SEQ ID NO: 1739 - DNA (genomic), 201 bp, Streptococcus pneumoniae; double-stranded, circular
  misc_feature (B) LOCATION 1...201
  hypothetical: NO
  anti-sense: NO
ggctttccgagttttcggagagcctgtttttttattttgatacccatactttttaatatgtatagtggattgatactcttcgaaaatcaaattcaaaccacgtcaatttcaccttgccgtactcaagtacagcctgcggctaacttcctagtttgcactttaattttcattgagtatgaatctggaatagaacactgttaa

SEQ ID NO: 1740 - DNA (genomic), 288 bp, Streptococcus pneumoniae; double-stranded, circular
  misc_feature (B) LOCATION 1...288
  hypothetical: NO
  anti-sense: NO
atacttccgagaaacaaaagtatttttatcatcttttttagccaatctctccactgtatatttcaacatcatttattcaaagaatgtgaaacaatcaccctacaacttttggtattagcagaagaattaaaaatatacgatattcttggattctctcaagtacgcttgggaatactacaacataactccgatttgattgataaaggaataactttattacgactaaccaaagaagaggcattagttaaaatactcgaaaaagaaattaatgatttttcaaacctataa

SEQ ID NO: 1741 - DNA (genomic), 669 bp, Streptococcus pneumoniae; double-stranded, circular
  misc_feature (B) LOCATION 1...669
  hypothetical: NO
  anti-sense: NO
cgacttcagagcaagataaaccaaagggggcggagaaaacgaggagttctgagagagcaagcaacacgtgataaaaaagaaaatgatgcgaagtcttcagattctagcgtaggtgaagaagctcttccaagcccatccctgaaaccagaaaaaaaggttgcagaagctgagaagaaggttgcagaagctgagaaaaaagccaaggctcaaaaagaagaagatcgccgtaactacccaaccaatacttacaaaacgcttgaacttgaaattgctgagtccgatgtgaaagttaaagaagcggagcttgaactagtaaaagaggaagctaaggaatctcgaaacgaggaaaaagttaatcaagcaaaagcgaaagttgagagtaaaaaagctgaggctacaaggttagaaaaaatcaagacagatcgtaaaaaagcagaagaagaagctaaacgaaaagcagcagaagaagataaagttaaagaaaaaccagctgaacaaccacaaccagcgccggctcctcaaccagaaaaaccaactgaagagcctgagaatccagctcccgcaccaaaaccagacaagccagctgaacaaccaaaagcagaaaaaacagatgatcaacaagctgaagaagactatgctcgtagatcagaagaagaatataatcgttga

SEQ ID NO: 1742 - DNA (genomic), 207 bp, Streptococcus pneumoniae; double-stranded, circular
  misc_feature (B) LOCATION 1...207
  hypothetical: NO
  anti-sense: NO
aggctacagaggcaggagaatttgttacaataccttatttcaggcttatatcgttcctacacacgtgatgccttctatcaactgttgaagcgccatggttggcgaaatattatgccacgtccagaacatcctaagaaagcagacgctcaaaccattgtcgcgtctaaaaataaaatctcaattcaagaagaaaagaaagcgctttaa

SEQ ID NO: 1743 - DNA (genomic), 789 bp, Streptococcus pneumoniae; double-stranded, circular
  misc_feature (B) LOCATION 1...789
  hypothetical: NO
  anti-sense: NO
ctgggacagagaaggaggacttgcatgtttaagttatcatttcagtccatcggacacgttgtggtacgcaactacatgagttttagaaatttatttaaaatttcaattgtccccaaccttatcgaccccctcttttatcttttagcaatgggatttggagttggtgcctatttgacgcatgttaacggtatgctctaccgtgattttgtcattacaggtttaattgctgcgactgccatgtctgcggccaccgcagaaacaacggtcaatgcctttatccagtataagattgaaaagacttatgatgctatgttgatgacgccaatcaatacgagtgatattgtggtgggtcaggctatctgggcaggtattcgtgcagtgattttcggtgggattttttggctgatttccatgcttatcacagcgcattttcatgtcttgatgttattgattcctctgattttatttatagtgggttatttgtttggtgttttgggactaatctttacctacttggcgccgtctagggaatttctgaattactacaatgttttggtaatccgtcctctttatatgttttcagataccttctttcccattacttccttgcccccaatacttggtgatttgacttggttttctcccttgtatcatgctactcgcatgattcgtattatatggggaggtgaggtgacaggtttgtatcttcatcttatctggttgatagccttggcgctcttgataacggtgcttcctatgtatatgttacatcgtagatattatagatag

SEQ ID NO: 1744 - DNA (genomic), 3675 bp, Streptococcus pneumoniae; double-stranded, circular
  misc_feature (B) LOCATION 1...3675
  hypothetical: NO
  anti-sense: NO
aaaaataagagaggagttaaatcgatgaagcttattccctttttaagtgaggaggagattcaaaaactgcaagaagcagaagcaaattcgagcaaggaacagaagaaaactgccgaacaaatcgaagctatctacacttctggtcagaatatcctggtctcagcatcggctggttctggaaagacctttgtcatggtagagcgcattctggaccaattggcgcgtggtgtcgaaatttctcaactctttatctcaacctttaccgtcaaggctgcaactgaacttaaagaacgtttagagaaaaaaatcagcaagaaaatccaagaaacagatgatgtcgacctcaaacaacacttgggtcgccagttggcagacctacccaacgctgccatcggaaccatggactctttcacacaaaaattccttggcaaacatggttatctgcttgatattgcacctaatttccgtattttacaaaaccaaagcgagcaacttcttctcgaaaacgaagtctttcatgaggtctttgaagcgcattaccaaggtaaacagaaagagacctttagtcatttgctgaaaaactttgctgggcgtggcaaggacgaacggggtctgcggcagcaagtctataaaatctatgacttcctccaatccaccagtaatcctcaaaagtggctgagtgaatctttcctcaaaggctttgagaaagctgattttaccagtgaaaaagaaaaactgactgagcaaatcaaacaagccctttgggatttggaaagctttttccgttaccatctggataacgatgccaaggagtttgcaaaggctgcctatttagaaaatgttcagttaattctggatgaaattggctccctaaatcaggagttcgatagtcaggcttatcaggcagtacttgcgcgtgttgtcgccatctctaaggagaaaaacggtcgtgctctgactaatgccagccgtaaggctgatttgaagcccctggctgatgcctacaacgaagagagaaagacccagtttactaaactaggacaattatcagaccagatagcgattctcgactatcaagaacgttatcatggagacacttggaaactagctaaaaccttccaatctttcatgagcgattttgtagaggcttatcgtcagagaaaacgacaggaaaatgcctttgaattcgctgatatcagccattacaccattgagattttagaaaatttcccacaagttcgtgagtcttatcaggagcgcttccatgaagtcatggtcgatgagtatcaggataccaaccatattcaagaacggatgctggaattgttgtctaatggccacaatcgctttatggtgggagatatcaagcaatccatctatcgtttccgtcaggcagacccgcagattttcaatgagaaattccaacgctatgcgcaaaatcctcaagaaggcaagctcattctcctcaaggaaaatttccgtagtagttcagaagtgctgtcagcaaccaatgatgtctttgaacgtctcatggaccaagaggtcggcgaaatcaactatgataacaagcaccagcttgtttttgccaataccaaactgactcccaatccagacaacaaggcagaatttctcctctacgacaaggacgatacaggtgaggaagaagagagtcaaacagaaacgaaactaacaggcgaaatgcgcttagttatcaaggagattctgaaacttcatcaagaaaaaggtgttgcctttaaggaaattgcccttctgacctccagccgcagtcgtaatgaccagattctcctcgccctgtctgagtacgggattcctgtcaaaactgacggagagcaaaacaattatctccaatccctagaagtgcaagtcatgctagacactcttcgtgtcattcacaatcccctgcaagactacgccttggttgcccttatgaagtctccaatgtttggttttgatgaggatgagctagcacgtttgtcccttcagaaagcagaggataaagtccacgaaaatctctatgagaaactggtcaatgcacaaaaaatggcaagtagtcaaaaaggcttgattcacacagctctagctgaaaaactaaagcaattcatggatatcctagcttcttggcgcttgtatgccaaaacccactctctctatgacttgatttggaagatttacaacgaccgtttttattatgactatgttggggctttgccgaatggtcctgctaggcaggccaatctctatgccctagcactgcgtgctgatcaatttgaaaagagcaatttcaaaggtttgtcgcgttttattcgtatgattgaccaagtcttagaagcccagcacgatttggcaagcgtggccgtcgcaccgccaaaagatgcagtagagctcatgaccatccacaagagtaaagggctggagtttccttacgtctttatcctcaatatggatcaagatttcaacaagcaagactctatgtcagaagtcattctcagtcgtcagaatggtcttggtgtcaaatatattgccaagatggagacaggggcagtagaagaccactatcctaaaaccatcaaactctccattcctagtctgacctataggcagaacgaagaggaattacagctagcaagctattctgagcagatgcgtttgctgtatgttgctatgacgcgggctgagaaaaagctctatcttgtcggcaagggttctcgtgaaaagctggaatccaaggaatacccagcagccaaaaatgggaaactaaatagcaatactagactgcaagcacggaatttccaagattggctttgggctatcagtaaagtgtttactaaggacaagctcaactttagttatcgttttattggcgaagatcagttgaccagagaagctatcggagagttggaaaccaagagtcctctccaagatagctcccaagcagacaatcgtcagtcagataccatcaaagaagctctggaaatgctgaaggaggtggaagtttataatactcttcaccgcgcagctattgaacttcctagtgttcaaaccccaagtcaaatcaagaaattctacgaaccagttatggatatggaaggtgtcgagattgctggtcaaggtcagtcagtaggcaagaaaatcagcttcgatttgccagatttttcaaccaaagaaaaggtaactggagctgagattggtagcgctactcacgaactcatgcagagaattgacctcagccagcaactaacccttgctagcctaacagaaacactcaaacaagttcaaactagccaagctgtcagagacaagatcaatcttgataaaattcttgctttctttgacacagtactcggtcaggaaattcttgctaataccgaccatctctatcgcgagcaacctttctccatgctcaaacgagaccaaaagagtcaggaagactttgttgtccgtggtatccttgatggctatctgctttacgaaaacaaaattgttctgttcgactacaagacagaccgctatgatgaaccaagtcaactcgtagaccgctatcgtggtcagttagctctatacgaagaggctttatcacgagcctattcgattgaaaatattgaaaaatacttgattttactcggtaaagacgaggttcaagttgtaaaagtataa

SEQ ID NO: 1745 - DNA (genomic), 1815 bp, Streptococcus pneumoniae; double-stranded, circular
  misc_feature (B) LOCATION 1...1815
  hypothetical: NO
  anti-sense: NO
agaaataagaggaagaaaatggaacaaaaacaccgttcagaatttccagagaaggaactctgggatttaacagccctataccaagaccgtgaggatttcttgcgtgcaatcgagaaagctcgtgaagacatcaaccagtttagccgtgattacaagggcaatcttcacacttttgaggatttcgagaaggcctttgcggaattggaacagatctacattcagatgagccatattggcaactatgcttttatgcctcagacgacggactatagcaatgacgaatttgccaatattgcccaagctgggatggaatttgaaacagatgccagcgtagccttgaccttctttgacgatgccttggtggtagcagacgaggaagtcttggaccgtttgggtgaattgcctcacttgacggcagctattcgtcaggccaaaatcaaaaaagcccactatctaggggctgatgtggagaaggccttgaccaatctcggtgaagttttctatagtccgcaggacatttatactaagatgcgagctggggattttgaaatggctgactttgaagcccatggcaagacctataaaaacagctttgtcacctatgagaatttctaccaaaatcacgaggatgctgaggttcgtgagaaatccttccgttccttctcagagggacttcgtaagcaccaaaatacggctgcagcagcctatctggctcaggtcaagtctgaaaaactcttggctgatatgaagggatacgactctgtctttgactatcttctagctgaacaagaagtggaccgtgtcatgtttgaccgccagattgacctcatcatgaaggactttgcaccagtcgctcagagatacctcaagcatgttgccaaggtaaatggtcttgaaaagatgacctttgcagactggaaattggacttggacagcgccctcaatcctgaagtgactattgacgatgcctatgatttggtcatgaagtcggtagaacctttggggcaagaatattgtcaggaagttgctcgttatcaagaagagcgctgggtggactttgctgctaacagtggcaaggattccggtggttatgcggcggacccatatcgcgtacacccttatgtactcatgagctggacaggccgtttgagcgatgtctataccttgattcatgaaatcgggcattctggtcaattcatcttttcagacaatcaccaaagctatttcaacgcccacatgtcgacctattatgttgaagcaccgtcgaccttcaatgaattgctactcagtgattacttagagaaccaatctaatgacccacgtcaaaaacgcttcgctctggctcatcgcttgacagacacctacttccataactttatcacccacctcttggaagccgccttccagcgtaaggtgtatacattgattgaagaaggagaaaccttcggagcaagcaaactcaacagcattatgaaggaagttttgacagatttttggggcgatgccattgaaatcgacgacgatgcagctttgacttggatgcgccaagctcactactatatgggcttgtatagttacacttactctgctggtcttgtcatctcgacagctggttaccttcatcttaaaaactcagaaactggagctgaagactggctcaatctcctcaaatcaggtggtagcaagacaccacttgagtcagccatgattatcggtgctgatatttcaacagacaaaccactccgtgataccatccaattcttgtctgacacagttgaccagattatcgcctacagtgctgagttgggggagtaa

SEQ ID NO: 1746 - DNA (genomic), 390 bp, Streptococcus pneumoniae; double-stranded, circular
  misc_feature (B) LOCATION 1...390
  hypothetical: NO
  anti-sense: NO
aaagataagagaacaaataaaatgattaatatcaagcctgttatttataaagaattgcaaaaggttgcagataatgtgaccgatacttatcctagcgattgggagactttcccagtcgttatttttttggaagaacaaaacaagccgggtgattggtttgatgaccaggaacaaaaatcctctatccgctacaaggtggatatctttgatgatactagcactagtgagttagctgttaaaatcaatcagatttttgagtctttaggtttgcgaagaactgactgccaagacgtgccagacccgtctcatttgagacataaggtcatgcgttttgaaggtatcgtcgacttacactcagagcttgtttttcaatttagaatggagaattaa

SEQ ID NO: 1747 - DNA (genomic), 693 bp, Streptococcus pneumoniae; double-stranded, circular
  misc_feature (B) LOCATION 1...693
  hypothetical: NO
  anti-sense: NO
caagtaaagagaggagaagtaaatatggaaacacaagactatgcatttcagccaggtttgactgttggagaattattaaaaagcagtcagaaggattggcaggctgcaatcaatcatcgttttgttaaggaactttttgcggggacaattgagaataaggtcttaaaggactatctgattcaagattatcacttctttgatgccttcttatccatgctgggtgcctgcgtagctcacgcagataaacttgaatccaagcttcgttttgccaagcaactaggctttcttgaagcagatgaagatggttatttccaaaaggcttttaaagagttaaaagtagcagagattatctatctagaagtgactttgcaccctgtaacaaaagcctttcaggatctaatgtattcggcggtggcttcatcagactatgcccatcttttggtcatgctggtcattgcagaaggtctctatttagactggggttctaaagatttggctttacctgaagtctatattcattcggaatggatcaatctccacagaggtcctttctttgcagagtgggttcaatttctggttgacgaactcaatcgtgtcggtaaaaatcgagaagatttgacagaacttcagcaacgctggaatcaagcagtcgctttagaattagctttttttgatattggttacgatgtctag

SEQ ID NO: 1748 - DNA (genomic), 1320 bp, Streptococcus pneumoniae; double-stranded, circular
  misc_feature (B) LOCATION 1...1320
  hypothetical: NO
  anti-sense: NO
ggagtaaagagaggagatattcatatgaaaaactcaaaatttatagaccaatttgccacctttgctggtaaactagggaaccaaattcatttaaaaaccctaagagatgcattcgtaacagtaatgccattatatattttggcaggtttaatcgttcttttgaacaacacggtatttaagtggattttccaaggggatacattaacaagattccaatattggggaataacaattgcaaacggtactttaagtatttcaggtatgattattgctgtaatggttggttatttcttagctaaaaacagagatttcgaaaacccgttagcagcatcaatgctatcattagtttctttaattgtgatgatgccaaatacagtttctgtagttcctgacggagcaaaagatgctgtaaacatttcaggtgttctttcattcaacaacacaggtacaggcgcaatgttcgccggggttatcgtagcgattattgcaacagaattattcattgaattatcaaatgttaaagctttacaaatgaaccttggtgaaaatattccaccagctgttagtagatcatttagcgtattacttccagtcatgaccgtcatctccttatttggggttgtctcagcattattattcaatataactggattgaacttaatctcaatcattacaatctttattcaagaaccaattcgtcatattggtacaagcttaatcggggtcattattatttactctttaggaaatatgttatggctatttggtattcaccaagcagttatttacagtgccatcctagaaccattactattaattaacattactgaaaacatcactgcagcaaataatggacaagccattccacacatcatcaacctatcacaaatacaaacattcgctttaatgggtggtagtggatctacattatgtttattaatagcaacattcttagtgagtcgcaatgctgtctctaaaaacgtggctaaattatcttttggacctggtatcttcaatatcaatgaaccagtattattcggttacccaatcgtttataacatttcattagctattccatttatcacagttccagtccttggtattttaatcagctacttagcaacagttacaggattcatgagtcctgcatttatacaagttccttggactacaccagtattcttaaatgcatggttagcaacagcaggggacgtgagagcagttctagttcaattcatcatctttgcacttggagttcttctatacattccatttatcaaagttaatgacaaagttgttgaacaagaaatggaaggttaa

SEQ ID NO: 1749 - DNA (genomic), 1356 bp, Streptococcus pneumoniae; double-stranded, circular
  misc_feature (B) LOCATION 1...1356
  hypothetical: NO
  anti-sense: NO
tgtagaaagagaagaacgatgaaaaaaatgagaaagtttttatgtctagctggaattgcgctagcggctgttgccttggtagcttgttcaggaaaaaaagaagctacaactagtactgaaccaccaacagaattatctggtgagattacaatgtggcactcctttactcaaggaccccgtttagaaagtattcaaaaatcagcagatgctttcatgcaaaagcatccaaaaacgaaaatcaagattgaaacattttcttggaatgacttctatactaaatggactacaggtttagcaaatggaaatgtgccagatatcagtacagctcttcctaaccaagtaatggaaatggtcaactcagatgctttggttccgctaaatgattctatcaagcgtattggacaagataaatttaacgaaactgccttaaatgaagcaaaaatcggagatgattactactctgttcctctttattcacatgcacaagtcatgtgggttagaacagatttgttaaaagaacataatattgaggttcctaaaacttgggatcaactctatgaagcttctaaaaaattgaaagaagctggagtttatggcttgtctgttccgtttggaacaaatgacttaatggcaacacgtttcttgaacttctacgtacgtagtggtggaggaagcctcttaacaaaagatcttaaagcagacttgacaagccaacttgctcaagatggtattaaatactgggttaaattgtataaagaaatctcacctcaagattctttgaactttaatgtccttcaacaagctaccttgttctatcaaggaaaaacagcatttgactttaactctggcttccatatcggaggaattaatgccaacagtcctcaattgattgattcgattgatgcttatcctattccaaaaatcaaagagtctgataaagaccaaggaattgaaacctcaaacattccaatggttgtttggaaaaattcaaaacatccagaagttgctaaagcattcttagaagcactttataatgaagaagactacgttaaattccttgattcaactccagtaggtatgttgccaactattaaggggattagcgattctgcagcctataaagaaaatgaaactcgtaagaagtttaaacatgctgaagaagtaattactgaagctgttaaaaaaggtactgctattggttatgaaaatggaccaagtgtacaagctggtatgttgactaaccaacacattattgaacaaatgttccaagatatcattacaaatggaacagatcctatgaaagcagcaaaagaagcagaaaaacaattaaacgatttatttgaggctgttcagtag

SEQ ID NO: 1750 - DNA (genomic), 810 bp, Streptococcus pneumoniae; double-stranded, circular
  misc_feature (B) LOCATION 1...810
  hypothetical: NO
  anti-sense: NO
ccaggaaagagggagactggctttcttgcagatgcttgctcaaaccctacagggctttcgttaaaactgtcgaacatcagagggaagactctggtgttttttgctgatgagactataaattttgtaaaaaatgtgataaaatanacgacggataaaataacggaagatagcatgcaaaataaaccaatcattattggagtgacaggtggttctggtggtggtaaaaccagtgtttcaagagccattttatcgcattttcctgatgaaaagatttccatgattgagcatgattcatactacaaggatcagtctcatttgacctttgaagagcgtgtcaaaaccaactatgaccatccttttgcctttgatacagacttgatgatcgagcagattaaggaattgttggcagggcgtccggtggacatcccgacctacgactatacagagcatacacggagtagcaagacctatcgtcaggagcctcaagatgtctttatcgttgagggcattttggtcttggaggacaagcgtctgcgcgatttgatggatatcaagatttttgtggatacggatgacgatgtgcgcattattcgtcgtatcaagcgtgatatggaggagcgtggccgtagccttgatagcgttattaaccagtacttaggtgtggtcaaaccaatgtaccaccagtttatcgagtcaactaagcgttatgctgatatcgtcattcctgaaggggttagcaataccgtggctatcgacctgttgacgaccaagattgcaaagattttggaagaagctcgaaacagcaaataa

SEQ ID NO: 1751 - DNA (genomic), 240 bp, Streptococcus pneumoniae; double-stranded, circular
  misc_feature (B) LOCATION 1...240
  hypothetical: NO
  anti-sense: NO
attttgaagaggagttacacaatggtaaccgtttattctaaaaacaattgtgtccaatgtaaaatgaccaagcgtttcttggacagtaataatgtctcttatcgtgaaatcaatcttgatgagcaacctgagtacgtcgatcaagttaaagagctcggttttagcgcagctcctgttatccaaacaccaactgaagtcttttcaggtttccaaccaggaaaactgaaacaattagcataa

SEQ ID NO: 1752 - DNA (genomic), 198 bp, Streptococcus pneumoniae; double-stranded, circular
  misc_feature (B) LOCATION 1...198
  hypothetical: NO
  anti-sense: NO
agaatgaagagagggatcatctatttctttatcggcctgtcactcttggtatggttagtggaaatgtttactgattggtttgatcaagccttgctttgccaattcattcgtggtgctttggagtttggatttatgattttcgtcgttttccctatgggaatggagtggttgaaaggagagtctcatgacggtggttaa

SEQ ID NO: 1753 - DNA (genomic), 201 bp, Streptococcus pneumoniae; double-stranded, circular
  misc_feature (B) LOCATION 1...201
  hypothetical: NO
  anti-sense: NO
acgatgaagagtagcaccagctggggcatgatacggataaattccagatacaatcgtgttaaaaatcgtatgattctagaatgggaggtcatgatgattcccatgactgttccgaacatcatggataagaggacagacaggatggatatcccaatcgtaacgcccaacccctgtaagattctcaggagattatttccttga

SEQ ID NO: 1754 - DNA (genomic), 1320 bp, Streptococcus pneumoniae; double-stranded, circular
  misc_feature (B) LOCATION 1...1320
  hypothetical: NO
  anti-sense: NO
gaaaggaagagacctgagggctcagacaaaattatgacttcagttgttgttgtaggtacccaatggggtgatgaaggtaaagggaagattacagacttcctttcagcgaatgcagaagtgattgcacgttaccaaggtggtgataatgctggtcacacgattgtgattgacggtaagaaatttaagttgcacttgattccatctgggattttcttccctgaaaaaatatctgtcattgggaatggtatggttgtaaatcctaaatctcttgtaaaagagttgagctatcttcatgaggaaggtgtaacaactgataacttgcgtatttctgatcgtgcgcatgttattttgccttatcatatcgagttggatcgcttgcaagaagaagctaagggcgacaataagattggtacgacaattaagggaattggtccagcttatatggacaaggctgctcgtgttggaattcgtattgcagatcttttagataaagatattttccgtgagcgtttagaacgtaaccttgctgaaaagaatcgtctttttgaaaaattgtatgacagtaaagcgattgttttcgatgatatttttgaagaatattacgaatatggtcaacaaatcaagaaatacgtgatagatacatctgttatcttgaatgatgcgcttgataatggcaaacgtgtgctttttgaaggtgcacaaggtgttatgctagatatcgaccaaggtacttatccatttgttacgtcatcaaaccctgtagctggtggtgtgacaattggttctggtgtcggtccaagcaagattgacaaggttgtaggtgtatgtaaagcttatacgaatcgtgtaggaaatggtcctttcccaactgagttgtttgatgaagtgggagaacgtatccgtgaagtgggtcatgagtatggtacaacaactggtcgtccacgtcgtgtaggttggtttgactcagttgtgatgcgtcataaccgtcgtgtttctggtattactaacctttctttgaactctattgatgttttgagcggtttggatactgtgaaaatctgtgtggcctatgatcttgacggtcaacgtattgactactatccagctagtcttgagcaattgaaacgttgcaagcctatctatgaagagttgccaggttggtcagaagatattaccggagttcgcaatttggaagatcttcctgagaatgcgcgtaactatgttcgtcgtgtgagtgaattggttggcgttcgtatttctactttctcagtaggtcctggtcgtgaacaaacaaatattttagaaagtgtttggtcctaa

SEQ ID NO: 1755 - DNA (genomic), 933 bp, Streptococcus pneumoniae; double-stranded, circular
  misc_feature (B) LOCATION 1...933
  hypothetical: NO
  anti-sense: NO
gtacctgagagcggagaaggccatcctaaaaaagttaagagaactccgattgaaggaggaaaaagagaaagaagaaagacagaaattgttcaagaattaatgactgagttttcgttagatcttcttctaaaagtcattaaactagctcgttcgacctactactatcacttgaaacagctagacaaaacagataaggaccaagagcttaaagctgaaattcaatccatttttatcgaacacaagggaaattatacttatcgccgggttcatttagaactaagaaatcgtggttatctggtaaatcataaaagagttcaaggcttgatgaaagtactcaatttacaagctaaaatgcgacagaaacgaaaatattcttctcataaaggagacgttggcaagaaggcagagaatctcattcaaagccaatttgaaggctctaaaacaatggaaaagtgctacacagatgtgacagaatttgccattccagcaagtactcaaaagctttacttatcaccagttttagatggctttaacagcgaaattatcgcctatcatctttctacttcgcccaacttagaacaagtacaaacaatgttggaacaggcattcacagagaagcactacgagaatacgattctccatagtgaccaaggctggcaatatcaacacgattcttatcatcggttcctagagagtaagggaactcaagcatccatgttacgcaagggaaacagccaagacaacggtatgatggaatctttctttggcattttaaaatcggaaatgttttatggctatgagaaaacatttaaatcacttaatcaattggaacaagccattatagactatattgattattacaacaacaagagaattaaggtaaaactaaaaggacttagccctgtgcaatacagaactaaatccttcggataa

SEQ ID NO: 1756 - DNA (genomic), 933 bp, Streptococcus pneumoniae; double-stranded, circular
  misc_feature (B) LOCATION 1...933
  hypothetical: NO
  anti-sense: NO
gtacctgagagcggagaatgccatcctaaaaaagttaagagaactccgattgaaggaggaaaaagagaaagaagaaagacagaaattgttcaagaattaatgactgagttttcgttagatcttcttctaaaagccattaaactagctcgttcgacctactactatcacttgaaacagctagataaaacagataaggaccaagagcttaaagctgaaattcaatccatttttatcgaacacaagggaaattatgcttatcatcggatttatttagaactaagaaatcgtggttatctggtaaatcataaaagagttcaaggcttgataaaagtactcaatttacaagctaaaatgcgacaaaaacgaaaatattcttctcataaaggagacgttggtaagaaagcagagaatctcattcaaggccaatttgaaggctctaaaacaatggaaaagtgctacacagatgtgacagaatttgccattccagcaagtactcaaaagctttacttattaccagttttagatggctttaatagcgaaattatcgcctataatctttcaacttcacccaacttagaacaagtacaaacaatgttggaacaggcattcacagagaagcactacgagaatacgattctccatagtgaccaaggctggcaatatcaacacgattcttatcatcggttcctagagagtaagggaattcaagcatctatgtcacgcaagggaaacagcccagacaacggcatgatggaatctttctttggcattttgaaatcggagatgttttatggttatgagaagaactttagatctttagaaaaccttgaacaagctattgtggactacattgattactacaacaacaaacgaattaaggtaaaactaaaaggacttagccttgtgcagtacagaactaaatccttcggataa

SEQ ID NO: 1757 - DNA (genomic), 933 bp, Streptococcus pneumoniae; double-stranded, circular
  misc_feature (B) LOCATION 1...933
  hypothetical: NO
  anti-sense: NO
gtacctgagagcggagaatgccatcctaaaaaagttaagagaactccgattgaaggaggaaaaagagaaagaagaaagacagaaattgttcaagaattaatgactgagtttttgttagttcttcttctaaaatccattaaactagctcgttggacctactactatcacttgaaacagctagacaaaacagataaggaccaagagcttaaagctgaaattcaatccatttttatcgaacacaaaggaaattatgcttatcgccgggttcatttagaactaagaaatcgtgcttatctggtaaatcataaaagagttcaaggcttgataaaagtactcaatttacaagctaaaatgcgacagaaacgaaaatattcttctcataaaggagacgttggcaagaaggcagagaatctcattcaaggccaatttgaaggctctaaaacaatggaaaagtgctacacagatgtgacagaatttgccattccagcaagtactcaaaagctttacttatcaccagttttagatggctttaacagtgaaattattgcttttaatctttcttgttcgcctaatttagaacaagtacaaacaatgttggaacaggcattcaaagagaagcactacgagaatacgattctccatagtgaccaaggctggcaatatcaacacgattcttatcatcggttcctagagagtaagggaattcaagcatccatgtcacgtaagggtaacagcccagacaatggtatgatggagtccttctttgggattctgaaatcggaaatgttttacggttatgagaagtcgtttcagtcgtttaagcaattggaacaagctattatagactatattgattactacaacaataaacgaattaaggtaaaactaaaaggacttatccctgtgcaatacagaactaaatccttcggataa

SEQ ID NO: 1758 - DNA (genomic), 516 bp, Streptococcus pneumoniae; double-stranded, circular
  misc_feature (B) LOCATION 1...516
  hypothetical: NO
  anti-sense: NO
tataatgagagaagaaaactgaaaggatttaccatgtcaaaagaagttattgtcgaaagttttgaacttgaccacaccattgtcaaagcaccctatgttcgcttgattggggaagaaacaggaccaaaaggagacatcatctccaattatgatattcgcttggtgcaaccaaacgaagactctatccctactgccggccttcacactatcgagcacctcttagccaaactcatccgtacccgcattgacggcatgattgactgttcaccatttggttgccgcacaggcttccacatgattatgtggggacgtcacaccagtgctaaaatcgcagctgttatcaaggattcgctcaaggaaatcgctgaaactactacttgggaagatgtcccagggacaaccatcgaatcttgcggaaactacaaggaccacagcctcttctctgctaaagaatgggcaaaactcatcttggaacaagggatttcagatgatgcctttgaacgtcatgtgatttaa

SEQ ID NO: 1759 - DNA (genomic), 324 bp, Streptococcus pneumoniae; double-stranded, circular
  misc_feature (B) LOCATION 1...324
  hypothetical: NO
  anti-sense: NO
agcaccgagagatccaaggattgggcgtactgtaaaccagaatactgggtcaccgataccagcaagaggtcccatcataccgattttgaccccttggatagcagcgtcatcgatttccacaccgttagcacgttcttcttcaagcgcaagagtaacccccatgactggagcagctacgtatggatgagtgttgaagaactcaaggtgacgctcaagagcagcgatttgatcttcttttttagtatagagttttttgatagctggaatgagtgtataagcccagcccaagttttgcatccgttcaaagttccaagacccttgtaa

SEQ ID NO: 1760 - DNA (genomic), 225 bp, Streptococcus pneumoniae; double-stranded, circular
  misc_feature (B) LOCATION 1...225
  hypothetical: NO
  anti-sense: NO
aaaacagagagggaagctcatggaagaagattgaaaatcattcaacaacagagtgctacaattgatagtctcaccaatgaacttgcccttctgcgtgaacaagtggcttatctgactcaaaagctctatggaaaatcctctgagaaaagtgtttgcccctctggacaactcaacctttttgaggaagagtctccatctgaggaagatggagatgttcccagttga

SEQ ID NO: 1761 - DNA (genomic), 318 bp, Streptococcus pneumoniae; double-stranded, circular
  misc_feature (B) LOCATION 1...318
  hypothetical: NO
  anti-sense: NO
aaagaagagagttgggacttgaataagcaaaagataagtaatctcttggggcttgctcagcgagcagggcgcatcatatcgggtgaagaattggtggtcaaggccattcaagacggcaaggccaagttggtctttctagctcatgatgctggacccaatctggccaagaagattcaagataaaagtcattattatcaagtagaaattgtaaccgtgttttcaacactggaattaagcatagcagtcgggaaatcgagaaaggttttggctgtaacagatgctggatttacaaagaaaatgaggtctcttatggaatag

SEQ ID NO: 1762 - DNA (genomic), 789 bp, Streptococcus pneumoniae; double-stranded, circular
  misc_feature (B) LOCATION 1...789
  hypothetical: NO
  anti-sense: NO
ggaaaggagagaacgatgaaaaaatttgccaacctttatctgggactggtcttatatggtctctacctgcctatcttttacttgattggctatgcctttaatgctggtgatgatatgaatagctttacaggttttagctggactcactttgaaaccatgtttggagatgggagactcatgctgattttggctcagacatttttcttggccttcctatcagccttgatagcgaccattatcgggacttttggtgccatttacatctaccagtctcgtaagaaataccaagaagcctttctatcactcaataatatcctcatggttgcgcctgacgttatgattggtgctagcttcttgattctctttacccaactcaagttttcacttggctttttgaccgttctatctagtcacgtggccttctccattcctatcgtggtcttgatggtcttgcctcgactcaaggaaatgaatggcgacatgattcatgcggcctatgacttgggagctagtcaatttcagatgttcaaggaaatcatgcttccttacctgactccgtctatcattactggttatttcatggccttcacctattcgttagatgactttgccgtgaccttctttgtaacaggaaatggcttttcaaccctatcagtcgagatttactctcgtgctcgcaaggggatttccttagaaatcaatgccctgtctgctctagtctttctctttagtattatcctagttgtaggttattactttatctctcgtgagaaggaggagcaagcatga

SEQ ID NO: 1763 - DNA (genomic), 1362 bp, Streptococcus pneumoniae; double-stranded, circular
  misc_feature (B) LOCATION 1...1362
  hypothetical: NO
  anti-sense: NO
aaagaggagaggatgaaaccagaatttttagaaagtgcggagttttataatcgtcgttaccataatttttccagtagtgtgattgtacccatggcccttctgctcgtgtttttacttggctttgcaactgttgcagaaaaggagatgagtttgtccactagagctactgtcgaacctagtcgtatccttgcaaatatccagtcaactagcaacaatcgtattcttgtcaatcatttggaagaaaataagctggttaagaagggggatcttttggttcaataccaagaaggggcagagggtgtccaagcggagtcctatgccagtcagttggacatgctaaaggatcaaaaaaagcaattggagtatctgcaaaagagcctgcaagaaggggagaaccactttccagaggaggataagtttggctaccaagccacctttcgcgantacatcagtcaagcaggcagtcttagggctagtacatcgcaacaaaatgagaccatcgcgtcccagaatgcagcagctagccaaacccaagccgaaatcggcaacctcatcagtcaaacagaggctaaaattcgcgattaccagacagctaagtcagctatggaaacaggtgcttccttggccagtcagaatttagcctactctctttaccagtcctacaagtctcagggcgaggaaaatccccaaactaaggttcaggcagttgcacaggttgaagcacagatttctcagttagaatctagtcttgctacttaccgtgtccagtatgcaggttcagctacccagcaagcctatgcgtcagggttaagcagtcaattggaatcccttaaatcccaacatttggcaaaggttggtcaggaattgacccttctagcccagaaatacttggaggcagagtcaggtaagaaggtacagggaaatcttttagacaaggggaaaattacggcgagtgaggatggggtgcttcatcttaatcctgagaccagtgattctagcatggttgcagaaggtgccctactagcccaactttatccatctttggaaagagaagggaaagccaaactcacagcctatctaagttcaaaagatgtagcaagaatcaaggtcggtgattctgttcgctatactacgactcatgatgccgggaatcaacttttcctagattctactattacaagtattgatgcgacagctactaagactgagaaagggaatttctttaaaatcgaggcggagactaatctaacttcggagcaggctgaaaaacttaggtacggggtggaaggccgcttgcagatgattacgggcaagaaaagttatctacgttattatttggatcaatttttgaacaaagagtaa

SEQ ID NO: 1764 - DNA (genomic), 708 bp, Streptococcus pneumoniae; double-stranded, circular
  misc_feature (B) LOCATION 1...708
  hypothetical: NO
  anti-sense: NO
aacgattggagaaatcttatgatatttcgagtgaaagtaaattcttctgtttctaggcctgtaaccgttgaagacatttgcccaaattgtaaaaaaccaaccaatccagatcttgtgaactcttcttatttttctcttggagaaaataaaacaagcttagtattaacatgtagatgcttaggttgtaagcacttttggacagaggagtttatagctacaagatttttaatcaatgactataccgaaaaatacgaaattgaacatatcaaagtaatccctaatcttccgagcgatatacctatatctgacgatgtagagatagtttctccaattggtaagcaaatctatgtccaagcactgaaagctgaacacgaacaactagaccacattgcaggtattggataccgtaaggcgcttgagttctttgttaaagatttctccattgttacaaatcctgatgatgaagataaaatcattaaaatgtcattaaaacaagttattgaaaaatatatcaaggatgaagaccttaaaacatttgcgcttgcatctgcttatatcggtaacgacgaaggtcattactatagaaataatcctgataaaggttttacagacctaaagaactacctacacggagttattcactacatggaaatgaaactcaatttccttgatgctcaagagcttgtgaatcgttcaaagaaatcttag

SEQ ID NO: 1765 - DNA (genomic), 864 bp, Streptococcus pneumoniae; double-stranded, circular
  misc_feature (B) LOCATION 1...864
  hypothetical: NO
  anti-sense: NO
caaagatggagaatttctatgacttggaagattattgctgactctggttgtgattatcgtcaactgccaacaccagctattaacacaacctttgtaagtgtccccttaaccattcaagtagctgatcaggtctttgttgatgacgccagtctcgatattgaccaaatgatggaaaccatgtatgcaactgcagaagcttcaaaatcggcttgtccaagcccagatgactatttgcgagcatttgaaggtgccaaaaacattttcctagtaaccatcacaggtaccctttctggcagtcacaatagtgctcaactagcaaagaatatttatctggaagaccatcctgacactaagattcatgtgattgatagtttatctgctggtggtgaagttgacctactcgtagaaaaattgaatgacttgattgaccagggcttgtcttttgaagaagtggttgaagctatcaccgcctatcaagaaaaaactaagttgctctttgtcctagccaaagtcgataacttggtgaagaacggccgtttgagcaagcttatcggtacggtcgttggccttctcaacattcgtatggtcggaaaagctagtgaaactggaactctcgaattgctacaaaaagcaaggggatcaaagaaatcagttcaagctgcctatgatgagttagtaaaagctggatatgctggtggccgtattgtcatggcccaacgcaataacgaaaaatgttgtcaacaactctcagagcgaatccgtgaaaccttcccacaagcggatattaaaattctaccaacctctggtctctgcagtttctatgcagaagatggcggtttgctgatgggctatgaaattgattaa

SEQ ID NO: 1766 - DNA (genomic), 1821 bp, Streptococcus pneumoniae; double-stranded, circular
  misc_feature (B) LOCATION 1...1821
  hypothetical: NO
  anti-sense: NO
aaaggatggaggaatctaatggtattacaaagaaatgaaataaatgaaaaagatacatgggatctatcaacgatctacccaactgaccaggcttgggaagaagccttaaaagatttaacagaacaattggagacagtagcccagtatgaaggccatctcttggatagtgcggataacctactagaaatcactgaattttctcttgaaatggaacgccagatggagaagctttacgtttatgctcatatgaagaatgaccaggatacacgtgaagctaagtatcaagagtactatgccaaggccatgacactctacagccagttagaccaagccttttcattctatgagcctgaatttatggagattagcgaaaagcagtatgctgactttttagaagctcaaccaaagctgcaggtttatcaacactattttgacaagctcttgcaaggcaaggatcacgttctttcacaacgtgaagaagaattattggctggagctggagaaatctttggttcagcaagtgaaaccttctctatcttggacaatgcggatattgtgttcccttatgtcctagacgatgatggtaaagaagttcagctatctcatgggacttacacacgtttgatggagtctaaaaaacgtgaggttcgccgtggtgcctatcaagctctttatgcgacttacgaacaattccaacacacctatgccaaaaccttgcaaaccaatgttaaggtgcaaaattaccgtgctaaagttcgtaactacaagagtgctcgtcatgcagccctcgcagcgaattttgttccagaaagtgtttatgacaatttggtagcagcagttcgcaagcatttgccactcttacatcgctatcttgagcttcgttcaaaaatcttggggatttcagatctcaagatgtacgatgtctacacaccgctttcatctgttgaatacagttttacctaccaagaagccttgaaaaaagcagaagatgctttggcagtcttgggtgaggattacttgagccgtgtcaaacgtgccttcagcgagcgttggattgatgtttacgaaaatcaaggcaagcgttcaggtgcctactctggtggttcttatgataccaatgcctttatgcttctcaactggcaggacaatctggacaatctctttactcttgttcatgaaacaggtcacagtatgcattcaagctatactcgtgaaactcagccttatgtttacggagattactctatctttttggctgagattgcctcaactaccaatgaaaatatcttgacggagaaattattggaagaagtggaagacgacgcaacacgctttgctattctcaataacttcctagatggtttccgtggaacagttttccgccaaactcaatttgctgagtttgaacacgccattcaccaagcagatcaaaatggggaggtcttgacaagcgatttcctaaataaactctacgcagacttgaaccaagagtattatggtttgagtaaggaagacaatcctgaaatccaatacgagtgggctcgtattccacacttttactataactactatgtatatcaatattcaactggatttgcggccgcctcagccttggctgaaaaaattgtccatggtagtcaagaagaccgtgaccgctatatcgactacctcaaggcaggtaagtcggactatccacttaatgtcatgagaaaagctggtgttgatatggagaaggaagactacctcaacgatgcctttgcagtctttgaacgccgtttaaatgagtttgaagcccttgttgaaaaattaggattggcataa

SEQ ID NO: 1767 - DNA (genomic), 1761 bp, Streptococcus pneumoniae; double-stranded, circular
  misc_feature (B) LOCATION 1...1761
  hypothetical: NO
  anti-sense: NO
atctgtcggagaaagtgtggaattatttatcacaccatcagacgttctgcaattttaaggaggtgcagtatgcgtcataaattaaatttaaaagattggcttattcgtttagggttaatctggttcttagtaacatttattatttatccaaactttgatctagtagtgaatgtatttgtaaaaggaggagaattttcccttgatgctgtacatcgtgttctaaaatctcagagggcacttcagagtattatgaacagttttaagttagcattttcactcattattacagttaatgtcgtaggtattctttgtgttctatttacagagtactttgatattaaaggtgctaaaattttaaaattaggttatatgacctctttaatttatggaggagtggttttagcgactggatataaatttgtctatggtccatatggattgattacaaaatttttacaaaatgttatcccttctttagaccctaactggtttattgggtatggtgcagtcttattcattatgacattttcaggaactgctaatcatacattgtttttaacaaatacaattcgaagcgttgactatcacactattgaggctgctcgaaatatgggagcaaaaccatttactgttttccgaaaagtagtgttaccaaccttaattccaactctatttgcacttactattatggtttttcttagtggtttatctgcagtagcagcacccatgattgttggtggtaaagaatttcaaactataaatccaatgattattacatttgcagggatggggaattctcgtgatttagctgccttacttgcaattattttaggtattgcaactacaattttgcttactatcatgaataagatagaaaaaggaggaaattatatttctatctctaagactaaagcgcctcttaaaaaacaaaaaattgcgtctaagccttggaatatcattgctcacattgtagcatatggattgttcacagttttcatgcttccactaatttttatagtattatactcatttacagatccagttgcaattcaaacaggtaacttaacattatcaaactttactttagaaaattatcgcttattctttagtaatagtgcggcattctctccattcttggtcagctttatttattctattattgctgcgacaacagcaacaattctcgcagttgtatttgctcgtgttgtcagaaaacataaatctcgttttgatttcttatttgaatatggtgctctacttccttggttactaccaagtacacttttagcagtaagtttattatttacttttaatcagccacaatttcttgtcttgaatcagattttggtaggtagtttggtaattctacttattgcatatatagttgtaaaaatcccattttcttatagaatggtacgtgctattttatttagtgttgatgatgagatggaagatgcagcaagaagtatgggtgcttcacctttttatactatgatgaaggttatcattccatttattttaccggttgttctctctgttattgctttaaactttaactctttattaactgacttcgacttatctgtattcctttaccatcccctagctcaaccattaggtattacgattcgatctgcaggtgatgaaacagcaacatctaatgcacaagctctggtatttgtttatacaattgttctgatgattatttctggaacggtattatacttcacacaaagaccggggcgtaaagtaaggaaataa

SEQ ID NO: 1768 - DNA (genomic), 1236 bp, Streptococcus pneumoniae; double-stranded, circular
  misc_feature (B) LOCATION 1...1236
  hypothetical: NO
  anti-sense: NO
ttgaaacggagaaaaaaagaggagcgagtcctgctgattggtgtggaattgcagggtatggacagttttgacctctccatggaagaattggctagtttagcgaaaacggcaggggcagtcgttgtagatagctacagacaaaaacgtgaaaaatatgattccaagaccttcgtcggctctggtaagttggaagagattgcgcttatggtggatgcagaagaaatcactactgtcatcgtcaacaatcgtctgaccccaaggcagaatgtcaatctagaggaagttctcggtgttaaggtcattgaccgtatgcagttgattttggatatctttgccatgcgggctcgaagccatgaagggaagctccaagtccacctagcccaattcaaatacctcttgcctcgcttggttggtcaggggattatgctcagccgtcaggcagggggaattggttcccgtggtcctggtgaaagccaactggagctgaaccgtcgtagcgttcgcaatcaaatcacggatatcgagcgccagcttaaggtggttgagaaaaatcgtgcgactgtcagagaaaaacgtttggagtctagcacttttaagattggtttgattggttatactaatgctgggaaatcaactatcatgaacatcttgaccagtaagacccagtatgaagcagatgagctctttgcgactctggatgcgacaaccaagagtattcatctgggaggcaatctccaagtaactttgacagataccgttggctttatccaagatttgccgacagagttggtgtccagtttcaagtcaaccttggaagaaagcaagcatgtggaccttctggttcatgttatcgatgctagcaatccttaccacgaggagcatgaaaaaacggttctctccatcatgaaagacctggacatggaagatattcctcacttgacgctttataataaagcggatttggtggaggatttcacgcctacccaaacgccatataccctcatttctgccaagtctgaggacagtcgtgaaaacttgcaagcattattgctagataagattaaggaaatttttgaagcatttaccctgcgagtgcctttttcaaagtcctacaagattcatgatttagagagtgttgcaattctggaagaacgtgattatcaggaagacggcgaagtgattacaggctacatttccgagaaaaataaatggaggttagaagaattttatgactga

SEQ ID NO: 1769 - DNA (genomic), 1347 bp, Streptococcus pneumoniae; double-stranded, circular
  misc_feature (B) LOCATION 1...1347
  hypothetical: NO
  anti-sense: NO
agctttaggaggaggagcagtaaaaggatgaaacatacacttgaaactatcaatagtagaactcagtggtttagagaagcaagatttgggatgttcattcattgggggttatattctattccaggaaaaggggaatggattcgtagtcatcagaaattatctattgaagattatgaaccatattttcgagcttttgatcctaaggaatataaccctagagaatgggctaaacaagcaaaagctgcagggatgaagtatatggttttaacggctaaacatcatgatgggttttgtttgtttgattcaaaatttacagattataaagcaacaaatacacctgcaggtagagatttagttaaagaatttgtagatgctgttcgagctgaaggtttaaaagtaggcttatattttagtttgattgactggcaccatcctgatttccctaaatatgctgatctaaatcatccaatgagaggaaatgaagcctatcgagatgagaaaattaactttgacagttatttggagtatttacacaatcaagttaaagaaattgtaactggttatggtcagattgacatattatggtttgattattcttatgaagacatggtgggtgaaaaatggggagcttcaaaattaatagacatggttcgtcattatcagccaaacgttatcgtagataatagattagaaacatcaggtgaaggattcggaagtatcgttacagatgaaattacctcttacgctggagattttgttagtccagagcaaattgttcctcacgaaggtattcgaaactttaaaggtgaacctgttccttgggaactttgtctaactatgaataacaattgggcttataatcctacagattatctatataagtctagtcaaactttgataagaaagttagtggaatgtgttagtaaaaacggaaatatgattcttaatgtaggcccagatgctttgggaagaattaatgattcaagtaagaaaatattagataattttcatcgatggatgtctcgaaatggtgaggcaatttatggatgtagtggagatgaaaatttaccaaaaccagattggggatactatactcgtaatggaaatacggtttatgctcatgtatttgaacaacctataggtcctttagctcttcttggtattagtaaagaaaacgtaaaaagaatgagctttcttcatgatggaagtgaggtgaaaatttcagaaagctggacgaccaatgcctacaaaggaatttgttttgcacagtttggagaagttccacattttacctatccattaccagacttgattgatagcgtaatcaaaattgagttgagagagtag

SEQ ID NO: 1770 - DNA (genomic), 654 bp, Streptococcus pneumoniae; double-stranded, circular
  misc_feature (B) LOCATION 1...654
  hypothetical: NO
  anti-sense: NO
tataataggagtatgattacaatagttttattaatcctagcctatctgctgggttcgattccatctggtctctggattggacaagtattctttcaaatcaatctacgcgagcatggttctggtaacactggaacgaccaacaccttccgcattttaggtaagaaagctggtatggcaacctttgtgattgactttttcaaaggaaccctagcaacgctgcttccgattatttttcatctacaaggcgtttctcctctcatctttggacttttggctgttatcggccataccttccctatctttgcaggatttaaaggtggtaaggctgtcgcaaccagtgctggagtgattttcggatttgcgcctatcttctgtctctaccttgcgattatcttctttggagctctctatcttggcagtatgatttcactgtctagtgtcacagcatcgattgcggctgttatcggggttctgctctttccactttttggttttatcctgagtaactatgactttctcttcatcgctattatcttagcacttgctagtttgattatcattcgtcataaggacaatatagctcgtatcaaaaataaaactgaaaatttggtcccttggggattgaacctaacccatcaagatcctaaaaaataa

SEQ ID NO: 1771 - DNA (genomic), 1962 bp, Streptococcus pneumoniae; double-stranded, circular
  misc_feature (B) LOCATION 1...1962
  hypothetical: NO
  anti-sense: NO
acgaataggaggttccttgtgtcaaaaaaggaaatcaatattaacaattataatgatgatgctattcaggtgctagaagggttggatgcggtccgaaaacgtccggggatgtatattggatcgaccgatggcgctggtcttcatcacctagtttgggaaatcgttgataatgcagtcgatgaagccttgtctgggtttggtgatcgtattgatgtaactatcaataaagacggtagtctaacggttcaagaccatggacgtgggatgccgacaggtatgcacgctatgggaattccaactgttgaggttatctttaccattcttcatgccggagggaaattcggtcaaggtggctataagacatcaggtggacttcacggagtgggttcttccgttgttaacgccctttctagctggttagaagttgaaattacccgtgatggcgcagtttacaagcaacgtttcgaaaatggtggaaaacctgtcacgactttgaagaaaatcggtacagcacccaagtctaaaacaggcaccaaagttacttttatgcctgacgcgactatattttctacgacagatttcaagtacaataccatttcagagcgccttaatgaatcagcctttctcttgaaaaatgtgaccttgtctttaacggacaagcgaacagatgaagcgattgagttccactatgagaatggagtacaagattttgtttcttatctcaacgaagataaggaaatcttgacgccagttctttactttgaaggggaagacaatggttttcaagtggaagtagccctccagtacaatgacggattctcagataacattctatcctttgtcaataacgttcgcaccaaggacggtggaacgcacgagacaggactcaagtctgccattaccaaggtcatgaatgactatgcacgtaaaacaggtcttctcaaggaaaaagataaaaaccttgaaggttcagactatcgtgagggactagcggccgttctttctatcttagttcctgaagaacacttgcagtttgaaggacagaccaaggataaactaggaagccccctagctcgcccagttgtggatggaatagtggctgataagttgacctttttccttatggaaaatggggaattagcttctaacctcatccgcaaggctatcaaggcccgtgatgctcgtgaagcagcacgtaaggcgcgtgatgagagccgaaatgggaagaaaaacaagaaagataagggcttgttgtctgggaaattgaccccagcccaatctaagaatcctgctaagaatgaactctatctagttgagggggactctgccggtggttctgccaaacaaggtcgtgaccgcaagttccaggctattctacctcttcgtggtaaggttatcaatacagccaaggccaagatggcggatatcctcaaaaatgaagagatcaataccatgatttataccattggtgcgggtgttggagcagacttctctattgaagatgccaactatgataagatcattatcatgaccgatgcggataccgacggtgcccatatccagaccttgctcttgacatttttctaccgttacatgcgtccgctagtcgaggcaggtcatgtctatattgccctcccacctctttacaagatgtccaaaggtaaaggaaagaaagaagaagtggcctacgcttggacggacggagaactagaagaactccgtaaacagttcggtaaaggcgctaccctccaacgatacaaaggacttggtgagatgaatgcggaccagctctgggaaacaaccatgaacccagaaacacgtaccctcatccgtgtcacaattgaagatttagcgcgcgccgaacgccgcgtcaatgttctcatgggagataaggtagaaccacgccgtaaatggattgaagataatgtcaagtttacgctagaagaagcgacagtgttttaa

SEQ ID NO: 1772 - DNA (genomic), 990 bp, Streptococcus pneumoniae; double-stranded, circular
  misc_feature (B) LOCATION 1...990
  hypothetical: NO
  anti-sense: NO
ccatgtaggagatacagatacagccctagaagaattggaacgtttaatttcccaaaagagaagaatggagtaataatggcaacaaaacaaaaagaagtaacaacatttgacgtacaggtagcagaatttatccgtaatcataagcaaaaagggacagcaacagatgatgaaatcaatgcaagtttggttattccttttaccttggacgctgatgggattgaagatctcttgcaacggattcaggatgcaggaatttctatcacagataacgaaggaaatccaagtgcgcgtgttcttagcaatgaagaagaaccagaactcagcgatgaggacttgattgggtcaacttctgctaaggtcaatgaccctgtccgtatgtacttgaaagaaataggggtcgttcctctcttgaccaatgaagaggagaaagagttggcactggctgttgaagctggtgatatcgaagccaaacaacgtcttgcggaagccaatcttcgtttggttgtttccattgccaaacgctatgtcggtcgtggtatgcagttccttgacttgattcaagaaggaaatatgggcttgatgaaggcggttgacaagtttgactattctaaagggttcaagttttcaacttatgcaacttggtggattcgtcaggctatcactcgtgctattgcagaccaagctcgtaccatccgtatcccagttcacatggttgaaactatcaataaattggttcgtgaacagcggaatctccttcaagaattggggcaagatccgacaccagaacagattgctgaacgaatggatatgacacctgataaggttcgtgaaatcttgaagattgcccaagaaccagtatctcttgaaactcctatcggtgaagaggacgatagccaccttggagactttatcgaagatgaagtgattgaaaatccagtggatctcatacgactcgtatcgtcttgcgtgagcaattggatgaaatcttag

SEQ ID NO: 1773 - DNA (genomic), 1383 bp, Streptococcus pneumoniae; double-stranded, circular
  misc_feature (B) LOCATION 1...1383
  hypothetical: NO
  anti-sense: NO
aatagtaggagtagaaatggagttcgagacatgaaagtaatagatcaatttaaaaataagaaagtccttgttttaggtttggccaagtctggtgaatctgcagctcgtttgttggacaagctaggtgccattgtgacagtaaatgatgggaaacctttcgaggacaatccagctgcccaaagtttgctggaagaagggatcaaggtcattacaggtggccatcctttggaactcttggatgaagagtttgcccttatggtgaaaaatccaggtatcccctacaacaatcccatgattgaaaaggctttggccaagggaattccagtcttgactgaggtggaattggcttatttgatttcagaagcaccgattattggtatcacaggatcgaacggtaagacaaccacaacgactatgattggggaagttttgactgctgctgggcaacatggtcttttatcagggaatatcggctatccagctagtcaagtggcccaaactgcgtcggacaaggacacgcttgttatggaactttcttctttccaactcatgggtgttcaagaatttcatccagagattgcggttattaccaacctcatgccaactcatatcgactaccatgggtcattttcggaatatgtagcagccaagtggaatatccagaacaagatgacagcagctgatttccttgtcttgaactttaatcaagacttggcaaaagacttgacttccaagacagaagccactgttgtaccattttcaacacttgaaaaggttgatggagcttatctggaagatggtcaactctacttccgtggtgaagtagtcatggcagcgaatgaaatcggtgttccaggtagccacaatgtggaaaatgcccttgcgactattgctgtagccaagcttcgtggtgtggacaatcaaaccatcaaggaaactctttcagccttcggtggtgtcaaacaccgtctccagtttgtggatgacatcaagggtgttaaattctataacgacagtaaatcaactaatatcttggctactcaaaaagccttgtcaggatttgacaacagcaaggtcgtcttgattgcaggtggtttggaccgtggcaatgagtttgacgaattggtgccagacattcctggactcaagaagatggtcatcctgggtcaatctgcagaacgtgtcaaacgggcagcagacaaggctggtgtcgcttatgtggaggcgacagatattgcagatgcgacccgcaaggcctatgagattgcgactcaaggagatgtggttcttcttagtcctgccaatgccagctgggatatgtatgctaactttgaagtacgtggcgacctctttatcgacacagtagcggagttaaaagaataa

SEQ ID NO: 1774 - DNA (genomic), 255 bp, Streptococcus pneumoniae; double-stranded, circular
  misc_feature (B) LOCATION 1...255
  hypothetical: NO
  anti-sense: NO
attttcaggagaataaaagagatgacagaaaaagaaatttttgaccgtattgtgaccattatccaagagcgacagggagaggactttgtcgtgacagaatccttgagtctgaaagacgatttggatgcggattctgttgacttgatggagtttatcttgactctggaagatgaatttagtatcgaaatcagcgatgaagaaattgaccaactccaaaacgtaggagatgtggttaaaatcattcaaggaaaatag

SEQ ID NO: 1775 - DNA (genomic), 864 bp, Streptococcus pneumoniae; double-stranded, circular
  misc_feature (B) LOCATION 1...864
  hypothetical: NO
  anti-sense: NO
attataaggagattagactgtattgcctactgtctatctataaaatatattttattggaggcttttactcaaatggcaaaagaaaaatacgatcgtagtaaaccacacgttaacattggtactatcggacacgttgaccacggtaaaactaccctaactgcagctatcacaactgttttggcacgtcgcttgccttcatcagttaaccaacctaaagactatgcgtctatcgatgctgctccagaagaacgcgaacgcggtatcactatcaacactgcgcacgttgagtacgaaactgaaaaacgtcactacgctcacatcgacgctccaggacacgcggactacgttaaaaacatgatcactggtgctgctcaaatggacggagctatccttgtagtagcttcaactgacggaccaatgccacaaactcgtgagcacatccttctttcacgtcaggttggtgttaaacaccttatcgtcttcatgaacaaagttgacttggttgacgacgaagaattgcttgaattggttgaaatggaaatccgtgacctattgtcagaatacgacttcccaggtgacgatcttccagttatccaaggttcagcacttaaagctcttgaaggtgactctaaatacgaagacatcgttatggaattgatgaacacagttgatgagtatatcccagaaccagaacgtgacactgacaaaccattgcttcttccagtcgaggacgtattctcaatcactggacgtggtacagttgcttcaggacgtatcgaccgtggtatcgttaaagtcaacgacgaaaactatattgttggtatcaaagaagaaaacctcgaaccccttgtttccgggtgttga

SEQ ID NO: 1776 - DNA (genomic), 486 bp, Streptococcus pneumoniae; double-stranded, circular
  misc_feature (B) LOCATION 1...486
  hypothetical: NO
  anti-sense: NO
agaaaaaggagaaaagagatgactgaaaaaagactggcctgggatgagtattttgcagcccaagctttactaattgcgaatcgttccacttgtaaacgtgctaaagtgggcgcgattttggtaaaagataataaggttatttccactggttacaatggttcggtgtcagggactgagcattgtattgatcacgaatgtttggtcattgaaggccactgtgttcgcacccttcacgctgaggtcaatgctatccttcaaggtgctgagcgtggtgttcccaaaggttttacagcctatgtaacccattttccttgtttcaactgtacaaaacaattgcttcaggtcggctgcaagcgtgtggtttatatcaaccagtaccgaatggacgactacgcccaatacctttatcaagagaaagggacagaattgacccatttaccacttgagacagtacagacagctcttaaagaggctgatctaatgtaa

SEQ ID NO: 1777 - DNA (genomic), 495 bp, Streptococcus pneumoniae; double-stranded, circular
  misc_feature (B) LOCATION 1...495
  hypothetical: NO
  anti-sense: NO
agtaggaggagttggatggaaatcaaaaatcactttggggtctactgtgtttgctttgaaaatggaaagttactttgtattgaaaaaacgagaggcccttatcaacatcggtatgatctacctggaggcagtcagcaacttggtgaaggactgacggaaacgctgactagagaagttatggaagagacgggatttactgttagaagctactctaatcctcgaatctacgatgttttcgtcagagaagagttaaaaaattttatggttcaccatgtcatggccttgtatgatgttgaaatgaatgagagtgcacctcaagttacgatttcggaagctgtgtctgatggtgcgaatgattcacttggatatatttggatggatattcaagagattacagaagaaaatgcatcgccattagtcttgaaggttaagtctgaattattaggatttccagaactggacaagacttcttacatgaattggaaggtgaagtag

SEQ ID NO: 1778 - DNA (genomic), 183 bp, Streptococcus pneumoniae; double-stranded, circular
  misc_feature (B) LOCATION 1...183
  hypothetical: NO
  anti-sense: NO
ttcttagggagctatttttattttttcaagaagttatcttcttgtattttatactcaatgaaaatcaaagagcaagctaggaaactagccgtaggctgctcaaaacactgttttgaggttgtagataagactgacaaagtcaggaacacatatctacggcaaggcgacgttgacgcggtttga

SEQ ID NO: 1779 - DNA (genomic), 543 bp, Streptococcus pneumoniae; double-stranded, circular
  misc_feature (B) LOCATION 1...543
  hypothetical: NO
  anti-sense: NO
gaaacagggagaaataagatgacagattattatgtaattggagatgttcacggaaaagctgggatgctggaagaccttcttaaaacctgggatggtcagacccagttgctctttctaggtgatttgattgacagaggtgaggatagtcaccgtgttcttgaaatggtcaaggacttggtggacaatcaaggggctatctgtttgtctggaaaccacgagtatatgtttttgacttggctagattacccagaagaaagttatgaccattatcgtcgcaatggtggagatacaaccattaagtctatcctaggtcgtcccttggatgcaccagttgatggagtagaagatgccaagcgggttgccgctgaagcggcagacttggtcgaattcattcgtcaaatgccatttgtagtagagacagacaagtatatctttgttcacgcaggtattgatttgaccttggacgactggcatgaaacaacagattataaaaaagtatggcttagaagaccattccacggaggtgcaaattatactggatag

SEQ ID NO: 1780 - DNA (genomic), 444 bp, Streptococcus pneumoniae; double-stranded, circular
  misc_feature (B) LOCATION 1...444
  hypothetical: NO
  anti-sense: NO
agaggggggagttgtcgtttgactagtcgtgtatttattgatgcagattgtatttcagtatttttatgggttggcactgaacatcttttagaaaagctctatttgggtaaaattgttattccacaagaggtgtatgatgaaatcaatatacctacaattccccatttaaaatctaggatagaccagttggtaactaagggttcagctgagattgtgagcatagacattggaactgaagaatacgcattatatagagatttaacaagaaatcatgatagtaacaagattattggtaagggagaagcgacttctattttcttagcgaaaaagcataatgggatattaggaagtaataacctaagagatgttaaaccatatgtagaagaattttctttagaacatatgacaacaggagatatactgattgaagcgtttaaagcgtaa

SEQ ID NO: 1781 - DNA (genomic), 471 bp, Streptococcus pneumoniae; double-stranded, circular
  misc_feature (B) LOCATION 1...471
  hypothetical: NO
  anti-sense: NO
acgtcttttgggtctggacatccagtcatgattccctcgacacctgcaggaattatggaaatgtttcatgaatatgggattgacttggaaggtaaaaatgcggtcgtaatcggtcgttcaaatatcgttggaaaacctatggctcagcttcttttggctaaaaatgcgacagtaaccttggcccactcacgaactcataatcttgccaaggtggctgctaaagcagatattcttgtagtcgcaatcggccgcgccaagtttgtgactgctgactttgtcaaaccaggtgcggttgtcattgacgttgggatgaatcgagatgaaaatgggaagctctgtggagatgttgattatgaggcagttgcaccacttgctagccatatcacgccagtccctggaggtgtcggtcctatgacccattaccatgctgatggagcaaacttatcaagcagcacttcggacattggatag

SEQ ID NO: 1782 - DNA (genomic), 546 bp, Streptococcus pneumoniae; double-stranded, circular
  misc_feature (B) LOCATION 1...546
  hypothetical: NO
  anti-sense: NO
gaaacttttggaggtatttccatcatggcaaagcaaaccatcattgtaatgagcgattcccatggcgatagcttgattgtggaagaagtccgtgatcgctatgtgggcaaagtcgatgccgtttttcataacggcgattctgaactacgtccggattctccactttgggagggcatccgcgttgttaaagggaacatggacttctacgccggctacccagaacgtctggtgactgagcttggttcgaccaagattatccaaactcatggtcacttgtttgacatcaatttcaactttcaaaagttggactactgggctcaggaggaagaggccgctatctgcctctatggtcacttgcatgtgccaagtgcttggatggaaggcaagatcctctttctaaatccaggttctatcagccaaccacgaggtaccatcagagaatgtctctatgctcgtgtggagattgatgatagttacttcaaagtggactttttgacacgagatcacgaggtgtatccaggtttgtccaaggagtttagccgatga

SEQ ID NO: 1783 - DNA (genomic), 903 bp, Streptococcus pneumoniae; double-stranded, circular
  misc_feature (B) LOCATION 1...903
  hypothetical: NO
  anti-sense: NO
tcgggttttggatgtgaccaagctaagcccagaggaaattatagaggaactaagatgaaaattgcttatctaggtcccaaaggatcattttcacaccacgttgtgcagacagcttttcctcatgaggaattgcaggcttttgccaacattacagatgtcatcaaggcttatgagcaaggattagtggactattctgtggtgccagttgaaaattctattgagggtagtgttcatgaaaccttggactatctttttcatcaggctcacatccaagcagtagcagaaatcgttcagcctattcatcagcagttgatggtggttccaggccatactaagattgaaaagattttttcacatccacagggcttggctcaaggaaagaaattcatcgatgaacaatatccagaggctcaaatcgaggtaacagctagtacagcttatgcggcccgttttatttccgaacatccagaccagccctttgcagcagttgcacctagaagttctgctgaagaatatggattggaactgattgccgaggatattcaggaaatggaagccaatttcacacgtttctgggttctaggagctgaaaagcctagtattcccttgcaagcacaaactgaaaagatgagtttggccttgacattacctgacaaccttccaggtgcactttataaggccttgtcgacctttgcttggcgaggaattgacttgacaaaaattgaaagtcgtccactcaagacagcactgggtgaatactttttcattatcgatgtggattatatcgataaggacttggtccactttgcccaaaaagaattagaagcgattggaatccagtataaaattctgggtgcctatcctatttatccaatatcagaccatggaaaggagagaagatga

SEQ ID NO: 1784 - DNA (genomic), 756 bp, Streptococcus pneumoniae; double-stranded, circular
  misc_feature (B) LOCATION 1...756
  hypothetical: NO
  anti-sense: NO
aaagtatttggaggaggaagaattatgttgaatcaggatctctttgattcgcttgaggcacaaaaaattgtagatactttgatgaaagggcaaaaagattatgtagatgaacgtctagaaaaaagagagacaatgatagtgtcgaatggttatgcatggacgcgacctaatcatattgatactgcatttgcatcagcagatttgtttgagtataaattacaattagcaggacagacttggggatatttagaatttgaaacaaatacagaaaaatatgggaaagtattgttaattataaagggtaagaagcgacttacgaaccaatttcctttggtacaaaaaaataagagtggctacttatttgaatatgctcagatgaatacactttatcttaatcaacattcttcctacaaaaatgatgaagatagtcattcctttccaattcagatggagttagtttctgatgaaatgattcaagaaattgaacaagctactaaaaattcgaatatcgaaaaatttatgattttaacttatgaggcggactcagaaaacaatattatatctgtagatgttgttatgcctgatgcacgaactggtcagttacacttgattcaagatttgtctgagtatattcaatcaagttcgtaccatttcgaagaagctaaatatcaagatattcctaatttttcagaattatcggaaacagaagattttgaaattattccaagaatagaaaaacaagaaggtcaaaagtag

SEQ ID NO: 1785 - DNA (genomic), 192 bp, Streptococcus pneumoniae; double-stranded, circular
  misc_feature (B) LOCATION 1...192
  hypothetical: NO
  anti-sense: NO
agaaaatttggaatctatttgcttattatcaatcgtttttttagcttatttgtcttagattggtatagaactgagctatggattaatactcttgtatcttatcctgttcctaaatatgttggtagaaaaatgaagcagttgttacgagtgtctgtattggaaaaaattttgtctatagaattctttaaatga

SEQ ID NO: 1786 - DNA (genomic), 192 bp, Streptococcus pneumoniae; double-stranded, circular
  misc_feature (B) LOCATION 1...192
  hypothetical: NO
  anti-sense: NO
aagattcttggctgggatataacgagaaactccattctcctcaaagacataaccatcgcctacttttcgaacagcttctttgaccaatttctcatcaattggattgcttggagctggttgaggatttggtgcaggttgcggacttggactaggttctggagtcggttgtggacttggttcttctggtcttga

SEQ ID NO: 1787 - DNA (genomic), 192 bp, Streptococcus pneumoniae; double-stranded, circular
  misc_feature (B) LOCATION 1...192
  hypothetical: NO
  anti-sense: NO
aagatccttggctgggatataacgagaaactccattctcctcaaagacataaccatcgcctacttttcgaacagcttctttgaccaatttctcatcaattggattgcttggagctggttgaggatttggtgcaggttgcagacttggactaggttccggagtcgattgtggacttggttgttctggtcttga

SEQ ID NO: 1788 - DNA (genomic), 1914 bp, Streptococcus pneumoniae; double-stranded, circular
  misc_feature (B) LOCATION 1...1914
  hypothetical: NO
  anti-sense: NO
ggaaaccttggagagattgagaaagtaagaatgaaaaagaaattaactagtttagcacttgtaggcgcttttttaggtttgtcatggtatgggaatgttcaggctcaagaaagttcaggaaataaaatccactttatcaatgttcaagaaggtggcagtgatgcgattattcttgaaagcaatggacattttgccatggtggatacaggagaagattatgatttcccagatggaagtgattctcgctatccatggagagaaggaattgaaacgtcttataagcatgttctaacagaccgtgtctttcgtcgtttgaaggaattgggtgtccaaaaacttgattttattttggtgacccatacccacagtgatcatattggaaatgttgatgaattactgtctacctatccagttgaccgagtctatcttaagaaatatagtgatagtcgtattactaattctgaacgtctatgggataatctgtatggctatgataaggttttacagactgctgcagaaaaaggtgtttcagttattcaaaatatcacacaaggggatgctcattttcagtttggggacatggatattcagctctataattatgaaaatgaaactgattcatcgggtgaattaaagaaaatttgggatgacaattccaattccttgattagcgtggtgaaagtcaatggcaagaaaatttaccttgggggcgatttagataatgttcatggagcagaagacaagtatggtcctctcattggaaaagttgatttgatgaagtttaatcatcaccatgataccaacaaatcaaataccaaggatttcattaaaaatttgagtccgagtttgattgttcaaacttcggatagtctaccttggaaaaatggtgttgatagtgagtatgttaattggctcaaagaacgaggaattgagagaatcaacgcagccagcaaagactatgatgcaacagtttttgatattcgacaagacggtttagtacacatttttacttcctacaagccgattccaagttttcaagctggttggcataagagtgcatatgggaactggtggtatcaagcgcctgattctacaggagagtatgctgtcggttggaatgaaatcgaaggtgaatggtattactttaaccaaacgggtatcttgttacagaatcaatggaaaaaatggaacaatcattggttctatttgacagactctggtgcttctgctaaaaattggaagaaaattgatggaatctggtattattttaacaaagaaaatcagatggaaattggttgggttcaagataaagagcagtggtattatttggatgttgatggttctatgaagacaggatggcttcaatatatggggcaattgtattactttgctccatcaggggaaatgaaaacgggctgggtaaaagataaagaagcctggtactatatggattctactggtatcatgaagacaggtgagatagaagttgctggacatcattactatctagaagaatcaggagctatgaagcaaggctggcttaaaaaggcaaatgattggtatttctacaagacaggtggttcacgagctataggttggattaaagacaaggataaatggtacttcttgaaagaaaatggtcaattacttgtgaatggtaagacaccagaaggctatactgtggattcaagtggtgcctggttagtggatgttccgatcgagaaatctgctacaattaaaactacaagtcattcagaaataaaagaatccaaagaagtagtgaaaaaggatcttgaaaataaagaaacaagtcaacatgaaagtgttacaaattcttcaactagtcaagatttgacatcctcaacttcacaaagctctgaaacgagtgtaaacaaatcggaatcagaacagtag

SEQ ID NO: 1789 - DNA (genomic), 243 bp, Streptococcus pneumoniae; double-stranded, circular
  misc_feature (B) LOCATION 1...243
  hypothetical: NO
  anti-sense: NO
catatgattggaagtattgcagcaattttaacaacatttgcatttttaccacaagtttttcgtgtagttaagacaaaggacacaggatctattgctctaggtatgtatgttatgcaagttattggtattgcattgtggcttgctcatggtattcgtataggagacttgcctttgattttagctaatagtgtttcatttctactttcaggaataattttattttataaattgaagtataaataa

SEQ ID NO: 1790 - DNA (genomic), 243 bp, Streptococcus pneumoniae; double-stranded, circular
  misc_feature (B) LOCATION 1...243
  hypothetical: NO
  anti-sense: NO
ttatgtgttgggtacctaccatacacactcatatcgtttctcctgttcaatttatctgtcttagtatatcaaaaagtcctaggattgtcagcttgcgatggctgtttgagtgattttttgcatagtttcacaaaggtttcaatttcccgaaagcggtgtaaatgtgtctgtttgaactcaatcatatcattcacttcttccttagttagcatgaatttccctcctctttctttctattcgtaa

SEQ ID NO: 1791 - DNA (genomic), 711 bp, Streptococcus pneumoniae; double-stranded, circular
  misc_feature (B) LOCATION 1...711
  hypothetical: NO
  anti-sense: NO
aaagacgttggtatgaaagaattacaaactgtactaaagaaccattttgcaatcgaatttacagacaaaaagttactggaaactgcctttactcatacgagttatgccaatgagcaccgcctcttaaaaatttcacacaatgaacgcttggaatttttaggagacgctgttctacagttattgatttcagaatatctgtataaaaaatatcctaaaaagcctgaaggtgacctatcaaaactccgtgctatgattgtccgtgaggagagtttagctggttttgcgcgtgattgccagtttgaccagtttatcaagttgggtaaaggggaagaaaaatctggtggtcgcaatcgtgacaccattcttggtgatgcctttgaagcctttcttggtgcccttcttttggataaggatgtggccaaggtcaaggaatttatctatcaagtcatgattcctaaggttgaagcaggcgagtttgagatgattacagactataaaacccatctccaagagttgcttcaggtcaatggtgatgtggctattcgttatcaggtgatttctgaaacagggcctgctcacgataaggtctttgatgtagaagttcttgttgaaggtaagagcatcggtcaaggccaaggtcgttctaagaaattagcagagcaggaagctgccaaaaatgccgttgagaaagggctggattcatgtatttaa

SEQ ID NO: 1792 - DNA (genomic), 1107 bp, Streptococcus pneumoniae; double-stranded, circular
  misc_feature (B) LOCATION 1...1107
  hypothetical: NO
  anti-sense: NO
gagttggttggaggtgttatgaagaaaattgggacttatttggtttatgtgctagctgttgtctttattatgctagcttttgcttgtggaacaatcgcatttgcagagttggggtattccgcagttttagcctttacttttggttatgccttcgctcttctaagcatgtatttaatctttattcttcatgagctgggtcatgctttttgtggctacttgacaggctatcggctggtggcttttggattaggacattttattttgaccaaaaagtcaggcaggtttcatctgagtagaacagccattctgaaaaatgttggtgctcaatacattggtttaaaagaggatgaaagcgatcaaagaatcatcctgatgctttcaggaggcttgatggttcatctcggcttgatattattggcgatagtgtttggatttttgacaagaagctggtattttgcagggacttggatttttcttaatttatctttcttcctaaataacattttgtcagtcgacatcaccgatggagcaaaaatttgggaattactacaacaccctgaaaataccaaatacgcctacctggtattgagacattctgctcaaactttgctggctcctcaagaatatgatttgaaagactttgttcaagcagttcctgaggatgcacgagggagttttgcggatggtgtattaggtatgcaaggtgaagtttccattttggaagggaaggaagaagtagctaaacagcagtttcaagcattacttgagaggacaactactccgatgatgcagacagttgcccaactatccctgcttcatatcgccttgttggaaggagattttgagcaagcggagcaatatgctagtattcgacaggtcaaatcgtttctgtctctcaaactgtccaatcttcaagtgatacaagcctggtatcaatttaaggtaaggaaagatgtggttcaaactcacaaggctatgaagattgctagacagaaaatggatagtagtcgaatgttgagggacgagaaacgctattatgaaaacttgttagcagagctggaaaaggaaatgttagaaggaactgaagatggaactagaaatttctga

SEQ ID NO: 1793 - DNA (genomic), 699 bp, Streptococcus pneumoniae; double-stranded, circular
  misc_feature (B) LOCATION 1...699
  hypothetical: NO
  anti-sense: NO
cttgtggttggtatcgcaacaccagcaacccaaaggttggctagtgccacaaaagacctaccagttatcatggccgctattacagacccaattggtgctaacttggttaaagatttgaaaaaaccaggtggcaacgttacaggggtatctgaccacaatccagctcaacaacaaattgaactcatcaaggctctgacaccgaatgtgaaaacaatcggagctctttactcaagtagcgaagacaattcaaaaacacaggtcgaagaatttaaggcttatgctgaaaaagcaggtctgacagtggaaacatttgcagttccttcaacaaatgaaattgcctcaactgtcactgttatgactagcaaggtagatgctatttgggttccaattgataacaccattgcatcaggatttccaacggttgtctctagcaatcaaagttctaagaaaccaatttatcccagtgcgacagctatggtagaagtaggtggtttggcatcagttgtaattgaccaacatgaccttggtgtggcaacaggtaaaatgattgtgcaagtcttgaaaggtgcaaaaccagccgataccccagtcaatgtcttttcaactggtaagtcagtcatcaataaaaaaatagcacaagaactaggtattactattcctgagtctgttctcaaagaagcaggacaagtcatcgaataa

SEQ ID NO: 1794 - DNA (genomic), 480 bp, Streptococcus pneumoniae; double-stranded, circular
  misc_feature (B) LOCATION 1...480
  hypothetical: NO
  anti-sense: NO
catatttctggtcaaacaaaagtttcgtcttggaggcgaacgttcgctatcaaggatgacaggggagaaattgcctatcaggtggagggatcatttttaaagattcccaaaacttttaccatctatgatgcggctggtgaacaagtcagtcagatcagtaaagaaatcttgaccttgcttcctcgttttgagattcagcttcgggatggctcgagttttgtcattcgtaagaagttgaccttttggcgagataagtatgagtttgataatctaggtcttcgtatcgagggcaatatctgggatttgaatttcaaattgctggatgatcgcgatcagttgattgcggaaattaagaaggaactcttccatctgacctctacctataccgtaacggttcttgaagacgcttatgcagacctagtcatttccctctgtgtcgcgattgactatgtggaaatgctggaaagccaatcacattaa

SEQ ID NO: 1795 - DNA (genomic), 537 bp, Streptococcus pneumoniae; double-stranded, circular
  misc_feature (B) LOCATION 1...537
  hypothetical: NO
  anti-sense: NO
aaccattctgggagttggatgaaagtgaagtacaggctatgcttgaaaatacagacgttcccaccagcaaaccgcgaatacttccgtggaggaggattctcaactcgtttcttgacgaagggggatatgccagtaacaatggtacgtctcaatcttttaaaaggggttggtccagtgctacaaattgcagaaggttacacacttgaacttcctgaagatgttcaccatactttagataatcgtacagatccaggatggccaactacttggtttgctccacgtttgacaggaaaaggtgctttcaagtctgtctatgacgtcatgaataattggggagctaatcacggagccataacatatggacacattggagcagacttgattaccttggcttctatgttgagaattcctgtcaatatgcataatgtacccgaggaagatatctttagacctaaaaattggtccttatttggaacagaagatctagaatcagcagactatcgtgcatgtcagttgttgggaccgctacataaataa

SEQ ID NO: 1796 - DNA (genomic), 3873 bp, Streptococcus pneumoniae; double-stranded, circular
  misc_feature (B) LOCATION 1...3873
  hypothetical: NO
  anti-sense: NO
gctccatctgggacagcttctgttctagtccgatttgccttccaagcacagactgttgcagccgatggagttactactactacagaaaaccaaccgaccatccatacagtttctgattcccctcaatcatccgaaaatcggactgaggaaacacctaaagcagagcttcaaccagaaactccagctactgataaggtagctagtcttccaaaaacagaagaaaaaccacaagaggaagttagttcaactcctagtgataaagcagaggtggtaactccaacttctgctgaaaaagaaactgctaataaaaaggcagaagaagctagccctaaaaaggaagaagcgaaagaggttgattctaaagagtcaaatacagacaagactgacaaggataaaccagctaaaaaagatgaagcgaaagcagaggctgacaaaccggaaacagaggcaggaaaggaacgtgctgcaactgtaaatgaaaaactagcgaaaaagaaaattgtttctattgatgctggacgtaaatatttctcaccagaacagctcaaggaaatcatcgataaagcgaaacattatggctacactgatttacacctattagtcggaaatgatggactccgtttcatgttggacgatatgagcatcacagctaacggcaagacctatgccagtgacgatgtcaaacgcgccattgaaaaaggtacaaatgattattacaacgatccaaacggcaatcacttaacagaaagtcaaatgacagatctgattaactatgccaaagataaaggtatcggtctcattccgacagtaaatagtcctggtcacatggatgcgattctcaatgccatgaaagaattgggaatccaaaaccctaactttagctattttgggaaggaatcagcccgtactgtcaatcttgacaacgaacaagctgtcgcttttacaaaagcccttatcgacaagtatgctgcttatttcgcgaaaaagactgaaatcttcaacatcggacttgatgaatatgccaatgatgcgacagatgctaaaggttggagtgtgcttcaagctgataaatactatccaaacgaaggctaccctgtaaaaggctatgaaaaatttattgcctacgccaatgacctcgctcgtattgtaaaatcgcacggtctcaaaccaatggcctttaacgacggtatctactacaatagcgacacaagctttggtagttttgacaaagacatcatcgtttctatgtggactggtggttggggaggctacgatgtcgcttcttctaaactactagctgaaaaaggtcaccaaatccttaataccaatgatgcttggtactacgttcttggacgaaacgctgatggccaaggctggtacaatctcgatcaggggctcaatggtattaaaaacacaccaatcacttctgtaccaaaaacagaaggagctgatatcccaatcatcggtggtatggtagctgcttgggctgacactccatctgcacgttattcaccatcacgcctcttcaaactcatgcgtcattttgcaaatgccaacgctgaatacttcgcagctgattatgaatctgcagagcaagcacttaacgaggtaccaaaagacctgaaccgttatactgcagaaagcgtcgcggccgtaaaagaagctgaaaaagctattcgctctctcgatagcaaccttagccgtgcccaacaagatacgattgatcaagccattgctaaacttcaagaaactgtcaacaacttgaccctcacgcctgaagctcaaaaagaagaagaagctaaacgtgaggttgaaaaacttgccaaaaacaaggtaatctcaatcgatgctggacgcaaatactttactctgaaccagctcaaacgcatcgtagacaaggccagtgaactcggatattctgatgtccatctccttctaggaaatgacggacttcgctttctactcgatgatatgaccattactgccaacggaaaaacctatgctagtgatgacgttaaaaaagctattatcgaaggaactaaagcttactacgacgatccaaacggtactacactaacacaggcagaagtgacagagctaattgaatacgctaaatctaaggacatcggtctcatcccagctattaacagtccaggtcacatggatgctatgctggttgccatggaaaaattaggtattaaaaatcctcaagcccactttgataaagtttcaaaaacaactatggacttgaaaaacgaagaagcgatgaactttgtaaaagccctcatcggtaaatacatggacttctttgcaggtaaaacaaagattttcaactttggtactgacgaatacgccaacgatgcgactagtgcccaaggctggtactacctcaagtggtatcaactctatggcaaatttgccgaatatgccaacaccctcgcagctatggccaaagaaagagggcttcaaccaatggccttcaacgatggcttctactatgaagacaaggacgatattcagtttgacaaagatgtcttgatttcttactggtctaaaggctggtggggatataacctcgcatcacctcaatacctagcaagcaaaggctataaattcttgaataccaacggtgactggtactacattcttggtcaaaaaccagaagatggtggtggtttcctcaagaaagctattgagaatactggaaaaacaccattcaatcaactagcttctaccaaatatcctgaagtagatcttccaacagtcggaagtatgctttcaatctgggcagatagaccaagcgctgagtacaaggaagaggaaatctttgaactcatgactgcctttgcagaccacaacaaagactacttccgtgctaattataatgctctccgcgaagaattagctaaaattcctacaaacttagaaggatatagtaaagaaagtcttgaggcccttgacgcagctaaaacagctctaaattacaacctcaaccgtaataaacaagctgagcttgacacacttgtagccaacctaaaagccgctcttcaaggcctcaaaccagctgcaactcattcaggaagcctggatgaaaatgaagtggctgccaatgttgaaaccagaccagaactcatcacaagaactgaagaaattccatttgaagttatcaagaaagaaaatcctaacctcccagctggtcaggaaaatattatcacagcaggagtcaaaggtgaacgaactcattacatctctgtactcactgaaaatggaaaaacaacagaaacagtccttgatagccaggtaaccaaagaagttataaaccaagtggttgaagttggcgctcctgtaactcacaagggtgatgaaagtggtcttgcaccaactactgaggtaaaacctagactggatatccaagaagaagaaattccatttaccacagtgactcgtgaaaatccactcttactcaaaggaaaaacacaagtcattactaagggcgtcaatggacatcgtagcaacttctactctgtgagcacttctgccgatggtaaggaagtgaaaacacttgtaaatagtgtcgtagcacaggaagccgttactcaaatagtcgaagtcggaactatggtaacacatgtaggcgatgaaaacggacaagccgctattgctgaagaaaaaccaaaactagaaatcccaagccaaccagctccatcaactgctcctgctgaggaaagcaaagctcttcctcaagatccagctcctgtggtaatagagaaaaaacttcctgaaacaggaactcacgattctgcaggactagtagtcgcaggactcatggccacactagcagcctatggactcactaaaagaaaagaagactaa

SEQ ID NO: 1797 - DNA (genomic), 357 bp, Streptococcus pneumoniae; double-stranded, circular
  misc_feature (B) LOCATION 1...357
  hypothetical: NO
  anti-sense: NO
gacaagtctggcggcaggaattttaacgagagatataggaggtcaggcttcaacaaaggaaatgatggaagctattattgcaaggttatgaagttagacgaaaaaattactctagtccttttgatttggaatgtcatcattttcttgatttatggcattgacaaattcaaggcaagaagaagagcttggcgcatcccagagaaaatcttactcattttagcccttacttgtggtggttttggggcctggttagctggaatcacttttcaccacaagactcgaaaatggtactttaaaacagtttggtttcttgggatggtgaccacactagtagccttatattttatttggaggtaa

SEQ ID NO: 1798 - DNA (genomic), 2226 bp, Streptococcus pneumoniae; double-stranded, circular
  misc_feature (B) LOCATION 1...2226
  hypothetical: NO
  anti-sense: NO
gaaagggctggattcatgtatttaaaggaaatcgaaattcaggggttcaagtcttttgctgataagaccaaggtcgtttttgaccaaggtgtgacggcagttgttggacccaatggatctggaaagtccaatattacagaaagtctgcgttgggctttgggggagtctagtgtcaagagtctccgtgggggcaagatgccggatgtcatctttgctggaacagaaagtcgcaaaccgctcaattatgcttctgtagttgtgactctggataatcatgacggatttatcaaggatgcaggtcaagaaatcagggtggaacgccatatctatcgtagtggagatagcgaatacaagattgacggcaagaaagtccgtctgcgtgatattcatgacctcttcttggatactggattgggacgagattccttctctattatttcccaagggaaggttgaggagatttttaattccaagcctgaggaacgacgagctatttttgaagaagctgctggagttttaaaatacaagactcgcagaaaagaaaccgagagtaaactgcagcaaactcaggataatctggaccgcttagaggacattatctacgagttggataatcaaatcaagcctcttgagaagcaagctgagaatgcccgtaagtttttagacttggaaggacaacgtaaggctatttatttagacgttctggttgctcaaatcaaggaaaataaggcagaactagagtcgacagaagaagagttggctcaggttcaagaactcttgatgagttattaccaaaagcgtgaaaaattagaagaagaaaatcaaactcttaaaaagcaacgccaagatttacaggctgaaatggccaaagaccaaggcagtttgatggacttgactagtctgattagtgatttagaaagaaaattagccctatcgaaactggagtccgagcaagtggccctgaatcaacaggaggcacaagctcgtttggctgctttggaggataagagaaattcactcagcaaagaaaagtatgataaagaaagctctttagctctgttagagggaaatctagtccaaaataatcaaaaactcaatcgtttagaagctgaattgctggctttctcagacgatcctgatcagatgattgagctcttacgtgaacgctttgtagctcttttacaagaagaagcggatgtctcaaaccagttgacccgtattgagaatgagttggaaaatagtcgtcagctttctcaaaaacaagcagatcaactagaaaagctgaaagagcaattagctacagctaaagagaaggctagtcagcaaaaagacgagcttgaaactgccaaggtgcaggttcagaaattattggctgactatcaagctattgccaaggagcaagaggagcagaaaacttcctatcaagctcaacaaagtcaactctttgaccgtctggatagtctcaaaaacaagcaggccagagctcaaagtttggaaaatatcctgagaaatcatagtaacttttatgcaggtgttaagagtgttctccaagaaaaagatcgcctaggtgggattattggtgcagtcagtgagcatctgacctttgatgtttattatcaaactgccctagagattgccttaggggcaagtagccagcatatcatcgtagaagatgaagagtcggcaaccaaagctattgatttcctcaaacgaaacagagtcggtcgtgcaacctttcttcctttgaccactattaaggcgcgtacgatttctagtcagaaccaagatgctatcgctgtaagcccaggtttccttgggatggcagatgagttggtgacttttgatactagactggaagccattttcaagaacttgctagctacgacggctatctttgataccgtagaacatgcgcgtgaagctgctcgacaagttcgttatcaggttcgtatggtgacattggatgggacagaattacgcacgggtggttcctatgcgggtggtgccaatcgccaaaataacagtattttcatcaagccagaactggagcaattacaaaaagaaattgctgcagatgaagcaagcttgggttcagaagaagcggctttgaagaccttgcaagaccagatggctgcattgacagaaagattagaagccatcaaactctcaaggagagcaggcacgtattcaggagcaaggcttgtccctcgcttatcagcaaactag

SEQ ID NO: 1799 - DNA (genomic), 237 bp, Streptococcus pneumoniae; double-stranded, circular
  misc_feature (B) LOCATION 1...237
  hypothetical: NO
  anti-sense: NO
ttgccccatggttgtttgttcatgaaagacggaaaaatgtctaagtcaaaagggaatgtcgtttaccctgaaatgttggtaggagcgttatggactagatccactttgttactaacctcatgcgtaactttccagttgtttcagacggaccctttactcctgaagactatgttggccgtatcaactatgaattggctaatgactttgggaacctccttaaccgtacgttttccatga

SEQ ID NO: 1800 - DNA (genomic), 216 bp, Streptococcus pneumoniae; double-stranded, circular
  misc_feature (B) LOCATION 1...216
  hypothetical: NO
  anti-sense: NO
caccagcatggtgtaactgtaattgttgcgcaaacatttgattttttaaacaactcatgggaagctgcagcctctggaacacgaccaatggtagatggagaaatcacacattccacaggttccccatctggatatttcaatgtgcttgaaatcaaatctgccacacttttagccatgttcattgtttgtacttcaagtgattcgcgtacaccttga

SEQ ID NO: 1801 - DNA (genomic), 1152 bp, Streptococcus pneumoniae; double-stranded, circular
  misc_feature (B) LOCATION 1...1152
  hypothetical: NO
  anti-sense: NO
atgtttaatggtcgggtattgaaagaattacggctgttaaatggtttaagtagagcagaattagctcagagaattaatttaacggaacaagccatttggcagtttgagtccaacgaaacgaaacctaaattatcaaccaaaatgcatttggccaaccaatttcatgttgatttaacttattttgaacaggaagaagagagcattcgatttgattcttctgtaattgcctttagaaatgcagacctagcaacacggaaaacaatagatattcaaactatgtatttacataaggtagatagtttgattgattattttgaaagttttgtaattatacctaatattataattcatgacctaagtaatgtagtgagtgaatcttatcataagggagaatccattgaggaattggctctttatgccagggaaaaattaggtatttcaaaagataatcatgatttgctttataaattagaacgttcaggcatctatatcgtggaacgattaattaatggccaagctgatgcttatagcgcatggtcaaaattgggaagaccttatattgtgttgggaacgaataaatcatctgtacgtcgaaattttgacttagctcatgagctaggacatattcttttacataaatataaagatatgaatgaagatggcgatcgtttggagcaagaagcaaattattttgcatcatgttttttattgccaaaagaagagtttttagtcaaatttgaagagagggttggcaagcgtgtcagcaatcctgatagttatattttattgaagtcggatttgaatgtttcgatacaggctttagagtatcgagcttttaagttaggattattgactccaaagcaacattcttacttttatcgtcaaattgcgcaaaaaggttacaaaatgattgaacctttggatgatcaaatttttgttaaaaaaccaagcaaagtaaagagtattctggacgtcgttttgagtaatcatctagtcagtctagcgactataatgtctaaacaaagtattcgtttacagtttataagcgaaatattttcagtcgaaatgaaattttttgatcagtatcaagaagatagaagaacagatcgatttgataacatcatccctttgtacaaaagaaataatttataa

SEQ ID NO: 1802 - DNA (genomic), 318 bp, Streptococcus pneumoniae; double-stranded, circular
  misc_feature (B) LOCATION 1...318
  hypothetical: NO
  anti-sense: NO
ttccctaatgggagctttttgcgtgctctgaacatttcccattttggaaggagtactgtgaaacgtcaatcagccttggtcgtctttagtggtggtcaagattcaacaacctgccttttctcgggcccacggcagtatgaaacagtcgaagctgtcacctttggcctacggcaacatcatcacctcgaaattcaaattgctagagaaatcgccaaggaacaggggcattcgtcacccatatcctcgatatgtctctgctgggacaaatcactgctcaaccacgactttgcgacgatttcatatttcctacatttctga

SEQ ID NO: 1803 - DNA (genomic), 402 bp, Streptococcus pneumoniae; double-stranded, circular
  misc_feature (B) LOCATION 1...402
  hypothetical: NO
  anti-sense: NO
aaagaaaatggtacaatatttctaagagaaaatacaatgggaggtaaaatgaggttattacctataagaaaaatatcacgtcagtctaaaaggttagcactttttttgacgttttgtgctggatatgtggatgcttacacttttattgttcgcgggaatacccttgtagctggacaaactggaaatgttgtctttctttcagtagaattaattaaaaataatgtttcggatgttagggacaaggttctcaccttgctagcgtttatgatgggagtctttttattaacgatttataaggaaaaattgagaattgtgaaaaaacctattctgtccttgattcccttggcaatcttatcaatcattattgcttttgtgccgcaaactgtggataatatctatcta

SEQ ID NO: 1804 - DNA (genomic), 984 bp, Streptococcus pneumoniae; double-stranded, circular
  misc_feature (B) LOCATION 1...984
  hypothetical: NO
  anti-sense: NO
agagtgaatgggaggaataagatgagcgatgtaaaagaggaagtaagctctctatctgagaagcagttacgccaaattgatgttgagtatgctgaattaaatgatagtgatattatcgagcgattagcttatttagaaattaacaacaatgaaaaacgtattgtcatctctgatattgaaccaaccaaggaaataatgtcagtctcggaccaaatttttgagattcaaaagaattttcaaaaaatcaagaatatgttcgaattgtttatttcagatgtctcggattttttaagtattaaaaataaacttgagtcaaaggaattagaaattgaagaggcagatgtaaatcgtttcatgattcatttattatccagtggaaaattgtttgtcgattttaacgaaaaccaaattaaacaaaaatattccaaagatagtgaggagtttgattgtatacatggttttgcaagctatcagtatgatatcaattttacttatcgattttgccattctttgagaaattattcgcaacatactgacttaccaataaatgaggtaaaagctgttagcccagatgatgagactgttataatagatttctatattgatttagattatcttttaaattccaactttaaatggaaaaaattgaaaggggagttgataaaactaaaccaagaaacatctaagattgacgctatagctctagtgaaagaatactttaatgctcttacagagctctatggtaattataataagttgtttttaaagttaaaccataatacattagtagatattaaatcaaagttggaatcattaaaattgaaacactctaggtattatatttcaaagataagcaagtatgatcttaaatataatcctggaaattatactatgtcaccacttgcagcatttgctgaaattgaagagatttatattgaactttcaaaaattggtttggttaaaattgtcaataaaagtaattaa

SEQ ID NO: 1805 - DNA (genomic), 519 bp, Streptococcus pneumoniae; double-stranded, circular
  misc_feature (B) LOCATION 1...519
  hypothetical: NO
  anti-sense: NO
gcagggaatggacatcgtaaaggatttcctgaaagctatgatatggaagctcttctcaacttcttggaccgcatcaaaaatggacaagatgtagatattcctgtctattctcatgaagtttacgacatcgtacccaaaaagaaacaaagtgtcaaagctgctgattttgtaatcgttgagggaattaatgtctttcaaaatccacaaaacgatcgtctctatatcactgacttctttgacttttccatctatgtagatgctggagtggatgatattgaaagttggtatctggaccgtttcttgaaaatgctgagtctagcccaaaacgaccctgatagctactattatcgttttactcagatgccgattggggaagtggagtcctttgcccatcaggtctggaccagtatcaatctcacaaatctgcaaaattatattgaaccaaccagaaatcgtgcagaagtgattcttcataaaagcaagaaccatgaaatcgatgaaatttacttaaaaaagtaa

SEQ ID NO: 1806 - DNA (genomic), 756 bp, Streptococcus pneumoniae; double-stranded, circular
  misc_feature (B) LOCATION 1...756
  hypothetical: NO
  anti-sense: NO
tcgcgtgatgggagaaatcctgagcgtaagtttgccatcatcacaggacttaacttaccgatgttgattcaagcctacacagagcgcctcatggacgctgctgcaggtgtagaaaaagtcgctgctaatatcattaaagaagccaaggatggcatcaaagctcttccagaagagctaaatccagttgaagaagttgcaagcgctgcagctgctccagttgcccaagctgctatcccagaaggaactgttatcggagacggtaaattgaaaatcaatcttgcccgtcttgacacacgtctacttcacggtcaggttgcaactgcttggactccagattcaaaagcaaatcgtatcatcgttgcttcagataacgtggctaaagacgaccttcgtaaagaattgattaaacaagcagctccaggtaatgtcaaggctaacgtggttccaattcaaaaactgattgagatttcaaaagacccacgttttggagaaacacatgcccttatcttgtttgaaacacctcaagatgcccttcgtgccatcgaaggcggcgtgccaatcaagactcttaacgttggttctatggctcactcaacaggtaaaacattggtcaataccgttttgtctatggacaacgccgatgttgcgacatttganaaaatgcgtgacttgggtgtcacgtttgatgtccgtaaagtaccaaatgattctaaaaaagatntgtttgacttgcttaacaaagccaatgtcaaataa

SEQ ID NO: 1807 - DNA (genomic), 207 bp, Streptococcus pneumoniae; double-stranded, circular
  misc_feature (B) LOCATION 1...207
  hypothetical: NO
  anti-sense: NO
tcgaaagatggaaaaaagaaggaaaatcaaatagagaaattgcctctctacttggaaaagctcctcaaactatccacactaaaatcaagcgtaggacagtccgaaaatgtcttggaaaagggcgcttcaaagaggtttattctgccgactatgctcaacagtcttatgaaaacaatcgcaagcgctcggtcaagaaatcaagcttga

SEQ ID NO: 1808 - DNA (genomic), 207 bp, Streptococcus pneumoniae; double-stranded, circular
  misc_feature (B) LOCATION 1...207
  hypothetical: NO
  anti-sense: NO
tcgaaagatggaaaaaagaaggaaaatcaaatagagaaattgcctctctacttggaaaagctcctcaaactatccacactaaaatcaagcgtaggacagtccgaaaatgtcttggaaaagggcgcttcaaagaggtttattctgccgactatgctcaacagtcttatgaaaataatcgcaagcactcggtcaagagatcaagcgtga

SEQ ID NO: 1809 - DNA (genomic), 294 bp, Streptococcus pneumoniae; double-stranded, circular
  misc_feature (B) LOCATION 1...294
  hypothetical: NO
  anti-sense: NO
aggaattgtggattgccaaattgtatcattgaaattattgctcaaatttgttatgatataaatatgaataaaagtagactaggacgtggcagacacgggaaaacgagacatgtattattggctttgattggtattttagcaatttctatttgcctattaggcggatttattgcttttaagatctaccagcaaaaaagttttgagcaaaagattgaatcgctcaaaaaagagaaagatgatcaattgagtgagggaaatcagaaggagcattttcgtcagggcaagccgaagtga

SEQ ID NO: 1810 - DNA (genomic), 330 bp, Streptococcus pneumoniae; double-stranded, circular
  misc_feature (B) LOCATION 1...330
  hypothetical: NO
  anti-sense: NO
aggtcatgtgggattaggctnnttnggctggttgtnganaacgaagcacggtgtaccgatgaaaatggagttatcgatgacgtgtatcgtattgaattttatgaagaacatttaagatggctacataaagccattgaagaaggaagtcactgttttggataccacgcttggaccgcatttgattgctggtcttggaataatgcatataagaatcgttacggatttatctccgttgatttagaaacgcaaaagagaaccatcaagagctcaggaagatggtatcgcaaagtaagtgacaataacggttttgaagtagaaattgaggagtaa

SEQ ID NO: 1811 - DNA (genomic), 297 bp, Streptococcus pneumoniae; double-stranded, circular
  misc_feature (B) LOCATION 1...297
  hypothetical: NO
  anti-sense: NO
gcccctcgtggtgaaacttttcaggananggtcagcatcacgacttatcaaaacaatcaagtttctaacaataaatttcaaacttcacttcatttcatcgaggttgtttccaaagatttgggagtagacaagtcagaagtctatgttaatacttccacaaacacagatggcgcacttatcaaggtgggagatcgctattatcgtgccctaaacggaagtgagccagacaagtacctgttagagaaagtcgaattgtataagacagacgcaattgaactggtggatgtgaacaaatga

SEQ ID NO: 1812 - DNA (genomic), 783 bp, Streptococcus pneumoniae; double-stranded, circular
  misc_feature (B) LOCATION 1...783
  hypothetical: NO
  anti-sense: NO
agggctagtggtgtttaccatggagctcttagtatcatgattatggcgacttatgaaacctttgcggcggtctatgatgcggtcatggacgatagtttatacgacaaatggacgaatttttctctgcgtcatttgcctaagaccaaggagagaaagaaactcttggaattggcttgtgggacaggaattcaatcagtgcgcttctctcaggctggttttgatgtgactggacttgacttgagtgcggatatgttgaagattgcggagaagagagcaacttcagccaagcaaaagattgcttttatagaaggtaatatgctgaatttgtccaaggcagggaaatacgattttgtcacgtgttattcggactctatctgctatatgcaggatgaggtggaagtaggggacgtctttaaggacgtgtacaatgcgctgaatgaagagggagttttcatctttgacgtgcactcgacctaccagacagatgaagtattccctggctattcctaccatgaaaatgcggaagattttgccatgctttgggatacatatgaggacgaagctcctcactccatcgtgcatgagctgactttctttatcaaggaggctgacggttcctttagtcgccacgatgaagtacatgaggagaggacctatgagatcttgacctatgatatcttgctggaacaggctggatttaagtccttcaaactctatgcagactttgaggataaggagccaacagaaactagcacccgttggttttttgtggcgcagaagtag

SEQ ID NO: 1813 - DNA (genomic), 345 bp, Streptococcus pneumoniae; double-stranded, circular
  misc_feature (B) LOCATION 1...345
  hypothetical: NO
  anti-sense: NO
gcaaaaagtggctttcgaacgagtagagcccttgttaaaaatgttccgtttggacagaaattagactggttccctgttcatttttcaaaagggatgaagcagaaggtcatgattatctgtgcttttgtggtggatccaagtcttttcatcgtggatgagcctttccttggtcttgatccgctggctatttctgatttgattcagcttttggaagtggagaagcaaaagggcaagtctattctcatgagtacccacgtgctggattcggcggagaagatgtgtgatgcctttgtcattcttcacaagggagaggtgcgtgcaaacgaatctcctgcaactacgtga

SEQ ID NO: 1814 - DNA (genomic), 489 bp, Streptococcus pneumoniae; double-stranded, circular
  misc_feature (B) LOCATION 1...489
  hypothetical: NO
  anti-sense: NO
gttccaggtggttcggaaaatattcgccaagtccttaaaataaatgacacagaaaataaggaagctggtgcctatcaattcgttacggttggtgttcaacatgccactttagctcatatgatttatgcttggttgacaccttttacagatattcgtagtgctcaggaaactacaggtggttcttccgatgttaaatttatgcaaatcaatcaattctacatgcaaacatcgcaaaatatggccaagtatcaaggactaaaaacagctggtaaggatatcgaactcaagtactttggagtttatgttttgaatgtgacggataattcaacctttaaagggattctcaatatctctgatacagtcacaacagtcaatgatcagacctttgataattccaaagaattgattgattacgtcagtgctcaaaaattaggggattccgtcaaggtcacctatgaagaggatgggcaaaccaagtctgcagaatga

SEQ ID NO: 1815 - DNA (genomic), 300 bp, Streptococcus pneumoniae; double-stranded, circular
  misc_feature (B) LOCATION 1...300
  hypothetical: NO
  anti-sense: NO
ggtggtatcggtggtacttatggtgctatgccagaactcttcttgaaactcaatcagttgattgcggataaggacctaaaaacagcgcgtgaattgcagtatgctatcaacgcaatcattggtaaactcacttctgctcatggaaatatgtacggtgtcattaaagaagtcttgaaaatcaatgaagtcttgaatattggatctgttcgttcaccattgacaccagtgactgaagaaggtcgtccagttgtagaagcggctgctgccttgattcgtgaaaccaaggagcgcttcctctaa

SEQ ID NO: 1816 - DNA (genomic), 582 bp, Streptococcus pneumoniae; double-stranded, circular
  misc_feature (B) LOCATION 1...582
  hypothetical: NO
  anti-sense: NO
atgaaaatcggaatattggccttgcaaggggcctttgcagaacatgcaaaagtgctagatcaattaggtgtcgagagtgtagaactcagaaatctagatgattttcagcaagatcagagtgacttgtcgggtttgattttgcctggtggtgagtctacaaccatgggcaagctcttacgtgaccagaacatgctacttcccatccgagaagccattctatctggcttaccagtgtttgggacctgtgcgggcttaattttgctggctaaggaaatcacttctcagaaagagagtcatctaggaactatggatatggtggtcgagcgtaatgcttatgggcgccaattaggaagtttctacacggaagcagaatgtaagggagttggcaagattccaatgacctttatccgtggtccgattatcagtagtgttggtgagggtgtagaaattctagcaacagtgaacaatcaaattgttgcagcccaagaaaaaaatatgttggtaagttcttttcatccagaattgactgatgatgtgcgcttgcaccagtactttatcaatatgtgtaaagaaaaaagttga

SEQ ID NO: 1817 - DNA (genomic), 855 bp, Streptococcus pneumoniae; double-stranded, circular
  misc_feature (B) LOCATION 1...855
  hypothetical: NO
  anti-sense: NO
ggaccagtcggttatagcttgtatggagggcttataatggcagatataaaattgattgcattggacttggacgggaccttgctgactactgataaaaggctgacggatcgtaccaaggaaaccttgaaagctgcgcgtgatcgtggtatcaaggtcgtattgacaactggtcgtcccttaaaagctatggatttctttctccatgagctagggactgacggtcaggaagaagagtataccattacttttaatggtggtttggttcagaaaaatacaggtgaaatccttgataagacagtcttttcatatgatgatgtggcacgcttgtatgaagaaacagagaaattatcactgcctcttgacgctatctcagaaggaactgtttatcaaattcaatcggaccaagaaagtctttatgccaaattcaatccagctttgacttttgttccagttgattttgaagacctgtctaatcaaatgacctacaacaaatgcgtgaccgcctttgctcaagaacccttggatgcagccattcagaagatttctccagaattgtttgaccaatatgaaatctttaaatcacgtgaaatgttgctagaatggtcaccaaagaatgttcataaagcaacaggtttggcaaaactaattagccatcttggaattgatcaaagtcaagtgatggcctgtggtgacgaggccaatgacctctctatgattgaatgggcagggctcggtgttgccatgcaaaacgctgttcctgaagtcaaggcagtcgcaaatgtggtaactcctatgaccaatgatgaagaagctgtcgcctgggctatcgaagaatatgtgctaaaggagaactaa

SEQ ID NO: 1818 - DNA (genomic), 186 bp, Streptococcus pneumoniae; double-stranded, circular
  misc_feature (B) LOCATION 1...186
  hypothetical: NO
  anti-sense: NO
ttttcttacgggcatgattctctccttaacagtacatacctattttatcattttttcggcagagaattattacagaaaggttacaaaaagaataaagtcccttttcattttcaaagcatggctgattttggagaaatgtggtataatttttcttatggaaaagattgtcattacagcaactgctga

SEQ ID NO: 1819 - DNA (genomic), 390 bp, Streptococcus pneumoniae; double-stranded, circular
  misc_feature (B) LOCATION 1...390
  hypothetical: NO
  anti-sense: NO
agaaaatacggaatcgaggggaattctatggagcaaattggaaaagtctttaaacaattacaagaatcaagaaatatctcactgatacaagcaaccggaggacaattttcgccgtctatgttgtcccgttttgaaacaggtcaaaatgagctttcggtggaaaagtttctatttgctctggaaaatatatctgccagtgtggaggaaatcctctttctggcaagaggtttccattatgatacaaatcctgagttgagaaaagaaattacagatgtcttggaaccaaagaatataccacctcttgaggacttatatcgcagggagtatcaaaagcatgcccattctcacaacaaacagaaacatattctaaatgccattattatcaagtct

SEQ ID NO: 1820 - DNA (genomic), 936 bp, Streptococcus pneumoniae; double-stranded, circular
  misc_feature (B) LOCATION 1...936
  hypothetical: NO
  anti-sense: NO
ggagaaaacggaggtaatagaagtatgatttatacagtcacactcaatccatccattgactatatcgttcgtntggaccaagtcaaagttggtagtgtaaatcgtatggacagtgatgataagtttgctggtgagaaaggaatcaatgtcagccgtgtcttgaaacgtttgaatatatcaaatacagcgacgggatttatcggtggctttactggtaaatttatcacagatactttagcagaggaagaaatcgagacacgttttgtccaggtggcagaagatactcgtatcaatgttaaaatcaaagcagaccaagaaacagaaatcaacggaacgggtccaactgttgaaccggttaagctagaagaattgaaagctattttatctagtctgacagcagaagatacagttgtctttgcaggttcaagtgctaaaaatctaggcaatgttatctataaggatttgatttccttgacgcgccagactggtgcgcaagtggtctgtgactttgaaggacagaccttaattgatagtttggactaccagcctcttcttgtaaaaccaaataatcatgaacttggagcgatttttggggttaaactcgaaagtttagatgaaattgagaaatacgctcgtgagttactggctaagggtgctcaaaatgttattatctctatggctggtgatggtgcccttcttgtcacatctgagggagcttacttcgctaaaccaatcaaaggaacagtcaaaaattcagttggagctggtgattctatggttgctggattcacaggtgaatttgtcaaatcaaaagacgcagtagaagccttcaaatggggagtggcttgcggaacggcaactaccttctcagatgacttggcaacggcggaatttattaaagaaacatatggaaaagttgaggtagaaaaacgatga

SEQ ID NO: 1821 - DNA (genomic), 831 bp, Streptococcus pneumoniae; double-stranded, circular
  misc_feature (B) LOCATION 1...831
  hypothetical: NO
  anti-sense: NO
tttggaaacgggtccagtcctttatcaccattcaaggaggttagtatgaaaaaatatcaacgaatgcatctgatttttatcagacaatacatcaaacaaatcatggaatataaggtggattttgtggttggtgtcttgggagatctttctggctcaaggcttgaatctcttgtttctcaatgtcatctttcaacatattccattcctagaaggtggacctttcaagagatagctttcatttatggattttccttgattcccaagggaatggaccatctcttttttgacaatctctgggcactagggcaacgcctagtccgaaaaggagagtttgacaagtatctgactcgtcccatcaatcctctctttcacatcctagttgaaacctttcagattgatgccttgggtgaactcttagtcggtggtattttattgggaacaacagtgaccagcattgtttggactcttccaaaattcctgcttttcctagtttgtattccttttgcgaccttgatttatacttctcttaaaatcgcaacagccagtatcgccttttggactaagcagtcaggcgccatgatttacatcttctatatgttcaatgactttgctaagtatccgatttctatttacaattctcttcttcgttggttgattagctttatcgtgcctttcgcctttacagcctattatccagctagctatttcttacaggaaaaggatgtgttctttaacgtaggaggtttgatgttgatttctctggttttctttgttatttcccttaaactttgggataagggcttagattcctacgaaagtgcgggttcgtaa

SEQ ID NO: 1822 - DNA (genomic), 615 bp, Streptococcus pneumoniae; double-stranded, circular
  misc_feature (B) LOCATION 1...615
  hypothetical: NO
  anti-sense: NO
atcaatgacgggaaaaatagtttaaatgttaaatcgaaaggattgtatatgtcaaaagcaaagaaaatatgtttcattattttctgtattttaatcttgacaattttccttcctgttttgatagattatcatcaagttagtgatctaggtattcatctacttagctggagacagaactccgtagttgaattctatcttgctagatatgtcttttgggggacagtggttctatcaactttagttttattatccattttagttgtgatgttttatcctaaacgttacttggaaatccaacttgaaactaaaaacgatacattaaaattaaagaattcggcaatcgaaggttttgttagaagtttggtgagtgatcatagattgatcaagaacccaactgttcatgtaaatttacgaaaaaataaatgtttcgttcatgtagaaggtaaaattcttccttcagacaacatcgctgacagatgccaaataattcaaaatgaaataactaatggattgaagcagttttttggtattgagcgtcaagtaaaacttgaagttgcagtaaaaaattaccaaccaaaacctcaaaacaaaaagactgttagtcgtgtgaagtaa

SEQ ID NO: 1823 - DNA (genomic), 1281 bp, Streptococcus pneumoniae; double-stranded, circular
  misc_feature (B) LOCATION 1...1281
  hypothetical: NO
  anti-sense: NO
tcaaaagacggaggaaacgctatgctcggaattttaacctttattctggtttttgggattattgtagtggtgcacgagttcgggcacttctactttgccaagaaatcagggattttagtacgtgaatttgccatcggtatgggacctaaaatctttgctcacattggcaaggatggaacggcctataccattcgaatcttgcctctgggtggctatgtccgcatggccggttggggtgatgatacaactgaaatcaagacaggaacgcctgttagtttgacacttgctgatgatggtaaggttaaacgcatcaatctctcaggtaaaaaattggatcaaacagccctccctatgcaggtgacccagtttgattttgaagacaagctctttatcaaaggattggttctggaagaagaaaaaacatttgcagtggatcacgatgcaacggttgtggaagcagatggtactgaggttcggattgcacctttagatgttcaatatcaaaatgcgactatctggggcaaactgattaccaattttgcaggtcctatgaacaattttatcttaggtgtcgttgttttttgggttttaatctttatgcagggtggtgtcagagatgttgataccaatcagttccatatcatgccccaaggtgccttggccaaggtaggagtaccagaaacggcacaaattaccaagatcggctcacatgaggttagcaactgggaaagcttgatccaagctgtggaaacagaaaccaaagataagacggcaccgactttggatgtgactatttctgaaaaggggagtgacaaacaagtcactgttacacccgaagatagtcaaggtcgttaccttctaggtgttcaaccgggggttaagtcagattttctatccatgtttgtaggtggttttacaactgctgctgactcagctctccgaattctctcagctctgaaaaatctgattttccaaccggatttgaacaagttgggtggacctgttgctatctttaaggcaagtagtgatgctgctaaaaatggaattgagaatatcttgtacttcttggcaatgatttccatcaatattgggatttttaatcttattccgattccagccttggatggtggtaagattgtgctcaatatcctagaagccatccgccgcaaaccattgaaacaagaaattgaaacctatgtcaccttggccggagtggtcatcatggttgtcttgatgattgctgtgacttggaatgacattatgcgactcttttttagataa

SEQ ID NO: 1824 - DNA (genomic), 333 bp, Streptococcus pneumoniae; double-stranded, circular
  misc_feature (B) LOCATION 1...333
  hypothetical: NO
  anti-sense: NO
tcttactgcggttatgatgaaaaaataatcttggaaaatataaatataaaaatacctgaagaaaaaatatcagttattattgggtcaaatggttgtgggaaatcaacactcattaaaaccttgtctcgacttataaagccattagagggagaagtattgcttgataataaatcaattaattcttataaagaaaaagatttagcaaaacacatagctatattacctcaatctccaataatccctgaatcaataacagtagctgatcttgtaagccgtggtcgtttccctacagaaagccttttaagagtcttggaaaagatgaccttgaaataa

SEQ ID NO: 1825 - DNA (genomic), 192 bp, Streptococcus pneumoniae; double-stranded, circular
  misc_feature (B) LOCATION 1...192
  hypothetical: NO
  anti-sense: NO
ggccggtgcggtgtgggcccggggtggggcggcggattcctgcgggggggggcgtgggggggttggcgtgcggcgggcggtggtgggggtggggggggggagttgctcgcgcgcggtgggggattggccgcgtggaggggggcggcatgcgggggaacggggggtggagggaagtggggtggccggggttga

SEQ ID NO: 1826 - DNA (genomic), 216 bp, Streptococcus pneumoniae; double-stranded, circular
  misc_feature (B) LOCATION 1...216
  hypothetical: NO
  anti-sense: NO
aaagaaagcggtaacaatatgcttaatgcgaaaattttttatatatttttatgtttgatcgttatcgaaactacaggcttgttgttgttgaaaagaggtctcgaaatgggttatttagacacagaagctattatcctcgcagttttttcatttgctttttacaacctatgttcattcgcttgggtctgctctacaataaaaaacaataaaaaataa

SEQ ID NO: 1827 - DNA (genomic), 579 bp, Streptococcus pneumoniae; double-stranded, circular
  misc_feature (B) LOCATION 1...579
  hypothetical: NO
  anti-sense: NO
gaaagcggcggaagaatttcaaaaatatccgaagctttgaaaaggcagactactcaacactatccagccttgatactttttgatgggcttatgtaccgcaacattaagagagataagctgaccgaggcggaacaagattatcttgaaaatcatgtcttcattacctcggctttgtacggtgttgttccagccttgtcacccatggctcctcaccgtttggattttttgatgaaattaaaagttgctggtaagactttgaagagccattggaaggcagtctatgatgaagctctgaagatggaagaagtgattttctctctcttgtcatcagagtttgagactgtattttctaaggaaatcagagcaaagatggtgaccttcaatttcatggaggatagagagcggtcactgaagattcactcaactatctccaagaaagcgcgcggggcctttttaacagctttaatagaaaatcaagtacaaactgtgggggaagcacgtcgcttgaactttgctggatttgtttaccgagaagatttgtcacaaccacagggattggtttttgtaaaggaagtatag

SEQ ID NO: 1828 - DNA (genomic), 393 bp, Streptococcus pneumoniae; double-stranded, circular
  misc_feature (B) LOCATION 1...393
  hypothetical: NO
  anti-sense: NO
gtnggcggcggggcggggtgggtggcgggggggttttggggctggcgtggggcggggcggctcgttcgttgggggtgtggtaggggggccggtgtgggctggtggcggagtggggggggtgtgcgggggcggggtggggcggtgaggccggtgcggtgtgggcccggggtggggcggcggattcctgcgggggggggcgtgggggggttggcgtgcggcgggcggtggtgggggtggggggggggagttgctcgcgcgcggtgggggattggccgcgtggaggggggcggcatgcgggggaacggggggtggagggaagtggggtggccggggttgaggcgggggcggtccggggacgggtggagtggggtgagtggggggcagttggtgtga

SEQ ID NO: 1829 - DNA (genomic), 1221 bp, Streptococcus pneumoniae; double-stranded, circular
  misc_feature (B) LOCATION 1...1221
  hypothetical: NO
  anti-sense: NO
aagattttaggaaaagtcgttatatcatgctatacctattctttgtggtataattgcaagaggtttaatccgataatttataaagagagaaagatattcatgagagatttattatctaaaaaaagtcataggcaattagaattattagaattattatttgaacataaacgttggtttcatcgttctgaactagcagagttattaaattgtacagaacgtgcagtcaaagatgatctatcccatgttaaatctgcttttcctgacttgatttttcattcttctactaatggtatacgcattattaataccgatgatagtgatattgaaatggtttaccatcatttctttaaacattcaactcatttttcgattttagaattcatcttctttaatgaaggttgtcaagctgagagtatttgtaaagaattttatatcagttcatcttcgctctatcgttttattagccaaatcaataaagtgattaaaaggcaatttcaatttgaagtcagtctgacccctgttcaaatcattggaaatgagagagacattcgttacttttttgcacaatatttttcagaaaaatattatttcctagaatggccatttgaaaatttttcatcagagccactatctcaattgttagaattggtttataaggaaacaagctttccaatgaatttgtcaacgcatagaatgctaaagttgctcctagttacgaacctatatagaataaagtttggtcattttatggaagtagataaagattcttttaacgaccaaagtttggattttttaatgcaggcagaaggaatagaaggtgttgctcagagttttgaatcagaatacaatatctctttagatgaagaagttgtttgccaattatttgtgtcttactttcaaaaaatgtttttcatagatgaaagtctctttatgaaatgcgtaaaaaaggatagttatgttgaaaaatcttaccatctattgagtgattttattgatcagatttcagtcaagtatcagattgaaatggagaataaggataatctgatttggcatctgcataataccgcacatctgtatcgtcaagagttgtttactgagtttattttatttgatcaaaaagggaatacaatcaggaactttcaaaatatttttccaaaatttgtttcagatataaaaaaagagatttctcactatttagagactcttgaggtgtgttcttag

SEQ ID NO: 1830 - DNA (genomic), 645 bp, Streptococcus pneumoniae; double-stranded, circular
  misc_feature (B) LOCATION 1...645
  hypothetical: NO
  anti-sense: NO
accatcataggtctcattattggacttgccattggtgtcttccgtactgctcctctctctgaaaacaaagccatttatggccttcaaaaactagtcggctgggttctcaatgtctacattgaaattttccgtggtacgccaatgattgttcaatcgatggttatctactatggaactgcccaagctttcgggatcaaccttgaccgtacactggctgctatcttcatcgtttcaatcaataccggtgcctacatgactgaaatcgtccgtggtggtatcctagcagttgacaagggacaatttgaagctgcgactgctcttggtatgacccataaccagaccatgcgtaagattgtcctacctcaggtagtccgtaacatcctacctgcaactggtaatgaatttgtcatcaatatcaaagatacatctgtattgaacgttatctctgttgtcgaactttatttctcaggaaataccgtggcaacacaaacctatcaatacttccagacatttacaatcatcgccgtgatttactttgtcctcaccttcaccgtaacacgtatcctacgatttatcgagcgccgaatggacatggatacctatactacaggtgctaaccaaatgcaaacggaggatttgaaataa

SEQ ID NO: 1831 - DNA (genomic), 363 bp, Streptococcus pneumoniae; double-stranded, circular
  misc_feature (B) LOCATION 1...363
  hypothetical: NO
  anti-sense: NO
tggatggtagggtcttcgagggaacacgctgcttgggctctagcggactatggttttaaggtcgtgattgcaggatctttcggtgacattcattacaataatgaactcaataatggcatgttgccaatcgttcagcctagagaggttagagagaaactagcccagctaaaaccaaccgaccaggtaactgtggacttggaacaacaaaaaatcatctcaccagttgaagaattcaccttcgagatagatagcaagtggaaacataaactcctaaatagtttggatgatatcggtattaccttgcagtatgaagagttgattgctgcttatgaaaaacaacgaccagcctactggcaggattag

SEQ ID NO: 1832 - DNA (genomic), 423 bp, Streptococcus pneumoniae; double-stranded, circular
  misc_feature (B) LOCATION 1...423
  hypothetical: NO
  anti-sense: NO
ttacaatcaggatctgggcaattagcagacaaatccagtcagttactttcaggtgcttctccattagagaatagagctaataaattggcagatggatctaggaaactagcagaaggtggaacaaagttaacttctggattggaagatttacagacaggacttgcttctttaggacaaggactaggtaatgctagtgatcaactcaaatcagtatcaacagaatctaaaaatgcagagattttgtcaaatccactcaatctttcaaaaacagacaatgatcaagttcctgtaaatggaatcgcaatagctccttatatgatatcagttgctctttttgttgcagcaatatcaacaaatatgatatttgcgaaattgccttcaggacgtcatccagagagccgttgggcttggttgaaatcttga

SEQ ID NO: 1833 - DNA (genomic), 876 bp, Streptococcus pneumoniae; double-stranded, circular
  misc_feature (B) LOCATION 1...876
  hypothetical: NO
  anti-sense: NO
aaaaaatcagggagattttggatgaagcttgatggctatacacgtttagctgcagttgttgccaatcctattaagcattctatttctcccttcatccacaatagagcctttgaggcgacagctaccaacggtgcttatgtggcttgggagattgaagcgagtgacttggtagaaacagtggccaatattcgtcgctaccagatgtttggcatcaatctgtccatgccctataaggagcaggtgattccttatttggataanctgagcgatgaancgcgcttgattggtgcggttaatacggttgtcaatgagaatggcaattggattggatataatacaaatggcaagggattttttaagtgcttgccttcttttaccatttcaggtaaaaagaataacctgctgggtgcacgtggtgcggctaaatcaatcttggcacaggctattttggatggcgtcagtcagatttcggtctttgttcgttccgtttctatggaaaaaacaagaccttacctagacaagttacaggagcagacaggctttaaagtggatttgtgtgctttagaatatgtttctgaactgcaagcaaggattgccgagtcggatttgctagttaatgccaccagtgtgggcatggatggccaatcctctcctgttcctgaaaacatagtcttaccagaaactcttttagttgcagatatcatataccaaccctttgaaacaccgtttttgaaatgggctagaagtcagggcaatccagcagtcaatggtctgggaatgttactctatcaagctgcagaagcttttcaactgtggacaggcaaggaaatgccgacagaagagatttggcagtctttaacagaaaaataccaataa

SEQ ID NO: 1834 - DNA (genomic), 330 bp, Streptococcus pneumoniae; double-stranded, circular
  misc_feature (B) LOCATION 1...330
  hypothetical: NO
  anti-sense: NO
cggaaatcaggcgcatacttaaatattcaacatgattataacacgaaaggagcaaaaatggaagcagttgaaattgtaagaattaaagatgtgattattgaaaaagtctctgctaatgatgaagagttaaaacgtatctttggatgttcaaaacgacaagcaggagagcgaagaagagaaatgcaaaaactccctagtcagcaaaaacatcttttggatagtggacaacttgtaacgattaaaggtttctatgaatacttgcaatatcgtggaactaaagcttggaaaaaagaaatggaaacaagcaagaaaatgaggtcagcaggatga

SEQ ID NO: 1835 - DNA (genomic), 849 bp, Streptococcus pneumoniae; double-stranded, circular
  misc_feature (B) LOCATION 1...849
  hypothetical: NO
  anti-sense: NO
gtaggatcaggttcaagttttaaaaaaccaagcaaatatgatatactaaagagcgagtattctagtagaattaggacaaataatatgaaacaaacgattattcttttatatggtggacggagtgcggaacgcgaagtctctgtcctttcagctgagagtgtcatgcgtgcggtcaattacgaccgtttcacagtcaagactttctttatcagtcagtcaggtgactttatcaaaacacaggaatttagtcatgctccggggcaagaagaccgtctcatgaccaatgaaaccattgattgggataagaaagttgcaccaagtgctatctacgaagaaggtgcagtggtctttccagtccttcacgggccaatgggagaagatggctctgttcaaggattcttggaagttttgaaaatgccttacgttggttgcaacattttgtcatcaagtcttgccatggataaaatcacgactaagcgtgttctggaatctgctggtattgcccaagttccttatgtggctatcgttgaaggcgatgatgtgactgctaaaatcgctgaagtggaagaaaaattggcttatccagtcttcactaagccgtcaaacatggggtctagtgtcggtatttctaagtctgaaaaccaagaagaactccgtcaagccttaaaacttgccttccgatatgacagccgtgtcttggttgagcaaggagtgaatgcccgtgaaattgaggttggcctcttgggtaactacgatgtcaagagcacgctacctggagaagttgtcaaggacgttgccttttatgactacgatgccaagtatattgataacaagattactatggatatt

SEQ ID NO: 1836 - DNA (genomic), 519 bp, Streptococcus pneumoniae; double-stranded, circular
  misc_feature (B) LOCATION 1...519
  hypothetical: NO
  anti-sense: NO
agcgtgtcagggctactaggggcagataggcttatagctaaatgtagacgattggctagtaaaaaaactggcgaggatatcgtcttacgtgcggtgcacaatgctactataaaggttgtccaagcagatgcaagaagactcgcaccagcgagagatggagagcttataactagtatcaaaactagggcaaaaatggacggagataaggctataggcgaagtttacaccaaccttaaatacgctccttatgttgagtttggaacgggaccaataggacaagctagccattctggtatttctccagaggtcagcgtgacttacaagtctagtccgtggtatgtacatgaagaccaaatcaatgtaggaccgtaccactttcaaaaaatcggggagttctacaagatgtatggtcaacctgcccagccttatctttatccagctttgagagacaatcaagagcgtgtgtctaagaatatttcgaattatgtccgtagaaagataagagaacaaataaaatga

SEQ ID NO: 1837 - DNA (genomic), 651 bp, Streptococcus pneumoniae; double-stranded, circular
  misc_feature (B) LOCATION 1...651
  hypothetical: NO
  anti-sense: NO
gagaagccaggaaaaatagtaaagaattggctaaaaactatcgctgacgtgacttctaaaattgtcgaatggatcatcaatctggctccatttggaatccttggtcttgtttttaaaaccatttctgacaagggagtcggaagccttgccaactacggtattttattggttccattagtaacgactatgctttttgttgcccctgtggtcaaccctttgattgccttcttttttatgagacgcaatccttaccctctagtttggaactgcctccgtgtcagcggtgtgacagcctttttcactcgtagttctgcgactaacattcctgtcaacatgaaactctgccatgaccttggactcaacccagatacctattctgtttctatcccactcggttctactatcaatatggctggagtagcgattaccattaaccttttgacccttgctgcagttaacactcttggaattcctgttgactttgccacagcctttgtcctcagtgtggtagcagctatctcagcctgtggtgcttcaggtattgccggaggttccctccttcttatcccagttgcttgtagccttttcggtatttctaacgatattgccatacaagttgttggggttggttttgtgattggtgtcatctaa

SEQ ID NO: 1838 - DNA (genomic), 735 bp, Streptococcus pneumoniae; double-stranded, circular
  misc_feature (B) LOCATION 1...735
  hypothetical: NO
  anti-sense: NO
acgataacaggaggtgattcagtgttaaaaacagaacgtaaacaactaattttagaggagttaaatcagcatcatgtagtttctctagaaaaattagttagtttgctagaaacgtcagaatcaacggttcgaagagacttggatgagttggaagcggaaaacaagcttcgtcgtgtgcatggtggagcagaactcccccactccttacaggaagaagaaaccattcaagaaaaatctgtcaaaaaccttcaagaaaagaaattgctggctcagaaagcagcctctctcattaaagaaaaagatgtcatctttatcgatgctggaacaacaactgcttttttgattcatgaattggtcaataagaatgttacagttgtgaccaactccattcaccatgccgctcagttggttgaaaagcagattccaactgtcatggttggaggaaacgtcaagacggcgacagatgctagtatcgggggcgttgctcttaaccagattaaccaattgcactttgaccgtgcctttatcggaatgaatggtgttgacgatggctattatacgactcctgatatggaagagggagctgtgaaaaaagctattttggagaatgccaagcagacctacgtcttggtggattcgtcaaaaattggacaaacttgctttgccaaggtagccccactcaaacgcgctatcgttatcactagtcaagngcatgagctccttgcaggttattaa

SEQ ID NO: 1839 - DNA (genomic), 288 bp, Streptococcus pneumoniae; double-stranded, circular
  misc_feature (B) LOCATION 1...288
  hypothetical: NO
  anti-sense: NO
aaaaaaacaggcatcacagtcattgaaccagatatgctgaatgagaaagaaagcaagcaactacactacccaggtctgaaagcaggtttgttctttggtctatggatgttttttataactcctcttctcagtatactcatagatgaaggtcaggactattttcattctcttctcactataagaaatggtgtatcaagtattctcggttctattttcttcggagcgagcatacagtttctcatctcccgtcgcattgcaaaaactaagaaaaatcaagatgaggattag

SEQ ID NO: 1840 - DNA (genomic), 213 bp, Streptococcus pneumoniae; double-stranded, circular
  misc_feature (B) LOCATION 1...213
  hypothetical: NO
  anti-sense: NO
acacctgcaggtgtgagggcgacacggttttcgttatttttaatttcttttgggattccgattaacattgagataacctacctttcaattgacggtcttgttttggttgtcacattccagttcataaatcaaaaatgtgacggtttcattgtatatgaaaccgcttcaaaaatcaagaaaaacttgtcatccaaattttttatgctagactag

SEQ ID NO: 1841 - DNA (genomic), 273 bp, Streptococcus pneumoniae; double-stranded, circular
  misc_feature (B) LOCATION 1...273
  hypothetical: NO
  anti-sense: NO
ccattggcaggcatattactttgtaccgaacgaacaactacaccagatgtaacattacttggaatattgagtcttctgatgtcgcttgtactcacattagataaattaaccatctggattcccaaagctggacgcgtcacttttccgtttttttctaactgttcaataatattgatagcatcatttgcaggaattgcgaaaccaagaccttctacagatgttcctccatttgtagcaattttacttgaggtaattccgataacctgcccttga

SEQ ID NO: 1842 - DNA (genomic), 945 bp, Streptococcus pneumoniae; double-stranded, circular
  misc_feature (B) LOCATION 1...945
  hypothetical: NO
  anti-sense: NO
ttctgggcaggtcttgctatgactatcactatgggaggcttggcctttgtcccaaatatctattggttaatctttcttcgtttactaaacggtgtatttgcaggttttgttcctaatgcaacggcactgatagccagtcaggttccaaaggagaaatcaggctctgccttaggtactttgtctacaggcgtagttgcaggtactctaactggtccctttattggtggctttatcgcagaattatttggcattcgtacagttttcttactggttggtagttttctatttttagctgctattttgactatttgctttatcaaggaagattttcaaccagtagccaaggaaaaggctattccaacaaaggaattatttacctcggttaaatatccctatcttttgctcaatctctttttaaccagttttgtcatccaattttcagctcaatcgatcggccctattttggctctttatgtacgcgacttagggcagacagagaatcttctttttgtctctggtttgattgtgtccagtatgggcttttccagtatgatgagtgcaggagtcatgggcaagctaggtgacaaggtgggcaatcatcgtctcttggttgtcgcccagttttattcagtcatcatctatctcctctgtgccaatgcctctagcccccttcaactaggactctatcgtttcctctttggcttgggaaccggtgccttgattcccggggttaatgccctactcagcaaaatgactcccaaagccggcatttcgagggtctttgccttcaatcaggtattcttttatctgggaggtgttgttggtcccatggcaggttctgcagtagcaggtcaatttggctaccatgctgtcttttatgcgacaagcctttgtgttgcctttagttgtctctttaacctgattcaattatcgaacacttattaa

SEQ ID NO: 1843 - DNA (genomic), 282 bp, Streptococcus pneumoniae; double-stranded, circular
  misc_feature (B) LOCATION 1...282
  hypothetical: NO
  anti-sense: NO
tcatgggcaggaagttggaacatcagtaattctgtggcccatgttatcttccgtggagcattcaacgagtatgccaattatatcccgaattactactatgaanacttactccaagccattgaacgctatgaaaccatgggacttgaaatccttttatcctcattaacacgaaccatgatgactcaggcaagcaatatatggagcagattcgaattgttcgccagaccttgcagaatcgtgattggaatgagaaaattaaaaagacggttcgaggatttatga

SEQ ID NO: 1844 - DNA (genomic), 432 bp, Streptococcus pneumoniae; double-stranded, circular
  misc_feature (B) LOCATION 1...432
  hypothetical: NO
  anti-sense: NO
ggggttncagggaagacaaaggatggtttccctctccgggaagtaaagggaatttcctccctaataatccgaaaagggatggaggggacggaatttatatggagatttgggattgttttatcaaggggcatggttcaaaacaatcgagtcttttggatggacaaacgccataattcagctttttcagggagggacctagaaattggtttgagagagcgtagagtgtttacccttatcttaacaggtgtctggacggatatatgtgtcctacatacagctaaagaggcctataatgtaggagatgacatagagattgttaaaccagctgtagcttccatctggcctgaaaatcatcaatttgccctaggtcatttcaaaaatacactcggaggtaagtcagtagaagaaaatttaaatgaactttctgagtaa

SEQ ID NO: 1845 - DNA (genomic), 1026 bp, Streptococcus pneumoniae; double-stranded, circular
  misc_feature (B) LOCATION 1...1026
  hypothetical: NO
  anti-sense: NO
cctaatcaaggaggatttatggctaccttaaaagacattgcacagctagcctctgtctctatcgcgaccgtatcccgcgtcctcaaccgcgaccagagcctatctgttacagaagaaaccagacaccgtattttaaccgttgctgaagagctgggctacaccaagcacctcaagacaggcgagtcccataaacccaagcaaaagattgccattattcaatgggtcagcgaacaaggggagctagacgacctctactactaccagattcgcctaggaatagaaaaaagagcccaagagttggactacgatatcttgcgctattttaatgaccatccttttaccttaagcgaggaagtgattgggattctctgcatcggaaaatttagccgagctcagatttctgcctttgaagaataccaaaaacccctggtctttctagacagtgatacactttccctcggacatacctgcattattacggacttttacactgccatgaaacaggttgtcgattatttcctcagtcaagggatggaccgtatcgggattctaacaggccttgaagaaacaactgaccaagaagaaatcattgaggataagcggctggaaaatttcagaaactacagtcaagcaaaaggaatctatcatgatgaactggtctttcaaggaagatttactgcccagtctggctatgacttaatgaaggaggccattcagagcttgggagaccaacttccgccagcatttttcgcagccagcgatagtttagctatcggtgccctccgtgccctccaagaagctggaatcagcctgccagatcgcgtcagcctcatttcctttaacgacactagtctgaccaaacaggtctatcctcccctctctagtattacagtttatactgaagaaatgggccgagcaggtatggatattcttaacaaggaagtcctccacggtcggaaaatccctagcctgaccatgctgggaaccagactgacattaagagaaagtaccctaaatcaagaatag

SEQ ID NO: 1846 - DNA (genomic), 897 bp, Streptococcus pneumoniae; double-stranded, circular
  misc_feature (B) LOCATION 1...897
  hypothetical: NO
  anti-sense: NO
aaattgcaaggaagaggttggaggcagaaaatgaaacaaactagaaattttgatgagtggttgtcaacgatgaccgacacagtagctgactggacttattatacagattttcctaaggtttataaaaatgtatctagtataaaagttgctctaaatattatgaatagtcttattggtagtaaaaatatacaagaggattttttagacttatatcaaaattatccagaaattttgaaagttgtgcctctacttattgctaaacgtttgagagatacgattattgttaaggatccgataaaagatttctattttgattttagtaaacgaaactatagtattgaagaatatactatgtttttggaaaaatcaggtatatttgatttattgcaaaatcatttagtatcaaatttagttgactacgttacaggtgttgaggttggtatggatactaatgggcgcaaaaatcggactggagatgcgatggaaaatattgttcaaagttatcttgaagctgaagggtatattttaggagagaatttatttaaagagattgaacaaaatgaaatagaggaaattttttctgtcgatttatctgctattacgaatgatgggaatactgtgaaacgttttgattttgtcataaaaaatgaacaagtgctttatctgattgaggttaatttttattcaggaagtggttcaaaattaaatgagacggctagatcttacaaaatgattgctgaagaaactaaagctattcctaatgttgagtttatgtggattactgatggacaaggttggtataaggctaagaataatttacgagaaacatttgatattttaccattcttatataatattaacgatttggaacataatattttaaagaatttgaaatag

SEQ ID NO: 1847 - DNA (genomic), 942 bp, Streptococcus pneumoniae; double-stranded, circular
  misc_feature (B) LOCATION 1...942
  hypothetical: NO
  anti-sense: NO
aaagttaaaggagtagccatgtcagaaaatcaacaagcattgaaccatgtggtgtccatggaagacctcactgtcgatcaagtaatgaaattgatcaagcgaggaattgagtttaaaaatggagcccagcttccctatgaagaccatccgattgtttccaatctcttctttgaggattctacacggacacataagtcctttgaagtcgcagagattaaacttggattggaacgacttgactttgatgtgaagactagttcggttaataagggtgagacactttatgacaccattttgactctgtctgctttaggagtggatgtctgtgtgattcgccatccagaggtcgactattatagagaattgattgatagtccaacgattacgacttccatcatcaatggtggagatggttcgggtcaacaccctagccagagcttgcttgatttgatgaccatttatgaggaatttggccactttgagggtcttaaagttgctattgcaggtgacttggaccactcacgcgttgccaaatccaatatgcagattttgaaacgcttgggagctgaactctttttcgctggacctgaggaatggagaagtcaagagtttgcagactatggaaagtttgtaaccattgatgaaatcattgatcaggttgatgtcatgatgtttctccgtgtgcaacacgaacgccatgatagtggagctgtattttcaaaagaagactaccatgcccaacatggcttgactcaagaacgttacgatcgtttgaaagaaacagcaatcctcatgcacccagctccaatcaatcgtgatgtagaaatagcagaccacttggttgaagcaccaaaatcacggattgtccaacaaatgaccaatggtgtctttgttcgaatggcaatcttagaatccgtactagcgagtagaaacgccaactaa

SEQ ID NO: 1848 - DNA (genomic), 204 bp, Streptococcus pneumoniae; double-stranded, circular
  misc_feature (B) LOCATION 1...204
  hypothetical: NO
  anti-sense: NO
atacctaaaggagaaatcaaaatggcagtacctgcacgtcgcacttcaaaagcgaagaaaaacaaacgtcgtacacactacaaagtaacagctccatctgtaaactttgacgaaactactggagattactcacgttctcaccgtgtatcacttaaaggatactacaaaggacgtaaaatcactaaagctgcatcagctgaataa

SEQ ID NO: 1849 - DNA (genomic), 1281 bp, Streptococcus pneumoniae; double-stranded, circular
  misc_feature (B) LOCATION 1...1281
  hypothetical: NO
  anti-sense: NO
atttataaaggaggctttccaatgaaatggtataaaaaaatcggacttcttgcaactacaggtttagctttggttgggctcggcgcttgctccaactatggtaaatctgcggatggcacagtgaccatcgagtatttcaaccagaaaaaagaaatgaccaaaaccttggaagaaatcactcgtgattttgagaaggaaaaccctaagatcaaggtcaaagtcgtcaatgtaccaaatgctggtgaagtattgaagacacgcgttctcgcaggagatgtgcctgatgtggtcaatatttacccacagtccatcgaactgcaagaatgggcaaaagcaggtgtctttgaagatttgagcaacaaagactacctgaaacgcgtgaaaaatggctacgctgaaaaatatgctgtaaacgaaaaagtttacaacgttccttttacagctaatgcttatggaatttactacaacaaagataaattcgaagaactgggcttgaaggttcctgaaacctgggatgaatttgaacagttagtcaaagatatcgttgctaaaggacaaacaccatttggaattgcaggtgcagatgcttggacactcaatggttacaatcaattagcctttgcgacagcaacaggtggaggaaaagaagcaaatcaataccttcgttattctcaaccaaatgccattaaattgtcggatccgattatgaaagatgatatcaaggtcatggacatccttcgcatcaatggctctaagcaaaagaactgggaaggtgctggctataccgatgttatcggagccttcgcacgtggggatgtcctcatgacaccaaatgggtcttgggcgatcacagcgattaatgaacaaaaaccgaactttaagattgggaccttcatgattccaggaaaagaaaaaggacaaagcttaaccgttggtgcgggagacttggcatggtctatctcagccaccaccaaacatccaaaagaagccaatgcctttgtggaatatatgacccgtccagaagtcatgcaaaaatactacgatgtggacggatctccaacagcgatcgaaggggtcaaacaagcaggagaagattcaccgcttgctggtatgaccgaatatgcctttacggatcgtcacttggtctggttgcaacaatactggaccagtgaagcagacttccataccttgaccatgaactatgtcttgaccggtgataaacaaggcatggtcaatgatttgaatgccttctttaacccgatgaaagcggatgtggattag

SEQ ID NO: 1850 - DNA (genomic), 666 bp, Streptococcus pneumoniae; double-stranded, circular
  misc_feature (B) LOCATION 1...666
  hypothetical: NO
  anti-sense: NO
ctttgtaaaggcagactttgtagatattttggaggacatcaagtaatgaaactctactttgtccgccacggtcgtaccctctggaaccaagaaggtcgttttcaaggtgctagcggtgattctcctcttcttcctgaatccattgaaaccctaaaacgacttggccagtatctcaaggaaattccttttgatcagatttattcaagtgatttacctcgagcggtcaaatctgctgagattatccaaagtcaactctataccccctgttctttagaaatcgttcctaatctccgtgaatggcaacttgggaagttagaaggtttgaaaattgcaaccttggaagctatttacccgcaacaaatccaggcttttcgttcaaatcttgctcaatttgacactcgaatgttcggagccgaatccctctatagtacaactcagcggaccatccaatttatcaaatcattaaaagatagtccagctgagcgtattctaattgtcggacacggcgccaatcttactgccagtcttcgtactctcctaggctataaagaaccacttcttcgtaaagatggcggtctagcaaatgccagcctgaccattatagaaacccatgattttgaaacattcactctcaatacttggaatgatacttcttatcaatcataa

SEQ ID NO: 1851 - DNA (genomic), 258 bp, Streptococcus pneumoniae; double-stranded, circular
  misc_feature (B) LOCATION 1...258
  hypothetical: NO
  anti-sense: NO
tacttcaaaggaggaaatcagatggtagtaaaaacaagaaaacaaggaaattcaatcaccattacgattccaagtgaatttaatattccaagtggtgttaaatacgaagcgaaattgttacaaagtggtgagattatctttactcctgaagaattggggcagcaggtttcttatgtatctgatgatgcctttgacttaaatttagataaaatatttgacgaatacgacgatgttttcaaagctttggtggaaaaatga

SEQ ID NO: 1852 - DNA (genomic), 747 bp, Streptococcus pneumoniae; double-stranded, circular
  misc_feature (B) LOCATION 1...747
  hypothetical: NO
  anti-sense: NO
gaccaaaaaggtcatatatataaaggagtcacaaaaatcatgaacaaacgtgtaaagatcgttgcaactttgggtcctgcggtagaaatccgtggtggtaaaaaattcggtgaggatggatactggggtgaaaaacttgatgttgaagcttcagctaaaaacattgctaaattgattgaagctggtgctaacacattccgattcaacttctcacacggcgaccaccaagaacaaggtgagcgtatggcaactgttaaacttgcggaaaaaattgcaggtaaaaaagttggtttccttcttgatacaaaaggacctgaaatccgtacagaattgttcgaaggtgaagctaaagaatattcatataaaactggtgaaaaaattcgtgttgcaactaaacaaggaatcaaatcaactcgtgaagtgattgcgttgaacgttgctggtgctcttgatatctatgatgatgttgaagttggtcgtcaagttttggttgacgatggtaaacttggtcttcgtgtggttgctaaagatgatgcaactcgtgaatttgaagttgaagttgaaaacgatggtatcatcgctaaacaaaaaggtgtgaacatccctaacactaaaattcctttcccagctcttgctgaacgcgataacgacgatatccgtttcggtcttgaacaaggtatcaacttcatcgcaatttcattcgtacgtactgcaaaagaatgtgaacgaagttcgtgcaatctgtga

SEQ ID NO: 1853 - DNA (genomic), 1362 bp, Streptococcus pneumoniae; double-stranded, circular
  misc_feature (B) LOCATION 1...1362
  hypothetical: NO
  anti-sense: NO
aaaagaaaaggaaaaataatgacaaaacgtgtaacgattattgacgtaaaagactatgttggtcaggaagtgacgattggcgcttgggttgccaacaaatcaggaaaaggaaaaatcgctttcttacaattgcgtgatggaacagccttctttcaaggtgtggcttttaaaccaaactttgtcgaaaaatttggtgaagaagtgggacttgagaagtttgatgttatcaaacgcttgagccaagaaacgtctgtttatgtgacaggtattgtcaaagaggacgaacgttctaaatttggctatgagttggacatcacagacatcgaagtgatcggtgaatctcaagactacccaatcacaccaaaagaacacggaacagactttttgatggataaccgtcacttgtggctacgctctcgtaagcaagtagctgtgttgcaaatccgtaacgctattatctatgcaacttatgagttctttgacaagaacggttttatgaagtttgacagcccaattctttcaggaaatgcggcagaagattctacagaactctttgaaactgactacttcggaacgccagcctacttgagccaatcaggtcagctttacctagaagcaggggctatggctcttggtcgtgtctttgactttggtccagttttccgtgctgaaaaatcaaaaacacgccgtcacttgactgagttctggatgatggatgctgagtactcatacttgacacatgatgagtcgcttgacttgcaagaagcttatgtgaaagctcttctacaaggtgttcttgaccgcgcgcctcaagccttggaaaccttggaacgtgatacagaactcttgaaacgctacattgcagagccattcaaacgtatcacttacgatcaagccattgacctcttgcaagagcatgaaaatgatgaagatgctgactacgagcatcttgagcatggtgatgactttgggtcaccacacgaaacttggatttcaaaccactttggtgtgccaacatttgtcatgaactatccagcagccatcaaggccttctacatgaaaccagttcctggaaatccagagcgcgtgctttgtgcagacttgcttgctccagaaggctatggagaaattatcggtgggtctatgcgtgaggaagattacgatgcccttgtcgctaagatggatgaacttggcatggatcgtacagaatatgaattctaccttgaccttcgtaaatacggtacagttccacacggaggatttggtatcggtatcgaacgtatggtaaccttcgcagcaggaacaaaacatatccgtgaagctattccattcccacgtatgttgcaccgtatcaaaccataa

SEQ ID NO: 1854 - DNA (genomic), 261 bp, Streptococcus pneumoniae; double-stranded, circular
  misc_feature (B) LOCATION 1...261
  hypothetical: NO
  anti-sense: NO
aaccagaaaggaggtaatattatgactgaaattcacgcatgtctttgcggaaattgggtgaacctatcagccgacgacgattgtgtaatgggaccaaatatggctagtccttacatttggtgggaagaaaatgcagaactctactcaccaatttctaaacctgaagcaaactcgatgtaccatcaggattatatctacattcactatcgtggcgctgactatcgtatccatccaatgttcattcaaatcgtttctagataa

SEQ ID NO: 1855 - DNA (genomic), 357 bp, Streptococcus pneumoniae; double-stranded, circular
  misc_feature (B) LOCATION 1...357
  hypothetical: NO
  anti-sense: NO
gttaagaaaggaaaaaacgaaatgcatattgaacatcttagccactggagtggtcatcttaaccgtgaaatgtaccttaaccgttatggacatggtgggattccagttgtggtctttgcttcatcaggtggtagtcacaacgaatactatgattttggcatgattgatgcctgtgcttcctttatcgaggaaggccgtgtccagttctttaccctatctagtgtggatagtgagagctggttggctacttggaaaaatgctcatgaccaagcggaaatgcaccgtgcctacgaacgttatgtgattgaggaggccattcttttatcaagcacaagacaggttggtttgatggcatga

SEQ ID NO: 1856 - DNA (genomic), 624 bp, Streptococcus pneumoniae; double-stranded, circular
  misc_feature (B) LOCATION 1...624
  hypothetical: NO
  anti-sense: NO
aaagagaaaggaaatctcatgttaaaacttattgctattgttggaacaaattcaaaacgttctacaaaccgtcaattgcttcaatacatgcaaaaacactttgctgacaaagctgaaattgaacttgttgaaatcaaggccattcctgtcttcaacaaaccagctgacaagcaagtacctgctgaaatattggaaattgctgctaaaatcgaagaggcagatggcgttattatcggtactcctgagtatgatcactctattccagctgttttgatgagcgctcttgcttggttgtcttatggtatttacccacttttgaacaaaccaatcatgattacaggtgcttcttacggtacgcttggttcatctcgtgcccaattgcaacttcgtcaaatcttgaatgctcctgaaatcaaggcaaatgttcttccagatgaattcttgctctcacactctcttcaagcatttaacccaagtggcgacttggttgaccttgatgttatcaagaaattggatgccatctttgatgacttccgtatcttcgtgaagattactgagaaattgcgcaatgcgcaagaattgcttcgcaaagatgctgaagactttgactgggaaaatttgtaa

SEQ ID NO: 1857 - DNA (genomic), 471 bp, Streptococcus pneumoniae; double-stranded, circular
  misc_feature (B) LOCATION 1...471
  hypothetical: NO
  anti-sense: NO
tgttttgaagggtggtatactaatctcaaagataacaattatatccaaaggaggcaacatatgccaaacgtcaaagaaattacaagagagtcatggattttagccactttcccagagtggggaacatggttgaacgaagaaatcgaagaagaagtcgtacctgaaggcaactttgccatgtggtggctaggcaactgtggtacttggattaagacaccagctggtgctaacgttgtcatggacctttggtcaaaccgtggaaaatcaaccaaaaaagtgaaagatatggttcgtgggcaccaaatggcaaatatggcaggtgttcgtaagttgcaaccaaacttgcgtgttcagccaatggttatcgatccatttgctatcaacgaactagactattacttagtttcacacttccacagtgatcatatcgacccatacacngctgcngcattttcacatttcctaagttag

SEQ ID NO: 1858 - DNA (genomic), 327 bp, Streptococcus pneumoniae; double-stranded, circular
  misc_feature (B) LOCATION 1...327
  hypothetical: NO
  anti-sense: NO
attgtagaaggtaaggaattatgctataatggtactattctaaggaaagagggtgttagaatgggatttactgaagaaacagtacgttttaaattggacgattccaataaaaaagaaattagcgaaactttgacagatgtttatgcttcgttgaacgataagggttacaacccaattaaccaaatcgtaggttacgtattgagtggagaccctgcctacgttcctcgttataataatgcacgaaatcaaatccgtaagtatgagcgtgatgaaatcgttgaggaattggttcgctactacctcaaaggacaaggagtcgatctataa

SEQ ID NO: 1859 - DNA (genomic), 516 bp, Streptococcus pneumoniae; double-stranded, circular
  misc_feature (B) LOCATION 1...516
  hypothetical: NO
  anti-sense: NO
ccgccagaaggcagtcgcagcggtaaatccttaatgatgaagaagacttataatcatattttggtctggggagtcattttctatagcatttgcattgtctatttttgctttactcctcaagaacaatctaccgtgggagtgggaactccagatattcagcatcttggacgcctggtttttcttttgactcctttcaattctctctggaaactgggcgaagtgagtgacattggacaattatgttggatttttttacaaaatatcctcaatgtcttcttgttttttcctctgattttccaactcctttatctatttccaaatttgcggaaaacaaaaaaggtccttctttttagttttcttgtgagtcttggaatcgagtgtacgcaattaatcttggactttttctttgatttcaatcgcgtctttgagattgatgatttgtggaccaacactttgggtggctatctggcttggctcctttataaacgattacataaaaacaagataaggaattaa

SEQ ID NO: 1860 - DNA (genomic), 486 bp, Streptococcus pneumoniae; double-stranded, circular
  misc_feature (B) LOCATION 1...486
  hypothetical: NO
  anti-sense: NO
aatcaagaaggaatcgaaaactacgcttacaccaccaacagcaagggcgaaaagatttacgcttttgaagtagatggcctaggaaatgccagcatcatggatgatccgaatgtgccaagtctactagctgcgccctatctgggctactgttcgatcgatgatgaagtgtatcaagccactcgccgtaccattctgagctctgaaaattcatacttctaccaaggagaatacgctagcggtcttggaagttctcataccttctatcgctatatctggccaatcgccctttctatccaaggattgacaacaagagataaggcagagaaaaaattcttgctggatcagctggttgcctgcgatggtggtacaggtgtcatgcacgaaagcttccacgtagatgatccgaccctctactctcgtgaatggttctcctgggctaacatgatgttctgtgagttggtcttggattacttggatattcgctaa

SEQ ID NO: 1861 - DNA (genomic), 1083 bp, Streptococcus pneumoniae; double-stranded, circular
  misc_feature (B) LOCATION 1...1083
  hypothetical: NO
  anti-sense: NO
aagaaagaaggaactgaaatgacaacattattttcaaaaattaaagaagtaacagaacttgctgcagtctcaggtcatgaagcgcctgtccgtgcttatcttcgtgaaaagttgacaccgcatgtggatgaagtggtgacagatggcttgggtggtatttttggtatcaaacattcagaagctgtggatgcaccgcgcgtcttggtcgcttctcatatggacgaagttggttttatggtcagcgaaatcaagccagatggtaccttccgtgtcgtagaaatcggtggctggaaccccatggtggttagcagccaacgtttcaaactcttgactcgtgatggtcatgaaattcctgtgatttcaggttctgttcctccgcatttgactcgtggaaaggggggaccaaccatgccagccattgccgatatcgtttttgatggtggttttgcggacaaggctgaggcagaaagttttggcatccgtcctggtgataccattgtaccagatagttctgcaattttgacagccaatgaaaaaaatatcatctcaaaagcttgggataaccgctacggtgtcctcatggtaagcgagctagctgaagctttatcgggttcaaaactcggcaatgaactctatctgggttctaacttccaagaagaagttggtctgcgtggcgctcatacctctacaaccaagtttgacccagaagtcttcctcgcagttgcttgctcaccagcaggtgatgtctacggtggtcaaggcaagattggagatggaaccttgattcgtttctatgatccaggtcacttgcttctcccagggatgaaggatttccttttgacaacggctgaagaagctggtatcaagtaccaatactactgtggtaaaggcggaacagatgcaggtgcagctcatctgaaaaatggtggtgtcccatcaacaactatcggtgtctgcgctcgttatatccattctcaccaaaccctctatgcaatggatgacttcctagaagcgcaagctttcttacaagccttggtgaagaaattggatcgttcaacggttgatttgattaaacattattaa

SEQ ID NO: 1862 - DNA (genomic), 282 bp, Streptococcus pneumoniae; double-stranded, circular
  misc_feature (B) LOCATION 1...282
  hypothetical: NO
  anti-sense: NO
actagggaaggagaaatttcaatggaacgcaataatcgtaaagttcttgttggacgtgttgtatctgacaaaatggacaagacaatcacagttgtagttgaaacaaaacgtaaccacccagtctatggtaaacgtattaactactctaaaaaatacaaagctcatgatgaaaacaatgttgccaaagaaggcgatatcgtacgtatcatggaaactcgcccgctttcagctacaaaacgtttccgtcttgtagaagttgttgaagaagcggtcatcatctaa

SEQ ID NO: 1863 - DNA (genomic), 1356 bp, Streptococcus pneumoniae; double-stranded, circular
  misc_feature (B) LOCATION 1...1356
  hypothetical: NO
  anti-sense: NO
aatcttagaggtacaatcaactacggaggaatagagatgctcagattagtttactatcaatttttacataataagaaacaatggttaggcgtttcaccagtaatttttgtttcgagtttagttatgggattggctgttaatggggtaattaatgttgagaataattcgcaagtatttgtcggacttccagatcctaaaccaatttttatgtttccgatagtattcggaggagtaacattattctttgtgctctctaacataataaatatgttggttgaaatttttagagatgattacgaacttctggaggtgttgggagcaagtcgccttcaactatcatttcttgtggggggacagatttttatcatttcctcgattattagttttattgcatatctatgctctatatttgttacgtcaaattattattattttttacaatactttttcggggaaaatatattacctgatatccaatttcaaatgagtgctgttggatgtatcattacagtagtgttgatttcatttttagcctttctaagtggttgcttttatacgttcaagaagattagaaataggaagagttctaaaataaggcatgttctttcaatagtaaaaagaatactgctattggctggttttagtgttatctggttgctttctttgcaacaaattttccaagatagcacaattttagcgaaggcccagataatattcaatattgtaatcttagatattgtgattatttatcaattatctccttttatacagtcatgttttatcaaactactttctataattatatttagaaataattttatgttcattgtttcgaagtggaatttactatatcgtaagccttatataaaatctatcagtgctgcaattacaggagctatattactaatttctagttttcaaatgatttctcagaatatactatctcaatttcaagatgacagtgatttagagctaaaagtggcatttattgtctatgtaggagcaccaattttgatagtacttgcaaatattatttcaattgcatttttgtcatcgcatcaagaaaggattgagattcagcaatttgaaattttaggaacttccaattaccagatggttaagattaaagttggtgaggctatatttttgacatttgttacttcattaattgcatttttacttaacattaaaattatggttttaatatactactctttagaggatattttaatagatgatatgaatcttttggggttaatacttccaaattttatagtgtctattattttatttattttaatatttattactaaaagttcctattttatctttaagaatgcaaaaattatttcttaa

SEQ ID NO: 1864 - DNA (genomic), 378 bp, Streptococcus pneumoniae; double-stranded, circular
  misc_feature (B) LOCATION 1...378
  hypothetical: NO
  anti-sense: NO
gaaaatagaggatatttatcacgtggagggactgctatgagagacgatatcaaaatcaatgaccgtgctttggccttgcaagaccaaatcatcgaaaaactagagaaagtttttgatacagatgtggaattggatgtttacaatctaggtctgatttatgaaatcaatctggatgaaacggggctctgcaagattgtcatgaccttcaccgatactgcctgtgattgcgccgaaagcctgcctattgaaatcgtggcaggtctgaaacaaatcgagggtatcaaagatatcaaggttgaagttacctggtcgcctgcttggaaaatcacacgaatcagtcgctatggccgtattgcccttggactaccacctcgttaa

SEQ ID NO: 1865 - DNA (genomic), 1455 bp, Streptococcus pneumoniae; double-stranded, circular
  misc_feature (B) LOCATION 1...1455
  hypothetical: NO
  anti-sense: NO
agtaacagaggatattcattcatgaaaattttatttgtagcagcagagggtgcacccttttcaaaaacaggtggtttgggagacgtcattggcgctcttccaaaatcactggtaaaagctgggcacgaagttgcagtgattttaccctactatgatatggtagaggctaaatttggaaatcagattgaagatgtgcttcattttgaggtgagcgttggttggcgcagacagtattgtggaattaagaaaacagtattaaatggtgtaaccttctactttattgacaatcaatattatttcttccgtggtcatgtttacggtgattttgatgacggagaacgctttgcctttttccaactggctgccattgaggctatggaaaggattgcctttattcctgatcttctccatgttcatgactaccatacagctatgattcctttcttgttgaaggaaaaataccgttggattcaagcctatgaggacattgaaacagttttaaccattcataatttagaattccaaggacaattttcagaaggaatgttgggtgatttgtttggagttggctttgaacgttacgctgatggcacccttcgatggaacaactgtctgaactggatgaaggcaggtattctctatgcgaaccgtgtttcaactgtttcacctagctatgctcatgaaattatgactagtcagtttggatgtaatttggatcagattcttaaaatggagtctggtaaagtatctggtatcgtgaatgggattgatgctgatctttataatcctcagacggatgctcttttagactatcatttcaatcaggaagatttgtctgggaaagccaaaaataaggcaaaattgcaagaaagagttggcttgcctgttagagctgacgttccactggtgggaattgtttctcgtttgacacgtcaaaaaggttttgatgtggtggtcgaaagtcttcaccatatcttgcaagaagatgttcagattgttcttttgggaactggcgatccagcctttgaaggagctttctcatggtttgctcagatttacccagacaagctatcagcaaatatcacttttgatgtcaaacttgctcaggaaatctacgctgcttgtgacctcttcctcatgccaagtcgttttgaaccgtgtggtttgtctcaaatgatggctatgcgttatggaaccttgccattggtccatgaagttggaggcttgcgagatacagtttgcgctttcaatccaatcgaaggaagcggtactggctttagctttgacaatctatctccttattggttaaattggactttccaaacagcattggacttgtatagaaaccatccagacatttggagaaacctacaaaaacaagctatggagagtgacttctcatgggatacagcctgcaagtcataccttgacttgtatcatagtttagttaattaa

SEQ ID NO: 1866 - DNA (genomic), 1590 bp, Streptococcus pneumoniae; double-stranded, circular
  misc_feature (B) LOCATION 1...1590
  hypothetical: NO
  anti-sense: NO
agaataagaggaagaaaaatggcatttgaaagtttaacagaacgtttgcagaacgtctttaaaaatctacgtaaaaaaggaaaaatctctgaatctgatgtccaagaggcaaccaaagaaattcgcttggccttgctcgaggccgacgttgccttgcctgttgtaaaggactttatcaagaaagttcgtgagcgtgcagtcgggcatgaggtcattgatacacttaatcctgcgcaacagattattaaaatcgttgatgaggaactgacagccgttttaggttctgatacggcagaaattatcaagtcacctaagattccaaccatcatcatgatggttggtttacaaggggctggtaaaacaacctttgctggtaaattggccaacaaactcaagaaagaagaaaatgctcgtcctttgatgattgcggcggatatttatcgtccagctgccattgaccagcttaagaccttgggacaacagattgatgtgcctgtctttgcacttggaacagaagtaccagctgttgagattgtacgtcaaggtttggagcaagcccaaactaatcataacgactatgtcttgattgatactgcgggtcgtttgcagattgatgagctcctcatgaatgagcttcgtgatgtgaaaacattggctcaaccaaatgaaatcttgcttgtcgttgatgctatgattggtcaggaagcagccaatgttgcgcgtgagtttaatgctcagttggaagtgactggggtcatccttaccaagattgatggcgatactcgtggtggtgctgctctgtctgttcgtcacattactggaaaaccaatcaagttcactggtacaggtgaaaagattacggacattgaaaccttccacccagaccgcatgtctagccgtatccttggtatgggggatatgctcactttgattgagaaagcttctcaggaatacgatgaacaaaaagcccttgaaatggctgagaagatgcgcgaaaacacctttgattttaatgatttcatcgatcaattagatcaggtgcaaaatatggggccgatggaagacttgctcaagatgattccaggtatggcaaacaatccagcccttcaaaacatgaaggtggatgaacgccagattgctcgtaaacgtgccattgtgtcttcgatgacacctgaagagcgtgaaaacccagatttgttaaatccaagccgtcgccgtcgtattgctgctggttctggaaatacattcgtcgaagtcaataaattcatcaaggactttaaccaggctaaacagctcatgcagggtgttatgtctggggatatgaataaaatgatgaagcaaatggggattaatccaaataaccttcctaaaaatatgccaaatatgggaggaatggatatgtctgcccttgaaggaatgatgggacaaggcggtatgcctgacttatcagctctcggaggagcaggaatgccagatatgagccagatgtttggtggcggtttgaaaggtaaaattggtgaatttgctatgaaacagtccatgaaacgtatggctaacaaaatgaagaaagcgaagaagaaacgcaagtaa

SEQ ID NO: 1867 - DNA (genomic), 1419 bp, Streptococcus pneumoniae; double-stranded, circular
  misc_feature (B) LOCATION 1...1419
  hypothetical: NO
  anti-sense: NO
attgaaagaggtagtgagatggacgcgaaattaagatacaaggcaaagaagatcaagattgtcttttttgatattgatgatacattgcggaattcaaagacagggtttattccaactacaattcccactgtttttaaacagttgcgtgaaaaaggaattttaacaggaatcgcctctggacgtggcatttttggtgttgttccagagattcgtgatctcaagcctgacttttttgtaactttgaatggggcttatatcgaagataaaaaaggtcaggtcatttatcagcatcagattgaaaagtcatatgttgaggagtatatctcttgggctaagcaagaaggaattgagtatggcttggttgggagtcatgatgccaagttgtcgactcgcaccgatatgatgagtgaagctatcaatccaatttatcccgacttagatgtagatcccgatttccatgaaaaagaagatatctatcagatgtggacttttgaagataagggagatgacttgcacttgcctgacagtctctcagacaaacttcgcatggttcgttggcatcaacattcgtctgatattgtgccgatttcaggctccaaagcgacgggggtggaaaaggttgtggaacaccttggcttgaaaccagagaaggtcatggtttttggagatggtctcaacgacttggaactctttgattatgctggaatcagcgttgccatgggaatttctcatgataaaatcaaagaaaaagcagattatattacacaaacattagaagaagatgtcatttttgatgccttagaagtatttggtatggtagaaaaagaattgcattttccacaagtagacattgaaacagtagaaggtcctcttgcgactattaagaccaatcacggagacttacgtatcaagcttttccctgaacatgctcctaaaacagtggctaactttgtatctctttcaaaagatggctactatgatggtgtcattttccaccgtattatcaaggactttatgatccaaggtggagacccaactggaactggtatgggtggcgagtcaatctacggcgaatcttttgaggatgaattctcagaagagctttacaatatccgtggtgctctttccatggcaaatgctggtccaaataccaacggcagccagttctttatcgtgcaaaaccaacacctaccttattctaagaaagaaattactcgtggtggttggccagaaccgattgcagaaatctatgccaatcaaggtgggacacctcacctagaccgccgtcacacggtttttggtcagttagctgatgaagcatcttacgctgtcttggatgtcattgctgctgttgagacaggagctatggacaagccagttgaagatgttgtaattgaaactattgaaatcgaggactaa

SEQ ID NO: 1868 - DNA (genomic), 669 bp, Streptococcus pneumoniae; double-stranded, circular
  misc_feature (B) LOCATION 1...669
  hypothetical: NO
  anti-sense: NO
tctaagagaggagaaaatatggaagcaattatcgagaaaatcaaagagtataaaatcatcgtcatctgtactggtctgggcttgcttgtaggaggatttttcctgctaaaaccagctccacaaacacctgtcaaagagacgaatttgcaggctgaagtcgcagctgtttccaaggatttggtatccgaaaaggaagtgaacaaggaagaaaaggaagaaccccttgaacaagatctaatcacagtagatgtcaaaggtgctgtcaaatcgccagggatttatgacttgcctgtaggtagtcgagtcaatgatgctgttcagaaggctggtggcttgacagagcaagcagacagcaagtcgctcaatctagctcagaaagttagtgatgaggctctggtttacgttcctactaagggagaagaagcagttagccaacagactggtttggggacagcttcttcaataagcaaggaaaagaaggtcaatctcaacaaggccagtctggaagaactcaagcaggtcaagggactgggaggaaaacgagctcaggacattatcgaccatcgtgaggcaaatggcaagttcaagtcagtagacgagctcaagaaggtctctggcattggtggcaaaacaatagaaaagcttaaagactatgttacagtggattaa

SEQ ID NO: 1869 - DNA (genomic), 1677 bp, Streptococcus pneumoniae; double-stranded, circular
  misc_feature (B) LOCATION 1...1677
  hypothetical: NO
  anti-sense: NO
gattttggaggaaaaatgagtaatatcagtttaacaacacttggtggtgtgcgtgagaatggaaaaaatatgtacattgctgaaattggagagtccatttttgttttgaatgtagggttaaaatatcctgaaaatgaacaattaggggtcgatgtggtgattccaaacatggattacctttttgaaaatagcgaccgtattgctggggttttcttgacccacgggcatgcggatgcgattggtgctctaccttatctcttggcagaggctaaagttcctgtatttgggtctgagttgaccattgagttggcaaagctctttgtcaaaggaaatgatgccgttaagaaatttaatgatttccatgtcattgatgagaatacggagattgattttggtgggacagtggtttccttcttccctacgacttactccgttccagagagtctgggaattgtcttgaagacatcggaaggaagcatcgtttatacaggtgacttcaaatttgaccaaacggctagtgaatcttatgcaactgattttgctcgtttggcagagattggtcgtgacggcgtcctggctctcctcagtgattcggccaatgcagacagcaatattcaggtggctagtgaaagtgaagttagggatgaaattacccaaactattgctgactgggaaggtcgtatcatcgttgcagctgtttccagtaatctttctcgtattcagcagatttttgacgctgcggataaaacaggtcgacgtatcgtcttgacaggatttgatattgaaaatatcgtccgcacagcgattcgtcttaagaagttgtctttagccaacgaaattctcttgattaagcctaaagatatgtctcgctttgaagaccatgagttgattattcttgagacaggtcgtatgggtgaacctatcaatggacttcgtaagatgtcgattggtcgccatcgttatgtagaaatcaaggatggggacctggtctatattgctacggctccgtctattgctaaagaagcctttgttgcgcgtgtagaaaatatgatttatcaggcaggtggggttgtcaaattgattacccaaagtttacatgtatcagggcacggaaatgtgcgtgatttgcagctgatgatcaatcttttgcaacctaagtacctcttccctgtccaaggggagtatcgtgagttggatgctcacgctaaggctgccatggcagttgggatgttgccagaacgcatcttcattcctaaaaaggggacgaccatggcttacgagaatggagactttgttccagctggatcggtttcagcaggagatatcttaattgatgggaatgccattggtgatgttggaaatgttgttcttcgtgaccgtaaggtcttgtcagaggatggaattttcatcgtggctattacagtcaaccgtcgtgagaagaaaattgtggctagagctcgtgttcacacgcgtggatttgtttatctcaagaagagtcgcgatattctccgtgaaagttcagaattgattaaccaaacggtagaagattatcttcaaggagatgactttgactgggcagatcttaaagggaaggttcgagataatttgaccaagtatctctttgaccaaaccaagcgtcgtccagctattttaccagtagtcatggaagcaaaataa

SEQ ID NO: 1870 - DNA (genomic), 195 bp, Streptococcus pneumoniae; double-stranded, circular
  misc_feature (B) LOCATION 1...195
  hypothetical: NO
  anti-sense: NO
gtgattggaggcaagaatatggataaagattatatattaaaagtgatagggctgtatcatcaatttttactgggaaacaataaaacgttgcaagtgctgaaaaatgtttctctttctgcttcgagaggagaatttataagtattctaggaattacgtggttctggaaagtcaactttattaaaatgtatttctag

SEQ ID NO: 1871 - DNA (genomic), 318 bp, Streptococcus pneumoniae; double-stranded, circular
  misc_feature (B) LOCATION 1...318
  hypothetical: NO
  anti-sense: NO
aaaatcggaggaaatattatgaagcttatcaatacgacaaactcacactcgcaacttgtaaaaagtcaactagaaagtaccgatgcaacccttgttgaggtttattctgcagggaatacagatgttatttttacccaagctccgcttcactatgaaatcctcatctcaaacaaacaccgtgctattcgtgagcctgaaatcgaaaccattcaagaatttttcttgaaacgtaaaattgataaggcctctgttgatgaagccaatatcaagacactctactcagagaaattaattggaatttcaatcccaatcaagtaa

SEQ ID NO: 1872 - DNA (genomic), 1311 bp, Streptococcus pneumoniae; double-stranded, circular
  misc_feature (B) LOCATION 1...1311
  hypothetical: NO
  anti-sense: NO
aaaaacggaggttttgtcatgaacaaaaaaagtcttttgaaatgcgctgttatcgggttagtagctacctttggtttagcagcttgtggaacatctaaggatgcaagcggtggaagttcttctggtaaagaagtattagaattttatcatgggtatcatcatagtgaagatgaatggcctgtagcgaagactatgcgagatttatatgataaatttgcagaagaacataaagatagtggtgtagaatttaaaccaacccctgtaaatggtgatttgaaggatataatgaataacaaggttgctagtggtgagtttcctgatgtgattgacctagcaggtaatgcagtatcattagctgcgattgaacaaaaacttgttttagatttgaaaccatatatcgattcaaataagcttgaaaaaaatgttggtttgaactataagcaaaaccaaaaagatggaaaaatttatacagttcacgaacagttatttacaatgggtttgtggtacaacaaggacatatttgcaaaagcgggtgctaagacacctgatcagtggaatacttgggatgatttcactcaggcaatggcaagcattagaaaacaagatggagtgtatgcatttggtgctggagaaccatctattcgcttgtttaatacagtattaggaaccacagaaaatggacgtaaattattagacaagccattaacaaaagaaggaattgaatctaaagaatttgcagatgctttgaaaatggttatgaaagaaattcaagctaatggttctaagaatgctggtggcgatgccaatgcttattccaaagatttccaagaaggtaaatctgcagtcttctttaatggtgtgtgggcttctggtgagatgtctaagaacccaagtcttgcacctggaatctatcctgcaggtgtagcaattagttcttctggaggtggtatcactatctcaagtaagatgtctgaagctaaacaaaaactagctcttgagtttttgaaatatatgactagcgatgatgtacaaaaagtaatttttgaaaaagtaggagcaaatccttctaatgaaaatgtaaatgtaaaagaactttcagaaaagagttcagaagctactactaaaattttaggacaagcaatcactcaagttaagaatgcaaaagcagttgttccaactgtaagtgatgtttggggtggcgatgtacacacagctattatcaatgcattgacagaaagtgctgctgaaaatgtagatgttgatcaaaaagtaaaatctactcaagatgtgttgaaatcattgattggttaa

SEQ ID NO: 1873 - DNA (genomic), 597 bp, Streptococcus pneumoniae; double-stranded, circular
  misc_feature (B) LOCATION 1...597
  hypothetical: NO
  anti-sense: NO
actttaggaggtcttatgaaattattagaagatcgcatcctcaaggatgggcatatcttgggtgataacatcctcaaggtagattcctttttaacccaccaagttgactttagcttgatgcgagagattggtaaggtttttgcggaaaaatttgctgctgccggcattaccaaggtcgtaaccattgaagcgtcgggtattgccccagccgtttttacagctgaagccttaaatgttcccatgatttttgccaaaaaggctaaaaacatcaccatgaacgaaggtatcctaactgcccaagtctactcctttaccaagcaagtgaccagcaccgtttctatcgctggaaaattcctctcaccagaggacaaggtcttgattatcgacgatttccttgctaatggccaagctgctaaaggcttgattcaaatcatcgaacaggccggtgccacagtccaagctatcggtatcgtgattgagaaatccttccaagatggtcgtgatttgcttgaaaaagcaggctaccctgtcctatcacttgctcgcttggatcgttttgaaaatggtcaggtcgtatttaaggaggcagatctctaa

SEQ ID NO: 1874 - DNA (genomic), 432 bp, Streptococcus pneumoniae; double-stranded, circular
  misc_feature (B) LOCATION 1...432
  hypothetical: NO
  anti-sense: NO
agaataggaggttgtatgcaaattgaatttttcaattttctaagaagtgtcgtacagactgaagatggtttggttttgtacgctctagcactgattgtctcaatggaaatcattgattttgtgacagggacgattgcggcgattatcaatcctgacatcgagtacaagagcaaaatcggcattaacgggctccttcgtaagatttcaggggttctcttactgatgatcctcattccggcgtccgttttgttgcctgaaaagacaggttttgtattcttgcactcaatctatctcgggtacatcgcatttacttttcaatctctcattgaaaattatcgcaaattaaaaggaaatgttactctttttcagccgattgtaaaagtatttcagcgattacttgaaaaagatgatgacacgaaaaaaggagaataa

SEQ ID NO: 1875 - DNA (genomic), 1500 bp, Streptococcus pneumoniae; double-stranded, circular
  misc_feature (B) LOCATION 1...1500
  hypothetical: NO
  anti-sense: NO
tcaaaaggaggctctatagtgatcttagtagataaatttgtaacacatgtcatttctgaaagttcatttgaggaaatggatcgaatctacctgaccaaccgtgttttggcacgagtgggagaaggtgttttggaagttgagaccaatctggataaattgattgacctcaaggaccagctagttgaggaagccgttcgattagagatgattgaggatagtcagactgcgcgtgaaatccttggtactgaactgatggacttggtgactccttatccgagtcaggtcaatcgtgacttctgggaagcctatgtccactctcctgagcaagcgatagaggatttttatcaactcagtcagaaaaatgactacatcaaactcaaggccattgctaaaaatatcgcttatcgtgttccatctgattatggagaacttgaaattaccatcaatctctctaagcctgaaaaggatccgaaagagattgcggtagccaagttggtgcaagctagtaattatcctcagtgtcaactttgtttagagaatgagggttaccatggtcgggtcaaccacccagctcgcagcaaccaccggattatccgttttgaaatggttggtcaggaatgggggttccagtattcgccctatgcttactttaatgagcattgtatttttttagatggccagcatcgtcccatggccattagtcgtcagagttttgaacgtctgttggctatcgtagagcagtttccaggatattttgctggatctaatgccgacctgccgattgtggggggctctattctaactcacgatcattatcagggaggccgtcacgtatttcctatggaattggctcccttgcaaaagaccttccgatttgctggttttgagcaggtcaaggctggaattatcaagtggccaatgtctgtcctacgcttgacttcggattccaaagaggatttgattaacttagctgataagattttccaggaatggcgtcagtattcagattctagtgtgcagattttagcagagacagacgggacaccgcatcacaccatcacaccaatagcgcgtaagcgtgatggacagtttgagttggacttggtcttgcgagacaatcagacttcagcagagcatcctgatggcatctatcatccccacaaggatgtccaacatatcaagaaggaaaatatcggcttgattgaggtcatgggcttggcaatcttgccaccacgtctgaaagaagaagtggagcaagtcgctagctatcttgtaggagaagctgttacagttgccgattatcatcaggagtgggcagaccaactcaaatcccaacatccagacctaacggataaagaaaaagcccttgcaatcgtcaaggactctgtgggtgctatctttgtgcgtgtacttgaggatgcaggagtctacaagcagacagaacaagggcagacagcctttatgcgctttgtggaacaggtcggaatttcactagactag

SEQ ID NO: 1876 - DNA (genomic), 717 bp, Streptococcus pneumoniae; double-stranded, circular
  misc_feature (B) LOCATION 1...717
  hypothetical: NO
  anti-sense: NO
gaaaaaggaggaaaaaggatgtcacagattagcaaagaagccttgattgagcaaatcaaagatggaatcatcgtttcttgtcaggctcttcctcatgaaccgctttatacagaagcgggaggggtgattcccttgctggtcaaagcggctgagcaaggtggagcagtcggtatccgagcaaacagtgttcgcgatatcaaggaaattaaggaagtcactaaacttccaatcattgggattatcaaacgtgattatccacctcaggaacccttcatcacggctactatgaaagaagttgatgaattggcagaactggacatcgaggtgattgctctggattgtaccaagcgtgaacgctacgatggtttggaaattcaagagttcattcgtcaggttaaggagaaatatcctaatcagcttttgatggctgatactagtatcttcgaagaagggctagcagctgtagaagcaggaattgactttgtcggaacaaccttatcaggctacacatcctacagtccaaaagtagatggtccagattttgaattgattaagaaactctgtgatgccggtgtagatgtcattgcagaaggaaaaattcatacaccagaacaagccaaacaaatccttgaatatggagtgcgaggcatcgttgttggtggcgctattactagaccaaaagagattacagaacgttttgtagcgggattaaaatag

SEQ ID NO: 1877 - DNA (genomic), 606 bp, Streptococcus pneumoniae; double-stranded, circular
  misc_feature (B) LOCATION 1...606
  hypothetical: NO
  anti-sense: NO
gaaaaaggagggctagatatgttgcagcttactcatgtgaccttaaaaacgcgacaagtcatcttgcaagatgcggatttcacctttaaaaagggtaggttttatggtcttcttgctatcaatggctctggaaagacgaccctgttccgtgccattagcaatttaattcccataagtagtggaaatatcgcagcccctccttctttattttattatgagagtattgaatggctggatggaaacttaagtgggatggactaccttcgtcttatcaaaaacatctggaagtcagacctaaacttgagagatgaaatcgcctactgggaaatggctgactatatcagtcttcccatccgcaagtattccttaggcatgaagcaacgcttggtgattgctatgtattttctcagtcaggcaaaatgctggctcatggatgagattacaaatggcttagacgagtattatcgacagaagttttttgataggctagcacaaatcgatagacaagaacagctggttcttttaagttcccactataaggaagagttggttgatatctgcgatagagtagtaaccattcatcaggggcagatagaagaggtttag

SEQ ID NO: 1878 - DNA (genomic), 234 bp, Streptococcus pneumoniae; double-stranded, circular
  misc_feature (B) LOCATION 1...234
  hypothetical: NO
  anti-sense: NO
cagaaaggaggtaggaacgtgcagtggactttagaagctatgagaatcaacaaaggacttactcaagcagagttggcagaaaaatttgaagtttcaagtcaaacaattgctagattagaaaaagatagctctgatatcggttatcagctattgaaaaaatacatgttttttttcaatgtgaaattcgatgatatttttttagggaaaaaatacgaaaatttcgtaaataactag

SEQ ID NO: 1879 - DNA (genomic), 282 bp, Streptococcus pneumoniae; double-stranded, circular
  misc_feature (B) LOCATION 1...282
  hypothetical: NO
  anti-sense: NO
attgaaggaggaggtcataaattgaaacgattcatagctatctggattctgctatctgctggattgaatatctggcagagtatctacattaaaaagttagaagaaaagcgccctattgtcgtctataaagctgataacgcaggcgctgagatattcggtaaagtcgtcgagaaaggacggcatggcaagctatacacgcttaccattcgtgactacggggtgttcgtggttacgaaggacgtgtatgagaaagtgaaagtaggggatgaggtgttactctaa

SEQ ID NO: 1880 - DNA (genomic), 639 bp, Streptococcus pneumoniae; double-stranded, circular
  misc_feature (B) LOCATION 1...639
  hypothetical: NO
  anti-sense: NO
agacgaggagggctaagagcagaacagacagccaaagctgatggaacagtcggaagtaagtctcaaggagctgcccagaagaaagcagaagtggtcaataaaggtgattactacagcattcaaggcanatacgatgaaatcatcgtagccaacaaacactatccattgtctaaagactataatccaggggaaaatccaacagctaaggcagagttggtcaaactcatcaaagcgatgcaagaggcaggtttccccattagcgaccattacagtggctttagaagttatgaaactcagaccaagctctatcaagattatgtcaaccaagatgggaaggcagcagctgaccgctactctgctcgacctggttatagcgaacaccagacaggcttggcctttgatgtgattgggactgatggtgatttggtgacagaagaaaaagcagcccaatggcttttggaccatgcagctgattatggctttgttgtccgttatctcaaaggcaaggaaaaggaaacaggctatatggctgaagaatggcacttgcgttatgtaggaaaagaagctaaagaaattgctgagagtggtctcagtttggaagaatactatggctttgaaggcggagattacgtcgattaa

SEQ ID NO: 1881 - DNA (genomic), 2415 bp, Streptococcus pneumoniae; double-stranded, circular
  misc_feature (B) LOCATION 1...2415
  hypothetical: NO
  anti-sense: NO
caaggaggaggtgagaagatggccctagctaagattatcgtagatgtgcccttgatgcagacggaccagccctatagttacaggattccggaggaatttgagggaatgctggaagttgggatgcgggttcatgtgccttttggtaagggtaatcgcctgattcaagggattgttcttggtttgaagtcccaatcagatggagaagagatggagcaagatttaaaagatattgcagaggtgctggatttttctcctgttctcacgccagaacaactctggctggctgaggagttacgcaaatctgtcttctcctacaaaatctctatcctcaaggccatgcttccagggtttctgaattctagctatgacaagattctctatcctctggaaggcttgagtcaggaagaacgagtacgcctgtttggttcagaagattcgctagccttttcttcactagaccttgccaagcaagctgaaatgatgcgtttgactagaaaaggcctgcttggtctggaatatcaggcagtcgatcaaaagaaggtcaagacccagtcttggtatgaggttgaccatgcccaattagaaggtgttgagatttctacacgtgccaagaaaaagttggaactgagagattatctgctgtctcatccagagagcgcttccttggctagcttgttagagtcctactcgcgagagcaagtcaacttctttgtggatcaaggtgctgttaccatagtccaaaaggaagttcaacgctcggctgcttattttgaaggaattgaagcaagtagacctttggagttaaatccagaacaaagacaggcgcgtgatgcggttgtgagttctattggcagttctcaacctccctttctacttcaagggattacaggaagtgggaagaccgaggtttacttgcagattatccaaggtgccctggataagggcaagacagctattttgctggtacctgagatttccttgactcctcagatgaccgagcgttttatagcacgttttggggacaaggtagccattcttcactcaggattatccaatggcgaaaagtatgatgaatggcgcaaggtggagcgtggcgatgcccaagttgttgttggtgccagatctgctatctttgctcctctgaaaaatctgggtgtcatgattattgatgaagagcatgaagcggcttataagcaggacagcaatccccgttaccatgccagagaggtagctattttacgggctcagtataatcaagcaactctggtacttggatctgcaacgccgagcttagagagccgggcacgtgctggcaaaggcgtctatcaacacttacgtctaacccaacgtgccaatcctttggctacaatccctgaggttcaagtgattgactttcgagactatatcggacaaaatgagacgtcaaactttacgcctcctttgctagaggctatccaagaccgtctggttaaaaaagagcaggtggttctcatgctcaatcgccgtggttattctagctttgtcatgtgtcgggagtgtgggacggtggatacttgtcccaactgcgatatttctctgaccttgcatatggataccaagactatgaactgccattattgtggtttctcgaaggatattcctcaggtctgtcctaactgtaagagccacagtattcgttactatggaacgggaactcagaaggcttatgatgagctagcagaactctttccccaagctcgcattctgaggatggatgtggatacgactcgaaagaaaggcagtcaccaagccttgcttgaccagtttgggcgaggggaagcggatattttacttggtactcagatgattgcaaagggtttggattttcccaatgttaccctagtcggagttctaaatgcggatacggccttgaatctgcctgatttccgttcttctgagagaaccttccagctcttgactcaggtggcaggtcgatcaggtcgggctgaaaaggcaggtcaagtcttgatacagtcctacaatccgcagcactatgctattcgatttgccaaggatcaagattacgaaggcttttatgcctatgaaatgggaatcagacgacaactcggctatccaccttactatttcacgattggtattaccctttctcacaagaaagaagaagaggttttcaaacgtgcctatgaagtcatgaacattttgcggtcaggcttgtcagagaccagtcccattctggggccaacgccaaaaccgattgcccgtacccacaacctctatcattaccagattttaattaaataccgtttagaagatgagctggggccgaccctcaaccaggttttagccttgactcaagaacgggaaaatagtgagctccgtctcagcattgaccatgagccgcagcaatttttataa

SEQ ID NO: 1882 - DNA (genomic), 201 bp, Streptococcus pneumoniae; double-stranded, circular
  misc_feature (B) LOCATION 1...201
  hypothetical: NO
  anti-sense: NO
gttaagggaggatatattattaaggtagatggaaagtattatgtttaccttaaagatcaagctcatgcagaaaatgtacgaacaaaagatgaaatcaatcgccaaaaacaagaacatggtaaagacgataaaggagctagtgcagaagtatctgtagcaaaattacagggacgttatactaccgatgatggttatatatag

SEQ ID NO: 1883 - DNA (genomic), 1176 bp, Streptococcus pneumoniae; double-stranded, circular
  misc_feature (B) LOCATION 1...1176
  hypothetical: NO
  anti-sense: NO
aggtgtctgggtagacaggtcactaacgacaaagcgtctggtcgttgctggatgtttgcggctctcaacaccttccgccacaaactcatctcgcaatacaaattggagaactttgagttgtcacaagcccacactttcttctgggataagtatgagaaatcaaactggttcttggagcaagtcattgcgacttcagaccaagaattgactagccgcaaggttagcttcttacttcaaacacctcaacaagatggtggtcaatgggatatggtcgtttccctctttgaaaaatacggtgtcgtgcctaagtcagtttatcctgagtctgtttcatctagcagcagtcgtgagctaaatgcgatccttaataaattgcttcgtcaagatgctcaaatcttgcgtgacttgcttgtttctggtgcagatcaagcgactgttcaagctaagaaagaagacctcttgcaagaaatctttaactttcttgctatgtcattaggacttccaccacgcaagtttgactttgcttatcgcgataaagataacaactacaaaagtgaaaaaggaatcacaccacaagagttttacaagaaatatgtcaatcttcctttagaagactacgtttctgttatcaatgctccaactgctgataaaccttacggaaaatcttacacagttgagatgttggggaatgtggttggtagccgtgcagttcgttacatcaacgttccaatggagcgcttgaaagaattggcgattgcccaaatgcaagcaggtgagactgtttggtttggttctgatgtcggccagctcagtaaccgtaaggctggcatccttgcgacagatgtttatgactttgaatcaagcatggacattaaacttactcaagacaaggctggacgtttggactatagcgaaagcttgatgacccacgccatggtcttgacaggtgttgacttggacgaaaatggtaaatcaaccaagtggaaggttgaaaactcatggggagacaaggtcggtacagatggttactttgttgcctcagacgcttggatggacgaatacacataccaaatcgttgttcgtaaggaattgctgacagcagaagaacaagctgcctatggagcagaaccaattgtacttgcaccatgggatccaatgggagccttggctgaataa

SEQ ID NO: 1884 - DNA (genomic), 183 bp, Streptococcus pneumoniae; double-stranded, circular
  misc_feature (B) LOCATION 1...183
  hypothetical: NO
  anti-sense: NO
aacagtctggggagtgactgtttcaatcgggagatagagatgagctttattgctcaggactttgataagctcaatatcataactgttcttgagagcagaacacaagccatcatccgaaatcccatgaatacaaggctatcaagcgatactgaaagctcattcaacaagatagtcagaaactga

SEQ ID NO: 1885 - DNA (genomic), 1740 bp, Streptococcus pneumoniae; double-stranded, circular
  misc_feature (B) LOCATION 1...1740
  hypothetical: NO
  anti-sense: NO
aacatcctgggggtaggcgaaattaaggaaattattgagaaggagggggtgggagggaattttcgaatgcaaacagatgttgcagctcgcaacagagttattgagttgaagccaattggagacgtagtagagaaacttggtatttcttacgacgatttggagttgtacggaaagtacaaggctaaactcagctttgataaaattcgggcagttgagagcaatccagtcggtaaattgatcttggttactgccatcaacccaacacctgcaggtgaaggaaagtcgacgcttaccattggtcttgcggatgccttgaacaagattggcaagaaaaccatgattgctatccgcgaaccgtctcttggtccagtcatggggatcaagggtggtgctgctggtggtgggtatgcacaagttctgccaatggaagacatcaacctccactttactggagatatgcatgctattacaactgccaacaatgccctttctgccttgattgacaaccacttgcaccaagggaatgagctgggaattgatcaacgtcgtatcctctggaaacgcgttgtggacttgaacgaccgtgcgctccgccatgtgactgttggtcttggtggtcctctaaacggtattccacgtgaggatggttttgatattacagttgcttcagaaatcatggcaattctttgcttggcaacggacatcgaggacttgaaacgtcgtttggcgaatatcgttattggttatcgctatgaccgtacgcctgtttctgtaggtgatttgcaggttgagggtgccttggctttgattttgatggatgctattaagccaaacttggttcagacaatttacggtacacctgcctttgtacacggtggtccatttgccaatatcgctcatggctgtaactctgttttggcgacgacaacagcccttcacttggctgattacactgttactgaagctggttttggtgcggaccttggtgctgagaaattccttgatatcaagacaccaaacttgccaacatctccagatgcagttgttattgtcgcaacccttcgtgcccttaagatgaatggtggtgtggctaaagacgctctgactgaagaaaatgtagaggcagttcgtgcaggttttgctaacttgaaacgccacgttgaaaatatccgtaagttcggtattccagcagttgtagctattaacgaatttgtatctgatacagaagctgaaattgcagtcttaaaagaactctgtgcctcaatcgatgtaccagttgaattggctagtgtctgggctgatggagcagaaggtggagtagcacttgccgaaacagttgttaagacaattgctgaaaatccagctaactataaacgtttgtacgataatgacctttctgtccaagaaaagattgaaaaaattgtcactgaaatctatcgtggtagcaaagtgaactttgagaagaaatctcaaacacaaattgctcaaatcgttcaaaacggttgggacaaattgccaatctgtatggctaaaactcaatacagtttctcagacaatccaaatgcgcttggagcaccagaaaactttgaaattaccattcgtgaattggtaccaaaattaggtgcaggcttcatcgttgccttaactggtgatgttatgaccatgccaggtcttccaaaacgtccagcagctctcaacatggatgttgaaagcgatggaactgtactaggcttgttctag

SEQ ID NO: 1886 - DNA (genomic), 366 bp, Streptococcus pneumoniae; double-stranded, circular
  misc_feature (B) LOCATION 1...366
  hypothetical: NO
  anti-sense: NO
tacaatatgggtatgattttaatgaaattagcatctattttattattgatactgaccttagtcgtctgcattatcctaaccaaactttttagattaaaaaaactaggacgaaactttgcggatttggcttttccagtcttggtatttgagtattacttgattacagctaaaacctttacccataatttcctccctagactggggctagccctctcgttcctagccattattctcgtctttttcttccttttgaaaaaacgcagcttttactatcctaaattcatcaaattcttctggcgtgcaggattcttattaacccttatcatgtatatagaaatgattgttgaattgttcttaatgaaatag

SEQ ID NO: 1887 - DNA (genomic), 189 bp, Streptococcus pneumoniae; double-stranded, circular
  misc_feature (B) LOCATION 1...189
  hypothetical: NO
  anti-sense: NO
ctagatatgggtattaaaatggaaaaaatttttgttattattttttttgtatgtctatttatatcatccataacttttttagcctatgattttgttagcgaagaaataaaaaaattgattatttggatcaatgtcgtttttttgattttaatcatagcaatgatgatttatccaaaattaagaaaatga

SEQ ID NO: 1888 - DNA (genomic), 330 bp, Streptococcus pneumoniae; double-stranded, circular
  misc_feature (B) LOCATION 1...330
  hypothetical: NO
  anti-sense: NO
agacccatgggaatgaagcaggaagaggctgagaagaaggcgagtggactcttggaacagttaggactaggaggacacgcagaggcctatcctttctcactatctggtgggcaaaagcagcgggtggctttggcgcgtgctatgatgattgacccagaaatcattggctacgatgaaccaacttctgccctggatccagaattacgtttggaagtggagaagctaatcttgcaaaatagggaacttgggatgacccagattgtggttacccatgatttgcagtttgctgaaaatatcgcagatgtattattgaaagtagaacctaaatag

SEQ ID NO: 1889 - DNA (genomic), 426 bp, Streptococcus pneumoniae; double-stranded, circular
  misc_feature (B) LOCATION 1...426
  hypothetical: NO
  anti-sense: NO
cccaaaatgggcagaaattcaaacattgacctctatctggaccaggttttgctctatgtcaatcaggtctgcgcccctatctctcctaataaagacaagggcctaacagcatctatggtcaacaattatgtgaaaaatggttacctgacaaagcctgacaaaaaaaaataccaacgccaacagattgcccgtttgattgctatcacaaccctcaagtctgtattttctattcaagaaatagcccagacacttaatactctacaaactcaagcaagttcagaccaactctacgatgcttttgtggactacatgaaccaaggaattgacccagctaaccctattatccaaaccagctgccaaaccgttaaactctatcatcaaactctagacttaatcgatcatactcaagaggaggtaatccaatga

SEQ ID NO: 1890 - DNA (genomic), 213 bp, Streptococcus pneumoniae; double-stranded, circular
  misc_feature (B) LOCATION 1...213
  hypothetical: NO
  anti-sense: NO
tatgaaatgggggaagaagagatgagaaataaaatgattatcgcagtaagtttagtagtagcaggagttatgacctatctcatgttttcgggattggatgaggatttctaccattttccttggaaggtctttgctggctttggaatcatgtcttggcttgttagagaaggtttgaaattagtcagagatgtgaaaaaggagtttgaagaatga

SEQ ID NO: 1891 - DNA (genomic), 873 bp, Streptococcus pneumoniae; double-stranded, circular
  misc_feature (B) LOCATION 1...873
  hypothetical: NO
  anti-sense: NO
gtagaggtgggctcatgcctgcttcttgtttttacagaaggaggacttatgcctgaattacctgaggttgaaaccgtttgtcgtggtttagaaaaattgattataggaaagaagatttcgagtatagaaattcgctaccccaagatgattaagacggatttggaagagtttcaaagggaattgcctagtcagattatcgagtcaatgggacgtcgtggaaaatatttgcttttttatctgacagacaaggtcttgatttcccatttgcggatggagggcaagtatttttactatccagaccaaggacctgaacgcaagcatgcccatgttttctttcattttgaagatggtggcacgcttgtttatgaggatgttcgcaagtttggaaccatggaactcttggtgcctgaccttttagacgcctactttatttctaaaaaattaggtcctgaaccaagcgaacaagactttgatttacaggtctttcaatctgcccttgccaagtccaaaaagcctatcaaatcccatctcctagaccagaccttggtagctggacttggcaatatctatgtggatgaggttctctggcgagctcaggttcatccagctagaccttcccagactttgacagcagaagaagcgactgccattcatgaccagaccattgctgttttgggccaggctgttgaaaaaggtggctccaccattcggacttataccaatgcctttggggaagatggaagcatgcaggactttcatcaggtctatgataagactggtcaagaatgtgtacgctgtggtaccatcattgagaaaattcaactaggcggacgtggaacccacttttgtccaaactgtcaaaggggggactga

SEQ ID NO: 1892 - DNA (genomic), 327 bp, Streptococcus pneumoniae; double-stranded, circular
  misc_feature (B) LOCATION 1...327
  hypothetical: NO
  anti-sense: NO
aacagtccggggagtgactgtttcaatcgggagatggagatgagcttcattgcgcaagattttaacaatctcaatatcatcactgttcttgagggaagaacacaagctatcattcgaaatcactttcttcgctacgatagagccgtccgatgtcgcgtcaaaatcattactatggatatgtttagcccttactatggcttggctaaacagcttcgctttcaaatttctaggctcaggctgaaacagtctcccagactgtttcactcccgaatgctaaaatcgttcttgatcgctttcacattgtgcaacatcttagccgtgctatga

SEQ ID NO: 1893 - DNA (genomic), 327 bp, Streptococcus pneumoniae; double-stranded, circular
  misc_feature (B) LOCATION 1...327
  hypothetical: NO
  anti-sense: NO
aacagtccggggagtgactgtttcaatcgggagatggagatgagctttattgcgcaaaattttgaaaagctcgatatcatcactgttcttgaaggtagaacacaagctgtcatccgagatcactttcttaaatatgatagagccgtccgatgtcgcgtcaaaatcattactatggatatgtttagcccttactatgacttggctaaacagcttcgctttcaaatttctaggctcaggctgaaacagtctcctagactgtttcactcccgaatgctaaaatcgttcttgatcgctttcacattgtacaacatcttagccgtgctatga

SEQ ID NO: 1894 - DNA (genomic), 327 bp, Streptococcus pneumoniae; double-stranded, circular
  misc_feature (B) LOCATION 1...327
  hypothetical: NO
  anti-sense: NO
aacagtccggggagtgactgtttcaatcgggagatggagatgagcttcattgcgcaagattttaacaatctcaatatcatcactgttcttgagggaagaacacaagctatcattcgaaatcactttcttcgctacgatagagctgtccgatgtcgcgtcaaaattattactatggatatgtttagcccttactatgacttggctaaacagcttcgctttcaaatttctaggctcaggctgaaacagtctcccagactgtttcactcccgaatgctaaaatcgttcttgatcgctttcacattgtacaacatcttagccgtgctatga

SEQ ID NO: 1895 - DNA (genomic), 327 bp, Streptococcus pneumoniae; double-stranded, circular
  misc_feature (B) LOCATION 1...327
  hypothetical: NO
  anti-sense: NO
aacagtccgggtagtgactgtttcaatcgggagatggagatgagctttattgcgcaagattttgacaagctcaatatcatcactgttcttgagggaagaacacaagctatcattcgaaatcactttcttcgctacgatagagccgtccgatgtcgcgtcaaaatcattactatggatatgtttagcccttactatggcttggctaaacagcttcgctttcaaatttctaggctcaggctgaaacagtctcccagactgtttcactcccgaatgctaaaatcgttcttgatcgctttcacattgtacaacatcttagccgtgctatga

SEQ ID NO: 1896 - DNA (genomic), 801 bp, Streptococcus pneumoniae; double-stranded, circular
  misc_feature (B) LOCATION 1...801
  hypothetical: NO
  anti-sense: NO
aacagtccggggagtgactgtttcaatcgggagatggagatgagctttattgcgcaagattttgaaaagctcgatatcatcactgttcttgaaggtagaacacaagctgtcatccgagatcactttcttaaatatgatagagccgtccgatgtcgcgtcaaaatcattactatggatatgtttagtccttactatgacttagctagacaacttttcccgtgtgctaaaatcgttcttgatcgctttcacattgtacaacatcttagccgtgctatgagtcgtgtgcatgtccaaatcatgaatcagtttcatcgaaaatcccatgaatacaaggctatcaagcgctactggaaactcattcaacaggatagctgtaaactgagtgataagcgattttatcgtcctatttttcgtatgcacttaaccaataaagagattttaaacaagcttttgagctattcggaagacttgaaacaccactatcaactctatcagctcttgctttttcacttccagaataaggaaccagagaaatttttcggacttattgaggacaatcttaagcaggttcatcctatttttcagactgtctttaaaaccttcctcaaagataaagaaaagattatcaacgcccttcaactacactattctaatgccaaactggaagcgaccaataatctcatcaaacttatcaagcgcaatgcctttggttttcgaaactttgaaaacttcaaaaaacggatttttatcgctctgaatatcaaaaaagaaaggacaaaatttgtcctttctcgagcttag

SEQ ID NO: 1897 - DNA (genomic), 327 bp, Streptococcus pneumoniae; double-stranded, circular
  misc_feature (B) LOCATION 1...327
  hypothetical: NO
  anti-sense: NO
aacagtccggggagtgactgtttcaatcgggagatggagatgagctttattgcgcaagattttgaaaagctcgatatcatcactgttcttgaaggtagaacacaagctgtcatccgagatcactttcttaaatatgatagagccgtccgatgtcgcgtcaaaatcattactatggatatgtttagcccttactatgacttggctaaacagcttcgctttcaaatttctaggctcaggctgaaacagtctcccagactgtttcactcccgaatgctaaaatcgttcttgatcgctttcacattgtgcaacatcttagccgtgctatga

SEQ ID NO: 1898 - DNA (genomic), 246 bp, Streptococcus pneumoniae; double-stranded, circular
  misc_feature (B) LOCATION 1...246
  hypothetical: NO
  anti-sense: NO
gaggacacgggcttgttcccgtataaactattttggaggattacccaagtccggctgaagggaacggtcttgaaaaccgtcaggcgtgtaaaagcgtgcgtgggttcgaatcccacatcctccttttatattaacgcgggatggagcagctcggtagctcgtcgggctcataacccgaaggtcgtaggttcaaatcctgctcccgcaataaggctcggtagctcagttggtagagcaatggattga

SEQ ID NO: 1899 - DNA (genomic), 207 bp, Streptococcus pneumoniae; double-stranded, circular
  misc_feature (B) LOCATION 1...207
  hypothetical: NO
  anti-sense: NO
gctggaacgggatgctgcgtgaaaaagataaaactccttgtattcgtcgaatactgcgtcagttttttctcctacatcccaatcttcgaagccgagttggagaggatattacgaccgtatgatgtttttgaaaaagtatcgtggcaatttttaaagaagatgagtgtctttcttcaaacaaagggaagcaatcaaaaagagtattga

SEQ ID NO: 1900 - DNA (genomic), 2178 bp, Streptococcus pneumoniae; double-stranded, circular
  misc_feature (B) LOCATION 1...2178
  hypothetical: NO
  anti-sense: NO
ttagataagggaaattttatgggattaaaacatcttgaagacgtgacttacttccgtcttaataacgaaattaaccgtcctgttaatggacaaatcatgcttcataaagataaggaagccttggatgctttctttaaagaaaatgtagttccaaacactatggtttttgattcaatcaaagacaaaatcaattacctcattgaacacaactacatcgaaacagcctttatcaagaaataccgtccagagttcttggaagaattggctcaatttatcaaagaccaaaacttccaattcaagtcattcatggcagcttataaattttacaatcaatatgccttaaagactaatgacggtgaatactatcttgaaaatatggaagaccgtgtcttcttcaacgccctttatttcgctgatgggaatgaagctgttgcaatcgatattgccaatgaaatcatccaccaacgctaccaacctgctactccttccttcttgaatgctggacgtgctcgtcgtggggagttggtatcttgtttcctaatccaagtgacggatgatatgaactctatcggacgttctatcaactcagctcttcaactttcacgtattggtggtggtgtgggaattaccctcagcaaccttcgtgaagctggtgcacctatcaaaggctatgaaggagctgcttcaggtgtcgttcctgttatgaagctttttgaagacagcttctcttactccaaccaattggggcaacgtcaaggtgctggtgttgtctacctcaacgtctttcacccagatatcatcgctttcctttcaactaagaaagaaaacgctgatgaaaaagtacgtgtcaagactctgtcacttggtgttgtagtacctgataaattctacgaattggctcgtaaaaatgaagaaatgtacctcttcagcccttactctgtagaaaaagaatacggtgtgccattcaattacatcgacattactgaaaaatacgatgaattggtcgcaaatccaaatattcgcaagacaaaaatcaaggcgcgggatttggaaactgaaatctctaaattgcaacaagagtctggctatccttatgtagtcaacatcgatacggctaaccgtgcaaatcctgttgatggaaagattatcatgagtaacttgtgctctgagattcttcaagttcaagaaccaagcttgatcaacgatgctcaagaattccttcaaatgggaacagatgtttcatgtaacctgggttcaaccaacgtggttaacatgatgacttcacctgattttggtcgttctatccgtgctatggttcgtgcccttactttcgttacagatagttcacatatcgtagctgtaccaacgattgaccatggaaatagccaagcccacacctttggtctcggtgccatgggactgcacagctaccttgcccaacaactcattgaatatggttcacctgagtctgttgaatttacaagcatctactttatgcttatgaactactggaccttggtagagtcaaacaatattgcgcgtgaacgtggtattaccttccacaactttgaaaaatcagactatgctaacggaagttactttgacaagtatgtaactggtgaatttgttccaacatcagaccgtgttaaagaactcttcaaaaatgtttttatccctggtgttgctgattgggctgaacttcgcgacaaggttcaagaagatggtctttaccaccaaaatcgccttgctgtagcgccaaatggttctatcagctatatcaacgacgtttctgcttctatccacccgattacgcaacgtatcgaagaacgccaagagaagaaaattggtaaaatctactaccctgctgctggcttgtctacagaaaccattccttactacacttctgcctacgatatggatatgcgtaaagtcatcgatgtttacgctgctgcgactgaacacgtggatcaaggactttcactcaccctcttcatgcgtagtgacattccaaaaggcctttacgaatggaagagggaaaataaacaaacgacacgtgacttgtccatccttcgtaactatgcctttaacaagggaatcaagtctatctactacgtccgtacctttacagatgacggtggagaagtcggcgccaaccaatgtgaaagctgtgtgatttag

SEQ ID NO: 1901 - DNA (genomic), 2451 bp, Streptococcus pneumoniae; double-stranded, circular
  misc_feature (B) LOCATION 1...2451
  hypothetical: NO
  anti-sense: NO
atagaaaagggaagtaagatgaactattcaaaagcattgaatgaatgtatcgaaagtgcctacatggttgctggacattttggagctcgttatctagagtcttggcacttgttgattgccatgtctaatcacagttatagtgtagcaggggcaactttaaatgattatccgtatgagatggaccgtttagaagaggtggctttggaactgactgaaacggactatagccaggatgaaacctttacggaattgccgttctcccgtcgtttgcaggttctttttgacgaagcagagtatgtagcgtcagtggtccatgctaaggtgctagggacagagcacgtcttctatgcgattttgcatgatggcaatgccttggcaactcgtatcttggagagggctggtttttcttatgaagacaagaaagatcaggtcaagattgctgcccttcgtcgaaatttagaagaacgggcaggctggactcgtgaagacctcaaggctttacgccaacgccatcgtacagtagctgacaagcaaaattctatggccaatatgatgggcatgccgcagactcctagtggtggtcttgaggactatacgcatgatttgacagagcaagcgcgttctggcaagttagaaccagtcatcggtcgggacaaggaaatctcacgtatgattcaaatcttgagccgtaagactaagaacaaccctgtcttggttggggatgctggtgtcgggaaaacagctctggcccttggtcttgcccagcgtattgctagtggtgacgtgcctgcggaaatggctaagatgcgcgtgttacaacttgatttgatgaatgtcgttgcagggacacgcttccgtggtgactttgaagaacgcatgaataatatcatcaaggatattgaagaagatggccaagtcatcctctttatcgatgaactccacaccatcatgggttctggtagcgggattgattcgactctggatgcggccaatatcttgaaaccagccttggcgcgtggaactttgagaacggttggtgccaccactcaggaagaatatcaaaaacatatcgaaaaagatgcggctctttctcgtcgtttcgctaaagtgacgattgaagaaccaagtgtggcagatagtatgactattttacaaggtttgaaggcgacttatgagaaacatcaccgtgtacaaatcacagatgaagcggttgaaacagcggttaagatggctcatcgttatttaaccagtcgtcacttgccagactctgctatcgacctcttggacgaagcagcagcaacagtgcaaaataaggcaaagcatgtaaaagcagacgattcagatttgagtccagctgacaaggccctgatggatggcaagtggaaacaggcagcccagctaatcgcaaaagaagaggaagtacctgtctacaaagacttggtgacagagtctgatattttgaccaccttgagtcgcttgtcaggaatcccagttcaaaaactgactcaaacggatgctaagaagtatttaaatcttgaagcagaactccataaacgtgtcatcggtcaagatcaagctgtttcaagcattagccgtgccattcgccgtaatcagtcaggaattcgcagtcacaagcgtccgatcggttcctttatgttcctaggacccacaggtgtcggtaagaccgagttggccaaggctttggcagaagttctctttgatgacgaatcagcccttatccgctttgatatgagtgagtatatggagaaattcgcagccagccgtctaaatggagctcctccaggctatgtgggttacgaagaaggtggggagttgacagagaaggttcgcaataaaccctattccgttctcctctttgatgaggtagagaaggcccacccagatatctttaatgttctcttgcaggttctggatgacggtgtcttgacagatagcaagggacgcaaggtcgatttttcaaataccattatcattatgacatcgaacctaggtgcgactgcctttcgtgatgataagactgttggttttggggctaaggatattcgttttgaccaggaaaatatggaaaaacgcatgtttgaagaactgaaaaaagcttatagaccggaattcatcaaccgtattgatgagaaggtggtcttccatagcctatctagtgaccatatgcaggaagtggtgaagattatggtcaagcctttagtggcaagtttggctgaaaaaggcattgacttgaaattacaagcttcagctctgaaattgttagcaaatcaaggatatgacccagagatgggagctcgcccacttcgcagaaccctgcaaacagaagtggaggacaagttggcagaacttcttcttaagggagatttagtggcaggcagcacacttaagattggtgtcaaagcaggccagttaaaatttgatattgcataa

SEQ ID NO: 1902 - DNA (genomic), 768 bp, Streptococcus pneumoniae; double-stranded, circular
  misc_feature (B) LOCATION 1...768
  hypothetical: NO
  anti-sense: NO
attgtagagggaatggttatgagtaacaatactaagtatatctttttatctccacatttagatgacgcaattttttcctgtggtgattatatttcaaaattaacttcagaaggagaaattgtacttgttattactatattttctggttaccctttgagccaacagctacagccctctgctaagcaatttcataagttgtgtaaccttgggaaatatccgattgaagaaaggaagaaagaagacaggttagcttgtgaacgtctacagtgtgattttagacacttatcgtactatgaatgtctctataggaaagatagaaatggcaattttctataccgtcatatctatagtgaattaaaaaatgaggacacattaaagaatgatatcataaaagagctgttaatgcatttagacgacaaatgtgtcgtatattgtccgctttcacttggtgaccatattgatcatgtttttgtgaatagtattggaagggcgcttgaatttatgcgttataaagtaatatattatgaggacttcccatatgtaagtgatagtagtatggttagttatatgggaaaaactaaagaattaaaaatgtatcaagaggaacttgatgaaaaacattatattgatagaatatcatcaatattgtgctataaatctcagattttgataatctggaaatcagttgaaaaacttttaaacaatattaaagagttgtatttaaggaatggggcagcttattctattagattttggattaagaaataa

SEQ ID NO: 1903 - DNA (genomic), 6717 bp, Streptococcus pneumoniae; double-stranded, circular
  misc_feature (B) LOCATION 1...6717
  hypothetical: NO
  anti-sense: NO
tataaggagggttttatggggaaaggccattggaatcggaaaagagtttatagcattcgtaagtttgctgtgggagcttgctcagtaatgattgggacttgtgcagttctattaggaggaaatatagctggagaatctgtagtttatgcggatgaaacacttattactcatactgctgagaaacctaaagaggaaaaaatgatagtagaagaaaaggctgataaagctttggaaactaaaaatgtagttgaaaggacagaacaaagtgaacctagttcaactgaggctattgcatctgagaagaaagaagatgaagccgtaactccaaaagaggaaaaagtgtctgctaaaccggaagaaaaagctccaaggatagaatcacaagcttcaagtcaagaaaaaccgctcaaggaagatgctaaagctgtaacaaatgaagaagtgaatcaaatgattgaagacaggaaagtggattttaatcaaaattggtactttaaactcaatgcaaattctaaggaagccattaaacctgatgcagacgtatctacgtggaaaaaattagatttaccgtatgactggagtatctttaacgatttcgatcatgaatctcctgcacaaaatgaaggtggacagctcaacggtggggaagcttggtatcgcaagactttcaaactagatgaaaaagacctcaagaaaaatgttcgccttacttttgatggcgtctatatggattctcaagtttatgtcaatggtcagttagtggggcattatccaaatggttataaccagttctcatacgatatcaccaaataccttcacaaagatggtcgtgagaatgtgattgctgtccatgcagtcaacaaacagccaagtagccgttggtattcaggaagtggtatctatcgtgatgtgactttacaagtgacagataaggtgcatgttgagaaaaatgggacaactattttaacaccaaaacttgaagaacaacaacatggcaaggttgaaactcatgtgaccagcaaaatcgtcaatacggacgacaaagaccatgaacttgtagccgaatatcaaatcgttgaacgaggtggtcatgctgtaacaggcttagttcgtacagcgagtcgtaccttaaaagcacatgaatcaacaagcctagatgcgattttagaagttgaaagaccaaaactctggaccgttttaaatgacaaacctgccttgtacgaattgattacgcgtgtttaccgtgacggtcaattggttgatgctaagaaggatttgtttggttaccgttactatcactggactccaaatgaaggtttctctttgaatggtgaacgtattaaattccatggagtatccttgcaccacgaccatggggcgcttggagcagaagaaaactataaagcagaatatcgccgtctcaaacaaatgaaggagatgggagttaactccatccgtacaacccacaaccctgctagtgagcaaaccttgcaaatcgcagcagaactaggtttactcgttcaggaagaggcctttgatacgtggtatggtggcaagaaaccttatgactatggacgtttctttgaaaaagatgccactcacccagaagctcgaaaaggtgaaaaatggtctgattttgacctacgtaccatggtcgaaagaggcaaaaacaaccctgctatcttcatgtggtcaattggtaatgaaataggtgaagctaatggtgatgcccactctttagcaactgttaaacgtttggttaaggttatcaaggatgttgataagactcgctatgttaccatgggagcagataaattccgtttcggtaatggtagcggagggcatgagaaaattgctgatgaactcgatgctgttggatttaactattctgaagataattacaaagcccttagagctaagcatccaaaatggttgatttatggatcagaaacatcttcagctacccgtacacgtggaagttactatcgccctgaacgtgaattgaaacatagcaatggacctgagcgtaattatgaacagtcagattatggaaatgatcgtgtgggttgggggaaaacagcaaccgcttcatggacttttgaccgtgacaacgctggctatgctggacagtttatctggacaggtacggactatattggtgaacctacaccatggcacaaccaaaatcaaactcctgttaagagctcttactttggtatcgtagatacagccggcattccaaaacatgacttctatctctaccaaagccaatgggtttctgttaagaagaaaccgatggtacaccttcttcctcactggaactgggaaaacaaagaattagcatccaaagtagctgactcagaaggtaagattccagttcgtgcttattcgaatgcttctagtgtagaattgttcttgaatggaaaatctcttggtcttaagactttcaataaaaaacaaaccagcgatgggcggacttaccaagaaggtgcaaatgctaatgaactttatcttgaatggaaagttgcctatcaaccaggtaccttggaagcaattgctcgtgatgaatctggcaaggaaattgctcgagataagattacgactgctggtaagccagcggcagttcgtcttattaaggaagaccatgcgattgcagcagatggaaaagacttgacttacatctactatgaaattgttgacagccatgggaatgtggttccaactgctaataatctggttcgcttccaattgcatggccaaggtcaactggtcggtgtagataacggagaacaagccagtcgtgaacgctataaggcgcaagcagatggttcttggattcgtaaagcatttaatggtaaaggtgttgccattgtcaaatcaactgaacaagcagggaaattcacccttactgcccactctgatctcttgaaatcgaaccaagtcactgtctttactggtaagaaagaaggacaagagaagactgttttggggacagaagtgccaaaagtacagaccattattggagaggcacctgaaatgcctaccactgttccgtttgtatacagtgatggtagccgtgcagaacgtcctgtaacctggtcttcagtagatgtgagcaagcctggtattgtaacggtgaaaggtatggctgacggacgagaagtagaagctcgtgtagaagtgattgctcttaaatcagagctaccagttgtgaaacgtattgctccaaatactgacttgaattctgtagacaaatctgtttcctatgttttgactgatggaagtgttgaagagtatgaagtggacaagtgggagattgccgaagaagataaagctaagttagcaattccaggttctcgtattcaagcgaccggttatttagaaggtcaaccaattcatgcaacccttgtggtagaagaaggcaatcctgcggcacctgcagtaccaactgtaacggttggtggtgaagctgtcacaggtcttactagtcaaaaaccaatgcaataccgcactcttgcttatggagctaagttgccagaagtcacagcaagtgctaaaaatgcagctgttacagttcttcaagcaagcgcagcaaacggcatgcgtgcgagcatctttattcagcctaaagatggtggccctcttcaaacctatgcaattcaattccttgaagaagcgccaaaaattgctcacttgagcttgcaagtggaaaaagctgacagtctcaaagaagaccaaactgtcaaattgtcggttcgagctcactatcaagatggaacgcaagctgtattaccagctgataaagtaaccttctctacaagtggtgaaggggaagtcgcaattcgtaaaggaatgcttgagttgcataagccaggagcagtcactttgaacgctgaatatgagggagctaaaggccaagttgaactcactatccaagccaatactgagaagaagattgcgcaatccatccgtcctgtaaatgtagtgacagatttgcatcaggaaccaagtcttccagcaacagtaacagttgagtatgacaaaggtttccctaaaactcataaagtcacttggcaagctattccgaaagaaaaactagactcctatcaaacatttgaagtactaggtaaagttgaaggaattgaccttgaagcgcgtgcaaaagtctctgtagaaggtatcgtttcagttgaagaagtcagtgtgacaactccaatcgcagaagcaccacaattaccagaaagtgttcggacatatgattcaaatggtcacgtttcatcagctaaggttgcatgggatgcgattcgtccagagcaatacgctaaggaaggtgtctttacagttaatggtcgcttagaaggtactcaattaacaactaaacttcatgttcgcgtatctgctcaaactgagcaaggtgcaaacatttctgaccaatggaccggttcagaattgccacttgcctttgcttcagattcaaatccaagcgacccagtttcaaatgttaatgacaagctcatttcctacaataaccaaccagccaatcgttggacaaactggaatcgtagtaatccagaagcttcagtcggtgtcctattcggagattcaggtattttgagcaaacgttcagttgataacttaagcgttggcttccatgaagaccatggagttggtgcaccgaagtcttatgtgattgagtattatgttggtaagactgtcccaacagctcctaaaaaccctagttttgttggtaatgaggaccatgtctttaatgattctgccaactggaaaccagttactaatctaaaagcccctgctcaactcaaggctggagaaatgaaccactttagctttgataaagttgaaacctatgctgttcgtattcgcatggtgagagcagacaacaaactaggaacgtctatcacagaggtacaaatctttgcgaaacaagttgcggcagccaagcaaggacaaacaagaatccaagttgacggtaaagacttagcaaacttcaaccctgatctgacagactactaccttgagtctgtagatggaaaagttccggcagtcacagcaagtgttagcaacaatggtctcgctaccgtcgttccaagcgttcgtgaaggtgagccagttcgtgtcatcgcgaaagctgaaaatggcgacatcttaggagaataccgtctgcacttcactaaggataagaacttactttctcataaaccagttgctgcggttaaacaagctcgcttgctacaagtaggtcaagcacttgaattgccgactaaggttccagtttacttcacaggtaaagacggctacgaaacaaaagatttgtcagttgaatgggaagaagttccagcagaaaatctgacaaaagcaggtcaatttaccgttcgaggccatgtccttggtagtgatcttgttgctgaggtcactgtacgagtgacagacaaactaggcgaagctctttcagataaccctaactatgatgaaaacagtaaccaggcctttgcttcagcaaccaatgatattgacaaaaactctcatgaccgcgttgactatctcaatgacggagatcattcagaaaatcgtcgttggacaaactggtctccaacaccatcttctaatccagaagtatcagcgggtgtgatcttccgtgaaaatggtaagattgtagaacggactgttgcgcaagccaaacttcacttctttgcagatagtggtacggatgcaccaactaaactcgttttagaacgctatgtcggtccagagtttgaagtgccaacctactattcaaactaccaagcctacgacgcagaccatccattcaacaatccagaaaattgggaagctgtgccttatcgtgcggataaagacatcgcagctggtgatgaaatcaacgtaacatttaaagctgtcaaagccaaagctatgagatggcgtatggagcgtaaagcagataagagcggtgttgcgatgattgagatgaccttccttgcaccaagtgaattgcctcaagaaagcacgcaatcgaagattcttgtagatggaaaagaacttgctgatttcgctgaaaatcgtcaagactatcaaattacctataaaggtcaacggccaaaagtctcagttgaagaaaacaatcaagtagcttcaactgtggtagatagtggagaagatagccttccagtacttgttcgcctcgtttcagaaagtggaaaacaagtcaaggaataccgtatccacttgactaaggaaaaaccagtttctgagaagacagttgctgctgtacaagaagatcttccaaaactcgaatttgttgaaaaagatttggcctacaagacagttgagaaaaaagattcaacactgtatctaggtgaaactcgtgtagaacaagaaggaaaaactggtaaagaacgtatctttacagcgattaatcctgatggaagtaaggaagaaaaactccgtgaagtggtagaagctccgacagaccgcatcgtcttggttggaaccaaaccagtagctcaagaagctaaaaaaccacaagtgtcagaaaaagcagatacaaaaccaattgattcaagtgaagctagtcaaactaataaagcccagttaccaaatacaggtagtgcggcaagccaagcagcagtagcagcaggtttagctcttctaggtttgagtgcaggattagtagttactaaaggtaaaaaagaagactag

SEQ ID NO: 1904 - DNA (genomic), 1241 bp, Streptococcus pneumoniae; double-stranded, circular
  misc_feature (B) LOCATION 1...1241
  hypothetical: NO
  anti-sense: NO
gggggcgggggaattcanaccgtggtcaagatgctctatctgcatgctctggatcaggtgcaagcactaaaggtgagaagacattctcatacatttatgagacagaccctgataacctcaactatttgacaactgctaaggctgcgacagcaaatattaccagtaacgtggttgatggtttgctagaaaatgatcgctacgggaactttgtgccgtctatggctgaggattggtctgtatccaaggatggattgacttacacttatactatccgtaaggatgcaaaatggtatacttctgaaggtgaagaatacgcggcagtcaaagctcaagactttgtaacaggactaaaatatgctgctgataaaaaatcagatgctctttaccttgttcaagaatcaatcaaagggttggatgcctatgtaaaaggggaaatcaaagatttctcacaagtaggaattaaggctttggatgatcagacagttcagtacactttgaacaaaccagaaagcttctggaattctaagacaaccatgggtgtgcttgcgccagttaatgaagagtttttgaattcaaaaggagatgattttgccaaagctacggatccaagtagtctcttgtataatggaccttatttgttgaaatccattgtgaccaaatcttctgttgaatttgcgaaaaatccgaactactgggataaggacaatgtgcatattgacaaagttaaattgtcattctgggatggtcaagataccagcaaacctgcagaaaactttaaagatggtagccttacagcagctcgtctctatccaacaagtgcaagtttcgcagagcttgagaagagtatgaaggacaatattgtctatactcaacaagactctattacgtatctagttggtacaaatattgaccgtcagtcctataaatacacatctaagaccagcgacgaacaaaaggcatcgactaaaaaggctctcttaaacaaggatttccgtcaggctattgcctttggttttgatcgtacagcctatgcctctcagttgaatggacaaactggagcaagtaaaatcttgcgtaatctctttgtgccaccaacatttgttcaagcagatggtaaaaactttggcgatatggtcaaagagaaattggtcacttatggggatgaatggaaggatgttaatcttgcagattctcaggatggtctttacaatacagaaaaaggcaaggctgagatttgctaa

SEQ ID NO: 1905 - DNA (genomic), 276 bp, Streptococcus pneumoniae; double-stranded, circular
  misc_feature (B) LOCATION 1...276
  hypothetical: NO
  anti-sense: NO
accattaggggaccgtgtgctcttaaaaatagaagacaaagaacaaaccgttgggggctttgtccttgcaggctcagccaagaaaaaaccaaaacagctcaagttgtggctactggacaaggtgttcgtaccttgaacggtgacttggttgctccaagtgttaaaactggagatcgtgtcttagttgaagcccacgcaggtcttgatgtcaaagatggcgatgaaaagtacatcatcgtaggcgaagctaacattttggcaatcattgaggaatag

SEQ ID NO: 1906 - DNA (genomic), 1353 bp, Streptococcus pneumoniae; double-stranded, circular
  misc_feature (B) LOCATION 1...1353
  hypothetical: NO
  anti-sense: NO
cagaataggggagaaaacatgtcaaagacatatcattttatcggaattaagggatcagggatgagtgccttggccttgatgttgcaccagatggggcacaaggttcagggatcagatgttgaaaagtactactttacccaacgcggtcttgagcaggcaggaattaccattcttccttttgatgaaaagaatctagacggtgatatggaaattatcgctggaaatgcctttcgtccagataacaacgtcgaaattgcctatgcggaccaaaatggtatcagctacaaacgttaccatgagtttctaggtagctttatgcgtgactttgttagcatgggagtagcaggagcacatggaaaaacttcaacgacaggtatgttgtctcatgtcttgtctcacattacagataccagcttcttgattggagatgggacaggtcgtggttcggctaatgccaaatattttgtctttgaatctgacgaatatgagcgtcacttcatgccttaccacccagaatactctattatcaccaacattgactttgaccatccagattatttcacaagtctcgaggatgttttcaatgcctttaacgactatgccaaacaaattaccaagggtctttttgtctatggtgaagatgctgaattgcgtaagattacgtctgatgcaccaatttattattatggttttgaagctgaaggcaatgactttgtagctagtgatcttcttcgttcaacaactggttcaaccttcaccgttcatttccgtggacaaaacttggggcaattccacattccaacctttggtcgtcacaatatcatgaatgcgacagccgttattggtcttctttacacagcaggatttgatttgaacttggtgcgtgagcacttgaaaacatttgccggtgttaaacgtcgtttcactgagaaaattgtcaatgatacagtgattatcgatgactttgcccaccatccaacagaaattattgcgaccttggatgcggctcgtcagaaatacccaagcaaggaaattgtagcagtctttcaaccgcatacctttacaagaaccattgccttgttggacgactttgcccatgctttaaaccaagcagatgctgtttatctagcgcaaatttatggctcggctcgtgaagtagatcatggtgacgttaaggtagaagacctagccaataaaatcaacaaaaaacaccaagtgattactgttgaaaatgtttctccactcctagaccatgacaatgctgtttacgtctttatgggagcaggagacatccaaacctatgaatactcatttgagcgtctcttgtctaacttgacaagcaatgttcaatag

SEQ ID NO: 1907 - DNA (genomic), 1140 bp, Streptococcus pneumoniae; double-stranded, circular
  misc_feature (B) LOCATION 1...1140
  hypothetical: NO
  anti-sense: NO
aaaaacaggggtaaaatcaaaatgacagtattaaaaggagataacttagaaatattaaaaactattgaatcctcaagtattgatttaatctatatggaccctcctttctttacacagaaaacccaaaaattatctaataacaaaaatattatgtattcattcgaagatacgtggacttcgattgaggattacaaagaatttttgtctgtaagattagaagaatgcaaaagagtgctaaaaaatagtggcagtattttcgttcattgtgataaaattgcaaatcatcatattagattaattttagataatatctttggagcagatatgtttcaaagcgaaattatatggaactataagcggtggtctaattcaaaaaagggattattgaacaatcatcaaaacatttacttttattcaaagtcaaaagattttaaatttaatacaatttttacagagtattcttctactacaaatatcgaccaaatactagtggaacgaaaacgagatggaaactctaaaactatatataaagttgataataatggtaactatattctagcaaaagagaaaaatggagttcccctttcagatgtttggaatataccatttcttaatccaaaagctaaagaaagagtaggttatcctacacaaaaacctattctgttattagaacaaattataaagattgctactgataaaaatgatatagttttagacccgttctgtggaagtggaactactttagtagcctccaagattttgaatagaaattatatggggattgatttatctgaggaagctatcaatataactcagcaacgtctggaaaatgttataaaaacaagttcaaatttattgaataaaggaatcgaagcatatagaaccaaaactgaggaagaggaaaacattcttaaattattacaggcaaaaattgttcaaagaaataaaggaattgatggttttttacctaaacattttcaaaaaaaaccgatacctataataattccaaaaaataatgaatgtctgaatgagagtatctctttattacagaaggctataaactccaaaagaattgaattgtggagtattataaaaaacccttccgataatttattatgtgattttgaaaccattccctga

SEQ ID NO: 1908 - DNA (genomic), 1056 bp, Streptococcus pneumoniae; double-stranded, circular
  misc_feature (B) LOCATION 1...1056
  hypothetical: NO
  anti-sense: NO
aggtcaaggggttcaagagctggaagaaatgaaatccaaccatcatcttcgccctactgtagaggagagacaaatgttaacttcagttgtagaaagattaagtcaggaattggaggaaacagaatgatgagaagtacgaaagaattacggcatgtatatagagacttccttttagaggctaatcaaagttattctgatatagtagtcttagaagccgatttgtcaagttcgatggctactcataatcttgaaaaggacttcggagaccgttatgtgaatgttgggattatggaagcagaaatggtcggccttgcagcaggcttgtctattcaggggtttagaccttatcttcatacatttggtccttttgcttcacgaagagtatttgatcaattatttatttctcttggatacgcacaattggatgccactgtgattggatcagatgcaggagtaactgcagaaatgaatggtgggacacatatgccatttgaagaaattggattgttacgtttaattcctaaatcgatcatttttgaagcaactgatgatatccaatttcgtgaaatattgaaccagacattagacttaaaaggactaaaatatattcgaacaattagaaaagctccagttcctgtgtatcaaggtggagaagatttttctaaaggctacattgagttaaggcatggtgaagatcttgtaatcgttgcttctggtataatggttgctccaagtattcgagttgcagatgaactgtctaaattaggttattcagtaagtgtgatagatttatttagaatcaaaccgataccagaacagataaaaacaatgttaagtggaaaaactatatttactgtagaaaatcacaatcagataggtggaattggcagtgctttatgtgaattattctctgatgatggaataacaaaaattcatcggatgggtgttcaagaaagattcggtcaagtagggaaaatggattatcttcttaatgagtatggtttgagtgaatcgaatataaaagagaaggttctagaaatttataatgcaagatag

SEQ ID NO: 1909 - DNA (genomic), 432 bp, Streptococcus pneumoniae; double-stranded, circular
  misc_feature (B) LOCATION 1...432
  hypothetical: NO
  anti-sense: NO
gagaaaagggggtgctcttgcttgattaagagaggagatgttgtagctctttatttgccttttccgactattagtagcgatttggctgtgaagaatcatatgtatatctgtattgacaacagcatgactaaaaacaaagagctggttaaaaatcagaccttcaaaccagctctcttgaccagacgtttggtcaagaactttatgatagaagagccggatctagctcgtaatccttttacaagaccaaccttgattgacttagataaggtatttatgttggataatacggtcattccgacttcttatttagccagacggcgacgcaatgtctcagaagaattgtacgaggaaattttggattacttagtccaaccacggctgatttcgctgaacaagtctgagtttatgcaactcaatccaggaacttattag

SEQ ID NO: 1910 - DNA (genomic), 249 bp, Streptococcus pneumoniae; double-stranded, circular
  misc_feature (B) LOCATION 1...249
  hypothetical: NO
  anti-sense: NO
aatggaaggggagggattcgaacccccgaacccgaaggagcggatttacagtccgccgcgtttagcctcttcgctacccttccaaaatatataaatggcgcgagacggaatcgaaccgccgacacatggagcttcaatccattgctctaccaactgagctaccgagccttattgcgggagcaggatttgaacctacgaccttcgggttatgagcccgacgagctaccgagctgctccatcccgcgttaa

SEQ ID NO: 1911 - DNA (genomic), 1536 bp, Streptococcus pneumoniae; double-stranded, circular
  misc_feature (B) LOCATION 1...1536
  hypothetical: NO
  anti-sense: NO
gatgtgagggggagttttatgtttaaagttttacaaaaagttggaaaagcttttatgttacctatagctatacttcctgcagcaggtctacttttggggattggtggtgcactttcaaacccaaccacgatagcaacttatccaatactagacaatagtatttttcaatcaatattccaagtaatgagctctgcaggagaggttgtattcagtaatttgtcactacttctctgtgtgggattatgtattggcttagcgaaacgagataaaggaaccgctgcgttagcaggagtaactggttacttagttatgactgcaacgatcaaagctttagtaaaactttttatggcagaaggatctgcaattgatactggagttattggagcattagttgtcggaatagttgccgtatatttgcacaaccgatataacaatattcaattaccttccgctttaggattctttggaggttcacgcttcgttcctattgttacatcgttctcttctatcttgattggctttgtcttctttgttatttggccacctttccaacaacttcttgtttctacaggtggatatatttctcaggcgggtccaattggaacttttctatatggatttttaatgagactttctggagcagtaggcttacatcatataatttaccctatgttttggtatactgaacttggtggtgttgaaactattgcaggacaaacagtggttggagctcaaaaaatattttttgctcaattagccgatccggcccattctggattatttacagaaggaacaaggttttttgcaggtcgtttctcaacaatgatgttcggtttaccggctgcctgtttagcgatgtaccatagtgttcctaaaaatcgtcgtaaaaaatacgcgggtttgttttttggagttgctttaacatcttttattaccggtattacagaaccaattgaatttatgtttctattcgtcagtccggttctatatgttgttcacgcattccttgatggtgttagcttctttattgcagacgtcttaaatatttcaataggaaacacattttcaggaggtgtaatcgatttcactttatttggaattttgcaggggaacgctaagacgaattgggttcttcagattccaattggacttatttggagtgttttgtattatattatttttagatggttcattactcaattcaacgttctaacgccaggacgaggagaagaagtagattctaaagaaatttctgaatccgcagattcaacttcaaatactgcagattatttaaaacaggatagcctacaaattatcagagcgttgggtggatcaaataatatagaagatgtagatgcttgtgtgacacgtttacgtgtagctgtaaaagaagttaatcaagttgataaagcacttttaaaacaaattggtgcagttgatgtcttagaagtgaagggtggcattcaagcaatctatggagcaaaagcaatcttatataaaaatagtattaatgaaattttaggtgtagatgattaa

SEQ ID NO: 1912 - DNA (genomic), 639 bp, Streptococcus pneumoniae; double-stranded, circular
  misc_feature (B) LOCATION 1...639
  hypothetical: NO
  anti-sense: NO
tataaaattttgaatatagagagttttctgacaatgaatcaatcctacttttatctaaaaatgaaagaacacaaactcaaggttcattatacaggtaaggagcgccgtgtacgtattcttcttcctaaagattatgagaaagatacagaccgttcctatcctgttgtatactttcatgacgggcaaaatgtttttaatagcaaagagtctttcattggacattcatggaagattatcccagctatcaaacgaaatccggatatcagtcgcatgattgtcgttgctattgacaatgatggtatggggcggatgaatgagtatgcggcttggaagttccaagaatctcctatcccagggcagcagtttggtggtaagggtgtggagtatgctgagtttgtcatggaggtggtcaagccttttatcgatgagacctatcgtacaaaagcagactgccagcatacggctatgattggttcctcactaggaggcaatatacccagtttatcggtttggaataccaagaccaaattggttgcttgggcgttttttcatctgcaaactggctccaccaagaagcctttaaccgctatatcgagtgccagaaactatcgcctgaccagcgcatcttcatctatgtag

SEQ ID NO: 1913 - DNA (genomic), 942 bp, Streptococcus pneumoniae; double-stranded, circular
  misc_feature (B) LOCATION 1...942
  hypothetical: NO
  anti-sense: NO
ttattttttattaaggagtattcaatgtctaagaaattaacatttcaagaaattattttgactttgcaacaattttggaatgaccaaggttgtatgcttatgcaggcttatgataatgaaaaaggtgcgggaacaatgagtccttacactttccttcgtgctatcggacctgagccatggaatgcagcttatgtagagccatcacgtcgtcctgctgacggtcgttatggggaaaaccctaaccgtctctaccaacaccaccaattccaggtggtcatgaagccttctccatcaaatatccaagaactttaccttgagtctttggaaaaattgggaatcaatcctttggagcacgatattcgttttgttgaggacaactgggaaaacccatcaactggttcagctggtcttggttgggaagtttggcttgacggaatggaaatcactcagttcacttatttccaacaagtcggtggattggcaactggccctgtgactgcggaagttacctatggtttggagcgcttggcttcttacattcaagaagtagactctgtctatgatatcgagtgggctaatggtgtaaaatacggagaaatctttatccagcctgagtatgagcactcaaaatattcatttgaaatttcggaccaagaaatgttgcttgaaaactttgataagtttgaaaaagaagctggtcgtgcattagaagaaggcttggtacaccctgcctatgactatgttctcaaatgttcacatacctttaatctgcttgacgcgcgtggtgccgtatctgtaacagagcgtgcaggctatatcgctcgtatccgtaacttggcccgtgttgtagccaaaacctttgttgcagaacgcaaacgcctaggttacccacttttggatgaagaaacacgagttaaacttttagcagaagacgcagaatag

SEQ ID NO: 1914 - DNA (genomic), 336 bp, Streptococcus pneumoniae; double-stranded, circular
  misc_feature (B) LOCATION 1...336
  hypothetical: NO
  anti-sense: NO
gaaaaaattttggagggtatccgtatgaaaattgttggtgttgcagcttgtactgtggaaattgcccacacttatattgcacaggaaaaattagagaatgccgcaaaggtagctggacatgtgattcatgttgagactcaggggacaataggggtagaaaatgaattgagtcaagagcagattgatgcagcggatgtagttattttagcagttgatgttaagatttctggtatggaacgctttgagggtaaaaagattatcaaggttccaacagaagtggcagtcaaatctcccaataaactgattgctaaagctgttgagattgttacgaaataa

SEQ ID NO: 1915 - DNA (genomic), 186 bp, Streptococcus pneumoniae; double-stranded, circular
  misc_feature (B) LOCATION 1...186
  hypothetical: NO
  anti-sense: NO
attatttttatgaatattgggttaacatttgaacattattcaagtaagcgttcacatattgaaaaaataaaacgtggggattataataaagttaatcaaggacgaagagagaagaaaaatggaagcggttttagcaatagatttaggtgcgacttctggaagagcaatcgttggttacctttctga

SEQ ID NO: 1916 - DNA (genomic), 888 bp, Streptococcus pneumoniae; double-stranded, circular
  misc_feature (B) LOCATION 1...888
  hypothetical: NO
  anti-sense: NO
ggagtttttatgaaaaacaaattttttctaatagctattttagctatgtgtatagtttttagcgcttgttcttctaattctgttaaaaatgaagaaaatacttctaaagagcatgcgcctgataaaatagttttagatcatgctttcggtcaaactatattagataaaaaacctgaaagagttgcaactattgcttggggaaatcatgatgtagcattagctttaggaatagttcctgttggattttcaaaagcaaattacggtgtaagtgctgataaaggagttttaccatggacagaagaaaaaatcaaagaactaaatggtaaagctaacctatttgacgatttggatggacttaactttgaagcaatatcaaattctaaaccagatgttatcttagcaggttattctggtataactaaagaagattatgacactctatcaaaaattgctcctgtagcagcatacaaatctaaaccttggcaaactttatggagagatatgattaaaattgattcaaaagccttaggtatggaaaaagaaggtgatgagttaatcaaaaatactgaagctcgtatatccaaagaattagaaaaacatccagaaatcaaaggaaaaatcaaaggaaaaaaagtattatttactatgattaatgctgcagatacatcaaaattctggatttatactagcaaagatccaagagcaaattatttaacagatttaggtctagttttccctgaatcattaaaagaatttgagagtgaagatagttttgcaaaggaaatttctgcagaagaagcaaataagataaatgatgctgatgtaatcataacttatggtgatgataaaactcttgaagctttacaaaaaggatcctcttttaggtaa

SEQ ID NO: 1917 - DNA (genomic), 267 bp, Streptococcus pneumoniae; double-stranded, circular
  misc_feature (B) LOCATION 1...267
  hypothetical: NO
  anti-sense: NO
aatccttttatcctcattaacacgaaccatgatgactcaggcaagcaatatatggagcagattcgaattgttcgccagaccttgcagaatcgtgattggaatgagaaaattaaaaagacggttcgaggatttatgattgaatcttacctagcagatggtcgtcaaaaccaaccagaggtctttggttgctctattactgacccttgcctaggttgggaaaatacagaggccttggtagaagagatttatgttaccttgacaaaataa

SEQ ID NO: 1918 - DNA (genomic), 327 bp, Streptococcus pneumoniae; double-stranded, circular
  misc_feature (B) LOCATION 1...327
  hypothetical: NO
  anti-sense: NO
ctcacttttatcaactggttctttagtaccaataccctttattttatcttctggtttcggtgtttcctctacagccttctcttcaggagcttctggttgcttttctggagagactggtgccttttcgtcttcacttggctcgactggttcacctacttgttcaacttttggttccgtttgtttttctacagcaggcgtttcaacttttggttcttcaacaggttgattagcagcctcatcttttgtttctactacttctggctgtgtatcttcttgtttcggtgtatcttccgctcccctatcttctttaggatcttctggttgtga

SEQ ID NO: 1919 - DNA (genomic), 336 bp, Streptococcus pneumoniae; double-stranded, circular
  misc_feature (B) LOCATION 1...336
  hypothetical: NO
  anti-sense: NO
aggtttttcttttttttaaaaggaaaacgagaacaggaggttcttatgaaagcaagcattgccttgcaagttttacccctagcacaggggattgatcggatagctgttattgatcaggtcattgcttatctgcaaactcaagaagtgacgatggtagtgacaccatttgaaacggtcttggaaggggagtttgatgagcttatgcgcattctaaaagaagcgctggaagtggcagggcaggaggcagacaatgtctttgccaatgtcaaaataaatgtaggagagattttaagtattgatgagaaacttgaaaagtatactgagacgacacattag

SEQ ID NO: 1920 - DNA (genomic), 207 bp, Streptococcus pneumoniae; double-stranded, circular
  misc_feature (B) LOCATION 1...207
  hypothetical: NO
  anti-sense: NO
aatcattttatactcttcgaaaatctcttcaaaccacgtcagcttcaccttgcagtatatatgttactgacttcgtcagttctatccacaacctcaaaacggtgttttgagctgacttcgtcagttctatccacaacctcaaaacactgttttaagcaacctgcggctagcttcctagtttgctctttgattttcattgagtattag

SEQ ID NO: 1921 - DNA (genomic), 633 bp, Streptococcus pneumoniae; double-stranded, circular
  misc_feature (B) LOCATION 1...633
  hypothetical: NO
  anti-sense: NO
aagaattttatgactgatattaaaactttggctctaaagtatggaggttatacaagtctggacaaggtctatctggatcagcttctagctggtaaaacagatcaggagcagttaacacttattacacctccgccaagtgttgttaatgcctactttgcagaactctatcagaaaaagagtcctcaggctgcgacggattattttgcagaactcagtcaggaactgaatctttacaatactgagccaagtttcaccctagaaaataagccttttattcggcttaatctgtctggtaaatcctttggtttttgttatgagagtgacggccttggtcggattttctttgaaaatgaggagaaaatctcggatgacttgctctttgaaattgcgcaaattttcccccatcaattagtctttgaagagtctggtaagatttacatgaagcctgtcgaggacgaggaagttatcagcctagaaagtctcacagctttgactgatttggaaagattggctgatggtcgaaaacgtctcaaaggctacagccaagaggatttattgcaagaagctgctgctttttctggcaaacgctatttccgatcggaaaaccgcacagccatgttatatattgattaa

SEQ ID NO: 1922 - DNA (genomic), 255 bp, Streptococcus pneumoniae; double-stranded, circular
  misc_feature (B) LOCATION 1...255
  hypothetical: NO
  anti-sense: NO
aaggttttcttactcatatcaaaggcacgaaccactcctaaaagattattggttgtcaacaccaaatctgctgactcgatggcgatatctgttccagctcccatagcaatccccacatctgctacactaagggcaggagcgtcattgataccgtccccaacaaaggctactttccctgactgttgcagtttatggatttcatgggctttttcttctggcaagacgcctgcaatgacctcttcaattccgatttga

SEQ ID NO: 1923 - DNA (genomic), 555 bp, Streptococcus pneumoniae; double-stranded, circular
  misc_feature (B) LOCATION 1...555
  hypothetical: NO
  anti-sense: NO
ggagtatttatgaaattaaaattattaagagtagatactaaggtgattatggggagtttcttacttgttctgtctagtctacttgctttgttgcttccccttatcttaaagggtttaatagatgggagttctattgaaaatataggttccaaagtatttcaatcgtttttgatttttattggtcaagccttgttttcttctattggttactatctgtttagtcaatcgggtgaaaaaaagatagcaaaaatcaggaaaaaagtgatagaggggttgatttatgcagagaaatccttctttgataagagccaaagtggggagttgacttctgccattgtcaatgacatgagtgtcattcgtgagtttttaattacgactttcccaaatattattctgagtttagttatggtacttggttccattgtagtcttatttagtcttgattggaatctttctctacttttattcatcactcttccttgtatgatgtttattatcttgcccctttccaatatcagtgaaaagtatagtcgtcgtttacaggaggaaatttaa

SEQ ID NO: 1924 - DNA (genomic), 1029 bp, Streptococcus pneumoniae; double-stranded, circular
  misc_feature (B) LOCATION 1...1029
  hypothetical: NO
  anti-sense: NO
aaaagatttatttttaaaacaaaaatgaaacgtttcaaaaaagaaataaagagacagcgccaagcgctatcttttctagaaaaaatgaaacgtttcaaaaaggaggttgctatgaatagcaaagcgaagcaagtttctctttgggaaagaatcaagaaacaaaaactcttgttattgatgactgtccccggtttagttttaacctttatctttaaatacatccctatgtatggggttttaatcgcatttaaagattacaatcctttaaaaggaattttagggagtgattggattggtttttctgagtttacaaaattcatatcctctcccaactttggtatcttgttagccaacacattaaaattaagtatctatggtttattgcttggctttttaccaccaatcattcttgctattatgctcaatcaactcttgagtgaaaaagtcaaaaaacgaattcagctcattttatacgcaccaaactttatctcagtcgttgttattgtcggtatgattttcctcttcttttcagtgggaggaccaatcaacaattttctttctatgtttggaatgaaggctgacttcttgacaaatccagacttctttagacccttatacatctttagtggtatctggcaaggaatgggctgggcttcaacgctctacacggcaacattggtaaatgtagatccagccttagtagaagcagcccgactggatggagccaatatcttccaacgaatctggcacattgatattccagctcttaagcctattatggttatccaatttgttttagctgcaggtggaattatgaatgtcggatatgaaaaagcattcttgatgcagacatcgttaaatttgccaacttctgaaattatctcgacatatgtctataaagttggtcttgtatcaggagactattcttactcaacagcggttggtttgtttaatgcagtgattcacgtagtattgcttgttgcagttaaccaaatcgttaaacgcatgaataatggtgaaggaatttaa

SEQ ID NO: 1925 - DNA (genomic), 318 bp, Streptococcus pneumoniae; double-stranded, circular
  misc_feature (B) LOCATION 1...318
  hypothetical: NO
  anti-sense: NO
aaaggatttatgaaacacctattatcttacttcaaaccctacatcaaggaatcaattttagcccccttgttcaagctgttagaagctgtttttgagctcttggttcccatggtgattgctgggattgttgaccaatctttacctcagggagatcaaggtcatctctggatgcagattggcctgctccttatctttgcagtaattggcgttttagtggccttgatagctcaattttactcagcaaaggcagcagtaggcttggctataggaattgacaaacgatctttatcgtcatattctttccttgcccaagcatag

SEQ ID NO: 1926 - DNA (genomic), 315 bp, Streptococcus pneumoniae; double-stranded, circular
  misc_feature (B) LOCATION 1...315
  hypothetical: NO
  anti-sense: NO
agccatttctttggggggaaaaaaaggggggaattgagtgatttttttgaggaagaaggaggtttccacccacccttaatttttggacaccatgtaccccatttgaaaacgaacttttttagaggggattttggggggggcaacaccttttttttcaaagaaggggaattagagggggttttgaaaaaaaattttttttttaaagaaactccacaacgaggaacaggggggtttttcgtcccccgggggggggattcctccggggtctccctcctggagggaggatgtaaaaagtggggatgtgaggttctttaa

SEQ ID NO: 1927 - DNA (genomic), 546 bp, Streptococcus pneumoniae; double-stranded, circular
  misc_feature (B) LOCATION 1...546
  hypothetical: NO
  anti-sense: NO
tggcttcttatcatctgcttgtggcttgctattatctggttttggtttttctggttgcggtttaacctctggttttggtttttctggttgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttctggttgcggtttaacctctggttttggtttttccagctgcggtttaacctctggttgaggacttggttgcatacctggttttggagcagatggttttttgttacctggttcttttggtgtgtcctgagttaa

SEQ ID NO: 1928 - DNA (genomic), 963 bp, Streptococcus pneumoniae; double-stranded, circular
  misc_feature (B) LOCATION 1...963
  hypothetical: NO
  anti-sense: NO
gaaattcttatgtctattagccaacgtacgaccaagctcatcttagctacctgtcttgcctgcctgcttgcttattttctcaatctttcgtcagcagtttcggctggaattatcgctctcttgagcctatctgatacgcgtagaagtactttaaaactggctcgcaatcgtcttttttctatgcttctagctctggctatcggtgttctagcttttcacttgagcggatttcatatctggagtctcggcctctatctggccttctacgttcctttagcctacaagatgggctgggaaattggcatcacaccaagcactgttttggttagccatctcttggttcaagagtcaacctctccagaccttctagtcaatgaattccttctctttgctattggtacaggatttgccttgcttgttaatctctatatgccttcacgagaagaggaaatccagcactaccacacgctggtggaagaaaagttaaaagatatcctccagcgcttcaaatactatttatccagaggagacggacgcaaccgagcacagctggtagcagaattagacacgcttttgaaagaagccctcagactggtctatttggatcactctgaccacctctttcaccagaccgactaccatatccactactttgagatgagacagcgacaaagtcgtatcctgagaaacatggcccaacagattaacacttgtcaccttgccgccagtgaaagcctgatcttagcgcaactcttttcaaaaattgcaggtcaactgagccagaccaatcctgcttctgatttgctagatgaaattgaacgttatctggaagtcttccggaaccgcagtctgcccaaaacaagagaagagtttgaaacccgcgccacccttcttcaactcctacgtgaagccaaaaccttcatccaagtaaaagttgatttttaccaaaaatatagacagtaa

SEQ ID NO: 1929 - DNA (genomic), 954 bp, Streptococcus pneumoniae; double-stranded, circular
  misc_feature (B) LOCATION 1...954
  hypothetical: NO
  anti-sense: NO
agatatcttatacaaagaggtattcatatgtctatttataacaacattactgaattaatcggtcaaacaccgattgttaaacttaacaacatcgtgccagaaggtgctgcagacgtctatataaagcttgaagcatttaatcctggttcatctgtaaaagaccgtattgcccttagcatgattgaaaaagctgaacaagatggtattctgaaacctggttctactattgttgaagcaacaagtggaaacactggtattggactttcatgggtaggtgctgctaaagggtataaagtcgtcatcgttatgcctgaaactatgagtgtagaacgacgtaaaattatccaagcttatggtgctgaactcgtcctaactcctggtagcgagggaatgaaaggtgctattgctaaggctcaagaaatcgctgctgaacgtgatggtttccttcctcttcaatttgacaatccagctaatccagaagtacacgaaagaacaacaggagctgagatactagctgctttcggtaaagatggattagatgcctttgttgctggagtaggtaccggtggaacgatttctggtgtttctcatgcactcaaatcagaaaattctaacattcaagtttatgcagtggaagctgatgaatctgctattctatctggtgaaaaacctggtcctcacaaaattcaaggtatctcagctggatttattcctgatacacttgatactaaagcctatgatggtatcgttcgtgtaacatcagatgatgctcttgcactcggacgtgaaattggtggaaaagaaggcttccttgtagggatttcctcagctgcagctatctacggagccatcgaggttgccaaaaaattaggtacaggtaaaaaagtccttgctctagcaccagataacggtgaacgttatctctctacagcactctatgaatttgaagtttag

SEQ ID NO: 1930 - DNA (genomic), 801 bp, Streptococcus pneumoniae; double-stranded, circular
  misc_feature (B) LOCATION 1...801
  hypothetical: NO
  anti-sense: NO
gtggatttctttatgaagaggtttgaagtatctacagaaattggtagtctctctgttgcttatcaaaagcaaaagaaagtgctagtttgtctaaatggagcaggtttgctaccaagttatgaaaatttttcacttatacttgaaaaacctcctcctacaattggttatttgacaattgattttccgaacacaggtaggagtccgatttatgaccaagctggaaaaaatctagataatcttgcagatgtggtttatgaagcacttgaagaattagggatttctgaatatatactttgtgtacatagttggagtggaattttagcttgcaaattactcgagaaaccaattaagtgtcagactttagtagtaattgaaccgacaactaaaaaagtcatgtttgctgatttttcagaaaatccttatccagaaatggaagagcagatgaggctgattgacgagtgtggtcctgaactttattttaagaacttaactcaagcaacatttagtcctgaaacgaataaaaaaatctgggaattaatgcaagaaaaaggcttagagttggaaaatcaagatccagaatttcagatatctggagagattactgaggaagattttgagaatttgtcgatagaatctcatgtccctgtatttattttttgtcagacttatagagaaaaagagtacagagaatcagaatattggacttccaatactaaactcattttaggagggaatcaccattatttacaatggtcagaatcggaaaaaattgcggctattattcgagaattgtcagaataa

SEQ ID NO: 1931 - DNA (genomic), 1968 bp, Streptococcus pneumoniae; double-stranded, circular
  misc_feature (B) LOCATION 1...1968
  hypothetical: NO
  anti-sense: NO
aatggtcttatgaataaaagaatgaatgagttagtcgctttgctcaatcgctatgcgactgagtactataccagcgataatccctcggtttcagacagtgagtatgaccgcctttaccgtgagttggtcgagttagaaactgcttatccagagcaagtgctagcagacagtccgactcatcgtgttggtggcaaggttttagatggttttgaaaaatacagtcatcagtatcctctttatagtttgcaggatgctttttcacgtgaggagctagatgcttttgatgcgcgtgttcgtaaggaagtggctcatccgacctatatttgtgagctgaaaatcgatggcttatctatctcgctgacttatgaaaaggggattttggttgctggggtaacacgtggagatggttcaattggtgaaaatatcacagaaaacctcaagcgtgttaaggacatccctttgactttgccagaagaactagatatcacagttcgtggggaatgttacatgccacgcgcttcctttgaccaagttaaccaagtgcgccaagaaaatggagagcctgaatttgctaatcctcgtaatgcggcagcaggaactctgcgtcagttggatacagcagtagttgccaagcgtaatcttgcaacgtttctctatcaagaagccagcccttcaactcgtgatagccaagaaaagggtttgaagtacctagaacaactaggttttgtggtcaatcctaagcgaatcttggctgaaaacatagatgaaatctggaattttatccaagaagtaggacaggaacgggaaaatctgccttacgatattgatggagtggtaatcaaggtcaacgacctagcaagtcaagaagaacttggttttacagttaaggctccaaagtgggcagtagcctacaagttccctgccgaagaaaaagaagctcaactcttatcagttgactggacagttggccgtaccggtgttgtaactccaactgctaatctaacaccagtacaacttgccggtacgactgttagccgtgcgaccctgcacaatgtagattatattgctgaaaaagatatccgaaaagacgatacggtcattgtatataaggctggtgacatcatccctgccgttttacgtgtggtagagtccaaacgggtttctgaagaaaaactagatatccctacaaactgtccaagttgtaactctgacttgttgcactttgaagatgaagtggccctacgttgtatcaatccgcgttgccctgctcaaatcatggaaggcttgattcactttgcttctcgtgatgctatgaatattacaggccttggtccatctattgttgagaagctttttgctgctaatttagtcaaggatgtggcggatatttatcgtttgcaagaagaggatttcctccttttagagggggttaaggaaaagtccgctgctaaactgtatcaggctatccaagcatcaaaggaaaattctgccgagaagctcttatttggtttgggaattcgtcatgtcggaagcaaggctagtcagcttttacttcaatatttccattcaattgaaaatctgtatcaggcagattcagaggaagtggctagtattgaaagtctaggtggcgtgattgccaaaagtcttcagacttattttgcgacagaaggctctgaaattctgctcagagaattgaaagaaactggggtcaatctggactataaaggacagacggtagtagcggatgcggccttgtcaggtttgaccgtggtattgacaggaaaattggaacgactcaagcgctcagaagctaaaagtaaactcgaaagtctgggtgccaaagtgacaggtagtgtttctaaaaagaccgacctcgtcgtggtaggtgcagacgctggaagtaaactgcaaaaagcacaagaacttggtatccaggtcagagatgaggcatggctagaaagtttgtaa

SEQ ID NO: 1932 - DNA (genomic), 558 bp, Streptococcus pneumoniae; double-stranded, circular
  misc_feature (B) LOCATION 1...558
  hypothetical: NO
  anti-sense: NO
ggattccttatgatttcattccttcttctattggtcttggtttggggattttatatcggctatcggagaggcctgctcttacaggtttattacctgatttcagccatggcatcggcttttatggctggccagttttataaggggcttggagagcaattccatttattgctcccttatgcaaattcgcaggaaggtcaggggactttctttttcccatcggatcaactctttcagctggataaggtcttttatgcaggtatcggctacttgcttgtatttgggattgtctatagcattggtcgtttgcttggtcttctcttacacttgattcctagcaaaaaactgggtggtaagttgttccaagtttcagcaggtatcttgtccatgttggtgaccttatttgtcttgcaaatggccttgacaatcttggcgaccatccccatggcagttatacaaaatcctcttgaaaagagtatcgtcgcaaaacacatcatccagagcataccgataacaaccagttggctcaaacaaatctgggtgacaaatttaatcggataa

SEQ ID NO: 1933 - DNA (genomic), 2406 bp, Streptococcus pneumoniae; double-stranded, circular
  misc_feature (B) LOCATION 1...2406
  hypothetical: NO
  anti-sense: NO
attatgcttatatcttataaatggttaaaagaattggtggacattgatgtgccatcacaagagttggctgaaaaaatgtcaactacaggaatcgaggtagagggtgtcgaatcaccagctgctggtctctcaaaaattgtcgtcggtgaggtcttgtcttgcgaagatgtgccagagactcacctccatgtttgtcaggttaacgttggcgaagaagagcgtcagatcgtttgtggtgccccaaatgtgcgtgctgggatcaaggtcatggtggctcttccaggagctcgtatcgctgataactacaaaatcaaaaaaggaaaaatccgtggtttggagtcacttggaatgatctgttcacttggtgaattgggaatttctgactcagttgtgcctaaggaattcgcagatggcatccaaatcttgcctgaagatgccgtgccaggtgaggaagtcttttcttacctagacttggatgatgaaatcatcgaactttccatcacaccaaaccgtgcagatgccctttctatgtgtggagtggctcacgaagtggcagccatctatgacaaggcagtcaactttaaagaatttactctaacagaaactaatgaagctgcggcagatgccctttctgtcagcattgagacagacaaggcgccttactatgcagctcgtatcttggacaatgtgaccatcgcaccaagtccacaatggttgcaaaaccttctcatgaacgaaggaatccgtcccatcaataacgtagtggacgtgaccaactacatcctgctctattttggtcaaccaatgcatgcctttgacttggataactttgaagggactgacatccgtgtgcgtgaagcgcgtgctggtgaaaaattggtgaccttggacggtgaagaacgtgacttggacgtgaatgacctagtcatcactgtcgcagacaagccagtagcccttgcaggtgtcatgggtggtcaagcaacagaaatctctgaaaaatctagtcgtgttgtccttgaagctgctgttttcaatggcaaatctatccgtaagacaagtggtcgcctgaaccttcgttctgagtcatcttctcgctttgaaaaaggaattaatgtggcaacagttaatgaagcccttgatgcggcagctagcctgattgcggaacttgcaggtgcgacggtgcgtaagggcatcgtttcagcgggtgagcttgatacttcagatgtagaagtttcttcaacccttgctgatgttaaccgtgtcctcggaactgagctgtcttatgctgatgtagaagacgtcttccgtcgtcttggctttggtctttctggaaatgcagacagctttacagtcagagtcccacgtcgtcgttgggatatcacaatcgaagctgacctctttgaagaaattgctcgtatctatggttatgaccgcttgccaactagtctaccaaaagacgatggtacagcaggtgaattgacagccacacaaaaactccgccgtcaagttcgtactattgctgaaggagcaggtttgacagaaatcatcacctatactctaacaactcctgaaaaagcagttgagtttacggctcaaccaagtaaccttacggaactcatgtggccaatgactgtggatcgttcagtcctccgtcaaaatatgatttcaggtatccttgataccgttgcctacaacgtggctcgtaagaataaaaacttggccctttacgagattggaaaagtctttgaacaaacaggtaatccaaaagaagaacttccaaatgaaatcaacagttttgcctttgccttgacaggcttggttgctgaaaaagatttccaaacagcagcagttccagttgatttcttctatgctaagggaatccttgaagccctatttactcgtttgggactccaagtaacctatacagcaacatctgaaatcgctagccttcatccaggtcgtacagccgtgatttcactcggtgaccaagttcttggtttccttggccaagtgcatccagtcactgccaaggcttacgatattccagaaacgtatgtggctgagcttaacctttcagctatcgaagctgcgcttcagccagcgactccatttgtagaaatcaccaaattcccggcagtcagccgtgacgttgcccttctcctcaaggcagaagtgactcatcaagaagttgtagatgctatccaagctgccggcgtgaaacgtttgacagatatcaaactctttgacgtcttctcaggtgagaaattgggacttggtatgaagtcaatggcttatagcttgaccttccaaaatccagaagatagcttaacggacgaagaagtcgcacgctatatggaaaaaatccaagcatcgctcgaagaaaaagtcaatgcagaagtgcgttaa

SEQ ID NO: 1934 - DNA (genomic), 243 bp, Streptococcus pneumoniae; double-stranded, circular
  misc_feature (B) LOCATION 1...243
  hypothetical: NO
  anti-sense: NO
ttccagcttatcctcagtgatattttgggaaccaaggaattggccgctctgcatggttatattttaacagcttggacaatggctggtttagcgngacctattttattagcagagacttataaaatggctcattcgtacacacaaacgttgttcgtatttctcattttatacagtatcgccttggctttgtcttattatctaggtcgttcaatcaaaaaagaaagtcaaaaaccgcttacatga

SEQ ID NO: 1935 - DNA (genomic), 303 bp, Streptococcus pneumoniae; double-stranded, circular
  misc_feature (B) LOCATION 1...303
  hypothetical: NO
  anti-sense: NO
aaacagcttatcaaaaaagtcggacaagctggtaaaatcttggctgacagtggttatcaagggctcatgaagatatatcctcaagcacaaactccacgtaaatccagcaaactcaagccgctaacagttgaagataaaacctataaccatgcgctatctaaggagagaagcaaggttgagaacatctttgccaaagtagaaacgtttaaaatgttttcaacaacctgtcgaaatcatcgtaaacgcttcggattacgaatgaatttgagtgctggtattatcaatcatgaactaggattctag

SEQ ID NO: 1936 - DNA (genomic), 783 bp, Streptococcus pneumoniae; double-stranded, circular
  misc_feature (B) LOCATION 1...783
  hypothetical: NO
  anti-sense: NO
gaggagcttatgataaaagatgaacgtgtacttgaattgattgaaattattataaagaaaaaaagaattgccgtaaaagagctggcagaaatcactttctccagcacaagtaccttacgtcgtgatttaattttcttagaaaatcaaggtcttatcaaaagaaagcacggatacgtgaccctgtcctctatgaacacaattgaactttctcatcaaatacgggaaggagaaagtactaggcaaaaaagactaatcgctagtctcgctaaagactttattcggtctggtatgtgtatctatctggattccagtacgactgtctacgaactctgtccctatctttctgaacttgataatttgattatttttacaaatggtttacatactgcacaaaccctatctgaaactgttaaagatagctccaaaatctttatcacatctggcgaggtcaaacatcaatcctgttccgtggtcaactatgataaggaaaattctttattagatcattttaatatcgatttagcattttgttcagcaagaggtattgatgaccaatatgtttatgaagcttctctcagccaagctatttcaaaaaagaatattattgacaaagcccatgaaaccatcttactgattgatagttctaaattttacaagactggattttttaaaattaatcccctatccaaatacacaacctttatttctgacaccttgccagaccaaaaattattagatgcagtagaattatttgatggagaatgggtttctgatattcaatga

SEQ ID NO: 1937 - DNA (genomic), 1965 bp, Streptococcus pneumoniae; double-stranded, circular
  misc_feature (B) LOCATION 1...1965
  hypothetical: NO
  anti-sense: NO
caatttattatccattcttcaaaattgcagataaacgcaatcttgaaaaagaaaaagctactgttggagggaaataagatggttatcagagtatttgatcaacagaaaaatacttattctagctttgccttagaggaattaagttactatatgaatcgggtctttaagactaacatagagcttgtcgaggagaaggaagcggatatttttgtaggattagtcaataaagaggacagaaaagaccatgttcttatctcattagacaagggtaaggggagaattgagtctaatacaattgtaggtttacttattggaatttaccgaatgtttcatgaatttggggttgtgtacactagaccagggcgcagacatgactttgttccagagttacgatttgaagattttttagataaagagctatctatagatgaaacagccagttactatcataggggagtatgtatagagggagcggattcatttgaaaatatactagatttcattgattggctacctaagattgggatgaacagttttttcatccagtttgaaaatccttactcttttttgaaacgttggtatgaacatgagtttaatccatacctaaataaagaaaaattctcaaatgaattagtacaagaattgagtgataggttggataaagaattgcaaaaaagaggtcttattcatcatcgtgttggtcatggatggacaggtgaggttttaggttactcttcaaaatttggctgggaatcaggtcttagtatttcagaggagaagaaaccgtatgtcgctgaaataaacgggaaacgagaattatttaatacggctccgattttaaccagtctggatttttcaaatccagatgtggcggataagatggtagaaattatcaaggattatgccaagaaaagacctgatgttaactacttacatgtatggttgtcggatgctcgtaataatatttgtgaatgcgaaaactgtagacaagaattggtttcggatcagtatattcgtattctcaatcaattggatagggctttaacgagtgagggattagatacaaagatttgttttctgctttaccatgagttgctatgggcgcctcagaaagaaaaattagataatcctgaacgctttaccatgatgtttgcaccgattacaagaacatttgaaatgagttatgcagatgtagattttgacaattccatacctacgcctaaaccttatctgcgtaataaaattatacttccgaattctcttgaggaaaatttatcttatctttttgagtggcaaaaaacatttaaaggagatagtttcgtatatgactatcctttagggcgtgctcattatggcgatttaggctatatgaaaattagtcaaaccatttacagagatgtatcttatctttctaacctacatttgaacggttacatttcgtgtcaagaattacgtgccggattccctcataattttcctaattatgttatgggggaaatgctctggaagaagacaagaagttatgaagaattgattgaagaatacttttctgctttgtatggggaaaattggcagtctgttgttgaatatttagaaaaattatccagttattcctcatgtgattattttaatgcaattggcagtcgtcaaaatgatgttttagcgaatcattattatatagcttacaatctagctgataattttttgccaattattgaggaaaatatttctaagttattaaatagtcaaaaggatgaatggaaacagctcagttatcatcgtgaatatgttgttaagatggcgaaggctttatatcttcaagcaaccggaaaaacaaggcaagctcaagatgaatggagaaatgtgttgaattatatccgtgggcacgaactgctattccaatctaatttggatgtttatcgtgtaattgaagtagcaaaaaattacgctggtttccacttataa

SEQ ID NO: 1938 - DNA (genomic), 807 bp, Streptococcus pneumoniae; double-stranded, circular
  misc_feature (B) LOCATION 1...807
  hypothetical: NO
  anti-sense: NO
gagtttattatggtttcttcagaatttatctcaaagattgaatttgcttgcaataagaaagaaagtctttatagtcaaagcaaatttaagtatgcgattcgttcgatgttcgcaggtgcatttttaaccttcagtactgctgcaggtgcagttggggctgacttgattaataaaattgcaccaggtagtggacgcttcctctttccattcgtttttgcttggggcttggcctacattgtttttttgaatgccgagttggtcacttcaaacatgatgttcttgactgctggtagtttcttaaaaaaaatctcttggagaaaaacagctgagattttactatactgtaccttgttcaaccttatcggagccttgatagcagggtggggctttgctcattcggcagcctatgcgaatctgacacacgatagtttcatctcaggtgttgttgagatgaagttaggccgctcaaatgaattggtcttgcttgaggcgattttggcaaatattttcgtaaatattgcgattctgtcatttattttggtcaaagatggtggtgccaaactttggcttgtgttgtcagctatttacatgtttgtattcttaacaaacgagcacattgcggcgaactttgcttctttcgcgattgtgaaattcagtgttgctgcggattcaattgccaacttcggtgttggaaatatgcttcgccactggggtgtgactttcatcggaaactttatcggaggaggcctcttgatgggtcttccatatgccttcctcaataaaaacgaagatacttatgtagattaa

SEQ ID NO: 1939 - DNA (genomic), 1320 bp, Streptococcus pneumoniae; double-stranded, circular
  misc_feature (B) LOCATION 1...1320
  hypothetical: NO
  anti-sense: NO
aggattattatgaaatcaagagtaaaggaaacgagtatggataaaattgtggttcaaggtggcgataatcgtctggtaggatacgtgacgatcgagggagcaaaaaatgcagtcttacccttgttggcagcgactattctagcaagtgaaggaaagaccgtcttgcagaatgttccgattttgtcggatgtctttattatgaatcaggtagttggtggtttgaatgccaaggttgactttgatgaggaagctcatcttgtcaaggtggatgctactggcgacatcactgaggtagccccttacaagtatgtcagcaagatgcgcgcctccatcgttgtattagggccaatccttgcccgtgtgggtcatgctaaggtatccatgccaggtggttgtacgattggtagccgtcctattgatcttcatttgaaaggtctggaagctatgggggttaagattagtcagacagctggttacatcgaagccaaggcagaacgcttgcatggtgctcatatctatatggactttccaagtgttggtgcaacgcagaacttgatgatggcagcgactctggctgatggggtgacagtgattgagaatgctgcgcgtgagcctgagattgttgacttagccattctccttaatgaaatgggagccaaggtcaaaggtgctggtacagagactataaccattactggtgttgagaaacttcatggtacgactcacaatgtagtccaagaccgtatcgaagcaggaacctttatggtagctgctgccatgactggtggtgatgtcttgattcgagacgctgtctgggagcacaaccgtcccttgattgccaagttacttgaaatgtgtgttgaagtaattgaagaagacgaaggaattcgtgttcgttctcaactagaaaatctaaaagctgttcatgtgaaaaccttgccccacccaggatttccaacagatatgcaggctcaatttacagccttgatgacagttgcaaaaggcgaatcaaccatggtggagacagttttcgaaaatcgtttccaacacctagaagagatgcgccgcatgggcttgcattctgagattatccgtgatacagctcgtattgttggtggacagcctttgcagggagcagaagttctttcaactgaccttcgtgccagtgcagccttgattttgacaggtttggtagcacagggagaaactgtggtcggtaaattggttcacttggatagaggttactacggtttccatgagaagttggcgcagctaggtgctaagattcagcggattgaggcaagcgatgaagatgaataa

SEQ ID NO: 1940 - DNA (genomic), 2820 bp, Streptococcus pneumoniae; double-stranded, circular
  misc_feature (B) LOCATION 1...2820
  hypothetical: NO
  anti-sense: NO
tttgttattatttataaaggagataccatgaaactcaaagacacccttaatcttgggaaaactgaattcccaatgcgtgcaggccttcctaccaaagagccagtttggcaaaaggaatgggaagatgcaaaactttatcaacgtcgtcaagaattgaaccaaggaaaacctcatttcaccttgcatgatggccctccatacgctaacggaaatatccacgttggacatgctatgaacaagatttcaaaagatatcattgttcgttctaagtctatgtcaggattttacgcaccatttattcctggttgggatactcatggtctgccaatcgagcaagtattgtcaaaacaaggtgtcaaacgtaaagaaatggacttggttgagtacttgaaactttgccgtgagtacgctctttctcaagtagataaacaacgtgaagattttaaacgtttgggtgtttctggtgactgggaaaatccatatgtgaccttgactcctgactatgaagcagctcaaattcgtgtatttggtgagatggctaataagggttatatctaccgtggtgccaagccagtttactggtcatggtcatctgagtcagcccttgctgaagcagagattgaataccatgacttggtttcaacttccctttactatgccaacaaggtaaaagatggcaaaggagttctagatacagatacttatatcgttgtctggacaacgactccatttaccatcacagcttctcgtggtttgacggttggtgcagatattgattacgttttggttcaacctgctggtgaagctcgtaagtttgtcgttgctgctgaattattgactagcttgtctgagaaatttggctgggctgatgttcaagttttggaaacttaccgtggccaagaactcaaccacatcgtaacagaacacccatgggatacagctgtagaagagttggtaattcttggtgaccacgttacgactgactctggtacaggtattgtccatacagcccctggttttggtgaggacgattacaatgttggtattgctaataatcttgaagtcgcagtgactgttgatgaacgtggtatcatgatgaagaatgctggtcctgaatttgaaggtcaattctatgaaaaggtagttccaactgttattgaaaaacttggtaacctccttcttgcccaagaagaaatctctcactcatatccatttgactggcgtactaagaaaccaatcatctggcgtgcagttccacaatggtttgcctcagtttctaaattccgtcaagaaatcttggacgaaattgaaaaagtgaaattccactcagaatggggtaaagtccgtctttacaatatgatccgtgaccgtggtgactgggttatctctcgtcaacgtgcttggggtgttccacttcctatcttctacgctgaagatggtacagctatcatggtagctgaaactattgaacacgtagctcaactttttgaagaacatggttcaagcatttggtgggaacgtgatgccaaagacctcttgccagaaggatttactcatccaggttcaccaaacggcgagttcaaaaaagaaactgatatcatggacgtttggtttgactcaggttcatcatggaatggagtggtggtaaaccgtcctgaattgacttacccagccgacctttacctagaaggttctgaccaataccgtggttggtttaactcatcacttatcacatctgttgccaaccatggcgtagcaccttacaaacaaatcttgtcacaaggttttgcccttgatggtaaaggtgagaagatgtctaaatctcttggaaataccattgctccaagcgatgttgaaaaacaattcggtgctgaaatcttgcgtctctgggtaacaagtgttgactcaagcaatgacgtgcgtatctctatggatattttgagccaagtttctgaaacttaccgtaagattcgtaacactcttcgtttcttgattgccaatacatctgactttaacccagctcaagatacagtcgcttacgatgagcttcgttcagttgataagtacatgacgattcgctttaaccagcttgtcaagaccattcgtgatgcctatgcagactttgaattcttgacgatctacaaggccttggtgaactttatcaacgttgacttgtcagccttctaccttgattttgccaaagatgttgtttacattgaaggtgccaaatcactggaacgccgtcaaatgcagactgtcttctatgacattcttgtcaaaatcaccaaactcttgacaccaatccttcctcacactgcggaagaaatttggtcatatcttgagtttgaaacagaagacttcgtccaattgtcagaattaccagaggctcaaacttttgctaaccaagaagaaatcttggatacatgggcagccttcatggacttccgtggacaagcacaaaaagccttggaagaagctcgtaatgcaaaagttatcggtaaatcacttgaagcacacttgacagtttatccaaatgaagtggtgaaaactctactcgaagcagtaaacagcaatgtagctcaacttttgatcgtgtcagacttgaccatcgcagaaggaccagctccggaagctgcccttagcttcgaagatgtagccttcacagttgaacgtgctgctggtgaagtatgtgaccgttgccgtcgtatcgacccaacaacagcagaacgcagctaccaggcagtcatctgtgatcattgtgcaagcatcgtagaagaaaactttgcggacgctgtcgcagaaggatttgaagagaaataa

SEQ ID NO: 1941 - DNA (genomic), 330 bp, Streptococcus pneumoniae; double-stranded, circular
  misc_feature (B) LOCATION 1...330
  hypothetical: NO
  anti-sense: NO
tttagtattatcgtagaaaatggactcggtgctatggatacaccggatgagaatggttatgtagcagataactatcggattacttacttagaggcccacatcaaggccatgcgagatgccatttaccaagacggggttgacttgcttggttatacgacttggagctgtatcgatccggtttcagctggcacaggggaaatgaataagcgctatggctttatctatgtagatcgagataatgtaggaaacggagctctcaaacgtagcaagaagaagtccttctattggtacaaggatgtcattgatagcaatggtgcaagcatcgggtag

SEQ ID NO: 1942 - DNA (genomic), 297 bp, Streptococcus pneumoniae; double-stranded, circular
  misc_feature (B) LOCATION 1...297
  hypothetical: NO
  anti-sense: NO
gtattaattatttttaaggctaaagcttggctggatatgagggaacgctctgctacaggtgctcaaggtttaagtaagtccattaaaaagcatttgaatgacattacccgtttgacagcttccttgctaggagatgaaaagttatcggctataacatcaagtagtgcggtaaaagcagacatgcaccgctttgtgatagaattagagcttgtgaagtcaactattcttcaaaatgatgacatttcattagatcaaaatgaaatttttgaaattctgaaaaattttttcgatggttaa

SEQ ID NO: 1943 - DNA (genomic), 360 bp, Streptococcus pneumoniae; double-stranded, circular
  misc_feature (B) LOCATION 1...360
  hypothetical: NO
  anti-sense: NO
atgtcaattattttaacaacgatcgttgctttggagcatttttacattttttatttggaaagtattgccacgcaatcagatgcgactagtcgtgtatttaatatggaaaaggaagaattggctcatccgtcagtaagttcattgttcaaaaatcaaggaatttataaggctctgctaggagtctttctcttgtatgtcatttatttctcacagaatttagaaattgtgactatttttgtcttatttgtgattggtgctgcgacttacggctctttaacagcggataaaaaaattattttgaaacaaggtggatcagctattttggccttgattagtattttactctttaaatacacttga

SEQ ID NO: 1944 - DNA (genomic), 804 bp, Streptococcus pneumoniae; double-stranded, circular
  misc_feature (B) LOCATION 1...804
  hypothetical: NO
  anti-sense: NO
tgccaaattatagagtggaggtcatttaaaatgattgataaagtaattgaacaatataaaagtcatgataatcttgatattcgagtagaattgcataagaagtattcaaaaaataaattgggatttaataattggatattttctaactaccaaatcactgatgaagtaaaggttctagaattgggatgtggtacaggagaattgtggaaaagtaatagtgattctatagataaaatgaagcagttgattgttacagatttttctaaagatatggtaaaatcaacgaagtcagtgattggaaatagaaacaatgtcaattatgagataatggatattcaaaagatttcttttgagaatgaaacttttgatattgttattgctaatatgcttctacatcatgtgaatgatattcctaaagctctctctgaggtgaatagggtcttaaaaaccggaggcattttttactgtgctacatttggtgaaaatggagttgtaaattatttggcaagtttatttaaagatgaggttaatcaagatttagaaaatagaacgtttactttacaaaatggtaaaaggtacctgagtaggtattttaactctgtcgatacattactctatgatgatgagttacaggtaactagtatagatgacctagttaaatacatccaatcgtttaaaggaatttcagaaataggttcactagaagaggaaataatacgtaaaagattggaaagtgagtttaataatggtatgttgatcattcctaaagaatatggtatgtttatcgctcgaaaagaaagttaa

SEQ ID NO: 1945 - DNA (genomic), 816 bp, Streptococcus pneumoniae; double-stranded, circular
  misc_feature (B) LOCATION 1...816
  hypothetical: NO
  anti-sense: NO
tcacaaattatgaaaaataacgaatataagtatggaggtgttcttatgacaaaaccatactacaataaaaataagatgattcttgttcattcagatacgttcaagttcttatcaaaaatgaaaccagaaagtatggatatgatttttgctgatccaccttattttttaagtaatggtggaatatctaattctgggggacaagttgtttctgttgataaaggagattgggataaaatttcttcattcgaagaaaaacatgagtttaatcgtaaatggattcgcctagcaaaagaagttctgaagcctaatgggacggtatggatttcaggtagtttgcacaacatatactcagttggaatggcattagaacaagaaggttttaaaattctgaataatattacttggcagaaaacaaaccctgcccccaatttatcttgtcgttattttacccattctactgaaaccattttatgggccagaaaaaatgataaaaaagctcgtcattactacaattatgatttaatgaaagaattgaatgatggaaaacaaatgaaagatgtctggaccggttctttaacaaagaaagttgaaaaatgggctgggaaacatccaactcaaaaaccagagtatttgttagaacgcattattttagcctctactaaagagggtgactatattctagacccatttgttggtagtggcactacgggtgttgttgcgaagcggttaggtagaagatttataggtatcgatgctgaaaaagaatatttaaaaattgcaaggaagaggttggaggcagaaaatgaaacaaactag

SEQ ID NO: 1946 - DNA (genomic), 636 bp, Streptococcus pneumoniae; double-stranded, circular
  misc_feature (B) LOCATION 1...636
  hypothetical: NO
  anti-sense: NO
cctaaaattataaaaggtagtagtgtagatatagaagataatgtagctgctccaaggctacctatttgccaaaatctaaatttgtctaagacgttattattcggtaaaattaaaaaacttacaaaactgcttaaagccatactaacacaagttcctgataaggctagttttataggggtaaggcctgcttttccgcttacagcaatcgcgtatacaaaaattacacttactaagccaccaatgattgcaaaacttatatggcttatgcttgatgaaattcctaaaaaagaaagaccaattactacactaagacttgctcctgtgtttataccgagtatacctggatcagctattgggtttctagtaactgattgcatcaatacaccgcttatggcaagactagaacctgctaaaattgcaaaaatagttctaggtattcttttatatataattgatttaataaaatcatcatttgtattgcccattccaaaagctgctaaaaaatctctgatattaatttcttttgttccaagctttaatgacaaaaatattgtaataagaagacctaggcagattacaaaaattatgcctaggtgtatttgtgttttatttcgcatttttgcatgcatttcctaa

SEQ ID NO: 1947 - DNA (genomic), 909 bp, Streptococcus pneumoniae; double-stranded, circular
  misc_feature (B) LOCATION 1...909
  hypothetical: NO
  anti-sense: NO
gaggaaattatgacttttaaatcaggctttgtagccattttaggacggccccatgttgggaagtcaacctttttaaatcacgttatgggggcaaagattgccatcatgagtgacaaggcgcagacaacgcgcaataaaatcatgggaatttacaccaccgataaggagcaaattgtctttatcgacacaccagggattcacaaacctaaaacagctctcggagatttcatggttgagtctgcctacagtacccttcgcgaagtggacaccgttcttttcatggtgcctgctgatgaagcgcgtggtaagggggacgatatgattatcgagcgtctcaaggctgccaaggttcctgtgattttggtggtgaataaaatcgataaggtccatccagaccagctcttgtctcagattgatgacttccgtaatcaaatggactttaaggaaattgttccaatctcagcccttcagggaaataacgtgtctcgtctagtggatattttgagtgaaaatctggatgaaggtttccaatatttcccgtctgatcaaatcacagaccatccagaacgtttcttagtttcagaaatggttcgcgagaaagtcttgcacctaactcgtgaagagattccgcattctgtagcagtagttgttgactctatgaaacgagacgaagagacagacaaggttcacatccgtgcaaccatcatggtcgagcgcgatagccaaaaagggattatcatcggtaaaggtggcgctatgcttaagaaaatcggtagcatggcccgtcgtgatatcgaactcatgctaggagacaaggtcttcctagaaacctgggtcaaggtcaagaaaaactggcgcgataaaaagctagatttggctgactttggctataatgaaaaagaatactaa

SEQ ID NO: 1948 - DNA (genomic), 1329 bp, Streptococcus pneumoniae; double-stranded, circular
  misc_feature (B) LOCATION 1...1329
  hypothetical: NO
  anti-sense: NO
aggttgattatgggagataagaaatacacagtagaaaaagccaatcgttttatagcagaaaataaacatctcgttaatactcaatataagcctgaagaacatttttcagctgagattggttggatcaatgatccaaatggatttgtctattttcgtggagaataccatctcttttatcaattctatccatatgatagtgtttggggacctatgcactggggacatgctaaaagtaaggacttggtgacttgggagcacttgccagtggcacttgctcctgaccaagattatgaccgaaatggttgtttctcaggctctgccattgtcaaggatgatcgcctctggctcatgtacactgggcatatcgaagaaaaaaccggtgtccgccaagtgcaaaatatggcattttcagatgacgggattcactttgaaaagatttcccaaaatccagttgtaactggaacagacttgccagatgagttgattgctgctgatttccgtgatccaaaactctttgaaaaagatggacgctattactccgtagtagctgtcaaacacatggataatgtgggctgtatcgttctactagggtccgataacctagtagaatggcagttcgaatccatctttttaaaagggggagaacaccaaggctttatgtgggaatgcccagattacttcgagttagatgggaaagattgccttattatgtcacccatgcgttatcagcgtgagggagactcatatcataacatcaactcatcgcttttgttcacgggtaaggtagattggagagaaaaacgttttatcccagaatcagttcaagaaattgatcatggccaagacttctatgcgcctcaaacattgttggacgatcaaaatcgtcgtatcctgattgcttggatgcagacatgggggcgtacccttccaacccatgaccaagaacacaaatgggcatgtgccatgactttacctagaattctaagattggaagatggcaaactaagacaattccctgttaaaaaaggccaatatcaaatccaaatagataaagattgtcattaccacttaggaaatgatatagattatcttgaatttggttatgacagtaatgcgcagcaagtttacattgatcgtagccatcttattcaaaaaattctaggtgaagaagaacaggacactagtcgacggtatgtagatattgaagctaaagaattggaagttgttctagataaaaattccatcgagatttttgtcaatcaaggtgaagcaagcttgactgcaacttattacttaacggtgccagctgagctatcacgaattgattaa

SEQ ID NO: 1949 - DNA (genomic), 513 bp, Streptococcus pneumoniae; double-stranded, circular
  misc_feature (B) LOCATION 1...513
  hypothetical: NO
  anti-sense: NO
ataatgattataaaagtagaaatggcagatgttgaggtgttggctaaaattgccaaacaaacctttcgtgaaacctttgcgtatgataatacggaagagcagttacaggaatactttgaagaggcttatagtctgaaaactttgtcaactgagttgggaaatcctgactctgaaacctatttcattatgcatgaggaggagatagctggttttctcaaagtcaactggggaagtgctcaaactgagagagaattagaggacgcttttgaaattcaacgcctctatgtgctacaaaaattccaaggatttggactaggtaagcaactgtttgaattcgcacttgaacttgctacaaaaaatagtttttcttgggcttggctaggtgtttgggagcataatacaaaagctcaagccttttataatcgatatggttttgaaaaatttagccaacatcattttatggttggtcaaaaagtagatacggattggttactgagaaagaaattaaggtaa

SEQ ID NO: 1950 - DNA (genomic), 726 bp, Streptococcus pneumoniae; double-stranded, circular
  misc_feature (B) LOCATION 1...726
  hypothetical: NO
  anti-sense: NO
tcagtgattatattaaaggagtttaagcctatgtcattactagcatttgaaaatgtatccaaatcatatggagcaacaccagcccttgaaaatgtttctcttgacattccagctggaaaaattgtcggccttcttgggccaaacggctcaggaaaaacaaccctgattaaactaattaatggcctcttacaaccagatcaaggacgtgtcctcatcaacgacatggacccaagcccagcaaccaaggccgttgtagcttatttgcctgatacgacctatctcaatgagcaaatgaaggtcaaagaagccctaacctacttcaagaccttctataaagatttcaatcttgaacgcgcccatcatctacttgcagacctgggcattgatgaaaatagtcgtctcaagaaactatcaaaaggaaacaaagaaaaggttcaactgattttggttatgagccgtgatgctcgtctctatgttttggatgaacccattggtggggtggatccagcagcccgtgcttatatcctcaataccattatcaacaactactcaccaacttctaccgttttgatttctacccacttgatttctgatatcgagccaatcttggatgaaattgtcttcctaaaagacggaaaagtcgtccgtcaaggaaatgtagatgatattcgctacgagtcaggtgaatccattgaccaactcttccgtcaggaatttaaggcctaa

SEQ ID NO: 1951 - DNA (genomic), 243 bp, Streptococcus pneumoniae; double-stranded, circular
  misc_feature (B) LOCATION 1...243
  hypothetical: NO
  anti-sense: NO
gaaaagattattgactcatacagactttcgcagatgatatccaaccacgtgtctttattgttatccaaagatgccaaggcctttgagttctgggaatatgcgcctgagttgtttgtagaagaacaacaagcagtagaacaggaacgacagaaacaagcacttttgttgcataaggaacggatgcgtgaatttgcagagagacataatcgaaaaaggaaggaggaagtaaatggcaactcttga

SEQ ID NO: 1952 - DNA (genomic), 627 bp, Streptococcus pneumoniae; double-stranded, circular
  misc_feature (B) LOCATION 1...627
  hypothetical: NO
  anti-sense: NO
aacgagattatcgagtggcgacgtaatcgctggaggacaattatgtcagaagaaatcaatgcaactgtatctactgaatcaactgagactgtcgacactcaaggaaatgttgattcagtgcaggaagaaaagcacgaacgaactttcactcgtgctgaaatcggtaagatgctatctgccgaacgctctaaatgggaagctgagcaagaagccaaggaaaacgaagctaagaaacttgccaagatgaacgctgacgagaaacaaaaatatcagttggatcagcgtgagcaagaactagctgaccgtgagaaggctattgctcgcaaggaattgaccgcagaagctaaagcaatgctaagtgaacgtgacttacctgttgagttagtaaatgtagttgatttgacaagcgcagagacggtatcgcagtctgtcgctgtattgcagaaatcatgggagcaagccgtgcaaaaaggcgttcaagaaaaactaaaaggcggagctccaatgaaacaagcgccagtcgatagtgacggtatcacaaaagaagaatttgctcgtatgggttatcagagtcgaaatgagctctatcaaaagaacccagagctttataagaaattgaaaggataa

SEQ ID NO: 1953 - DNA (genomic), 1098 bp, Streptococcus pneumoniae; double-stranded, circular
  misc_feature (B) LOCATION 1...1098
  hypothetical: NO
  anti-sense: NO
agggagattatcatgatggacagtccaaaaaaattaggctatcacatgccagcagagtacgaaccccatcatggtaccctcatgatatggccgactcgaccaggatcatggccttttcaaggaaaggctgctaaaagagcatttactcagatcatcgagaccatagcagaaggggaaagagtctatcttttggtggagcaggcctatctatctgaagcccaatcctatcttggagacaaggttgtttatttagacattcccaccaatgatgcctgggcgcgtgatactggcccaaccattctcgtcaatgataaaggtaagaaattagccgtggattgggccttcaatgcttggggaggcacctatgatggtctttatcaagattatgaagaggatgaccaagtagccagtcgttttgctgaggccttgggaaggcctgtctatgatgctaaaccttttgtactggaaggaggcgcaatccatagcgatggtcaaggaactattctcgtaactgaaagttgcttgcttagtcctggtcgcaatcctaacctgactaaagaggagattgaaaacacattattagaaagtcttggtgctgaaaaagttatttggcttccttatggtatttatcaggatgaaaccaatgaacacgtcgataatgttgctgcctttgttggtcctgctgagcttgttttggcttggacagatgacgaaaatgatccccagtatgccatgtcaaaagcagatctcgaactcttagaacaggaaacagatgcaaaaggttgtcacttcaccattcataaattgcctatccctgcagttcgacaagttgtgacagaagaagatttgccaggctacatctatgaagaaggagaagaaaagcgatacgcaggtgaacgactagcagcttcctacgtaaacttttatatcgccaacaaggctgtcttggttccacagtttgaggatgtaaacgaccaagtggccttagatatcctcagcaagtgtttcccagaccgtaaagttgtcggaataccagccagagatattctcttaggtggtggcaatatccactgtatcacccaacaaattccagaatag

SEQ ID NO: 1954 - DNA (genomic), 435 bp, Streptococcus pneumoniae; double-stranded, circular
  misc_feature (B) LOCATION 1...435
  hypothetical: NO
  anti-sense: NO
agccacttcttgagggtatttataggccagaaggagtggaataagatttccgaaaatcatcagataaaagaggacgataaagacttggttcccaatactatcggcctcacgccgtttgtattcgtcaaggggaccagaaataccgtatgtgcgtttgatcagtttttcagtgaaggtttcttttttcatgagtttgctccttttttaaaaatcttccttccaaaagagactgttgaggtcagtttggaggctgcgggcgagattgagacagagttccagagttggattgtacttgtcgttttcaatcatattgatggtctgtctcgagacaccgatatccttggcgagctcgagctgggaaatgcccagttccttgcgaaattctttcacacgattcatctggtctcctttctgatttgtgtcgtatatatttga

SEQ ID NO: 1955 - DNA (genomic), 426 bp, Streptococcus pneumoniae; double-stranded, circular
  misc_feature (B) LOCATION 1...426
  hypothetical: NO
  anti-sense: NO
gagtttgttatggatttattagagaaagaatgtttaaaatgtgataaaaatttccaacagggtgatatttggaattactattatttatcagataaggtgcctgcacaagggtggaaaatacacataagctcccaaataaaagacgctgtaaatatttttaagattgtgtataaactatcccaactaaataattgtagctttaaagtcgttaaaaatttagaggaattaaaaaaaattaattcccctagggaaatgagccctactgctaacaaatttataactctatatcctaagtcagaatctgaagctaagagtatgatttgtaatcttacgaatagactgtcagaatttaaggctccaaaaatactatctgactatcaatgtggaatgcattctctagttcattatagatatggggctttttaa

SEQ ID NO: 1956 - DNA (genomic), 693 bp, Streptococcus pneumoniae; double-stranded, circular
  misc_feature (B) LOCATION 1...693
  hypothetical: NO
  anti-sense: NO
gaatgtgttatgaaagtattagcttttgatacgtccagcaaggctctttctctggctattttagaggacaagcaggttcttgctgagacgacgattaatatcaagaaaaatcacagtattaccctcatgccagccattgattttttgatggagagtttggactggacgcccaaggatttggaccgaatcgtggtggcggaagggccaggtagctacacaggcttgcgaatcgcggtagccactgccaagaccttgactcatactctgaacattgagttagttggtatgtctagcctcttggctctggtgccatatcaacaagaaggcttgttcgttcctttgatggatgcgcgtcgcaacaatgtttatgcaggattttatgaaaatgctaaacctgtcatgccagaagcgcacctatcttttgaagaggtgctagaaaaagtcaagggtgctagtcaggtaacctttgtcggagaagttgccccctttgtggagcagattcaagaacacttgccaaggactaattataaagaaaccttgcctaatgcagccaatcttgctcttttagcttgggacaaggaagcagactccttgcatgattttgtgccgaactacctcaagcgtgtcgaagctgaggaaaattggctcaagaatcacaccgagtctggtgagtcctacattaaacgcctatga

SEQ ID NO: 1957 - DNA (genomic), 1407 bp, Streptococcus pneumoniae; double-stranded, circular
  misc_feature (B) LOCATION 1...1407
  hypothetical: NO
  anti-sense: NO
tcgcgcgttataaggtcagggaagtgtctgaggctattaataacttacactgagctaggagagtttatgaatgttgcttggatattgttgtatacacttgttactcacggattaaaaattgtcatattctttaaggtagatggaattagtctcacttttgagaggatttttaaggcctttctttttaagatactgttggccgttgtttttggaatgcttggctatatggtaggaaatgtttacctatcttattttatggaacccttgtacggcataggcttatctttcttattgttaagagaacttcctaaaaaactccttctcttttatggtctctttccaatgatattagtgaatctcttttatagaggtgtttcctattttgtgcttccatttttgggacaagggcaagtatatgatgactactcatttatttggttatgtataataattttcaatttcttcatttctctagcttttttgaaatggttggactatgatttcactagcttgagaaaggggattctcgataaagattttcaaaagtccctgactcagattaactggataatgggggcttactatttggtgatacaaaatctgtcttactttgaatatgaacaggggattcaatcaacgactgttcgccatctcatcctagtcttttacctgctcttttttatggggattatcaagaaattggatacctatttgaaggacaaactccatgagagactgaaccaagagcaggacttgcgctacagagagatggagcggtatagtcggcatatagaggagctttataaggaagtacggagttttcgccatgactacaccaacctcttgactagcttacgtctgggcattgaagaggaggatatggagcagataaaagagatctacgactcggtcttaaaggattctagtgaaaaattgcaggacaataaatatgaccttggccgattggtgaatgttcgggatcgtgccctcaaaagtctcctagctggaaaatttataaaagctagagataagaacattgtctttaatgtcgaagttccagaggagattcaggtagagggggtgagtctacttgattttctaaccgttgtgtctatcctttgtgacaacgctattgaagctagtgtagaagcctgtcaacctcatgtttcaattgccttttttaaaaatggagcacaggagacctttatcattgaaaattccatcaaagaagagggaatcgatatttctgaaatcttctcctttggagcaagttctaaaggggaggagagaggagttggtctctataccgttatgaaaattgtggaaagtcatcccaataccagtctcaataccacctgccaagatcacgtttttcgtcaggtacttactgtaatacatatagaatga

SEQ ID NO: 1958 - DNA (genomic), 513 bp, Streptococcus pneumoniae; double-stranded, circular
  misc_feature (B) LOCATION 1...513
  hypothetical: NO
  anti-sense: NO
ttgacagttattctaagttaccaggtatcgggattaagacggctacgcgtctggccttttatacgattgggatgtctgctgatgatgtcaatgaatttgcaaaaaatctccttttctgctaagagagaattgacatattgttctatttgtggacgtttgacagacgacgatccttgttctatctgtactgatccgactcgtgaccagacaacaattttagttcttgaggatagtagagatgtggcagccatggaaaatatccaagaataccatggactctatcatgtccttcatggcctcatttctcctatgaatggtatcagtccggacgatatcaatctcaagagccttatgactcgtcttatggatagtgaagtttcagaagtgattgtggcgactaatgctacagcggatggtgaagcgacttccatgtatctttcacgtttgctcaagccggctggtatcaaggttacgcgtctagacacgaggtctcgctgtgggagcggacattga

SEQ ID NO: 1959 - DNA (genomic), 339 bp, Streptococcus pneumoniae; double-stranded, circular
  misc_feature (B) LOCATION 1...339
  hypothetical: NO
  anti-sense: NO
actagagttatgacacgcaaagtatatgatactgatttaaacgatcaagaatgggctaagattgaaccctatttctccaaacaccgcacctataaatggccgaaacgagtacttgttaatgagactttgtacgtcactaaaacaggttgtcaatggcgcatgctccctcacgactttcctctttacttaatggtatggagtttctttcgtcgttctatgacgacaggttggttccaggtcaatggcagatggtactacgcttatagctcaggtgccttggcagtgaatacgaccgtagatggctattctgtcaactataatggtgaatgggttcggtaa

SEQ ID NO: 1960 - DNA (genomic), 1791 bp, Streptococcus pneumoniae; double-stranded, circular
  misc_feature (B) LOCATION 1...1791
  hypothetical: NO
  anti-sense: NO
aggagagttatcattatgactcaagggaaaattactgcatctgcagcaatgcttaacgtattgaaaacatggggcgtagatacaatctacggtatcccatcaggaacactcagctcattgatggacgctttggctgaagacaaagatatccgcttcttacaagttcgccacgaagagacaggtgctcttgcagcggttatgcaagctaaattcggcggctcaatcggggttgcagttggttcaggtggtccaggtgcgactcacttgattaacggtgtttacgatgcagctatggataacactccattcctagcgatccttggatcacgtccagttaacgaattgaacatggatgctttccaagagcttaaccaaaacccaatgtacaacggtatcgctgtttacaacaaacgtgtagcttacgctgagcaattgccaaaagtaattgacgaagcctgccgtgctgcaatttctaaaaaaggtccagctgttgttgaaattccagtaaacttcggtttccaagaaatcgatgaaaactcatactacggttcaggttcatacgaacgctcattcatcgctcctgctttgaacgaagttgaaatcgacaaagctgttgaaatcttgaacaatgctgaacgcccagttatctatgctggatttggtggtgttaaagctggtgaagtgattactgaattgtcacgtaaaatcaaagcaccaatcatcacaactggtaaaaactttgaagctttcgaatggaactatgaaggtttgacaggttctgcttaccgtgttggttggaaaccagccaacgaagtggtctttgaagcagacacagttcttttccttggttcaaacttcccatttgctgaagtttacgaagcattcaagaacactgaaaaattcatccaagtcgatatcgacccttacaaacttggtaaacgtcatgcccttgacgcttcaatccttggtgatgctggtcaagcagctaaagctatccttgacaaagtaaacccagttgaatcaactccatggtggcgtgcaaacgttaagaacaaccaaaactggcgtgattacatgaacaaactcgaaggtaaaactgagggtgaattgcaattgtatcaagtttacaatgcaatcaacaaacatgctgatcaagacgctatctactcaatcgacgtaggtaacactactcaaacatctactcgtcaccttcacatgacacctaagaacatgtggcgtacatctccactctttgcgacaatgggtattgcccttcctggtggtatcgctgctaagaaagacaatccagatcgccaagtatggaacatcatgggtgacggagcattcaacatgtgctacccagacgttatcacaaacgttcaatacgaccttccagttatcaaccttgtcttctcaaatgctgagtacggcttcatcaagaacaaatacgaagatacaaacaaacacttgtttggtgtagacttcacaaacgctgactacgctaaaattgcggaagctcaaggagctgttggattcacagttgaccgtatcgaagacatcgatgcagttgttgcagaagctgttaaattgaacaaagaaggtaaaactgttgtcatcgatgctcgcatcactcaacaccgtccacttccagtagaagtacttgaattggatccaaaacttcactcagaagaagctatcaaagccttcaaggaaaaatacgaagcagaagaactcgtaccattccgtctcttcttggaagaagaaggattgcaatcacgcgcaattaaataa

SEQ ID NO: 1961 - DNA (genomic), 510 bp, Streptococcus pneumoniae; double-stranded, circular
  misc_feature (B) LOCATION 1...510
  hypothetical: NO
  anti-sense: NO
atgacggttattatcaaatcaatggaaactcctgaagagatagaaggtaaatcccttgttcactggcaaacgtggagagaggcttatgatgaccttttgcctgcagaatttcaggagacaatgacattagaaagatgtcgattctttagtcaaaagtatccagaaaatacattgattgcgataggtgatctgaaggtagttggttttatcagttatggtaactttcgtgatgagactattcaagctggtgaaattattgctttatatgttttaaaagactattacggaaaaggcatagcacaaaagttaatgaaagcagctttgactgctctgaatcatttttctgaaattttcttatgggtattgaaagataacaagcgagccattgctttctatcaaaaaatgggttttacttttgatggacaagaaaagatacttgaacttggaaagcctataaaggaaaaacgaatggtattctattctaaaataattttaaaaagtagaagctaa

SEQ ID NO: 1962 - DNA (genomic), 744 bp, Streptococcus pneumoniae; double-stranded, circular
  misc_feature (B) LOCATION 1...744
  hypothetical: NO
  anti-sense: NO
aggaaggttataatcatgaaattaaataaattgaattttcttaaggaaaatataagaaatttatattcatcaggcgtaatatatctcagtttgcttatctcgtttataccgccgatattgcttacattctttattctaaagactcaagggacatcgcttggtattaagcatatttcaaacttttatgctatgctcggtatgttaatggctgttatacatgctaatcgagttattagtagagatttttcccacaatacggtaagtttgttttataatcaacagaagaatcggatgatttacgtcttgtctaattttctatatgccatctcagtttccattatttatgctttgaatggcattgtgttactagtcatagtaagtaaattgggtattccaggtgatttaggattagattttatagtagctattgtagtcaatacaattttgttagtcctgttttattttctattatcttacattttctatttatacaaattgaaaagtggcttggtatttggtattttagtagctttactactctttatccctaatatattaaatacgatgatgatgaatactagtaatgatttgtttatcaaagcaattgaacttcttcctttttattctttacctgtatttgtggcttcaaatacgatgtctattagtcagtatcttgtgctaatcactacaatcattttattgtactttttcactctcaagaaaagcaagaagtattcattttag

SEQ ID NO: 1963 - DNA (genomic), 954 bp, Streptococcus pneumoniae; double-stranded, circular
  misc_feature (B) LOCATION 1...954
  hypothetical: NO
  anti-sense: NO
gagagggttatgccgattcgaattgataaaaaattgccagctgttgagattttacggacagagaatatctttgtcatggatgatcaacgtgctgcccaccaagatatccgtcctttgaagattttaattttaaatctcatgccacagaaaatggtcacagagacccagttgttgcgccacttggctaatacacccctacaactggatattgattttctctatatggagagccaccgttctaaaacaactcgttcagagcacatggagaccttctataaaacttttcctgaagtcaaggatgagtattttgatgggatgatcatcacgggtgctccagttgagcatttaccatttgaggaagtggactattgggaggaatttagacagatgcttgagtggtctaagactcatgtctattcgacccttcatatctgttggggggctcaggctgggctttatctgcgctatggtgtagaaaaataccagatggacagtaagctatcaggtatttatcctcaggacaccctaaaagaaggtcaccttctatttagaggctttgatgatagctatgtatcccctcattcacggcacacggagatttctaaggaagaggtcttaaacaagaccaatctcgagattttatcagaaggacctcaggttggggtttctattttggccagtcgtgatttacgagaaatttatagttttggtcatttggagtatgaccgtgataccttggcaaaagagtattttcgagatcgtgatgcaggtttcgacccacatattccagaaaattactttaaagatgatgatgttaatcaggttacttgtctttgttggtcttcatctgcagccctctttttcagtaattgggtaaaccatgcggtctatcaggagacgccttttgattggagaaagatagaagatgatgcatctgcatatgggtatttataa

SEQ ID NO: 1964 - DNA (genomic), 981 bp, Streptococcus pneumoniae; double-stranded, circular
  misc_feature (B) LOCATION 1...981
  hypothetical: NO
  anti-sense: NO
acgcattctattgagtgtgataaaggagaatttatggcaaatcgtaaaattgtagtagctttgggaggaaatgcgattctttcttctgacccatcagcaaaggctcaacaagaagctttagttgaaacagctaagcatcttgtaaaattgattaaaaatggagatgatttgattatcactcacggtaatggacctcaagttgggaatctcttgctccaacatttggcatcagactctgaaaagaaccctgccttcccactcgactcacttgtcgctatgacagaaggtagcatcggtttctggttgaaaaatgctttgcaaaatgctctcttggatgaaggcatcgaaaaaaatgttgcctctgttgtaacgcaagttatcgtagataaaaatgatccagcttttgttaacttgagtaaaccaatcggtcctttctattcagaagaagaagcaaaagcagaagccgaaaagagcggagcgactttcaaggaagatgctggccgtggctggcgtaaggtcgttgcctcaccaaaacctgttgacatcaaagaaattgaaaccatccgtactcttttaaataatggtcaagtcgtcgtagctgcaggtggtggcggtattcccgtcgtcaaagaaaacaatggacatttgactggtgtcgaagcggttattgataaagacttcgcttcccaacgtttggcagaattggttgatgcagacctcttcatcgttttgacaggtgtagattatgtatttgttaactacaacaagccaaaccaggaaaaattggaacatgtgaatgttgcccagctggaagaatatatcaaacaagatcagtttgcaccaggtagcatgcttccaaaagtagaagcagctatcgcttttgtcaatggtcgtccagaaggaaaagcagttattacttcccttgaaaatctaggcgccttgattgaatctgaaagcggaacaattattgaaaaaggataa

SEQ ID NO: 1965 - DNA (genomic), 216 bp, Streptococcus pneumoniae; double-stranded, circular
  misc_feature (B) LOCATION 1...216
  hypothetical: NO
  anti-sense: NO
tgcttctctattatccatatactccctttctcctgtaagcgttttctatgtttttattatactacctttttagagaagattcaagtaaattactatacttctttaattattttgaaaatctacaacaagttcacttactcgttcaattgtaaatcaatattttttcaaaaaattgcgaaaacacctttctttttctactatagtgaaatgaaataa

SEQ ID NO: 1966 - DNA (genomic), 225 bp, Streptococcus pneumoniae; double-stranded, circular
  misc_feature (B) LOCATION 1...225
  hypothetical: NO
  anti-sense: NO
tttcaatctattatatctattatgcacaccactataggatctaataaaaatcacaacaagttcattcatagatggttacctcagggaactaagaaaacgactacaaaggaagtcgcattcatcgaaaagtggattaacaactatcctaaaaaatgcttgaactacaagtcccccagagaagacttctggatgactaacttgaacttgaaatttagcaataattaa

SEQ ID NO: 1967 - DNA (genomic), 714 bp, Streptococcus pneumoniae; double-stranded, circular
  misc_feature (B) LOCATION 1...714
  hypothetical: NO
  anti-sense: NO
attatgtctatccatattgctgctcagcagggtgaaattgctgataaaattcttcttcctggggatcctcttcgtgctaagtttattgcggagaatttccttggtgatgctgtttgttttaacgaagtgcgtaacatgtttggttacactggtacttacaagggtcaccgtgtatctgtcatgggaactgggatgggaatgccatctatttcgatttatgcgcgtgagttaatcgtagactacggtgtgaagaaattgattcgtgtgggaactgcaggttctttgaatgaagaggttcatgttcgtgaattagttttggcgcaggcggctgcaaccaactcaaacatcgttcgtaatgactggccacagtacgattttccacaaattgctagctttgatttgcttgataaagcctaccatatcgccaaagaacttggtatgactactcacgttgggaacgttttgtcatctgatgtcttttactcaaattactttgaaaagaatatcgagcttggtaaatggggagtcaaggctgtggaaatggaagcagcagctctttactatcttgctgcccaataccatgttgatgcgctagctatcatgaccatctctgatagcttggtcaatccagacgaagacacaactgcagaagaacgtcaaaataccttcactgatatgatgaaggttggtttggaaaccttgattgcagaataa

SEQ ID NO: 1968 - DNA (genomic), 1494 bp, Streptococcus pneumoniae; double-stranded, circular
  misc_feature (B) LOCATION 1...1494
  hypothetical: NO
  anti-sense: NO
ttatggtctatagagaggaaagacatgtaccaatatttaacctatccacgggatggatatgatgagggttctttgaagaaagacctgatttacaaattgataacgatacataacactgaaagctcacgcttgaagaatttaaaaagctactacatgggtgatcatgctattttaaatcacaagagacgcaacgtgaacgcacccaattacaagacggtagctaatcatgccaaggatatcgcagacacggctacgggctattttatgggcaatcctatcaagtataacaatactgctgacggtgatattgatgaactacttacagcctttgatggtgctgagattgaccaagtggatgcgcagaacgcactaaatatggctatctacggccgtgcttacgagtacatctatgctaaagagggtatgactgagttggattcaactagtattgatccggagaatactttcatggtctacgatgatagtattgagcggaagcctttgtttgcggtctattactatgaagtaaaagacgatacgaaagacactaccaagcaccaggctgaggtctttaccgaaaatctgcactatcacatggtgctgagaagtacagattcaggaacaactcagagcgaggaggcaacacctcacaaccttggtcaaatcccaattatcgagtatcgcaataatcactttgcgattggcgactacgagcaacaaattagcttgatagacgcttataattccttgatggggaatcgtgtcaatgataaggaacaggctgtagagtctatccttgtcttgtatggcacgcagttagcagacactccagaagacgctaaggtagcaatgaagattctttctgaagaaggtcttttggaattgccgggcgatagtgcaagggctgagttcttgaagaatacgctggacgaaagtgctactgaaatcttgcgtacagctcttaaagaggacatctacacatttagccatgtgcctaatttgactgatgagaatttcgcagggaatacatcaggcgtagccatggaatttaagctgatgggccttgagatgattactaagaccaaggaagcgaactataagcgaggattgcgtcagcgtattgcgatttttgctcattacttaggcatgaagcagattgctttagagtctcattcaatcgttccacaattcagtcgtggtttgcctaagaacttattagaaatctctcagattgtgaacaatttggaaggcaaagtgaccaatagacagcttatttctctcttgccgtttgtggaagaccctgacgctgagctggaagccttggaagaagagaaaaagaagaacatggaagacatgccgatgttcaacaaagacaacacgaaacccgaagacgaggtagaggatgaagaatcaggagtattgggcgaagaggaaagccaatctgatttaccagcagatggacaaggccgaaaagcaggcagaccagttcgataa

SEQ ID NO: 1969 - DNA (genomic), 1113 bp, Streptococcus pneumoniae; double-stranded, circular
  misc_feature (B) LOCATION 1...1113
  hypothetical: NO
  anti-sense: NO
ggagttcctatggcaaaaacaatctatatcgcaggtcttgggttgattggagcctctatggcacttggtatcaaacgcgatcatccagattatgaaattttaggttataatcgtagtcaagcttcgagagatatcgccttgaaagaaggcatgattgaccgtgcaacggatgattttgctagttttgctcctttggcagatgtcattatactcagcttgccaatcaaacaaactattgctttcattaaggagttggccaatttggatttgcgagaaggcgttattatttcagatgctggttcgaccaagtcaaccattgtggatgcggcggagcagtatttggctggcaagtctgttcgctttgtcggggcccatcccatggctggtagtcacaagacaggggctgcttcggcagatgtcaatctttttgaaaatgcctattatatctttacaccttcaagcctgacaagtcaggacacgcttaaggaaatgaaggatctgctttcaggtcttcatgctcgttttatcgagattgatgccaaggagcatgatcgtgtcacttctcagattagccattttcctcatattttggcttctagtctcatggagcagactgcggtctatgctcaagagcatgagatggcaaggcgctttgcggcaggtggttttcgagatatgacccgaattgcggaaagcgagccaggaatgtggacctccattctcttgtccaatagcgagaccattctggatagaattgaggatttcaaggaacgtttggaagcgattggtcaggccattagtaagggagatgaagagcaaatttggaacttttttaaccaagcgcgtgaacaacgccagaccatggaaatccataagcgtggtggtgtggatagctcttacgacctctatgttgacgttcctgatgaagaagatgtcatcctgcggattttggaactgctacgtggaacttccttggttaacatccacatcaacgaggaaaatcgtgaggatattcacggaatcctacaaatttcatttaaaaatgctcaagacttggaaagagctgagcatctcataacagaaaataccgactatacagtcgtcatcaaataa

SEQ ID NO: 1970 - DNA (genomic), 612 bp, Streptococcus pneumoniae; double-stranded, circular
  misc_feature (B) LOCATION 1...612
  hypothetical: NO
  anti-sense: NO
caggttcctatgtctttaagggagaagtcaatgagcgagtacaaactctcagaaaacaactggactagggttgcagtttttgcaggcggaaaccgcggtcattatcggacagattttgatgcttttgttggggtggatcgaggctcgctctgggtcttggaagaagacttacctcttgctctagcagtcggagattttgattctgtgacggaagaagagcgacaggtgattcaaaaacgtgcccagtattttgtccaagcccgaccagaaaaagatgataccgatttggaattggctctcttaaccatctttgagaaaaatcctcaggctcaggttactattttcggtgccttgggtggccgtattgaccatatgttggccaatgtctttctgcctagcaatcctaagttnnnnnnnnnnnnnnnnnnnnnnnnnnnnnnnnnnncaaaaaaannnnnnnnnnnngnnnnnnnnnnnngngggnnnnnggggngnggggngnnggggggggggggggggggggggngggggggggggggggggggggggggggngggnngggggggggggggggnggggggggggggnggggngggnggggggggggggggg

SEQ ID NO: 1971 - DNA (genomic), 288 bp, Streptococcus pneumoniae; double-stranded, circular
  misc_feature (B) LOCATION 1...288
  hypothetical: NO
  anti-sense: NO
aaatatcctatgtacaatgatgtaatcgaaaggatatctttatatgagtttatcggtgatattttctattctaaaataataagttgttgcatcgtagctagcgatttatctaaaaatactatgaaattggacgtcatattttttgaggataaaaataaaagatccgcagttttaggtttacgaagagacaaaagcggagtatttaaaccagttactctacattttacaagcgctaagaaatatgctaaagttcgtaaaacagatgtgaaagaaatgaaatggctataa

SEQ ID NO: 1972 - DNA (genomic), 258 bp, Streptococcus pneumoniae; double-stranded, circular
  misc_feature (B) LOCATION 1...258
  hypothetical: NO
  anti-sense: NO
aacgtgttcttcaacgttaccatgaattgcaagatatcattgctatccttggtatggatgagctttctgatgaagaaaagaccttggttgctcgcgcccgtcgtatccagttcttcttgtcacaaaacttcaacgttgcggaacaatttactggtcagccaggttcttatgttccagttgctgaaactgtacgtggctttaaggaaatccttgatggtaaatacgaccacttgccagaagatgccttccgtggtgtag

SEQ ID NO: 1973 - DNA (genomic), 192 bp, Streptococcus pneumoniae; double-stranded, circular
  misc_feature (B) LOCATION 1...192
  hypothetical: NO
  anti-sense: NO
attgagcctattttatcacaaaatataagagaaagctatgtgggatttcagaagaatacttttaatactcttcgaaaatctcttcaaaccacgtcagttttatctgcaacctcaaagctgtgctttgagcaacctgcagctagcttcctagtttgctctttgattttcattgagtataactcaaaaaagtaa

SEQ ID NO: 1974 - DNA (genomic), 669 bp, Streptococcus pneumoniae; double-stranded, circular
  misc_feature (B) LOCATION 1...669
  hypothetical: NO
  anti-sense: NO
gaggttactatggaatctattttagaaattttaaccccagataacctagtctttatctttaaaggatttggcttgaccctctatatttctctgattgccatcatcctctctactatcatcggtaccgtgcttgccgtcatgcgaaatggaaaaaatcctatcttacgcattatttccagtatttatatcgagtttgtgcgcaacgttcccaaccttctctggatttttactatctttttggtgttcaaaatgaaatccacaccagcaggtattacagcctttactctctttacatcagcagccttggctgagattattcgaggcggtctcaatgccgtaaacnagggacaatacgaagcaggaatgtcacaaggcttcacctcagcccaaatcctctactacatcattctcccacaagccatccgcaaaatgctaccagccatcatttctcagtttgttaccgtgattaaggataccagtctcctctactctgttatcgccctacaagaactctttggagccagccaaattctcatgggccgttatttcgaaccagagcaggtcttcagtctttacatcctgattgccctcatctacttcagctttaacctagcaatttctaacctgtctcatatgctagcaaaacgttggcaacaagctgcagaataa

SEQ ID NO: 1975 - DNA (genomic), 186 bp, Streptococcus pneumoniae; double-stranded, circular
  misc_feature (B) LOCATION 1...186
  hypothetical: NO
  anti-sense: NO
cactatactataccggcggccggggtcgaaccggcacgtccttgcggacactggattttgagtccagcgcgtctgccaattccgccacgccggcaaatagtaactggggtagctggattcgaaccaacgcatgagggagtcaaagtcccttgccttaccgcttggctataccccaatataaaatag

SEQ ID NO: 1976 - DNA (genomic), 1692 bp, Streptococcus pneumoniae; double-stranded, circular
  misc_feature (B) LOCATION 1...1692
  hypothetical: NO
  anti-sense: NO
tataatactatggaatacaatcacaaggagagaacgatgtcatttgacggattttttttacaccacatagttgaggaattgcgaagcgaattagtgaatggtcgcatccagaaaatcaatcagccttttgaacaagagttggtcttgcaaatccgcagcaatcgccaaagccatcgcctgctcctttctgcccatccagtttttggacgcattcagctgacccaaacgacttttgaaaatccagcccaaccttctacctttatcatggttttgagaaagtatttgcagggggccctgattgagtcgattgagcaagtggaaaatgaccgtattgtggaaattacagtttccaataaaaacgagattggagaccatatccaggctaccttgattatcgaaattatggggaaacacagtaatattctactggtcgataaaagcagtcataaaatcctcgaagttatcaaacacgtcggtttttcacaaaatagctaccgcaccttacttccaggatcgacctatatcgctccgccaagtacagaatctctcaatccttttactatcaaggatgaaaagctctttgaaatcctgcaaacccaagaactaacagcaaaaaatcttcaaagcctttttcaaggtctgggacgcgatacggcaaatgaattggaaaggatactggttagtgaaaaactttccgctttccgaaattttttcaatcaggaaaccaagccatgcttgactgagacttccttcagtccagttccttttgcaaatcaggtgggagagccttttgcaaatctttctgatttgttggacacctactataaggataaggctgagcgcgaccgcgtcaaacagcaggccagtgaactgattcgtcgtgttgaaaatgaacttcagaaaaaccgacacaaactcaaaaaacaggaaaaagagttactggcgacagacaacgctgaagaatttcgtcaaaaaggagaattgctgacaaccttcctccaccaagtgcctaacgaccaagaccaggttatcctagacaactactataccaaccaacctatcatgattgcgcttgataaggctctgactcccaaccagaatgcccaacgctattttaaacggtatcagaaactcaaagaagctgtcaaatacttgactgatttgattgaagaaaccaaagccactattctctatctggaaagtgtagaaaccgtcctcaaccaagctggactggaagaaatcgctgaaatccgtgaagaattgattcaaacaggttttatccgcagaagacaacgggagaaaatccagaaacgcaaaaaactagaacaatatctagcaagcgatggcaaaaccatcatctatgtcggacgaaacaatcttcaaaatgaggaattgacctttaaaatggcccgcaaggaggaactttggttccatgctaaggacattcctggaagccatgttgtcatctcaggaaatcttgacccatctgatgcagtcaagacagacgcagcagagttagctgcctacttctctcaagggcgcctgtcgaatctggtgcaggtagatatgattgaagtcaaaaaactcaataaaccaactggtggaaaacccggctttgtcacttacacaggacaaaagaccctccgcgtcacaccagactccaaaaaaattgcatccatgaaaaaatcctga

SEQ ID NO: 1977 - DNA (genomic), 450 bp, Streptococcus pneumoniae; double-stranded, circular
  misc_feature (B) LOCATION 1...450
  hypothetical: NO
  anti-sense: NO
aggtgtactattctagtttcaatatactataaaatcggtttaagttcatctggtgtctataaagcagtcgctgatggagaaatgactgttggtctctcttatgaagatccagcagttaaactcttaaatgacggagctaacattaaggtagtctatccaaaagaaggaaccgtcttcctacctgctagtgctgctatcgttaaaaaatctaaaaatatggaaaatgccaagaaatttatcgattttattatctctcaagaagtacaagatacacttggtacaaccactactaaccgtcctgttcgtaaaaatgctaaaacaagcgaaaacatgaaaccaattgacaaaatcaaaacactcactgaagattatgattatgtcatcaagaataaatcagatatcgttaagaaatacaacgaagtctttacagatatccaatctaaacagtaa

SEQ ID NO: 1978 - DNA (genomic), 240 bp, Streptococcus pneumoniae; double-stranded, circular
  misc_feature (B) LOCATION 1...240
  hypothetical: NO
  anti-sense: NO
aggtgtactattctagtttcaatctactatattatggacaatgcaagattccatagaatgggtaagctagaacttttatgtgaagagtttgggcataaacttttacctcttcttccctactcacctgagtacaatcctattgagaaaacatgggctcatatcaaaaagaacctcaaaaaggtattaccacgttgccataccttttacgaggctcttttgtcctgctcttgtttcaattga

SEQ ID NO: 1979 - DNA (genomic), 183 bp, Streptococcus pneumoniae; double-stranded, circular
  misc_feature (B) LOCATION 1...183
  hypothetical: NO
  anti-sense: NO
aggtgtactattctagtttcaatctactatattatggataatgcaagattccatagaatgggtaagctagaactcttgtgtgaagagtttgggcataaacttttacctcttcctccctactcatctgagtacatcctattgagaaaacatgggctcatatcaaaaagcacctcaaaaaggtga

SEQ ID NO: 1980 - DNA (genomic), 246 bp, Streptococcus pneumoniae; double-stranded, circular
  misc_feature (B) LOCATION 1...246
  hypothetical: NO
  anti-sense: NO
aacaccactataatctctatcagctcttgcttttccaccctgtttaaaaccttcctcaaagataaagagaaaatcgtcaacgcccttcaattaccttattccaacgccaaactggaagccaccaataatctcatcaaacttatcaagcacaatgcctttggttttaggaactttgaaaacttcaaaaaagaaaggacgaaatttgtcctttctagatcttcgctttcttcaacccactacagttga

SEQ ID NO: 1981 - DNA (genomic), 297 bp, Streptococcus pneumoniae; double-stranded, circular
  misc_feature (B) LOCATION 1...297
  hypothetical: NO
  anti-sense: NO
tttgaaactatatatctgtttcggacaaaagaaaaagacttgaagcaaacgtctcaaatcctttgtatagcttgttttatagctttatttcagttagacggttcaaacgcgttattagtaattcttataagtgactatggcttgttattagaaaagactataactgattctagtcaactttttccctgttcaagtggaacgactgctagtgtctttcctagactagctaggacttttaagactgtgtccaactgtggactagtcttacctgtctccatcctagctataacaggctga

SEQ ID NO: 1982 - DNA (genomic), 1644 bp, Streptococcus pneumoniae; double-stranded, circular
  misc_feature (B) LOCATION 1...1644
  hypothetical: NO
  anti-sense: NO
gtggagactatgacagaaattgtgaaagcaagcttagaaaatggcattcaaaaaatccgtatccgagctgaaaaaggctatcatccagcccatatccagcttcaaaagggaattccagctgagattacctttcatcgtgctactccttcaaactgttataaggaaattctgtttgaagaagaaggtatcttggaaccaatcggcgtagatgaggagaaagtcattcgttttacacctcaagaattagggcgacatgaattttcttgtggcatgaagatgcaaaagggaagctatatagtcgttgagaagactcgaaaatctctatctctcctgcaacgtttttggattactagtatctttactgtgcctcttgtgattctcatgattgggatgttgacaggtagcattagtcatcaagtcatgcattggggaacctttctagcaacaacgcctattatgttagttgcaggtaagccatatatccagagtgcttgggccagttttaaaaagcacaatgccaacatggataccttggttgcgctgggaactctagtggcttatttctatagcctagttgctctctttgctggtctccctgtttacttcgaaagtgctggatttatcctctttttcgttcttttgggagcagtttttgaggaaaaaatgagaaaaaatacgtcccaagctgtggagaaattactggacttgcaagctaaaaccgcagaagtcttgagtgatgatagttatgtccaagttcctttggaacaagtcaaggtaggcgacctgattcgagtgcgtcccggtgaaaagattgctgttgatggtgtcgtagtagaaggtgtctctagtattgacgaatccatggtgacaggtgagagtctgcctgtggacaagacagttggagatactgtcattggctcaaccatcaatcatagtggaacgcttgtctttagagcagaaaaagttggctcagagactgttttggctcagattgtggattttgtgaagaaagctcagacaagtcgtgcgccgattcaggacttgacggataagatttcagggatttttgtcccagtagttgtcattttaggaatcatgaccttttgggtttggttcgtcttgctcagggatagtgtggtcgtgcttggagctagctttgtgtcctctcttctctacggagtggcggttttgattatcgcctgtccttgtgccttgggacttgcaacaccgacagcccttatggtggggacaggacgtagtgccaagatgggggttctcctcaaaaatggaactgtcttacaggaaatccagaaagttcaaactcttgtctttgataagaccgggactttgacggaagggaaacctgtggtaacagatatcatcggcgacgaagtagaagtgtttggattggcagcctccttggaagatgcttctcaacacccactggctgaggctatcgttaagcgagcgagtgaagctggacttgagtttaaaactgttgaaaattttcaggccttgcacgggaaaggtgtttcagggcgaatcaatggaaaacaagttttacttggaaatgctaaaatgctggatggcatggatatttctaatacttatcgagataaactagaagaactagaaaaaggctaa

SEQ ID NO: 1983 - DNA (genomic), 297 bp, Streptococcus pneumoniae; double-stranded, circular
  misc_feature (B) LOCATION 1...297
  hypothetical: NO
  anti-sense: NO
ggagttgctatgaaattatccaacctactgctatttgcaggagctgcagccggaagttatctggttacaaaaaatcgccaaaccatcacagatgaagtcttgaataccactgaccgcgttcaagctatcaaagacgatgtggatattatccaaaatagcctgcaaatcatcgaccagcaaaaagaacttatcaaggaataccaagaagacttgacttacaagtttaaggtcttggaaaaggatatccagactagactagctgtgataaaagaaatgcagggaactgaagataagtaa

SEQ ID NO: 1984 - DNA (genomic), 585 bp, Streptococcus pneumoniae; double-stranded, circular
  misc_feature (B) LOCATION 1...585
  hypothetical: NO
  anti-sense: NO
aaaaatgctataatgaagggtatgaaatatcacgattacatctgggatttaggtggaactttactggataattatgaaacttcaacagctgcatttgttgaaacattggcactgtatggtatcacacaagaccatgacagtgtctatcaagctttaaaggtttctactccttttgcgattgagacattcgctcccaatttagagaattttttagaaaagtacaaggaaaatgaagccagagagcttgaacacccgattttatttgaaggagtttctgacctattggaagtcatttcaaatcaaggtggccgtcattttttggtctctcatcgaaatgatcaggttttggaaattttagaaaaaacctctatagcagcttattttacagaagtggtgacttctagctcaggctttaagagaaagccaaatcccgaatccatgctttatttaagagaaaagtatcagattagctctggtcttgtcattggtgatcggccgattgatatcgaagcaggtcaagctgcaggacttgatacccacttgtttaccagtatcgtgaatttaagacaagtattagacatataa

SEQ ID NO: 1985 - DNA (genomic), 1068 bp, Streptococcus pneumoniae; double-stranded, circular
  misc_feature (B) LOCATION 1...1068
  hypothetical: NO
  anti-sense: NO
aaaaatgctataattgaaaggactatatcgaaggagaacaaaatgactaaacccattattttaacaggagaccgtccaacaggaaaattgcatattggacattatgttggaagtctcaaaaatcgagtattattacaggaagaggataagtatgatatgtttgtgttcttggctgaccaacaagccttgacagatcatgccaaagatcctcaaaccattgtagagtctatcggaaatgtggctttggattatcttgcagttggattggatccaaataagtcaactatttttattcaaagccagattccagagttggctgagttgtctatgtattatatgaatctagtttcgttagcacgtttggagcgaaatccaacagtcaagacagagatttctcagaaaggatttggagaaagcattccgacaggattcttggtctatccaatcgctcaagcagctgatatcacagctttcaaggctaattatgttcctgttgggacagatcagaaaccaatgattgagcaaactcgtgaaattgttcgttcttttaacaatgcatataactgtgatgtcttggtagagccggaaggtatttatccagacaatgagagagcagggcgtttgcctggtttagatggaaatgctaaaatgtctaaatcactaaataatggtatttatttagctgatgatgcggatactttgcgtaaaaaagtaatgagtatgtatacagatccagatcatatccgcgttgaggatccaggtaagattgagggaaatatggttttccattatctagatgtttttggtcgtccagaagatgctcaagaaattgctgatatgaaagaacgttatcaacgaggtggtcttggtgatgtgaagaccaagcgttatctacttgaaatattagaacgtgaactgggtcctattcgtgagcgccgtattgaatttgctaaggatatgggagaagtttataatatgattcaaaaaggtagtgaaagagcgcgtgaagttgcgggtcaaaccctatctgaggtaaaaggggcaatgggacttcattactttaactaa

SEQ ID NO: 1986 - DNA (genomic), 441 bp, Streptococcus pneumoniae; double-stranded, circular
  misc_feature (B) LOCATION 1...441
  hypothetical: NO
  anti-sense: NO
aaatgtgctataatagaaggaggaaaaggaggattctcagacatccgggtatcagcccaactaatgatttgtcaatttatccgcgatatgctggacttgccagcaaaaaatgtgacgattttggagggaagtaacattcacgtcttgccttccatgccctactcagcgcaggatttctatactagtatagacgtcttggcggagttagataatggaatccaagttatcatcgaaattcaggttcatcatcagaattttttcatcaatcgcctatgggcttatctgtgcagtcaggttaatcaaaacctagaaaaaattcgccaacgtgaaggtgatacccaccagagctacaaacaaatcgcaccagtatacgctatcgcaattgtcgatagtaattacttctcagatgacctagcttttcatagttttatagtaaaatga

SEQ ID NO: 1987 - DNA (genomic), 492 bp, Streptococcus pneumoniae; double-stranded, circular
  misc_feature (B) LOCATION 1...492
  hypothetical: NO
  anti-sense: NO
tacaacgctatccaagttggtttcgatgacaaacgcgaagtattgagcaacaaacctgctaaaggacatgtagcgaaagctaacacggctcctaagcgcttcattcgtgaattcaaaaacgttgaaggcttggaagttggtgctgaaattacagttgaaacattcgcagctggagacgttgttgacgtaactggtacttctaaaggtaaaggtttccaaggtgttatcaaacgccacggacaatcacgtggaccaatggctcacggttctcgttaccaccgtcgtccaggttctatgggacctgttgcacctaaccgcgtattcaaaggtaaaaaccttgcaggacgtatgggtggtgaccgcgtaacaattcaaaatcttgaagttgtacaagttgttccagaaaagaacgttatccttatcaaaggtaacgtaccaggtgctaagaaatctcttatcactatcaaatcagcagttaaagctggtaaataa

SEQ ID NO: 1988 - DNA (genomic), 186 bp, Streptococcus pneumoniae; double-stranded, circular
  misc_feature (B) LOCATION 1...186
  hypothetical: NO
  anti-sense: NO
aatttgattttatactcttcgaaaatctcttcaagccacgtcagcatcgccttaccgtatgtatggttactgacttcgtcagtttcatctacaacctcaaaacagtgttttgagcaacctgcggctagcttcctagtttgttctttgattttgagtattagatttactcaaaatcaaggattttga

SEQ ID NO: 1989 - DNA (genomic), 1704 bp, Streptococcus pneumoniae; double-stranded, circular
  misc_feature (B) LOCATION 1...1704
  hypothetical: NO
  anti-sense: NO
aaaaattatattgaggttaatactatgtcaaaagaaaaaataaaagtatacctctatacacgagtatctacgtcaatacagatagaggggtattcgttagaggcacaaaaatcacgaatgaaagcttttgctatttacaacgattatgaaattgttggagagtatgaagatgccgggaagtctggcaagtctattgaaggtagaatacagttcaatcgaatgatggaagatataaaatctggaaaagatggagtatcttttgttcttgtgtttaagttatcaagatttgcaagaaatgccgctgatgttctttctacacttcagataatgcaggattatggagttaatcttatctgcgttgaagatggcattgattcatctaaagatgctgggaaactaatgatttctgttttatcagctgtggctgaaatagaaagagaaaacatccgtattcaaacaatggaaggtcgcattcaaaaagcaagggaaggaaaatggaatggtggctttgctccgtatggatataaacttgaagacggcaagctgtttataaatgaggaagaggcagttgcaataagaacgattttcgaccagtatgtaaatactacgataggagccaatgggatatctaaatacttagagaatcatggaattagaaaaatcccaagacagaatggtaagaatcctttgtttgatgcaggtcttataagaaagatattaaagaatcctgtatataatgggaaaatagcatttggaagaagaactttagaaaaagttcatggtacaagaaatgaatataagcaggttgaacaagatgaatatctaatatctgaagggatacatgaagctatagtttccgatgaagtttggcaagctgctcaggttaagctaaaatctcaagcaaagaaatatgagcatgtgaataaaggaaaagatacacgcacacacttgctttctggaattgtaaaatgcccgatatgtggagtgggaatgtttgggaacaagtgtatcaagaaaaagaaagatggcacaaagtataaagatttttattactatggttgtaaacataggcagatgataagaggtcataagtgtacattcagtaagcaaattagagaagaattgttagatgatgctgttgcagaggtgattgtcaagatagtaagtaatccgaaatttgcttctatgatgcaagaaaaaatcaacatgaaggtggatacctctgaaatagaaaaagaaatagataattaccaaaaggaattgagaaagagtcattctacaaagtttaagctaattgaggaaatagataatttagatgttgaagataagcattataagagaaggaaacaggatttagatgatagactatatcgtatgtatgacaaaatagatgaattagaatcatcactaattgatgcgaaagcaaagaaacagactattgaagctgaaaagcttacaggagataacatatataaggttctaatctattttgataagctctataaagtcatgaatgatgtagagcgtaggcagttaatttcagctttgatttctgaaattcaagtttatgaagaaaaacaatctaacggacaatggctaaaatccattacttttaagctaccaattatagaagaaaatctcaacataggtttggacaatgatgaacaagttgaatgtgtaagtttattagagaaacgtagttaa

SEQ ID NO: 1990 - DNA (genomic), 189 bp, Streptococcus pneumoniae; double-stranded, circular
  misc_feature (B) LOCATION 1...189
  hypothetical: NO
  anti-sense: NO
ccagttctcttcattataccacaaaataacaagcataaagcggattcaaagataaagattaaggttcatatactaattttctttattgactttttgtcttctgtattagggagtttatcattttccaaaaactttatcttcaatttgttatctaaaatttctacaataaaaaagcctacctttcagtag

SEQ ID NO: 1991 - DNA (genomic), 456 bp, Streptococcus pneumoniae; double-stranded, circular
  misc_feature (B) LOCATION 1...456
  hypothetical: NO
  anti-sense: NO
tgtagctatattatatcaaaattcagtacagtagaggtagattttatgtcagattgcattttttgtaaaatcatcgcaggggaaattgctgcttcagaagtatatgaagatgagcaggtccttgcctttcttgatatctctcaagtaacactaggacacaccttggtcgtgccaaaagaacactatcgcaatcttttggagatgaatgctacgagcgccagccaactctttgcccaagtaccaaaagtagctcaaaaagtcatgaaagtcactaaggctgctggtatgaatatcatttccaactgtgaagaagtcgctggtcaaacagtttttcatactcacgttcaccttgtgcctcgctacagtgctgacgatgacctcaagattgattttatcgcccacgaaccagactttgacaaacttgctcaagtcgctgaaaccatcaaaaacgcttaa

SEQ ID NO: 1992 - DNA (genomic), 1980 bp, Streptococcus pneumoniae; double-stranded, circular
  misc_feature (B) LOCATION 1...1980
  hypothetical: NO
  anti-sense: NO
gaggaatatatgtcactacaatcagttaacgccattcgttttcttggcgtagatgctattaacaaatctaattctggtcacccgggaatcgtcatgggtgctgcgccaatggcttatagcctatttacaaagcaccttagaattacacctgagcagccaaactggattaaccgagatcgctttatcttgtctgcgggtcatggatcaatgctactgtatgctctcttgcatttaacagggtataaggatgtatccatggacgagattaaaaatttccggcaatggggatctaagacacctggtcatcctgaagtgacgcatacgtctggtgtggatgcgacatctggtccgcttggtcaggggatttctactgccgttggtttcgcccaagcagagcgttttttagctgctaagtacaacaaagatggttttcctatttttgaccattatacttatgttatcgctggagacggtgacttcatggaaggagtgtctgcggaggcggcttcttatgcaggtcatcaagctttagataagcttatcgtcctctacgactccaacgatatctgcttggatggtgagaccaaagatactttctctgaaaatgttcgcgcccgttacgatgcttatggttggcatacagttctggtagaagatggaacagatttagcagcaatttctacagcaattgagacggccaagttttctggtaagccgagtttgattgaagtgaaaacggtaattggttacggctcacccaataaaagtggtacaaatgctgttcatggtgcaccactaggagcagaagaaacaggagcaactcgtaagtttttgggatgggattacgatccatttgaagtaccagaggaagtatattctgatttcaagacaaatgtagcggatcgtggtcaggaggcatacgatgcttgggctagtttggtgtctgattacaaggttgcttatcccgaagttgctagtgagattgacgctattgtagctggaaaatcccctgtaaccattactgaaaaagacttccctgtctatgagaatggcttctctcaagcaactcgtaattcgtcccaagatgctattaatacagcagcagcagttttaccaaccttcttaggtggatcggcagacttagctcactccaacatgacctacatcaaggcagatggcttacaagataaatataatccattaaaccgcaatattcagtttggggtacgtgaatttgccatgggaacaatcctcaatggaatggctcttcatggtggtttacgagtttatggcggaaccttctttgttttctctgactacgtcaaagctgctattcggctatcagccattcaggagttgcctgtaacttatgtctttacccatgattcaattgccgttggtgaagatggtccaactcatgaaccagttgaacatttggcaggtttacgctcaatgccaaacttgactgttatccgtccagcggatgcccgtgaaactcaagcggcttggcatcatgccttgaccagtaccaccactccaactgtcattgtcttaacccgtcaaaacttggtagttgaagaagggacagactttggtaaggtcgctaaaggagcctacgtcgtgtatgataccccgggatttgatactattatcattgctacaggatctgaggtcaatctagctatcaaagctgctaaggaattggttttacaaggtggtaaagtacgtgtggtatctatgccctcaaccgaactatttgatgctcaagatgctacctacaaggaagacattttaccatctaagactcgtcgtcgtgtggccattgaaatggcagcgacccaaagttggtacaagtatgttggtttggatggcgcggtcatcggtattgacatcttcggtgcgtctgccccagctcagactgtgattgataattatggatttacggtagagaatatcgttgctcaagttaagtccctatag

SEQ ID NO: 1993 - DNA (genomic), 1854 bp, Streptococcus pneumoniae; double-stranded, circular
  misc_feature (B) LOCATION 1...1854
  hypothetical: NO
  anti-sense: NO
cagcttcatatcaatccagctcaaccaaactggattaaccgcgaccgctttattctttcagcaggtcatggttcaatgctcctttatgctcttcttcacctttctggttttgaagatgtcagcatggatgagattaagagcttccgtcaatggggttcaaaaacaccaggtcacccagaatttggtcatacggcagggattgatgctacgacaggtcctctagggcaagggatttcaactgctactggttttgcccaagcagaacgtttcttggcagccaaatataaccgtgaaggctacaatatctttgaccactatacttacgttatctgtggagacggagacttgatggaaggtgtctcaagcgaggcagcttcatatgcaggcttgcaaaaacttgataagttggttgttctttatgattcaaatgatatcaacttggatggtgagacaaaggattcctttacagaaagtgttcgtgaccgttacaatgcctacggttggcatactgccttggttgaaaatggaacagacttggaagccatccatgctgctatcgaaacagcaaaagcttcaggcaagccatctttgattgaagtgaagacggttattggatacggttctccaaacaaacaaggaactaatgctgtacacggcgcccctcttggagcagatgaaactgcatcaactcgccaagccctcggttgggactacgaaccatttgaaattccagaacaagtatatgctgatttcaaagaacatgttgcagaccgtggcgcatcagcttatcaagcttggactaaattagttgcagattataaagaagctcatccagaactggctgcagaagtagaagccatcatcgacggacgtgatccagtcgaagtgactccagcagacttcccagctttagaaaatggtttttctcaagcaactcgtaattcaagtcaagatgccttgaatgttgtggcagctaaattaccaaccttcctaggtggatcagctgaccttgctcactcaaacatgacttatataaagacggatggacttcaagacgatgccaatcgcttgaatcgtaacattcagtttggtgttcgtgaatttgcaatgggaacaatcttgaacgggatggcccttcatggtggacttcgtgtatacggtggaactttcttcgtcttctctgactatgtgaaggcagctgtccgcttgtcagccttacaaggacttcctgtgacttatgtctttacccatgattcaatcgcagttggggaagatggtccgactcacgaaccagttgagcatttagcaggtcttcgtgctatgccaaatctaaatgttttccgtccagcagatgcgcgtgaaactcaagcagcttggtaccttgcagtgacaagtgagaaaacaccaactgcccttgttttgacacgtcaaaacttgactgttgaagatggaacagacttcgacaaggttgctaaaggtgcttatgttgtatatgaaaatgcagccgactttgataccatcttgattgcgacaggttcagaggttaatcttgctgtctcagctgctaaagaattggctagtcaaggcgaaaaaatccgcgtagtcagcatgccatctacagatgtctttgataaacaagatgcagcttacaaggaagagattcttccaaatgcagtccgtcgtcgtgttgcagtcgaaatgggtgcaagtcaaaactggtacaaatatgttggtctcgatggtgccgttctaggtattgataccttcggagcctctgccccagcaccaaaagtattggcagaatatggctttactgtagaaaatcttgtaaaaattgttcgaaacttgaaataa

SEQ ID NO: 1994 - DNA (genomic), 324 bp, Streptococcus pneumoniae; double-stranded, circular
  misc_feature (B) LOCATION 1...324
  hypothetical: NO
  anti-sense: NO
gaggttcatatgaatcaagaggaactgcaggttgcagcatttgaaattatcctgcattcgggaaatgcaaggtcagaaatacatgaagcatttgcaaaaatgagagaaggtagttttgatgatgcagaaagtaaattaaatcaatcaaatgagataattcttgaagcgcatcatgcacaaaccaaactcttgcaagaatacgcaagtggagtggaaattaaaattgaaattatcatggtacatgctcaagatcatttaatgaccactatgacattattagaagtagcaaaggaaatgttagctctttataagaaagttaactaa

SEQ ID NO: 1995 - DNA (genomic), 339 bp, Streptococcus pneumoniae; double-stranded, circular
  misc_feature (B) LOCATION 1...339
  hypothetical: NO
  anti-sense: NO
acttgtcatattgaaatccttccttttcactttatacgatctactgatttcgatttatctctatctttcgttaagaaatttttttcatttacgttgaatgatttatactcaatgaaaatcaaagagcaaactaggaagctaaccgcagattgctcaaaacactgctttgaacctgtagataagactgacgaagtcagctcaaaacactgttttgaggttgtggatagaactgacgaagtcagtaaccatacctacggcaaggtgaaactgacgtggtttgaagagattttcgaagagtattacctcatcaaatttgtaaatatcatgagccttctctag

SEQ ID NO: 1996 - DNA (genomic), 1083 bp, Streptococcus pneumoniae; double-stranded, circular
  misc_feature (B) LOCATION 1...1083
  hypothetical: NO
  anti-sense: NO
aatagtcatatgaaaaggatccaactgaatatgaatgaaacgaaaaaatatcttgtgataaaagctatagcccaaggaaagaaaacaaagaaacgggcctgtgtcgaactcaatctttctgaaagacaaatcaatcgtctgctactagcctatcaacagaaagaaaaagaagccttcagacacggaaacagaaatcgaaaaccaaaacatgcaatccctgatgaaatcaaagaacgtatcctaaagaaatacctctcctatcaaacatataaaccaaatgtccgtcatttctgtgaattgctagctgaagaagaaggaattcagctctctgatacaactgttagaaaaatactctataagaaaaatatcctgtcgcctaagtctcacagaaagacaaagaagagagtaagaaaacaagctaaactgaaccccaagcaacccctagacaatccaatcttaccgacagctgaaaacttcctggaagaccctaaaaaggtacatcctagtagacccagaaaaaaatttgctggagaactcatccaaatggatgccagccctcatgcctggtttggagtagaaacctctaacttacacctagccattgatgatgcttctggcaatatcctaggcgcttattttgacaaacaagagaccttgaatgcttactatcatgtcctcgaacaaatcttagccaaccacggcattcctcttcaaattaaaacagataagagaactgtttttacctatcaagcctccaactctaagaaaatggaggacgacacccatacacaatttggatacgcctgtcaccaactgggaattctccttgagacaacctctatccctcaagctaaagggagagtcgaaagactcaatcagacactacaatctcgcctgcctatcgaactggaacgaaacaatattcataccttggaagaagccaatacctttctaccttcctatatccaaacctttaatgaacagtttggaaacaagacaaaactctctgtctttgaggaggctcctaagccctctgaacgaaatctcattctagctagactggcgggagagagtcgtcgatag

SEQ ID NO: 1997 - DNA (genomic), 1203 bp, Streptococcus pneumoniae; double-stranded, circular
  misc_feature (B) LOCATION 1...1203
  hypothetical: NO
  anti-sense: NO
ttcaaacatatggaggcaaatatgaaacatctaaaaacattttacaaaaaatggtttcaattattagtcgttatcgtcattagcttttttagtggagccttgggtagtttttcaataactcaactaactcaaaaaagtagtgtaaacaactctaacaacaatagtactattacacaaactgcctataagaacgaaaattcaacaacacaggctgttaacaaagtaaaagatgctgttgtttctgttattacttattcggcaaacagacaaaatagcgtatttggcaatgatgatactgacacagattctcagcgaatctctagtgaaggatctggagttatttataaaaagaatgataaagaagcttacatcgtcaccaacaatcacgttataaatggcgccagcaaagtagatattcgattgtcagatgggactaaagtacctggagaaattgtcggagctgacactttctctgatattgctgtcgtcaaaatctcttcagaaaaagtgacaacagtagctgagtttggtgattctagtaagttaactgtaggagaaactgctattgccatcggtagcccgttaggttctgaatatgcaaatactgtcactcaaggtatcgtatccagtctcaatagaaatgtatccttaagatcggaagatggacaagctatttctacaaaagccatccaaactgatactgctattaacccaggtaactctggcggcccactgatcaatattcaagggcaggttatcggaattacctcaagtaaaattgctacaaatggaggaacatctgtagaaggtcttggtttcgcaattcctgcaaatgatgctatcaatattattgaacagttagaaaaaaacggaaaagtgacgcgtccagctttgggaatccagatggttaatttatctaatgtgagtacaagcgacatcagaagactcaatattccaagtaatgttacatctggtgtagttgttcgttcggtacaaagtaatatgcctgccaatggtcaccttgaaaaatacgatgtaattacaaaagtagatgacaaagagattgcttcatcaacagacttacaaagtgctctttacaaccattctatcggagacaccattaagataacctactatcgtaacgggaaagaagaaactacctctatcaaacttaacaagagttcaggtgatttagaatcttga

SEQ ID NO: 1998 - DNA (genomic), 933 bp, Streptococcus pneumoniae; double-stranded, circular
  misc_feature (B) LOCATION 1...933
  hypothetical: NO
  anti-sense: NO
cctatgattttaacagtcacaatgaacccatccattgatatttcctatcccttggatgagttgaagattgatactgtcaatcgtgtggtggatgtaaccaaaacggctggtggtaagggacttaatgttacccgagtactttcagaatttggtgattctgttcttgctactggtttagtgggtggcaaacttggtgagtttttggttgaacatatcgatgatcaagtaaagaaagatttcttttctattcagggagaaactcgtaactgtatcgctattctccacggtgacaaccaaacagaagttcttgaaaaaggtcctgaagtattggaacaggaaggtcaagactttttggaacatttcaaaaaactcttggagtcagttgaagtagtagccatctcaggtagtctgccagctggccttccagttgattactatgcgagcttggtagagcttgctaatcaagctggcaagctagtagtcttggactgctctggtgcagcacttcaggcggttcttgaatcaccccataaaccgacagtaatcaaacccaataatgaggaattgtctcagcttctaggaagagaagtttctgaggatttggaggaattaaaagaagtccttcaagaatctttgtttacagggattgaatggattatcgtttcacttggtgccaacggtacttttgccaaacatggtgacactttctacaaggtagatattcctagaattcaggtggtaaatcctgttggatctggagactctactgtggcaggaatttcttcaggacttcttcacaaagaatcggatgcaggattactcatcaaggcaaatgtccttggtatgctcaatgctcaagaaaaaatgactggtcatgtcaacatggccaactatcaagctctatatgatcaattaatagtaaaagaggtataa

SEQ ID NO: 1999 - DNA (genomic), 990 bp, Streptococcus pneumoniae; double-stranded, circular
  misc_feature (B) LOCATION 1...990
  hypothetical: NO
  anti-sense: NO
gagactaatatgtttatttccatcagtgctggaattgtgacatttttactaactttagtaggaattccggcctttatccaattttatagaaaggcgcaaattacaggccagcagatgcatgaggatgtcaaacagcatcaggcaaaagctgggactcctacaatgggaggtttggttttcttgattacttctgttttggttgctttctttttcgccctatttagtagccaattcagtaataatgtgggaatgattttgttcatcttggtcttgtatggcttggtcggatttttagatgactttctcaaggtctttcgtaaaatcaatgaggggcttaatcctaagcaaaaattagctcttcagcttctaggtggagttatcttctatcttttctatgagcgcggtggcgatatgctttctgtctttggttatcaagtgcatctagggattttctatattgttttcgctcttttctggctagtcggtttttcaaacgcagtaaacttgacagacggtgttgacggtttagctagtatttccgttgtgattagtttgtctgcctatggagttattgcctatgtgcaaggtcagatggatattcttctagtgattctggccatgattggtggtttgctcagtttcttcatctttaaccataagcctgctaagatctttatgggtgatgtgggaagtttggctttaggtggaatgctggcagctatctctatggctctccaccaagaatggactctcttgattatcggaattgtgtatgtttttgaaacaacttctgttatgatgcaagtcagttatttcaaactgacaggtggtaaacgtattttccgtatgacgcctgtacatcaccattttgagcttgggggattgtctggtaaaggaaatccttggagcgagtggaaggttgacttcttcttttggggagttgggcttctagcaagtctcctgaccctagcaattttatatttgatgtaa

SEQ ID NO: 2000 - DNA (genomic), 990 bp, Streptococcus pneumoniae; double-stranded, circular
  misc_feature (B) LOCATION 1...990
  hypothetical: NO
  anti-sense: NO
agaaataatatgatgaaaagccttgagggagtgatcgatatgtcaagtaaagccaatcatgcaaagacagctatttgcggaattatcaatgtaaccccagattccttttcggatggtggtcaattttttgctcttgagcaggcactccagcaggctcgtaaattgatagcagaaggagccagcatgctagatatcggtggagaatcaactcggccgggaagtagctatgttgaggttgagatagaagaggaaatccagcgtgttgttccagtgatcaaagctattcgcaaggaaagtgatgtcctcatttctattgatacttggaaaagtcaggtggcagaggctgctttggctgctggtgctaatctagttaatgatatcactggtctcatgggtgatgaaaaaatggcccatgtgatagctaaagatggagcgaaagtggtcattatgtttaatcttgttatggctcgacctcagcatcctagctcgctcatattccctcattttggatttaatcaagcttttacagaggaagagttagctgactttgaaacattgccaatcgaagagttgatggagactttctttgaaagagcactagcgagagcaaatcaagctggaattgcacaagaaaatatcctgttggatccaggaatcggctttgggctgactaagaaagaaaatttgcttcttttacgagacctggataaactacatcagaagggctatccaatctttcttggagtgtcgcgcaagaggtttgtcatcaatatcctagaagaaaatggttttgaagtcaatcctgagacagaacttggtttccacaattgggacacagcttcggctcatgtaactagtatcgctgcgagacagggtgtagaagtggtgcgcgtgcatgacgtagctagtcacaagatggcggttgaaattgcctccgctattcgtctggctgatgaagcggaaaatttagatttaaaacaatataaataa

SEQ ID NO: 2001 - DNA (genomic), 2073 bp, Streptococcus pneumoniae; double-stranded, circular
  misc_feature (B) LOCATION 1...2073
  hypothetical: NO
  anti-sense: NO
gtgaataatatgtcttttaaagtgctacataaaggataccaacatatccgactatcatcttctttttcacttaccttggatattcaaaactatcttcgttccttggcgagagatgaaaaggggattgagtctatccagttttacatggatcaacagcactttactctacgcataaaagaaggcttttctgtattagataatgcagaagcctttttaaaaagaattgataaagggaaagtttctgagttgatgactcttcccattcgtagagaagagagtgcttattctattgtttcaggtgcagcggttaagcgtgtactttttcgtagttttgtgccgtatcctattcgctatatatggactagttatcaggctttgggttatattagagaagcctatcaaacaatagcgcgtaaggaactaacgatggaagtcttggactgttcggctattttattgtctttgtttatgaaccaatcaaagacagctagcaatatcatgtttatgcttgatttggggaatcatttagatcagtggtccttgaaaaaaactgcaacagatttagaacagagtcttcttgcaaaagagagcgatgtattcctagtacagggcgatacggttgttagtatcaagagttccgatgttcaaataggagatgtcttgatcttatctcaaggaaatgaaattctgtttgatggacaagtagtttcaggtttaggtatggtcaacgaaagttccttgacaggagagagttttccagttgaaaaaagagagtctgatttggtttgtgcaaatacagtattagaaactggagagttacgcattcgtgtaacagataatcagatgaacagccgtattttacagctgattgagttgatgaagaaatctgaagaaaacaagaaaacgaaacaacgctatttcatcaagatggcggataaagtcgtcaaatataatttcttgggggctgggctgacttacctattgacaggttctttttctaaggctatttctttcctattggtcgatttctcctgcgctttgaaaatctctactcctgtagcttatttgacagttatcaaggaagggttgaaccgtgaaatggtgattaaggatggagatgttctggagaaatatctggaagttgatactttcttgtttgataagacaggaacaatcacaactagttatcctatagttgaaaaggtgttaccttttggagactatagtgaggaagatattctcagaatcagtgcctgtcttgaggaacacatttatcatcctattgctaatgccatcgtcaagcaagctgagatagagggaattgaacatgaggaaatgcatgggaaactccaatatatcgcaagcaaggggatcaaatctcatatagatggccaaccagttcttattgggaattatgtcttgatgcaggatgagcagattcatatcagttcagaacaaaatgctttaattgaagagtacaagagtcactacaatctcttattcttggcttatcaaaatgaattgattggaatgttctgcattcatactcctttgagaaaagaagcaaaaacagccttggataaacttaaggcacaggggaaaaaattgattctggcaacaggagacaccttgattaggacagaggagttagtcaaagatttgccctttgatcaggtctatacagacttgaaacctgatgggaaatttgagttagtagagaaactgcagaaagcaggtcacactattttgatggttggagatggattgaatgactcagcggctttaactctatcagatatcggtgtggtgatgaatgagagtgcagatatttctaagcagatgagtgatatcttattgttagataatcgtttggatttcttccaagagttggattcgttatcatcatctttgcaaacactcatcaagaaaaatattcaggataccgttgtcgtaaatagtagtttgattggctttggcttatttaattggttcagtccttcaaatctctctatcttacataatctaacaaccttgcgcattgtcctgcgtagcctgtctattaaaaatagatag

SEQ ID NO: 2002 - DNA (genomic), 1068 bp, Streptococcus pneumoniae; double-stranded, circular
  misc_feature (B) LOCATION 1...1068
  hypothetical: NO
  anti-sense: NO
aagaataatatgaaaaaaattgtctttacaggtggggggacggttggacacgttaccctcaatcttttgttaatgcctaagttcatcgaagatggttgggaagtccactatatcggggacaagcgtggtatcgaacaccaagaaatccttaagtcaggtttggatgtcaccttccactccattgcgactgggaaattgcgtcgctatttctcttggcaaaatatgctggacgtcttcaaagttggctggggaatcgtccaatcgctctttatcatgttgcgacttcgtccacagacccttttttcaaaggggggctttgtctcagtaccgcctgttatcgctgcgcgtgtgtcaggagtgcctgtctttattcacgaatctgacctgtctatgggcttggccaataaaatcgcctataaatttgcgactaagatgtattcaacctttgagcaagcttcgagtttgtctaaggttgagcatgtgggagcagtgaccaaggtttcagatcaaaaaaatccagaaccagatgaattggtggatattcaaagccactttaatcataaattgccgactgtattgtttgttggcggttctgcaggtgctcgtgtctttaaccaattggtgacagaccataagaaagaactaacagagcgctacaatattatcaatctaactggagattctagcctgaatgagttgagccaaaatctttttcgtgttgactatgtgaccgatctctatcaacccttgatggaattggctgatattgttgtgacacgtggtggtgccaatacgatttttgagctcttggcgatagcaaaattgcatgtcattgtgccacttggtcgtgaagctagtcgtggtgaccagattgaaaatgcagcttactttgttaagaaaggctatgcagaagaccttcaagaaagcgatttgaccttggatagtttggaagagaagctttctcacttactaagtcacaaggaagattaccaagctaagatgaaagcttctaaggaattgaaatctctagcagatttttatcaattgttgaaaaaagatttatcataa

SEQ ID NO: 2003 - DNA (genomic), 240 bp, Streptococcus pneumoniae; double-stranded, circular
  misc_feature (B) LOCATION 1...240
  hypothetical: NO
  anti-sense: NO
ggagataatatgttaggaagtatgttcgttggtctcctagtgggatttttagcaggtgctatgaccaatcgtggagagcgaatgggatgttttggaaaaatgtttctcggttggatcggagcctttctaggtcacttgctctttggaacttgggggccagttttatcaggaacagctattatcccagctgttttaggtgccatgattgtcttagctattttttggagacgaggaagttaa

SEQ ID NO: 2004 - DNA (genomic), 861 bp, Streptococcus pneumoniae; double-stranded, circular
  misc_feature (B) LOCATION 1...861
  hypothetical: NO
  anti-sense: NO
gggatgattttaagtaaaaatagagaagatgggttaagaaaatttgcgactaacatccgattaaatactcttagaacattgaatcatcttggattcggacattacggaggaagtctgtctatcgtagaagttttagcagtgctttatggtgaaataatgccaatgactccagaaatatttgcagcacgagatagagattatttcatattatcaaaaggtcatggaggaccagctctatacagtacactctatttgaatggtttctttgacaaagaattcttatattctttaaatacaaatggaaccaaattaccgtctcatcctgatagaaatctaacgccaggcatagatatgacaacgggctctttaggacaaggaattagtgttgcaactggacttgcatatggtcagagaataagaaagagtcccttttatacttatgctattgttggagatggtgagttaaatgagggacaatgttgggaggctatacagtttgcttctcatcaacagttatccaacttaattgtatttgttgatgataacaaaaaacaattagatggttttacaaaggatatttgtaatccaggtgatttcgtagaaaaattttcagcatttggatttgaatccattagggtcaagggttcagatattagagaaatttatgaagggattgtccaattaaaacagtcacataattcatcacctaagtgcattgtattagatactattaaaggtcaaggggttcaagagctggaagaaatgaaatccaaccatcatcttcgccctactgtagaggagagacaaatgttaacttcagttgtagaaagattaagtcaggaattggaggaaacagaatga

SEQ ID NO: 2005 - DNA (genomic), 261 bp, Streptococcus pneumoniae; double-stranded, circular
  misc_feature (B) LOCATION 1...261
  hypothetical: NO
  anti-sense: NO
ttagtaaatatggaggtaagaacattggcaaacattaaatcagctatcaaacgcgctgaattgaacgttaaacaaaacgaaaagaactcagctcaaaaatcagctatgcgtactgctataaaagctttcgaagcaaacccatctgaagaacttttccgtgctgctagctcagctatcgataaagcagaaactaaaggtttgattcacaaaaacaaagcaagccgcgataaagctcgtctttcagctaaacttgctaaataa

SEQ ID NO: 2006 - DNA (genomic), 1419 bp, Streptococcus pneumoniae; double-stranded, circular
  misc_feature (B) LOCATION 1...1419
  hypothetical: NO
  anti-sense: NO
gtggtaaatatgaaattaaataaaaaaatatatttctttgataaaggaatttttaatccttatcgaatgagtaatgtaaaattaaaagttaatcaggcagtaaaggataaagaaattttcttcactgaggaaaaaccatgggaaattcgttttgataacagttatccaaatgttttctttgatgatttagcaggtgtttatcgttgctactattctacatttactgatgatgaggagtctgaaaaatactctttagaggagcgtaaggaacgtcaatatctacctcgtgcgaagcgtattgtttcactttgttatgctgaaagtaaagatggtgttaactgggtgaaaccaaatctaggtattacagaatttcgaggatcaactgaaaataatattatcggacattttttacatggtacatctgtttttctagataaacatgacgcagatgaaaatcgtcgttataaaatgtttacaaagattgattacggtaacggtgttcatttcattgctgtagcattttcaaaagatggtctacactttgatgaatacattaaagtaccaaacttcaatccacgtgcagacactcataaccatatcatatatgatgaagcattaaatcgctatgtgctaattactcgtacttggagagattcattgcgcttgccgtgtgtatctacgagtgctgatttcattaactggactccaattcaagaaattttgaatgtctgtgattatgaaaatcaaatttattctatgcctatttttaaacgtggcgattatatactaggtttagcttcagttttccatgaaggagatcaactgaacaagaattacgatacagtggaccttcaattgacttatagttatcgtcatgttggttggcattatctaaacactgatactccacttattcctcgtggtaaaggtcaatatggtgatggagaatttgactgtggatgtatctattcttctgcaccagttactatcggtgaccgtacttatttctactacatgggaggaaatggacaacatacaaacttccgtgaaacaagcttgtctcgtgcttatattgagaaagatcactttgcatattgggatactaaacgtccagaatatccaggtgttttgtataccaatggatttattttcctcaatgatcaagtttaccttgatgcagatattgcagctggaggctttgtaacaattgaattgttcgagaataatcacactccaatggaaattacagcttcccttgaaaaaatagaagatggtcgctatcaagtgttattcagcgaacctttacctcgaactcaaactcgactgaaaattagctttaaaaatgctaaaatctacgcaatcgaaggaaatttagatattttcagaattgaatcagacaatgctctattgagggggtaa

SEQ ID NO: 2007 - DNA (genomic), 240 bp, Streptococcus pneumoniae; double-stranded, circular
  misc_feature (B) LOCATION 1...240
  hypothetical: NO
  anti-sense: NO
aaagcaaatatgatacaattttatttgaaaaaaaataaaaaaggagattttattatgacattaaaaacacttgctttaattagtggtatcgtcggtcttgtgggaggaattttacttcttattggtccttttgtcttgttgggaacaacggtaaacacagctgctacaactcttaatggaggagctactgcaggggctttttcaggtgttgcctgtactcttgaatgccttgaagattga

SEQ ID NO: 2008 - DNA (genomic), 585 bp, Streptococcus pneumoniae; double-stranded, circular
  misc_feature (B) LOCATION 1...585
  hypothetical: NO
  anti-sense: NO
aggaaaaatatggacttaaaatttgaaggggttgatttagaatacaaaaaagctaaaaacaatcttccagagtctttctgggaaacctactcagcatttgcaaatacaaatggcgggaaaataattctcgggatagatgaaaaaaacattgacacctaccaaagagtcaatagactccctgcgaaacaaaattatgaagcaagtaaacaactaactgatgcacgatttaagcgtcttgttggtgttcagcgtaccacttttgaagagatgttagctgtattaaaaacagcttatcaacttaaacacgcaaaaggtggacgaaaacctaaattaagcctagaagaccttcttatggccactcttcaatatgtgcgagaatatcgcacttatgaagaaattgcggctgattttggtatccacgaaagcaacttaatccgtcggagccaatgggttgaagtaactcttgttcaaagtggtgttacgatttcaagaactcttctcagttctgaggacacggtaatgattgatgcgacggaagtaaaaatcaatcgccctaaaaaaacaattagcgaatcattctggtaa

SEQ ID NO: 2009 - DNA (genomic), 2364 bp, Streptococcus pneumoniae; double-stranded, circular
  misc_feature (B) LOCATION 1...2364
  hypothetical: NO
  anti-sense: NO
aaagaaaatatgaaagatagaataaaagaatatttacaagacaagggaaaggtgactgttaatgatttggctcaggctttgggaaaagacagttccaaggattttcgtgagttgattaaaaccttgtccttaatggaaagaaagcaccaaattcgttttgaagaagatggtagtctgacattagaaattaagaaaaaacatgagattaccctcaaggggatttttcatgcccataaaaacggctttggctttgttagtctggaaggcgaggaggacgacctttttgtagggaaaaatgatgtcaactatgctattgatggtgataccgtcgaggtagtgattaagaaagtcgctgaccgcaataagggaacagcagcagaagccaaaattattgatatcctagaacacagtttgacaacagttgtcgggcaaatcgttctggatcaggaaaagcctaagtatgctggctatattcgttcaaaaaatcagaaaatcagtcaaccgatttatgttaagaaaccagccctaaagttagaaggaacagaagttctcaaggtctttatcgataaatacccaagcaagaaacatgatttctttgtcgcgagtgttctcgatgtggtgggacactcaacggatgtcggaattgatgttcttgaggtcttggaatcaatggacattgtatccgagtttccagaagctgttgttaaggaagcagaaagtgtgcctgatgctccgtctcaaaaggatatggaaggccgtctggatctaagagatgaaattacctttaccattgacggtgcggatgccaaggacttggacgatgcagtgcatatcaaggctctgaaaaatggcaatctggagcttggggttcacatcgcagatgtttcttattatgtgaccgaggggtctgcccttgacaaggaagcccttaaccgtgcgacttctgtttacgtgacagaccgagtggtgccaatgcttccagaacgactatcaaatggcatctgctctctcaatccccaagttgaccgcctgacccagtctgctattatggagattgataaacatggtcgtgtggtcaactataccattacacaaacagttatcaagaccagttttcgtatgacctatagcgatgtcaatgatatcctagctggcgatgaagaaaagagaaaagaatatcataaaattgtatcaagtatcgaactcatggccaagcttcatgaaactttagaaaacatgcgtgtgaaacgtggagctctcaattttgataccaatgaagcgaagattttagtggataaacaaggtaagcctgttgatatcgttcttcggcagcgtggcattgccgagcggatgattgagtcttttatgttgatggctaatgaaacagttgccgaacatttcagcaagttggatttgccttttatctatcgaattcacgaggagcctaaggctgaaaaggttcagaagtttattgattatgcttcgagttttggcttgcgtatttatgggactgccagtgagattagtcaggaggcacttcaagacatcatgcgtgctgttgagggagaaccttatgcagatgtattgtccatgatgcttcttcgctctatgcagcaggcttgttattcggagcacaatcacggccactatggactagctgctgactattatactcactttaccagtccaattcgtcgttatccagaccttcttgttcaccgtatgattcgggattacggccgttctaaggaaatagcagagcattttgaacaagtgattccagagattgcgacccagtcttccaaccgtgaacgtcgtgccatagaagctgagcgtgaagtcgaagccatgaaaaaggctgagtatatggaagaatacgtgggtgaagagtatgatgcagttgtatcaagtattgtcaaattcggtctctttgtcgaattgccaaacacagttgaaggcttgattcacatcactaatctacctgaattttatcatttcaatgagcgtgatttgactcttcgtggagaaaaatcaggtatcactttccgagtgggtcagcagatccgtatccgtgttgaaagagcggataaaatgactggagagattgatttttcattcgtacctagtgagtttgatgtgattgaaaaaggcttgaaacagtctagtcgtagtggcagagggcgtggttcaaatcgtcgttcggataagaaggaagacaagagaaaatcaggacgctcaaatgataagcgtaagcattcacaaaaagacaagaagaaaaaaggaaagaaatctttttacaaggaagtagctaagaaaggagccaagcatggcaaagggcgagggaaaggtcgtcgcacaaaataa

SEQ ID NO: 2010 - DNA (genomic), 474 bp, Streptococcus pneumoniae; double-stranded, circular
  misc_feature (B) LOCATION 1...474
  hypothetical: NO
  anti-sense: NO
ggagaaaatatgcctcagttagcgacgatttgctacattgataatgggaaagaactgctcatgctccatcgtaataagaaacccaatgatgtccatgaagggaaatggattggtgtgggtggtaagctagagagaggagagacgccccaggaatgcgcggcgcgtgaaatccttgaagaaacagggctcaaagccaagccagttctaaaaggtgtcatcacttttcctgaatttacaccagatttagactggtacacctatgtttttaaggtgacggagtttgagggcgacttgattgactgcaatgaggggatgctagaatgggttccctatgatgaggttttgagcaagccgacttgggaaggtgaccacacctttgttgagtggcttttagaggataaacccttcttttcagccaagtttgtttatgatggggataaattgttggatacccaagttgatttctatgaataa

SEQ ID NO: 2011 - DNA (genomic), 846 bp, Streptococcus pneumoniae; double-stranded, circular
  misc_feature (B) LOCATION 1...846
  hypothetical: NO
  anti-sense: NO
ggaggaaatatcgtgggaattcgtgtttataaaccaacaacaaacggtcgccgtaatatgacttctttggatttcgctgaaatcacaacaagcactcctgaaaaatcattgcttgttgcattgaagagcaaggctggtcgtaacaacaacggtcgtatcacagttcgtcaccaaggtggtggacacaaacgtttctaccgtttggttgacttcaaacgtaataaagacaacgttgaagcagttgttaaaacaatcgagtacgatccaaaccgttctgcaaacatcgctcttgtacactacactgacggtgtgaaagcatacatcatcgctccaaaaggtcttgaagtaggtcaacgtatcgtttcaggtccagaagcagatatcaaagtcggaaacgctcttccacttgctaacatcccagttggtactttgattcacaacatcgagttgaaaccaggtcgtggtggtgaattggtacgtgctgctggtgcatctgctcaagtattgggttctgaaggtaaatacgttcttgttcgtcttcaatcaggtgaagttcgtatgattcttggaacttgccgtgctacagttggtgttgtcggaaacgaacaacatggacttgtaaaccttggtaaagcaggacgtagccgttggaaaggtatccgcccaacagttcgtggttctgtaatgaaccctaacgatcacccacacggtggtggtgaaggtaaggcaccagttggtcgtaaagcaccatctactccatggggcaaacctgctcttggtcttaaaactcgtaacaagaaagcgaaatctgacaaacttatcgttcgtcgtcgcaacgagaaataa

SEQ ID NO: 2012 - DNA (genomic), 1866 bp, Streptococcus pneumoniae; double-stranded, circular
  misc_feature (B) LOCATION 1...1866
  hypothetical: NO
  anti-sense: NO
attttgaatattatagaggaaatcatgacaaaattaagagaagatatccgtaacattgcgattatcgcccacgttgaccacggtaaaacaaccctggttgacgaattattgaaacaatcagaaacgcttgatgcacgtactgaattggcagagcgtgctatggactcaaacgatatcgaaaaagagcgtgggattaccatccttgctaaaaatactgccgttgcttacaacggaactcgtatcaacattatggacacaccaggacacgcggactttggtggagaagttgagcgtatcatgaaaatggttgacggtgttgtcttggtcgtagatgcctatgaaggaaccatgccacaaactcgtttcgtattgaaaaaagccttggaacaagaccttgtcccaatcgtggttgttaacaaaatcgataagccatcagctcgtccagcagaagtagtggatgaagtcttggaacttttcatcgagcttggtgcagatgacgaccagcttgatttcccagtggtttatgcttcagcgatcaacggaacttcttcattgtcagatgatccagctgaccaagaagcgactatggcaccaatctttgacacgattatcgaccatatcccagctccagtagataactcagatgagcctttgcagttccaagtgtcgcttttggactacaatgacttcgttggacgtatcggtatcggtcgtgtcttccgtggtacagttaaggttggggaccaagttaccctttctaaacttgacggtacaactaaaaacttccgtgttacaaaactcttcggtttctttggtttggaacgtcgtgaaatccaagaagccaaagcgggtgacttgattgccgtttcaggtatggaagacatctttgtcggtgaaaccatcactccgacagatgcagtagaagctcttccaatcctacacatcgatgagccaactcttcaaatgactttcttggtcaacaactcaccatttgctggtaaagaaggtaaatgggtaacttctcgtaaggtggaagaacgcttgcaggcagaattgcaaacagacgtttcccttcgtgttgacccaactgattcaccagataaatggactgtttcaggacgtggagaattgcacttgtcaatccttatcgaaacaatgcgtcgtgagggctatgaacttcaagtatctcgtccagaagttatcgtaaaagaaatcgacggtgttaaatgtgaaccatttgaacgtgtacaaatcgacactccagaagaataccaagggtctgttatccaaagcctttctgaacgtaaaggtgaaatgttggatatgatttcaactggtaatggtcaaactcgtttggtcttccttgttccagcgcgtggtttgattggatactcaactgagttcttgtcaatgactcgtggttacggtatcatgaaccataccttcgaccagtacttgccattgattccaggggaaattggtggacgtcaccgtggtgcccttgtttctatcgatgctggtaaggctacaacttactcaatcatgtctatcgaagaacgtggtacgatctttgtcaacccaggtactgaggtttatgaaggaatgatcatcggcgaaaactctcgtgaaaatgacttgacagttaacatcacgaaggcaaaacaaatgaccaacgttcgttcagctactaaggaccaaacagctgttatcaagacgcctcgtatcttgacacttgaagagtctcttgagttcttgaacgacgatgagtacatggaagtaacgcctgagtctatccgtttgcgtaaacaaatccttaacaaagcagagcgtgagaaagctaacaagaagaaaaaatcagctgaataa

SEQ ID NO: 2013 - DNA (genomic), 357 bp, Streptococcus pneumoniae; double-stranded, circular
  misc_feature (B) LOCATION 1...357
  hypothetical: NO
  anti-sense: NO
cgtgtgaatattaaatctgccagtgatttgttgggaatttcagcggatacgattcggtattatgaacgggttggtcttgtgccaccgattactcgtactgctactgggattcgtgattttcaagatcaggatatcgaagcgctggaatttattaagtgttttcgttcggcgggtgtctctgtagatagtttagttgactatatgtcgctctaccaaaagggagatgaaacgagagaggagaggcttggtattttagaagaggaaaagcaaaaattagaggagcgcttgtctcagctacagacagctttaaatcgtttaaatctcaaaattaaactttataaggaaggaaaattttaa

SEQ ID NO: 2014 - DNA (genomic), 1059 bp, Streptococcus pneumoniae; double-stranded, circular
  misc_feature (B) LOCATION 1...1059
  hypothetical: NO
  anti-sense: NO
ggaaagaatatgactgaatacaaaaatattatcgtgacaggtggagctggctttatcggttctaactttgtccattatgtttacgagaactttccagatgttcacgtgacagtcctagataagttgacttatgctggaaaccgcgcgaatattgaggaaattttaggtaatcgtgttgagttagttgttggtgacattgctgatgcggagttggtagacaagttggctgctcaagcagatgctatcgttcattatgcagcggaaagccacaatgataattcgctcaatgatccatcgccatttattcatactaacttcattggaacctatactcttttagaagctgctcgtaagtatgatattcgcttccaccatgtatcgacagatgaagtttatggggatctccctttacgcgaagatttgccaggtcatggagaagggccgggtgagaaatttacggctgaaaccaagtacaatccaagctcgccttactcatcaaccaaggcagcctcagatttgattgtcaaagcctgggtgcgttcttttggagtcaaggcaacgatttccaactgttcaaataactacggtccttatcaacatatcgaaaaattcatcccacgtcagattactaacatcctaagtggtatcaagccaaaactttacggtgaaggtaaaaacgttcgtgactggattcataccaatgaccattcttcaggagtttggacaatcttgacaaaagggcaaatcggtgaaacctacttgattggggctgatggtgagaagaacaataaggaagttttggaacttatccttaaggaaatgggacaagctgcggatgcctatgatcatgtgactgaccgtgcaggacatgaccttcgctatgcgattgatgctagcaagctccgtgatgagttggggtggaaacctgaatttaccaactttgaagctgggctcaaggcaacaatcaagtggtatacagataaccaagaatggtggaaagcagaaaaagaagctgttgaagccaattatgctaagactcaggagattattacagtataa

SEQ ID NO: 2015 - DNA (genomic), 963 bp, Streptococcus pneumoniae; double-stranded, circular
  misc_feature (B) LOCATION 1...963
  hypothetical: NO
  anti-sense: NO
gataggaatatggattttgaaaaaattgaacaagcttatacctatttactagagaatgtccaagtcatccaaagtgatttggcgaccaacttttatgacgccttggtggagcaaaacagcatctatctggatggtgagactgagctagaacaggtcaaagacaacaatcagacccttaagcgtttagcactacgcaaagaagaatggctcaagacctaccagtttctcttgatgaaggctgggcaaacagaacccttgcaggccaatcaccagtttacaccggatgctattgctttacttttggtgtttattgtggaagagttgtttacagaggaggaaattactatcctcgaaatgggttctgggatgggaattctaggcgctactttcttgacctcgcttgataaaaaggtggattacttgggaatggaagtggatgatttgctgattgatctggcagctagcatggcagatgtaattggtttgcaggctggctttgtccaaggagatgccgttcgcccacaaatgctcaaagaaagcgatgtggtcatcagtgacttgcctgttggctattatcctgatgatgccgttgcgtcgcgccatcaagttgcttctagccaagaacatacttacgctcatcacttgctcatggaacaagggtttaagtaccttaagtcagatggatatgctatttttctagctccgagtgatttgttgaccagtcctcaaagtgatttgttgaaagtctggttgaaagaggaggcaagtctggttgctatgattagtctgcctgaaaatctctttgctaatgccaaacaatctaagactatttttatcttacagaagaaaaatgaaatagcagtagagccttttgtttatccacttgctagcttgcaagatgcaagtgttttaatgaaatttaaagaaaattttcaaaaatggactcaaggtactgaaatataa

SEQ ID NO: 2016 - DNA (genomic), 1866 bp, Streptococcus pneumoniae; double-stranded, circular
  misc_feature (B) LOCATION 1...1866
  hypothetical: NO
  anti-sense: NO
tcgaggaatattatgaaacaaagtaaaatgcctatcccaacgcttcgcgaaatgccaagcgatgctcaagttatcagccatgctcttatgttgcgtgctggttatgttcgccaagtttcagcaggtgtttattcttatctaccacttgccaaccgtgtgattgaaaaagctaaaaacatcatgcgccaagaattcgaaaagattggtgctgttgagatgttggctcctgcccttcttagtgcagaattgtggcgtgaatcaggtcgttacgaaacctatggtgaagacctttacaaactaaaaaaccgtgaaaaatcagactttatcttaggtccaactcatgaagaaacctttacagctattgtccgtgattctgttaaatcttacaagcaattgccactcaacctttatcaaattcagcccaagtatcgtgatgaaaaacgcccacgtaatggacttcttcgtacacgtgagtttatcatgaaggatgcttatagtttccacgctaactatgatagtttggatagtgtttatgatgagtacaaagcagcctatgagcgtattttcactcgtagtggtttagacttcaaggctattattggtgacggtggagccatgggtggtaaggatagccaagaatttatggccattacatctgctcgtacagaccttgaccgctgggttgtcttggacaagtcagttgcctcatttgacgaaattcctgcagaagtgcaagaagaaatcaaggcagaattgctcaaatggatagtctctggtgaagataccattgcttactcaagtgagtctagctatgcagctaacttagaaatggcaacaaacgagtacaaaccaagcaaccgtgttgtcgctgaagaagaagttactcgtgttgcaacgccagatgttaaatcaattgatgaagttgcagccttcctcaatgttccagaagaacaaacgattaaaaccctcttctacattgcagatggcgagcttgttgcagcccttctagttggaaatgaccaactcaacgaagtcaagttgaaaaatcacttgggagcagatttctttgacgttgctagcgaagaagaagtggcgaatgttgttcaagcaggatttggttcacttggaccagttggtttgccagagaatattaaaattattgcagatcgtaaggtacaagatgttcgcaatgcagttgtcggtgctaacgaagatggctaccacttgantggtgtgaacccaggccgtgattttactgcagaatatgtggatatccgtgaagttcgtgagggtgaaatttccccagatggacaaggtgtccttaactttgcgcgtggtattgagatcggtcatattttcaaactcggaactcgctattcagcaagcatgggagcagatgtcttggatgaaaatggtcgtgctgtgccaatcatcatgggatgttacggtatcggtgtcagccgtcttctttcagcagtgatggagcaacacgctcgcctctttgttaacaaaacgccaaaaggtgaataccgttacgcttggggaatcaatttccctaaagaattggcaccatttgatgtgcatttgattactgtcaatgtcaaggatgaagaagcgcaagccttgacagaaaaacttgaagcaagcttgatgggagctggttatgaagtcttgacagatgaccgtaacgaacgtgtcggtgttaaatttagcgatagtgacttgattggtcttccaatccgtatcactgttggtaaaaaagcggccgatggcattgtagaagttaagatcaaggcaactggtgacaccattgaggttcatgcagataacgtgcttgaaacgcttgaaatcctaagcaagaaataa

SEQ ID NO: 2017 - DNA (genomic), 1185 bp, Streptococcus pneumoniae; double-stranded, circular
  misc_feature (B) LOCATION 1...1185
  hypothetical: NO
  anti-sense: NO
aagtttgatataatggtagttatgaatagaataagagtcagcaaaagggttgaaaagaagcttgctaaagggctagttttactagaagccagtgatcttgagaatgtcaatcttaaggatcaggaagtagaggtgcagggtcaggaaggaaactttcttgggactgcctacctttctcagcaaaacaagggcttgggctggtttgtcagcaaagacaaggtggccttcaatcaagctttctttgaaacgttgtttagaaaagccaaagaaaagagaaacgcctactatcaagatgatttgacaactgcctttcgtctctttaatcaagagggagatggctttgggggtctgacagtggatctttatggcgactacgccgtcttttcttggtataactcttatgtttatcagattcgtcagactatatcagaagcctttagacaggttttccctgaggttttaggggcttatgagaaaatccgctttaagggtttggactatgaatctgcccatgtttatggtcaagaagcacctgactttttcactgttttagaaaatggtgtcctgtatcaagtctttatgaatgatggcttgatgacaggaattttcctagaccagcatgaggttcgcggtagtttagttgacggcttggctatgggtaaatccttgctcaatatgttttcctacacagcggctttttcagtagctgcggccatgggaggagctagccagacaacttctgttgatctagccaaacgttcacgagaattgtctcaagcgcattttcaggcaaatgggctcagcacagacgagcatcattttatagtcatggatgtctttgagtatttcaaatatgccaaacgcaaagacttgacctacgatgtgattgtcctagatccgcctagctttgctcggaataaaaaacaaactttctctgtggccaaggattatcacaagttgatttcccagagtcttgagattttaaatccgggagggattatcattgccagtactaatgctgccaatgtttcccgtcagaaatttacagaacaaattgataaaggctttgcaggaagaagttaccagattttaaacaaatatggtcttccagcagattttgcctataataaaaaagatgaaagtagtaattacctcaaggtgattagtatgaaggttagtaaatga

SEQ ID NO: 2018 - DNA (genomic), 828 bp, Streptococcus pneumoniae; double-stranded, circular
  misc_feature (B) LOCATION 1...828
  hypothetical: NO
  anti-sense: NO
acattcgatattgatattgccgaccttcgagcaccgctcgatgcggaagaaatgtctcgtattaccattgaagacgagtataccctgattatcgtagacgtgccggtcacggaggaaagaaataaccgcacctactacgtaaccatcccgcttggtattatcatcactgaggaaaccattatcactacgtgtttggaaccactacctgtccttgatgtctttatcaaccgtcgattgcgtaatttctataccttcatgcgttcacgttttatctttcaaattctttatcgcaatgcagagctttacctaacagcccttcgttcaatcgaccgcaagagtgaacaaatcgaaagtcaactgcatcaatcaactcgtaatgaagaattgattgagctcatggaattggaaaaaactatcgtctatttcaaggcctccctcaaaacaaatgagcgcgtgattaagaaattgaccagttcaaccagcaatatcaagaaataccttgaggacgaagacctgcttgaagacaccctgattgaaacccaacaggccatcgagatggcagatatttatggaaacgtcttgcattctatgacagagacctttgcctctatcatttctaacaaccagaacaacatcatgaaaaccttggcccttgtgaccatcgtcatgtccatcccaaccatggtcttttctgcctacgggatgaactttaaggataatgaaatccccctaaacggagagccaaatgccttctggttaatcgtctttatcgcctttgctatgagtgtctcgctcactctctatctcatccataaaaaatggttctaa

SEQ ID NO: 2019 - DNA (genomic), 597 bp, Streptococcus pneumoniae; double-stranded, circular
  misc_feature (B) LOCATION 1...597
  hypothetical: NO
  anti-sense: NO
actaaagatatgaaacatgattttaaccacaaagcagaaactttcgattcccctaaaaatatcttcctcgcaaacttggtatgtcaagcagtcgagaaacagattgatattttatcagacaaagtaattttagatttcggtggtggcacgggtctattagccttgcccctagccaagcaggctaagtcagtcactcttgtagacatttctgagaaaatgttggagcaagctcgtttgaaagtggagcagcaagcaatcaagaatatccagtttttggagcaagatttaccgaaaaatcccttggagaaagagtttgattgccttgctgttagtcgggttcttcatcatatgcctgatttggatgcggctctctcactgtttcatcaacatttgaaggaagatgggaaactcatcattgctgattttaccaagacagaagctaatcatcatggatttgatttagctgaactggaaaacaagctaattgagcatggtttttcatctgtgcatagtcagattctctatagcgctgaagacctgtttcaaggaaatcactcagaattctttttaatagtagcccaaaaatcactcgcctag

SEQ ID NO: 2020 - DNA (genomic), 243 bp, Streptococcus pneumoniae; double-stranded, circular
  misc_feature (B) LOCATION 1...243
  hypothetical: NO
  anti-sense: NO
aatatggatatcaaatcagaagttattgaaattattgatgagttgtttatggaagatgtttctgacatgatggatgaagatctttttgatgcaggtgtcttggatagtatgggaacggttgagttgattgtggagattgagaaccgttttgacattcgtgtccctgtaacagagtttggtcgtgacgactggaatacagctaataaaatcatagctggtattgtggagctacaaaatgcttaa

SEQ ID NO: 2021 - DNA (genomic), 732 bp, Streptococcus pneumoniae; double-stranded, circular
  misc_feature (B) LOCATION 1...732
  hypothetical: NO
  anti-sense: NO
ataatggatattaaattaaaagattttgaaggacccctggacttactcttgcatctggtttctaagtaccagatggatatctacgatgtgcccattacggaagtcatcgaacagtatctagcctatgtctcaaccctgcaggccatgcgtctggaagtgacgggtgagtacatggtcatggctagtcagctcatgctgattaagagtcgtaaactccttccgaaggtagcagaagtgacagacttgggggatgacctggagcaggacctcctctctcaaatcgaagaatatcgcaagttcaagctcttgggtgagcacttggaagccaagcaccaagaacgggcccagtattattccaaagcgccgacagagttgatttacgaagatgcggagcttgtgcatgacaagacgaccattgacctctttttggctttttcaaatatcctagccaagaaaaaagaggagtttgcacaaaatcacacgacgatcttgcgggatgagtataagattgaggacatgatgattatcgtgaaagagtccttgattggacgagatcaattgcgcttgcaggatttgttcaaggaagcccagaatgtccaagaggtcatcaccctctttttggcaaccctagagttaatcaaaacccaggagctgatcctcgtgcaagaggagagtttcggagatatctatctcatggaaaagaaggaagaaagtcaagtgcctcaaagctag

SEQ ID NO: 2022 - DNA (genomic), 948 bp, Streptococcus pneumoniae; double-stranded, circular
  misc_feature (B) LOCATION 1...948
  hypothetical: NO
  anti-sense: NO
aaaatggatatagtatatgcgacagataataattttgtagatgtattgagtgcatctatcaagtcgctttacactactaattcagatttggatttaaatttatggattattgctgataaagtttcggatagaaataaagaaaagataaatagattatcaaaacaatttgcgcagagagaaattaattggatagagaacgttgagattccatttaaattacatttagataggggatcaattagttcatttagcagattatttctgggaagtgttcttccatcttcaatgagtaaagttctctatcttgatagtgatattattgtaatggattctttacgaagtattcttgatattgattttaaagataaaattctctatggggtaaatgatacttttaataaagaatacaagcaggtgttggggataccaatcgacaaaccaatgtttaatgctggagttatgctgattaatttagagttatggagaaataataacgtcgaagaaaaatttttgcaagtaattcaaaagtttaatggtactatattacaaggtgatttaggagttttaaatgcagttttatataactcatttggtgtacttcctccagaatataattatatgaccatatttgaagatttgacttatgaagaaatgatagtttttaaaaaaccaattaactattattcaaaagaagaaattaaaaatgctagagaacgtatagtcttgcgccatttcacaacgtgttttctatcactcagaccttggcaagaaaatagtgaggtggcgcatgtggaaatatttaaaaaatactatagaggaacatacaaacaagtatctccatctaagttatcaagaatttataaaattttaccgaaaaaaatgtcgctctatttactaggttttattcaatcaaaagtgcgtccaaaactgtatagaattttgaaataa

SEQ ID NO: 2023 - DNA (genomic), 639 bp, Streptococcus pneumoniae; double-stranded, circular
  misc_feature (B) LOCATION 1...639
  hypothetical: NO
  anti-sense: NO
actttatgtatctttagaaagtgtgttaacttgaaagaacaaatttttttgatgggtgggaatcccccaatgaagaaatatagtattgttgataaaattgtattatcaaccaagattaaaagaattatcatttttacagtttttcgagaaaattgggaaccgtacatgaaaaagtacacggaagtttttcaaagtcaatttcctaatctaaacattgattacttgctcctggacactgagcagattgatcttgatagctatctagatgctgacataattatcatcggtggtggaaatacggaaaaatatattgctacttatgttaatcaggagttcaaaagttatatcgatcatatgcttaataaagaggcaaaaattataggattttctgcaggagccctactattaggagaaaaagtctatgtctcacctaatgataattcagatcatcagataaagataaaaaatggattaggactctttagtcagtttttaattagtgtccattatgattcctggaatgataaagcaaataaggatagagctgaagaactcgttaatgttcccataattccactaaatgatcattcttgtcttgtattggataaacttggaaacatcatagagaaaattgactaa

SEQ ID NO: 2024 - DNA (genomic), 1713 bp, Streptococcus pneumoniae; double-stranded, circular
  misc_feature (B) LOCATION 1...1713
  hypothetical: NO
  anti-sense: NO
ttgttatgtatccattcttccaaaaatactttgataaaggaattatggctggttcacttaaaggataaaaaaagaaaaaataaaaggagttttctcatgaaattcaaaacattctcaaaatcagcagttttgttgacagctagtttagcagtacttgcagcctgtggctcaaaaaatacagcttcaagtccagattataagttggaaggtgtaacattcccgcttcaagaaaagaaaacattgaagtttatgacagccagttcaccgttatctcctaaagacccaaatgaaaagttaattttacaacgtttggagaaggaaactggcgttcatattgactggaccaactaccaatccgactttgcagaaaaacgtaacttggatatttctagtggtgatttaccagatgctatccacaacgacggagcttcagatgtggacttgatgaactgggctaaaaaaggtgttattattccagttgaagatttgattgataaatacatgccaaatcttaagaaaattttggatgagaaaccagagtacaaggccttgatgacagcacctgatgggcacatttactcattcccatggattgaagagcttggagatggtaaagagtctattcacagcgtcaacgatatggcttggattaacaaagattggcttaagaaacttggtcttgaaatgccaaaaactactgatgatttgattaaagtcctagaagctttcaaaaacggggatccaaatggaaatggagaggctgatgaaattccatttacatttattagtggtaacggaaacgaagattttaaattcctatttgctgcatttggtataggggataacgatgatcatttagtagtaggaaatgatggcaaagttgacttcacagcagataacgataactataaagaaggtgtcaaatttatccgtcaattgcaagaaaaaggcttgattgataaagaagctttcgaacatgattggaatagttacattgctaaaggtcatgatcagaaatttggtgtttactttacatgggataagaataatgttactggaagtaacgaaagttatgatgttttaccagtacttgctggaccaagtggtcaaaaacacgtagctcgtacaaacggtatgggatttgcacgtgacaagatggttattaccagtgtaaacaaaaacctagaattgacagctaaatggattgatgcacaatacgctccactccaatctgtgcaaaataactggggaacttatggagatgacaaacaacaaaacatctttgaattggatcaagcgtcaaatagtctaaaacacttaccactaaacggaactgcaccagcagaacttcgtcaaaagactgaagtaggaggaccactagctattctagattcatactatggtaaagtgacaaccatgccagatgatgccaaatggcgtttggatcttatcaaagaatattatgttccttacatgagcaatgacaataactatccaagagtctttatgacacaggaagatttggacaagattgcccatatcgaggcagatatgaatgactatatctaccgtaaacgtgctgaatggattgtaaatggcaatattgatactgagtgggatgattacaagaaagaacttgaaaaatacggactttctgattacctcgctattaaacaaaaatactacgaccaataccaagcaaacaaaaactag

SEQ ID NO: 2025 - DNA (genomic), 2268 bp, Streptococcus pneumoniae; double-stranded, circular
  misc_feature (B) LOCATION 1...2268
  hypothetical: NO
  anti-sense: NO
ggtagatgtatgctttgtcaaaactgtaaaattaacgactcaacaattcatctttacaccaatctcaatggaaaacaaaaacaaattgacctctgtcaaaactgctataagattatcaaaacagatcctaacaatagcctcttcaaaggtatgacggatctgaacaatcgtgacttcgatccctttggtgatttcttcaatgatctaaacaatttcagaccttctagcaatactcctcctattcccccaacccaatcaggtggaggttacggtggaaacggcggttatggttcccaaaatcgtggatctgctcaaactccgccacctagccaagaaaaaggcctgctgaaagaatttggtattaatgtaactgaaattgcccgtcgtggagacattgaccccgttattgggcgcgacgatgagattatccgtgtcatcgagattctcaatcgtagaaccaagaataatcctgtccttatcggtgaacctggtgtcggaaaaacggccgttgtcgaaggtctagctcagaaaattgtcgatggcgatgtgccacataaactccaaggtaaacaagtcatccgtctggatgtggttagcttagttcaaggaacggggattcgaggacaatttgaagaacgcatgcaaaaactcatggaagaaattcgcaaacgtgaagacatcatcctctttatcgatgaaatccatgaaattgttggtgctggttctgcgagtgatggtaatatggacgcaggaaatatcctcaagccagcccttgctcgtggagaactgcaactagtcggtgctactaccctcaatgaataccgtatcattgaaaaggatgctgccctcgagcgtcgtatgcagcctgttaaagtcgatgaaccaacggtggatgaaacaatcactattctcaaagggattcaaaagaaatacgaagattaccaccacgttcaatataccgatgctgcgattgaagcagctgcaactctttccaatcgctacatccaagatcgcttcttgcctgacaaggccattgacctcctagatgaagctggttctaagatgaacttgaccttgaattttgtggatcctaaagtaattgatcagcgcttgattgaggctgaaaatctcaagtctcaagctacacgagaagaagattttgagaaggcggcctacttccgcgaccagattgccaagtataaggaaatgcaaaagaaaaagatcacagaccaggatactcctatcatcagcgagaaaactattgagcacattatcgagcagaaaaccaatatccctgttggtgatttgaaagagaaagaacaatctcaactcatccatctagccgaagatctcaagtctcatgttattggccaagatgatgcagtcgataagattgccaaggctattcgccgtaatcgtgtcggacttggtacccctaaccgcccaatcggaagcttcctcttcgttgggccaactggtgtcggtaagacagaactttccaaacaactggctatcgaactttttggttctgctgatagtatgattcgctttgatatgagtgaatacatggaaaaacatagtgtagctaagttggtcggcgctcctccaggttatgttggctatgatgaggctggtcaattaactgaaaaagttcgccacaatccatattctctcatccttctcgatgaagtggaaaaagctcacccagatgttatgcacatgtttcttcaagtcttggacgatggtcgtttgacagacgggcaaggacgcaccgttagcttcaaggatgccatcattatcatgacctcaaatgcaggtacaggaaagaccgaagctagcgttggatttggtgctactagagaaggacgtaccaattctgtcctcggtgaactcggtaacttctttagcccagagtttatgaaccgttttgatggcattatcgaatttaaggctctcagcaaggataacctccttcagattgtcgagctcatgctagcagatgttaacaagcgcctctctagcaacaacattcgtttggatgtaactgacaaggtcaaggaaaagttggttgacctaggttatgatccaaaaatgggagcacgcccacttcgtcggactattcaagactatattgaggacacaatcactgactactaccttgaaaatccaagcgaaaaagatctcaaagcagttatgactagcaagggaaacattcagattaaatctgccaaaaaagctgaagttaaaagttctgaaaaagaaaaataa

SEQ ID NO: 2026 - DNA (genomic), 585 bp, Streptococcus pneumoniae; double-stranded, circular
  misc_feature (B) LOCATION 1...585
  hypothetical: NO
  anti-sense: NO
cataagtgtattattctttatatagataaaaatatagataaaagaaaggatactaatatggtattagcgattattttagtaacattccttattcgattgatttttttaaagcgttcgatagagaatgagaaacgaatccttagcaatggcgggaaagaatttggagttgagaatacaaaacgattaacgttggctcatattgttttttatctctcttgcctcgttgaagcaatggtgcataagacaatgtttgatggtatgagcatggttggtttagtcttgcttattttttctatgctgatgttgatgttggtgattcacttgttgggagatatttggacagtgaagcttatgcttgtcaataatcacaaatatgtagatcatatcttgtttaggacagtaaaacatcctaattactttttaaatattttacctgagttgattggcttgaccttgttgagtcatgcctatatgacttttgttttagtctttccagtttatgcagttattttgtatcgacgaatagctgaagaggaaaagctattacatgaagttataatcccaaatggaagcataaagagataa

SEQ ID NO: 2027 - DNA (genomic), 1176 bp, Streptococcus pneumoniae; double-stranded, circular
  misc_feature (B) LOCATION 1...1176
  hypothetical: NO
  anti-sense: NO
ggagagtgtatgagatatttaactgcaggagaatcacacggcccccgtctaacagctattattgagggaattccagctggacttccattgacagctgaggatatcaatgaggaccttagacgccgtcagggtggctacggtcgtggtggtcgtatgaagattgagagtgaccaggttgtctttacttcgggcgttcgccacgggaagacgacaggggcgcctattactatggatgtcatcaataaggaccaccagaaatggctggacatcatgtctgcggaggacattgaagaccgccttaaaagcaagcggaaaattactcatcctcgcccaggtcatgccgatttggttggggggattaagtaccgttttgatgatttgcgaaattctttggagcgttcatcagctcgtgaaaccaccatgcgggtggcagttggtgcagtagccaaacgcctcttggctgagctggatatggagattgccaaccatgtcgtggtctttggtggtaaggaaatagatgttcctgaaaatctgacagtcgctgaaattaagcaaagagctgcccagtctgaagtttctattgtcaaccaagaacgagaacaggaaatcaaggactatattgaccaaatcaaacgtgatggtgataccatcggtggggttgtggagacagtcgtcggaggcgttccagttggtcttggttcctatgtccaatgggatagaaaattggatgcaagattggctcaagctgttgtctctatcaatgcctttaaaggggtggaatttggtcttggctttgaggctggttatcgtaaaggcagccaagttatggatgaaattctctggtctaaagaagacggttatactcgccgtaccaataatctaggtggttttgaaggtggtatgactaatgggcaacccatcgttgttcgtggggtcatgaaacccattcctactctttataaacctcttatgagtgtggatatcgaaacccacgaaccttacaaggcaaccgtggagagaagtgatccgactgctcttccagctgcaggaatggtcatggaagcagttgtagcaacggttctggcgcaagaaatcctcgaaaaattctcatcagataatcttgaggaactaaaagaagcggtagccaaacaccgagactatacaaagaactattaa

SEQ ID NO: 2028 - DNA (genomic), 1476 bp, Streptococcus pneumoniae; double-stranded, circular
  misc_feature (B) LOCATION 1...1476
  hypothetical: NO
  anti-sense: NO
aggaggtgtatcgtgtctagaaaacaagaacaaatggaaacgttgttgctccttttgcgagatagtaaggattatatatctgctaaagtattgggagaaaaattaaattgctctgataaaacggtttatcgccttgtcaagggaatcaacaaagattgtccggtagaagcattcattttatctgaaaaaggcagaggtttcaaattaaatccaagaagttccctcgtggacgttgatgggaattttacagaggcttttgatcctgaagtaaggcgtgaaaaattactagaacgtctcttgttgactgctcctaagccacattctatttatgatttaggagaggaattctacgtaagcgagtcagtagtactaaaagatcgtcagatattacaagagagtctagcaatttatgggttagatttaaaaatgagacaacgaaagctttttattgatggggatgaggctcaaattcgttcagccattctaaatctactgccaatgtttaatcagttggatttagagcaaattacacagaataaggttcagcctcttgacggagaacttgctcacttttgtttgggattactgattacacttgagagagaattgggggtaaacattccctatccatataatataaatattttctctcacctgtatatttttatcagtaggaatcgtcgtagtactagtattcatgttgtagcaccttcaaaacctactattgttgatgagaaaatttacagtgtctgtcaaaaaattattcaagaaattgaacaatattttaggatgaaggttgatgcagttgagattgactatctttatcaatacgttgtatcttcgagattgcaaaaaccattttcttccgggaagcttcctttttctcagcgagttttagatgtcactcattactattttagccgtatgtgtatggacaatagagagattgaaacgacagatcctgactttgttgacttggcgagtcatatcagtcccttactgaggagattagataatagagtacagattaagaatagtcttttatcacaaattcttttaacctatcctaatctggttaaagagttaacaactatttctaaagaagtgagtctagtatttggttttgcttccttgagtctggacgagattggttttctagtcttatattttgcacggtttcaagaaaagcgagcacgtcctctaaaaacagtagtgatgtgtacatcaggtgtcggaacttcagagcttttacgagcacgattagaaaagcaattttctgaattggatattattgatgtagttgcttatcatcaattagatgagctgataaatctatatccagatttagatttcattgtgacgacggtagctttgcaggaaccagcaagtgtcccgtttgtcctagttagtgtttttctaaccgagggtgataaacaacgtcttcaagcaaaaattcaggagataaactatgaataa

SEQ ID NO: 2029 - DNA (genomic), 654 bp, Streptococcus pneumoniae; double-stranded, circular
  misc_feature (B) LOCATION 1...654
  hypothetical: NO
  anti-sense: NO
ggacagctcttatgcaggcagaaaatgtggcccagagaatcaaggagttgcagattgacaaaggttaaaatttgtggactatcgaccaaagaagcggtggaaacagccgtttcagcaggagccgactatatcggttttgtctttgcacctagtaaaagacaggtgactttagaagaggcagctgagttggcaaagcttattcctgcagatgtgaaaaaggttggagtatttgtttcaccaagtcgggtagaactgctggaagcgattgacaaagttgacttggacttggttcaagttcacggtcaggtggcagatgatttatttgagaatttgccttgtgccagtattcaggctgtgcaggtagatggaaatgggcatgtccccaattctcaggcagattatctactctttgatgcccctgtggcaggaagtggccagtcctttgattggggtcaactggatacgactggactagcacagcccttctttatcgcaggtggccttaatgaagataatgtagtaaaagcaattcaacattttactccctatgcagtagatgtatcgagcggagtggagacagatggacaaaaagatcatgaaaagattagaagatttatagagagggtaaagcatggcatatcaggaaccaaataa

SEQ ID NO: 2030 - DNA (genomic), 558 bp, Streptococcus pneumoniae; double-stranded, circular
  misc_feature (B) LOCATION 1...558
  hypothetical: NO
  anti-sense: NO
gagaatagtatggaaatcaaatttacaattaaacaagttgttgctgtcggaattggcgctgccctctttgtcgtcatcgggatgatcaacattccaacccctgttccaaatacaagcatccagcttcagtatgcggtacaagcgctactttctattatttttggaccgattatcggtttgcttgtcgggttgattggtcatgcaatcaaagactctcttgttggttatggtctatggtggacttggattatctctagcggactctttggtttagttgtgggactttttagaaagtacgttcgcgtgatcaatagtgtttttgactggaaagatattcttatttttaatctcattcaactacttgcaaatgcccttgtttggggtgtcttggcaccacttggagatgttgtgatttatcaagaagcggcagaaaaagtatttgcacaagggattgttgcgggaattgccaatggtgtatctgtagctattgcaggaactcttctcttacttgcctatgcaggaacccaaactcgtgcaggaagtttgaaaaaggactaa

SEQ ID NO: 2031 - DNA (genomic), 573 bp, Streptococcus pneumoniae; double-stranded, circular
  misc_feature (B) LOCATION 1...573
  hypothetical: NO
  anti-sense: NO
gggaatagtatgatttatttaagaaagttaaagagagaagatttgatgtctttatgggaaatggcttattcacaacttaatccagtttggaaacagtatgatgctccctattatgatgattatcagtatttttcaaattttaaagaattcgaactacaaaaatcagaatccattttaagcaactcaaatcgccttggtatttttgttgatgataaactagttgggactgtttcgcgttattgggtatgtaaacaaacaagatggatggaattgggaattggtatttatgataaaaaattctggaacactggtattgggaaagttgctatgttgcagtggatagataggacgtttcaggattacttggagttggagcatctgggtttgacaacttggtcaggaaatcttggtatgatgaaacttgctgaaaaattaagaatgaaaaaagaagctcatattccaaaagttcgttattatcaaggtaaatattttgatagtattaaatatggtattttgagagaagactgggagaaaatgaatgacggttattatcaaatcaatggaaactcctga

SEQ ID NO: 2032 - DNA (genomic), 795 bp, Streptococcus pneumoniae; double-stranded, circular
  misc_feature (B) LOCATION 1...795
  hypothetical: NO
  anti-sense: NO
atggatagtatgattttagggcgttatatcccaggggattcgattgttcaccgattggatccacgtagcaaattgcttgctatgatgctactgattttgattgtgttttgggctaataaccccttgacgaatctgattctttttatagcgacagggatatttattgccttgtcaggagtatctctttcattttttattcagggcttgaagtctatgtttttcttgattgccttcacaactatttttcaactatttttcatttctaatgggaatgttttatttgagttttcgtttgtgagaatcacggattatgctttgcaacaagctgggattattttttgtcgctttgtattgattattttcttttcaactttgttaaccttaacaaccatgcctttaagtttggcatcagctgtcgaagctttattagcacctttaaagcgtgtgaaagttccagttcatgaaattggattgatgctgtctatgagtttgcgttttgtcccaaccttgatggatgatacgacgcggattatgaatgcacagaaagctcgtggagtggattttggagaaggaagcatcgttcaaaaagtaaaggcgatgattcccattttgattcctctttttgcgacaagtttaaaacgtgcagattccttggctatcgctatggaagcgcgtggctatcagggtggaaaaggcagaagtcaataccgacaattgaaatggactctaaaggatacgctgaccattcttgttattctcgtacttggttgttgtttatttttcttaaaatcttag

SEQ ID NO: 2033 - DNA (genomic), 267 bp, Streptococcus pneumoniae; double-stranded, circular
  misc_feature (B) LOCATION 1...267
  hypothetical: NO
  anti-sense: NO
tattacagtatctgggagaagatgatgccagctaatacgaaagttatttttcaagaaatgtttgcggattttcagaactattatgttctgattgggggaactgctacctctatcgtattggattcgcaaggatttaaaagtcgcacaacaaaagattatgatatggtcatcattgatgaagtaaaaaataaggaattttatactacctggaatcattttttagaattgggagagtatcaaggaagtcagaaagatgagaaagcgtag

SEQ ID NO: 2034 - DNA (genomic), 396 bp, Streptococcus pneumoniae; double-stranded, circular
  misc_feature (B) LOCATION 1...396
  hypothetical: NO
  anti-sense: NO
tnagtaagtattattgctactatattagttttattttttaataaaagactagaaattattgaacttggtgaagaaatagcaatcggacttggagcaaatcccgagctttcaaggcttgttttaattttttgcgctgtatctttaactgctttttctacttcaattacaggaccaatagcttgtatatcttttttagctggcccaatagccttaaatattggcaagaaaagaagtccaatattagctggattggttggaattttactagttttgttatcagacatattctctcaaaatattttaccagctagatatccagtaggtgttgtaactgcattgttagtttcacaatacttaatatacttactaataaaaatgaacaggaggaatatataa

SEQ ID NO: 2035 - DNA (genomic), 189 bp, Streptococcus pneumoniae; double-stranded, circular
  misc_feature (B) LOCATION 1...189
  hypothetical: NO
  anti-sense: NO
gacaaaagtataatattaaatataaaaagcgaacaaaatcagttatctgacactcagaattctgtcttgttcgcttttttgtctaatctatcgattttaaaaatttataataaagaattcctaaaatcaaaatctttttatcccagactcttttcttttaagccgaatactttttacaaacatttttga

SEQ ID NO: 2036 - DNA (genomic), 1488 bp, Streptococcus pneumoniae; double-stranded, circular
  misc_feature (B) LOCATION 1...1488
  hypothetical: NO
  anti-sense: NO
atgaaaagtataaaattaaatgctctatcttacatgggaattcgtgtcttgaatattatttttcccatcctaactggaacctatgtcgcgcgtgtcttggaccgaactgactatggttacttcaactcagtcgacactattttgtcatttttcttgccctttgcaacttatggtgtctatagctacggtttaagggctatcagtaatgtcaaggataacaaaaaagatcttaacagaaccttttctagtcttttttatttgtgcatcgcttgtacgattttgaccactgctgtctatatcctagcctatcctctcttctttactgataatccaatcgtcaaaaaggtctaccttgttatggggattcaactcattgcccagattttttcaatcgaatgggtcaatgaagctctggaaaattacagttttctcttttacaaaactgccttcatccgtatcctgatgctggtctctattttcttatttgttaaaaatgaacacgatattgttgtctatacacttgtgatgagtttatcgacgctgattaactacctgattagttatttttggattaaaagagacatcaaacttgttaaaattcacctaagtgattttaaaccactctttctccctctgacagccatgttagtctttgccaatgccaatatgctcttcacttttttagatcgcctcttcctcgttaaaacagggattgatgtcaacgttagttactataccatagctcagcgaattgtgaccgttatagctggggttgtaacaggtgcaattggagtgagtgtgcctcgtctcagttactatctggggaaaggagacaaagaagcctatgtttctctggttaatagaggtagtcgaatctttaacttctttatcattccactgagttttggactcatggttttaggaccaaatgccatcctactttacggtagtgaaaaatatatcggaggcggcatcttgacctctctcttcgcttttcgtacgattatcctggccttagataccattcttggttcccaaattctctttaccaatggctatgaaaaacgtatcacagtctatacagtctttgctgggctactcaatttgggcttgaatagtctcctttttttcaaccatatcgtggctcctgaatactacttactgacaactatgctatcagagacttctctacttgttttctatatcattttcatccatagaaaacaactcatccacttgggacatatctttagctatactgttcgatactctctcttttcactttcctttgtagcaatttatttcctgattaatttcgtgtatcctgtagatatggtcattaatttgccatttttgattaatactggtttgattgtcttgctatcagctatctcttatattagtctacttgtcttcacaaaagatagcattttctatgaatttttaaaccatgtcctagccttaaaaaataaatttaaaaaatcatag

SEQ ID NO: 2037 - DNA (genomic), 1473 bp, Streptococcus pneumoniae; double-stranded, circular
  misc_feature (B) LOCATION 1...1473
  hypothetical: NO
  anti-sense: NO
aaggaaagtatgtcaattacatcatttgtaaaaagaattcaagatatcactcgaaacgatgctggtgttaatggtgatgctcaacgtattgagcaaatgtcttggttattattcttaaaaatttatgatagccgtgaaatggtttgggaattagaagaagacgagtatgagtcaattatcccagaggaattaaaatggcgaaattgggctcatgctcaaaatggggaacgggtattgacaggcgatgaattacttgattttgtcaataacaagttattcaaagagttgaaagagcttgaaataacttcaaatatgcctattcgaaaaacgattgttaaatcagcttttgaagatgcgaacaactatatgaaaaatggcgtcttgttacgccaagtcatcaatgttattgatgaagttgatttcaatagccctgaagatcgtcattcgtttaatgatatttacgaaaaaattcttaaagatattcaaaatgctgggaactcaggagaattttatacgccacgtgcagcgactgattttattgccgaagttcttgacccaaaacttggagaatcaatggcagaccttgcttgcggaacaggaggcttcttgacttcgactctgaaccgtttaagtagtcaacgtaaaactagtgaagataccaaaaaatataatacagctgtttttggtattgaaaagaaagcatttcctcatcttttagcagttacaaatctgtttcttcacgaaattgatgaccctaaaattgttcatggaaatactttggagaaaaatgttcgtgaatatacggatgatgaaaaatttgacattattatgatgaatccaccttttggagggtcagaattagaaacaataaaaaataactttccagcagaattacggagttctgaaacagctgatttatttatggctgtcattatgtatcgtttgaaagaaaatggtcgtgttggagttattttacctgatggttttctatttggtgaaggtgtaaaaactcgcttgaaacaaaaactggtagatgagttcaacttacatacgattattaggttgcctcatagtgtctttgcaccgtatacaggaatccatacgaacattcttttctttgataaaacaaagaaaacagaagaaacttggttttatcgtttagatatgccagatggttataaaaatttctcgaaaactaagccgatgaagtcagaacacttcaatcctgttcgtgactggtgggaaaatcgtgaagagattctggaaggtaagttctacaaatctaaatcatttacacctagtgaattggctgagttgaattataatttagaccagtgtggctttccaaaagaggaagaggaaatcttaaatccctttgagttgattcagaattatcaagcggaaagagcaactttaaatcataagattgataatgtattagctgatattttgcagttgttggaggacaaataa

SEQ ID NO: 2038 - DNA (genomic), 996 bp, Streptococcus pneumoniae; double-stranded, circular
  misc_feature (B) LOCATION 1...996
  hypothetical: NO
  anti-sense: NO
gaggaaagtattatgatccaacatccacgtattgggattcgtccgactattgatggtcgtcgtcaaggtgtacgcgaatcacttgaagtacaaacaatgaacatggctaaaagtgtggcagatttgatttcaagcacattgaaatatccagatggggaacctgtggaatgtgtgatttctccatctaccattggtcgtgttccagaggctgcagcttcccatgagttgtttaaaaaatcaaatgtttgcgcaacaattacagttacaccatgctggtgttatggtagtgaaactatggatatgtctccagatattcctcatgctatttggggatttaatgggacagaacgcccaggagctgtctatcttgcagctgtactagcttcacatactcaaaaagggattccagcctttgggatttatggtagagatgttcaggaagctaatgatacagctattccagaagatgtcaaagaaaaacttttacgttatgcgcgggcagctcttgcaactggcttgatgagagacactgcttacctatcaatgggtagtgtttcgatggggattggtggttctattgtaaatccagatttcttccaagaatacttaggaatgcgaaatgaatcggtagatatgacggagttcacgcgccgtatggaccgtggtatttacgaccctgaagagttcgaacgtgcgctcaaatgggtgaaagaaaacgtaaaagaaggattcgaccataaccgtgaagaccttgttttaagccgtgaagaaaaagatagacaatgggaatttgttattaagatgttcatgattggacgtgacttaatggttggtaacccaagacttgctgaacttggttttgaggaagaagcagttggtcaccatgctttagtagctggtttccaaggtcaacgtcagtggacagaccattttccaaatggggactttatggaaactttcctcaatactcagtttgactggaatggtattcgataa

SEQ ID NO: 2039 - DNA (genomic), 2421 bp, Streptococcus pneumoniae; double-stranded, circular
  misc_feature (B) LOCATION 1...2421
  hypothetical: NO
  anti-sense: NO
tatggaagtatgataaggaataaaaaacaagattatgtactggcctacaagcaaccagcttcaaccacttacatgggttgggaagaagaagctttaccgataggtaatggttctttaggagcaaaagtatttggccttatagggtctgaacggattcaatttaatgaaaaaagtctctggtctggaggtccacttcctgatagttcagattatcagggtggaaatcttcaggatcagtatgtttttttagctgagattcggcaggctttggagaagagagattacaatctggctaaggaactggctgagcagcacctaattgggccaaaaacgagtcaatatgggacctatctgtcttttggggatattcacattgagttcagccagcaaggtacgactttgtctcaggtgacggactatcagagacagttgaatattagtaaggcacttgcgacgacttcttatgtctataagggaacgcgatttgaacgtgaagcttttgcgagttttccagatgatctcttggttcaatgttttactaaggaagggttggaaactctagattttactatagaactatccttgacctgtgatttggcttctgatggaaagtatgagcaggaaaaatctgattacaaggagtgtaagttggatattactgattctcatatcttgatgaagggaagagttaaggataatgatctgcggtttgctagttatctagcttgggaaacggatggagatattagagtttggtcagatagggttcagatatcaggagccagttatgccaatctcttcttggccgctaagacggattttgcccaaaatcctgctagcaattatcgcaagaaactagatttagagcaacaggtgatagacttggtggacacagctaaagaaaagggctatacccaattgaaatcaaggcatatcgaggactaccaagccttattccagcgtgttcaattggatttggaagctgatgttgacgcatccactacagatgatttgttaaaaaattataagccacaagaagggcaggctttggaggagctgttcttccagtatggacggtatttattgattagttcgtccagagactgcccagatgctctaccagctaacctacagggagtctggaatgcggtcgacaatcctccttggaattcggactatcacttaaatgtcaatctgcagatgaattattggccagcctatgttaccaatctcctagagacggtctttccagtcatcaactatgtagatgatttgcgtgtctatggtcgtctagcggctgtaaagtatgcaggaatcgtctctcagaaaggtgaggaaaatggttggttggttcatactcaagcgactccctttggttggacggcacctggttgggattactattggggttggtcaccagctgccaatgcgtggatgatgcaaaccgtttatgaagcctattcattttatagggaccaagactatcttagggagaaaatttatcccatgttgagggaaacggttcgtttttggaatgcctttttacataaggatcagcaggcgcagcgttgggtgtcttctccgtcttattccccagaacatgggccgatttcgattggcaatacctatgaccaatctctgatttggcagttatttcatgattttattcaggctgctcaggaattgggactggatgaggacttgttgactgaggttaaggagaagtctgatttactaaatcctttgcaaatcactcaatctggtcgaatcagggagtggtatgaggaggaagagcagtattttcaaaatgagaaagtggaggcccagcatcggcacgcttcccatctagtgggactctatcctggcaatctctttagctacaagggacaagagtatattgaagcggcgcgtgctagcctcaatgatcgtggagatggcggcacaggctggtccaaggctaataagatcaatctctgggcgcgtttgggagatggcaatcgagcccataaattattggcagagcagttaaagacatccaccttgcaaaatctttggtgtagccatcctccttttcagatagatggtaattttggtgctactagtggcatggcagaaatgttactccagtctcatgcagcttatctggtacctctagctgccctacctgatgcttggtcaacaggttctgtttcaggcttaatggcacgtggacattttgaagtgagcatgagctgggaagataaaaaactcttacagttgaccattttatcaaggagtggaggagatttgcgagtttcttatccagatattgagaagagtgtgattaaaatgaatcaagaaaaaataaaagcgaaatgcatggggaaagattgtatttcggtggcaacagcagaaggtgatcttgttcaattttatttttaa

SEQ ID NO: 2040 - DNA (genomic), 1158 bp, Streptococcus pneumoniae; double-stranded, circular
  misc_feature (B) LOCATION 1...1158
  hypothetical: NO
  anti-sense: NO
gtggggagtatagttatgaaattgaagtttcttataacaaatttgtttcatgttcttttgtctaatctgattacaattcttacatcagttatagttgtactaattttaccaaaaattatgggagtaactgagtatagttattggcaactatatattttttacctaacatatattggtttttttcatctgggatggattgatggaatttatcttaaatatggcggattagagtaccagaacttagataagaaacagttttattctcaaatacttcaattttccagttttttaattttaatttcttttctattatttggttttaacttattgactgtgacagatcaaaatgcaaaatatatttataacatgactattattagtatgatagttacaaatttaagaatgttattcgtttatattttgcagatgacaaatcgattaaaggatagttccatcattctaatcagtgatcgcgttatatatgttattcttttattcctgtttattatatttaaatggcatgaatacaaggtaatgatttgggcagatgttttgggaaggacattttctctcctactttctttttggatttgtaaagatattgtttttcaatccttatccgagtttatattggatctgagagagtcttttgacaatatccgtgttggaatcaatttaatgttatccaatattgcaagtagtatgattattggtattgttcgaatgggaattcaatggaattggaatatcgaaacattcgggaaagtatcactgacgctaagcatctctaatttattaatgacttttattaatgcgattggtttagttgtttttcctttgttaaaacggacaaaaacggaaaatttatctaaaatttattccaacttaaaaaatgtattgatgcttatcatgttcgcgatattgctcatttactatcctttaaaaattgtgttatacctctggttgtcagcctatcaagatgccttgattttcatgaaccttattttccctatgtcagtctatgaaagaaaaatggcattggtcattaatacttacttaaagggcttaaaaatggagagagatattctcaaaataaatactttgattatgttgttcagtatgttagtttacctaaataactactctattattaaatag

SEQ ID NO: 2041 - DNA (genomic), 984 bp, Streptococcus pneumoniae; double-stranded, circular
  misc_feature (B) LOCATION 1...984
  hypothetical: NO
  anti-sense: NO
aattatggtataatattagcaataaaagaaatctggaggattagaatcatggtatcaacgaaaacacaaattgctggttttgagtttgacaattgcttgatgaatgcagcaggtgtggcttgtatgacgatagaggagttagaagaggtcaaaaactcagcggcaggaacctttgttactaagacagcgaccttggacttccgtcaggggaatcctgagccacgctaccaagatgttccacttggttccatcaactctatgggcttgccaaataatggcttagactattatttggattatcttttagatttgcaggaaaaagagtcgaaccgaactttcttcttatctctggtcggcatgtctccagaggaaacccatactattttgaaaaaagtccaagagagtgattttcgtggtctgactgagctaaatctttcctgtccaaatgttccaggtaaacctcagattgcctatgattttgagacaacagaccggattttggcagaagtgtttgcttacttcaccaaacctcttggaattaaattgccaccttattttgatattgttcactttgatcaagcggcagctattttcaacaaatatccgctcaagtttgtcaactgcgttaactctatcggaaacggcctctatatagaagacgaatctgtcgttattcggcctaagaatggttttggtggaattggtggagaatacatcaaaccgactgctctagccaatgttcacgccttttatcaacgtttaaatcctcaaatccaaattatcggaacaggtggcgttctgactggtcgagatgcctttgaacacatcctctgtggagcaagtatggtgcaggtgggaacgacccttcacaaagaaggcgtcagtgcttttgaccgcattaccaatgaactgaaagcaatcatggtggaaaaaggctacgagagcttagaagatttccgtgggaaattgcgctatattgactaa

SEQ ID NO: 2042 - DNA (genomic), 264 bp, Streptococcus pneumoniae; double-stranded, circular
  misc_feature (B) LOCATION 1...264
  hypothetical: NO
  anti-sense: NO
atctacggtatccatgttgccaagattgctggcttgccagcagaccttttagcaagggcggataagattttgactcagctagagaatcaaggaacagagagtcctcctcccatgagacaaactagtgctgtcactgaacagatttcactctttgatagggcagaagagcatcctatcctagcagaattagctaaactggatgtgtataatatgacacctatgcaggttatgaatgtcttagtagagttaaaacagaaactataa

SEQ ID NO: 2043 - DNA (genomic), 240 bp, Streptococcus pneumoniae; double-stranded, circular
  misc_feature (B) LOCATION 1...240
  hypothetical: NO
  anti-sense: NO
ataataggtattttcataggcaacaggattcacggttttatggattttcatactagctccaatctcaaagaatgtactaatactcttcgaaaatctcttcaaaccgcgtcaactttatctgcaacttcaaagcagtgctttgaacagcctgcggctagctttctagtttgctctttgattttcattgagtataaattaagtatagcacagttagggagaataggtaaggatttaaaatga

SEQ ID NO: 2044 - DNA (genomic), 279 bp, Streptococcus pneumoniae; double-stranded, circular
  misc_feature (B) LOCATION 1...279
  hypothetical: NO
  anti-sense: NO
gataggggtatgaatctgaaagtgaaacaaaaaataccattaaaaatcaagcgcatgggaattaacggtgagggaatcggcttttaccaaaaaacattagtctttgtaccaggagctctcaaaggcgaagatatctattgtcagattacttctattagacgcaactttgttgaagcaaaattactgaaggtcaacaagaagtctaaatttcgaattgtgccatcttgtactatttataatgaatgcggaggctgcgcaaatcatgcacctgcattatga

SEQ ID NO: 2045 - DNA (genomic), 1884 bp, Streptococcus pneumoniae; double-stranded, circular
  misc_feature (B) LOCATION 1...1884
  hypothetical: NO
  anti-sense: NO
ggtactatctttccctactttttttgctataatggaactatgaacaacttgattaaatcaaaactagagctcttgccgaccagccctggttgctacattcataaggataaaaatggcaccattatctatgtaggaaaggctaaaaatctgcgtaatcgagtacggtcctattttcgtggaagtcataataccaagacagaggctctggtgtctgaaattgtggattttgaatttattgttacggagtctaatattgaggcacttctcctagaaattaacctgatcaaggaaaacaagcccaagtacaatatcatgctcaaggatgacaagtcctatcctttcatcaaaatcaccaatgagcgctatccacgcttgattatcactcgtcaggtcaaaaaggacggaggtctttattttggaccctatcccgatgtgggggcagccaatgaaatcaagcggttgctggatcggatattcccttttcgtaagtgtaccaacccgccctctaaggtctgtttttattaccatatcggtcaatgcatggcccacaccatctgtaagaaggatgaggcttatttcaagtctatggctcaggaggtgtctgattttctgaaaggtcaggatgacaaaatcatcgatgatctcaagagtaaaatggcagtagcagcacaaagtatggagtttgaacgtgcggcggaataccgtgacctgattcaggctattggaacgcttcgaaccaagcaacgggtcatggcgaaagatttgcaaaatcgcgatgtctttggctactatgtggataagggctggatgtgtgtgcaggttttctttgtccgtcagggtaagcttatcgagcgcgatgtcaatctcttcccctacttcaatgatccagatgaggattttttgacctatgtaggacaattctatcaagaaaaatctcatctagttcccaatgaggtactgattccgcaggatattgacgaagaggctgtcaaggccttggtggattccaagattcttaagcctcaacgtggagagaaaaaacaactggtcaatctagccataaaaaatgctcgtgttagtctagagcagaagttcaatctgctagaaaaatctgtcgaaaagactcaaggagctattgaaaatctagggcgtttgctccaaatcccgaccccagtacgtatcgagtccttcgataactctaatatcatgggaactagccctgtttcggctatggtggtctttgtcaacggtaaaccgagtaagaaggattaccgtaagtacaagataaaaacggttgttggaccagacgactatgccagcatgagagaggtcattcgcagacgctatggtcgagtacagcgtgaggctttgactcctccagatttgattgtgattgatggggggcaaggtcaagtcaatatcgctaagcaggttatccaagaggaactgggcttggatattccaattgctgggctgcaaaagaatgataagcaccaaacccatgaattgctctttggagatccgcttgaggtggtggacttgtctcgcaattctcaggaatttttcctcctccaacgcatccaagatgaggtgcaccgctttgctatcactttccaccgccaactgcgctccaaaaattctttctcatctcaattggatgggattgacggtctgggacctaaacgcaagcagaatcttatgaagcatttcaagtctttgaccaaaatcaaggaagccagtgtggatgagattgtcgaagttggggtacctagagtcgttgcagaggctgtgcaaagaaagttgaacccgcagggagaagccttgcctcaagtagcagaagaaagagtagattaccaaacggaaggaaaccacaatgaaccataa

SEQ ID NO: 2046 - DNA (genomic), 498 bp, Streptococcus pneumoniae; double-stranded, circular
  misc_feature (B) LOCATION 1...498
  hypothetical: NO
  anti-sense: NO
ctccaaatcttccaaggttttattagccaatttagcatagttgtgggatttttctacacggaaatagacatccccttgactctcataggcaaagcctttctcgatcaagtcttccacaaaacggatgatgtctgccataaactccactacacgcggatggcgagtcgcaggtttcacgcccaatgccgtcacatcctcacgaaaggcagcgatgtacttatccgcaacctcctgaggtgtgatgccttcttccctggcacggttgataatcttatcatccacatctgtaaaattggaaatataggcaaccttatacccacggtactcaaaatagcgacgaatcgtatcaaaagctaccgtcgaacgggcgtttcccacgtgaatatagttgtacacggttggcccacaaacatacatcttgatcttgccgtcctcaatcgggacaaattctcgcaaatcacgagacatggtgtcatagattttaatcataaatcataa

SEQ ID NO: 2047 - DNA (genomic), 1368 bp, Streptococcus pneumoniae; double-stranded, circular
  misc_feature (B) LOCATION 1...1368
  hypothetical: NO
  anti-sense: NO
ggaaaaatcttaatgtatcaagcactttatcgaaaatatagaagtcaaaacttctcccagttagttggtcaagaagttgtggctaagactcttaaacaagcggtggagcaagagaaaataagtcacgcttatcttttttctggtcctcgtggaacgggaaaaaccagtgttgctaaaatctttgccaaggctatgaactgtcccaatcaagtgggtggcgaaccttgcaataactgctatatttgtcaagcagtgacggacggtagtttagaagatgtcattgaaatggatgcagcttctaataatggggtagatgaaattcgcgaaattcgtgataaatctacctatgcgcctagccttgctcgttataaggtttatatcatagatgaggttcacatgctgtctacaggggcttttaatgccctcctaaagacgctggaagaaccaacacagaatgtagtctttattttggccactactgaattgcacaagattcctgctactattctatcccgtgtgcaacgttttgagtttaaatcaattaagacacaggatattaaggaacatattcactatatcttagaaaaagaaaatatcagttctgaaccagaggctgtggaaatcattgccagacgggcggaaggtggaatgcgggacgccttgtctattttggatcaagccctgagtttgacacagggaaatgagctgacgactgctatctctgaagaaattactggcaccattagcctatcagccttggatgattatgtggcggccttgtctcaacaggatgttcccaaagctttgtcttgcttgaatcttctttttgacaatggtaagagcatgactcgttttgtgaccgatcttttgcactatttaagagacttgttaattgttcaaacagggggagaaaatactcatcatagttcagtctttgtagaaaatttggcacttcctcaaaaaaatctgtttgaaatgattcgcttagcaacagtgaatttagcagatattaagtctagtttgcagcccaagatttatgctgaaatgatgaccgtccgtttggcggaaatcaagcccgaaccagctctatcaggagcggttgaaaatgaaattgctacgctgagacaggaagttgcccgtctcaaacaagagctttctaatgcaggtgcggttcctaaacaagttgcaccagctcctagtcgaccagctacgggcaaaacagtctatcgtgtcgatcgcaataaagtgcaatctatcttacaagaggccgtcgaaaatcctgatttaacacgtcaaaatctaattcgtttgcagaatgcatggggagaggtaattgaaagtctaggtgggccggacaagctctgctag

SEQ ID NO: 2048 - DNA (genomic), 213 bp, Streptococcus pneumoniae; double-stranded, circular
  misc_feature (B) LOCATION 1...213
  hypothetical: NO
  anti-sense: NO
gtccctttcattataccacaaactagccaccctgaccagtttgttctacactttcagggatggaatagacagcaaaaagaaccctgcttttctgaaaaagaggtctccttgctaagtttatactcaatgaaaatcaaagaacaaactaggaagctagccacaggttgctcaaagcaccgctttgaggttgcagataaaactgacacggtttga

SEQ ID NO: 2049 - DNA (genomic), 348 bp, Streptococcus pneumoniae; double-stranded, circular
  misc_feature (B) LOCATION 1...348
  hypothetical: NO
  anti-sense: NO
agtattatcattgttattaacatagaggaggaaaacataatggtgaagattggtttgttttgtgcagcaggtttttctactggtatgcttgtaaataatatgaaaattgcagcgcaagctagtggagttgaggcagaaatagaggcgttttctcagtctaaattagcggattatgcgccaaatatagatgttgcactattgggtccacaagttgcttatacattagataaatcaaaagaaatttgtgataagtgtgatgttccgatagctgttattccgatgatggactatggtatgttagatgggaaaaaagtattagatttggccctatctttgattagtgggtaa

SEQ ID NO: 2050 - DNA (genomic), 714 bp, Streptococcus pneumoniae; double-stranded, circular
  misc_feature (B) LOCATION 1...714
  hypothetical: NO
  anti-sense: NO
gcggttatcatgcccaatcacgaggggctggacttgcagttgccaaagaagtgtgtttatgcattggtaggtgaggagattgaccgctatgcaagggaagtaggggcggattgtgtcggcgaattcgtttctgctaccaagacctatccagtctatgtcatcaactacaagggtgaggaggtctgtctggctcaggctcctgttggctccgctccagcagcccagtttatggattggttgattggctatggtgtggagcagattatctctactgggacctgtggtgtcctagctgatatagaggaaaatgcctttctagtccctgttcgcgctttgcgagatgagggagccagttaccactatgtggcaccttgtcgttatatggaaatgcagccagaggctattgctgctattgaggaagttttggaagacagagggattccttatgaagaagtcatgacctggacgacagacggtttttaccgagaaacggctgaaaaggtggcttatcgtaaggaagaaggctgtgctgttgtggagatggagtgttctgctcttgcggcagtagctcaattgcgtggggttctctggggtgaattgttgttcacagcagattctctagcggacttggaccagtacgacagtcgtgactggggctcggaagcttttaataaggcgctagaactgagtttagcaagtgttcaccacctttag

SEQ ID NO: 2051 - DNA (genomic), 555 bp, Streptococcus pneumoniae; double-stranded, circular
  misc_feature (B) LOCATION 1...555
  hypothetical: NO
  anti-sense: NO
gagcctatcatggagtttgaagaaaaaacgcttagccgaaaagaaatctatcaaggaccaatatttaaactggtccaagatcaggttgaattaccagaaggcaagggaactgcccgacgggatttgattttccacaatggggctgtctgtgttttagcagtaacggatgaacaaaaacttatcttggtcaagcagtaccgcaaagctatcgaggctgtctcttacgaaattccagccggaaaattggaagtaggagaaaacacagcccctgtggcagctgcccttcgtgaattagaggaagaaacagcctatacagggaaattagaactcttgtacgatttttattcagctattggcttttgtaatgagaagttaaaactatatttagcaagcgatttgacaaaagtggaaaatccgcgtccgcaggatgaggatgaaaccttggaagtccttgaagtgagcttagaagaagcgaaagaattaatccaatcaggtcatatctgtgatgccaagacaattatggctgttcagtattgggagttgcagaaaaaatag

SEQ ID NO: 2052 - DNA (genomic), 246 bp, Streptococcus pneumoniae; double-stranded, circular
  misc_feature (B) LOCATION 1...246
  hypothetical: NO
  anti-sense: NO
gggactatcatatgcggcttttttaggtattttattccaaagtatgtaagcgagtctcgtgtactgtatttggattcagatattgttgtaagaaaatcgatagatgagctgtgggatttggacttgacggctatacccttagctgcagttagagatgatttttatacacataattttaattctggtgttctgttaatcaacgatggcatgtggagagcagaaaatgtcacgcaagacctgatttaa

SEQ ID NO: 2053 - DNA (genomic), 999 bp, Streptococcus pneumoniae; double-stranded, circular
  misc_feature (B) LOCATION 1...999
  hypothetical: NO
  anti-sense: NO
agggatatcatgaaatacattatcaatcattcaaatgacactgcttttaatattgccttggaagaatacgcctttaaacaccttttggatgaggatcaaatcttcctactttggattaacaagccatctatcattgttggtcgtcaccagaacactatcgaagaaatcaaccgtgattatgttcgcgaaaatggtattgaggtagttcgccgtattagtggtggtggagctgtttaccacgatttaaataacctcaactacacgatcatctccaaagaagatgaaaataaggcatttgacttcaagagcttctcaactccggttatcaataccctggctcaactcggggttaaagctgagttcacaggtcgtaatgaccttgagattgatggtaagaagttctgtggcaatgcccaagcctatatcaacggccgtatcatgcaccacggttgcttgctctttgacgttgatttgtcagtcctcgcaaatgcccttaaggtttcaaaagataaatttgaatcaaaaggtgtgaaatccgtccgtgcccgtgtaactaatattatcaatgaattaccaaaaaaaatcacagtcgaaaaattccgtgatttactcttggaatacatgaaaaaagagtacccagagatgactgaatacgtcttttcagaagaagaattggccgaaatcaatcacatcaaggatactaagtttggaacttgggactggaactatggtaaatcacctgaatttaacgtccgtcgtggaaccaaattcactagtggtaaggttgaagtctttgctaacgttactgaatcaaaaatccaagacatcaagatttatggtgacttctttggtattgaagacgttgctgcagtagaagatgtccttcgtggggtgaaatacgaacgcgaagatgttcttaaggcgctaaaaaccattgatatcacacgctacttcgctggtattagccgtgaagaaatcgctgaagcggtagttggataa

SEQ ID NO: 2054 - DNA (genomic), 213 bp, Streptococcus pneumoniae; double-stranded, circular
  misc_feature (B) LOCATION 1...213
  hypothetical: NO
  anti-sense: NO
tttttcatcataagaatatttttgatatccagcattgggccaatgacgagaaaagccagaactggagccaaaccgaaactcgagagtagagaagccccgataaaggcatccgcctcactacagagcgaaagaagaaaggccaaaatcatcaagagcaggatggcaaaaagaggagtcgcactgatagaggtcagaatccgagtcggaacataa

SEQ ID NO: 2055 - DNA (genomic), 1047 bp, Streptococcus pneumoniae; double-stranded, circular
  misc_feature (B) LOCATION 1...1047
  hypothetical: NO
  anti-sense: NO
gaggtcatcatggatattagacaagttactgaaaccatcgccatgattgaggagcaaaacttcgatattagaaccattaccatggggatttctcttttggactgtatcgatccagatatcaatcgtgctgcggagaaaatctatcaaaaaattacgacaaaggcggctaatttagtagctgttggtgatgaaattgcggctgagttgggaattcctatcgttaataagcgtgtatcggtgacacctatttctctgattggggcagcgacagatgcgacggactacgtggttctggcaaaagcgcttgataaggctgcgaaagagattggtgtggactttattggtggtttttctgccttagtacaaaaaggttatcaaaagggagatgagattctcatcaattccattcctcgcgctttggctgaaacggataaggtctgctcgtcagtcaatatcggctcaaccaagtctggtattaatatgacggctgtggcagatatgggaccaattatcaaggaaacagcaaatctttcagagatcggagtggccaagttggttgtattcgctaatgctgttgaggacaatccatttatggcgggtgcctttcatggtgttggggaagcagatgttatcatcaatgtcggagtttctggtcctggtgttgtgaaacgtgctttggaaaaagttcgtggacagagctttgatgtagtagccgaaacagttaagaaaactgcctttaaaatcactcgtatcggtcaattggttggtcaaatggccagtgagagactgggtgtggagtttggtattgtggacttgagtttggcaccaacccctgcggttggagactctgtggcacgtgtccttgaagaaatggggctagaaacagttggcacgcatggaacgacggctgccttggccctcttgaacgaccaagttaaaaagggtggagtgatggcctgtaaccaggtcggtggtctatctggtgcctntatccctgtttctgagggtgaaggaatgattgctgcagtgcgcaaatggctctcttaa

SEQ ID NO: 2056 - DNA (genomic), 477 bp, Streptococcus pneumoniae; double-stranded, circular
  misc_feature (B) LOCATION 1...477
  hypothetical: NO
  anti-sense: NO
tttcccatcatcatgggctcaaaatccgactgggcaaccatgcaaaaaacagcagaagtcctagaccgcttcggtgtagcctacgaaaagaaagttgtttccgcacaccgtacaccagacctcatgttcaaacatgcagaagaagcccgtagtcgtggcatcaagatcatcatcgcaggtgctggtggcgcagcgcatttgccaggcatggtagctgccaanacaacctatccagtcattggtgtgccagtcaagtctcgtgctcttagtggagtggattcactctattctatcgttcagatgccgggtggggtgcctgttgcgaccatggctatcggtgaagctggagcgactaacgcagctctctttgccatccgtctcctctctgtagaagataagtccattgcggatgcacttgccaactttgctgaagaacaaggaaaaatcgcagaggagtcgtcaaatgagctcatctaa

SEQ ID NO: 2057 - DNA (genomic), 561 bp, Streptococcus pneumoniae; double-stranded, circular
  misc_feature (B) LOCATION 1...561
  hypothetical: NO
  anti-sense: NO
ggtagcatcatgaaatctattggtacgcaaatattacagacagaacgtttgattttaagaagatttgtggagagtgatgcagaagccatgtttcaaaattgggcttcatccgctgagaatctgacctatgttacctggaatccccatcctgatgtcgaaatcactcgaaactcgattcgcaattgggttgcttcctatactaatctcaactattacaaatgggccatttgtctaaaagaaaacccagagcaagtgataggagatatcagcatcgttaagatagacgaggctgatttaagctgtgaaatcggctatgtgctaggcaaggcttactggggacatggtatgatgacagaggccttgaaagctgtcttggacttttgttttactcaagcaggttttcaaaaggtcagagcacgttatgccagtctcaacccagcttcaggtcgtgtcatggaaaaggctggaatgtcctatctacaaaccattgttaatggtgtagagagaaaaggctatcttgcggatcttatttattatggtataagtagggaagaatgttga

SEQ ID NO: 2058 - DNA (genomic), 1455 bp, Streptococcus pneumoniae; double-stranded, circular
  misc_feature (B) LOCATION 1...1455
  hypothetical: NO
  anti-sense: NO
gtgttaatcatgagtagacgttttaagaaatcaggttcacagaaagtgaagcgaagtgttaatatagttttgttgactatttatttattgttagtttgttttttattgttcttaatctttaagtacaatatccttgcttttagatatcttaatctagtggcaactgcctttgttctactagttgccttaatagggctactctcgattatctataaaaaagctgaaaagtttaccatttttctgttggtgctctctattcttgtcagctcagtgtcgctctttgcagtacagcagtttgttggactgaccaatcgtttaaatgcgacttctaattactcagaatattcgctcagtgtcgctgttttagcagatagtgagattgagaatgttacgcaactgacgagtgtgacagcaccgactgggactgataatgaaaacattcaaaaactactagctgatatcaaatcaagtcagaatatcgatttgacggttaatcaaagttcgtcttacttgtcagcttacaggagtttgattgcaggagagactaaggccattgtcttaaatagtgtctttgaaaatatcattgaatcggagtatccagatcacgcatcgaagataaaaaagatttataccaagggattcattaaaaaagtagaagctcctaagacgtctaagaatcagtctttcaatatctatgttagtggaattgatacttatggtccaattagttcggtgtcgcgttcagatgtcaatatcttgatgactgtcaatcgagataccaagaaaattctcttgaccacaacgccacgtgatgcttatgtaccaatcgcagatggtggaaataatcaaaaagataaattgactcatgcgggcatttatggagttgattcgtccattcacaccttagaaaatctctatggagtggatatcaattactatgtgcgattgaacttcacttcgtttttgaaattgattgatttgttgggtggggtagatgtttataatgatcaggaattcacagctcttgctaataaaaaacactattctattggtaatgtccatttagattcagaagaggcactcgcttttgttcgtgagcgctattccctagcggatggtgatcgtgaccgtgggcgcaatcaacaaaaggtgattgtggctatccttcaaaaattaacttcgaccgaagtactgaaaaattatagtacgatcattgatagcttgcaagattctatccaaacaaacatgccacttgagaccatgataaacttggtcaatgctcagttagaaagtggtggaacgtacaaagtaaattcgcaagacttgaagggtaggggacggacggatcttccttcctatgcgatgccagatagtaacctctatgtgatggaaattaacgacagtagccttgcatctgtcaaaacggctattcaggacgtgttggagggcagatga

SEQ ID NO: 2059 - DNA (genomic), 768 bp, Streptococcus pneumoniae; double-stranded, circular
  misc_feature (B) LOCATION 1...768
  hypothetical: NO
  anti-sense: NO
tgtagaatcatggaaaaatttgaaatgatttctatcacagatatacaaaaaaatccctatcaaccccgaaaagaatttgatagagaaaaactagatgaactagcacagtctatcaaagaaaatggggtcattcaaccgattattgttcgtcaatctcctgttattggttatgaaatccttgcaggagagagacgctatcgggcttcacttttagctggtctacggtctatcccagctgttgttaaacagatttcagaccaagagatgatggtccagtccattattgaaaatttacagagagaaaatttaaacccaatagaagaagcacgcgcctatgaatctctcgtagagaaaggattcacccatgctgaaattgcagataagatgggcaagtctcgtccatatatcagcaactccattcgtttactttccttgccagaacagattctttcagaagtagaaaatggcaaactatcacaagcccatgcgcgttccctagttgggttaaataaggaacaacaagactatttctttcaacggattatagaagaagatatttctgtaaggaaattagaagctcttctgacagagaaaaaacaaaagaaacagcaaaaaactaatcatttcatacaaaatgaagaaaaacagttaagaaaactactcggattagatgtagaaattaaactatctaaaaaagacagtggaaaaatcattatttctttttcaaatcaagaagaatatagtagaattatcaacagcctgaaataa

SEQ ID NO: 2060 - DNA (genomic), 825 bp, Streptococcus pneumoniae; double-stranded, circular
  misc_feature (B) LOCATION 1...825
  hypothetical: NO
  anti-sense: NO
aaaggaatcattatggatcaactgcagattaaggatttggaaatgtttgcctatcatggtctttttcctagtgagaaagaattggggcagaaatttgtcgtttcagccatcctatcctatgatatgaccaaggcagctacagacttggatttaacagcctctgtccattacggagaattgtgtcagcagtggacgacttggtttcaggaaacgagtgaagatttgattgaaacggtagcctataaactggtggaacgtacctttgagtcttatcctcttgtccaagaaatgaagttggaactgaaaaaaccttgggcaccggtgcatttgtcactagatacttgctcggtaaccattcatcgccgcaagcaacgagcctttatcgccctaggaagcaatatgggagataaacaagcaaacttgaagcaagccattgacaaactgcgagctcgtggcatctatattctcaaagagtccagtgtcttagcgacggagccttggggtggagtggagcaggatagctttgccaatcaagtggttgaggtggaaacctggctaccagcacaagacttgttagaaaccttgttagccattgagtcagagctgggacgggtgagagaagtgcattggggacctcgtttgattgatttggacttgctctttgtggaggaccagatcctttatacagacgacctcatattgcctcatccttacatagcggaacgcctttttgtccttgagtccttacaggaaattgcgcctcattttatccatccgatattaaaacaaccgatccgtaacttgtatgatgctttgaaaaaatag

SEQ ID NO: 2061 - DNA (genomic), 216 bp, Streptococcus pneumoniae; double-stranded, circular
  misc_feature (B) LOCATION 1...216
  hypothetical: NO
  anti-sense: NO
tctacgatcatagtcttcttcagcttgttgatcagctggtttttctgcttttggttgttcagctggcttctctggttttggtgcgggagctggttgaggagccggcgctggttttggttgttcagctggtgcttctggggctggagtttctggagctggagctggtttttctggctcattaactgctttcttaaggtcagcttcagttttttctaa

SEQ ID NO: 2062 - DNA (genomic), 285 bp, Streptococcus pneumoniae; double-stranded, circular
  misc_feature (B) LOCATION 1...285
  hypothetical: NO
  anti-sense: NO
tcctggatcattctcatcaggattactctttactgctattttagaaactggggtggtttgatggaaagtattggtcttgttatcgtttcacattccaaacacattgcagaaggtgttgttgcactaattagtaaagtagctaaagatgttccgattacttatgtaggaggaaccgagggcggaggaattggaacgagttttgatcaagtagatagggttgtttccgaaaatccagcagatactttacttgccttttttgacctaggttctgctataaaatgttaa

SEQ ID NO: 2063 - DNA (genomic), 1017 bp, Streptococcus pneumoniae; double-stranded, circular
  misc_feature (B) LOCATION 1...1017
  hypothetical: NO
  anti-sense: NO
gcagggatcatagccttatccagttttgtattgatggcacttcgtttttcgagtatggtttatgatacaaatggggagcaggtcaagcagttatttggcggcgcaataccattttttagcctgaatgcatcttctttgtttatggcgattactattggattggttacagcagagatttatcgtatgtttatccagcgcggaattacgataaaaatgccaagtggtgtcccagatgtagtaagtaaatcattttcagctcttttacctggttttactacttttgttttgtgggctttggtcttaaaaggtcttgaagcggcaggagttgcaggaggtctcaacggattcctaggtgcaattgttggaacaccgcttaagttaattgcaggaacgcttccaggtatgattctatgtgttattgtaaactcattcttttggttctgtggagttaatgggggacaagttttaaatgcttttgtagacccagtttggttacaatttactacagaaaaccaagaagctgtggctgcaggacaaacactccaacacattattacattaccgtttaaagatttatttgtatttataggtggcggtggagcgactattggtcttgcgatttgtctcttcctatttagtaagagtcgtgcgaataaaacattaggtaagctagctattataccgtctatttttaatatcaatacagctattctatttacgtttccaacagttttaaatccgattatgctgattccgtttattgctactcctacaatcaatgccttgattacctatgtatcaatggctgtaggattagtaccctatacaacaggtgtaatccttccgtggacaatgccaccgattataggaggcttccttgcaacaggggctagttggcgaggagctctattacaagttgttttgattttggtttctgtagcaatttattatccattcttcaaaattgcagataaacgcaatcttgaaaaagaaaaagctactgttggagggaaataa

SEQ ID NO: 2064 - DNA (genomic), 723 bp, Streptococcus pneumoniae; double-stranded, circular
  misc_feature (B) LOCATION 1...723
  hypothetical: NO
  anti-sense: NO
aatactgtcattttgaatataaaggagtttgatatggagtggattagattaataggaatagcaatcattgttgtgggttttattttaaaatttgatacaattgcaacagtagtcttagctggtttggttacagctttagtttcaggtgtttctctcgttgaatttttggagattttgggaaaagaatttagcaatcagcgagtgctcacgatttttatggttaccttgcctcttgtggggctgtcagaaacctttggactcaagcaacgatcaatcgatttgattcgaaagattaaaggtctgacagttggaaacttctatacagtttatttctttattcgagagttagctggtttcttttcaattcgtctaggaggacaccctcagtttgtcagacctttggttcagcctatgggagaagcagctgcagagtctcaattaggtagaaagttaacagaggttgaagatgagacaataaaagcgcgtgcggctgcgaatgaaaattttggaaatttctttgctcaaaatacgtttgtaggtgctgggggagtcctcttgatagggggaacattagatcagttaggctatgaaagcaattatgcagggattgcttctacatctattattgttgctgttataacacttattgtagtggggatttacaattatttatttgataaaaaattgatatcaaaaaagactaggggaggagaacaaaaatga

SEQ ID NO: 2065 - DNA (genomic), 516 bp, Streptococcus pneumoniae; double-stranded, circular
  misc_feature (B) LOCATION 1...516
  hypothetical: NO
  anti-sense: NO
aatagtgtcatgagtaaaatgtattatgcagaaaatcctgacgctgctcacgacattcatgagttgagagtggacttgttgggacaaaaaatgacctttttaacggatgcgggtgtttttagcaagaaaatagttgactttggaagtcaactattgctcaagtgtcttgaggtcaaccaaggagaaactgtccttgatgtaggctgtggttacggacctttgggtttgtccttagctaaggcttatggagttcaggctactatggttgatatcaacactcgtgccttggatttagctcggagaaatgctgaaaaaaataatgcaaaagcgacgattttccagtccaacatctatgaacaagttgaaggacattttgatcatgtcatttccaatcctcctatccgtgcgggcaagcaagtcgttcatgaaatcattgagaaaagtaaagatttcttggaaactggtggggatttgacaatcgtcatccagaaaaaaacaaggggctccaagtgctaa

SEQ ID NO: 2066 - DNA (genomic), 1422 bp, Streptococcus pneumoniae; double-stranded, circular
  misc_feature (B) LOCATION 1...1422
  hypothetical: NO
  anti-sense: NO
ggattagtcatggaaaatttacagtttaaagccttaccgaaggagtttttattaggagctgctaccgctgcttatcaagtagagggtgcaactagggtagatggtaaaggaataaatatgtgggatgtttatttgcaagaaaatagtccgttcttaccagatccagctagtgatttttattatcgttacgaagaggatatagctttggcggcagaacatggtttgcaggctttgcgtttatctatttcttgggttcgtatatttcctgatatagatggagatgctaatatattggctgttcgttattaccatagagtctttcagtcttgcttaaaacataatgtgattccgtttgtttctttacatcattttgattcgcctcagaaaatgttagaaacaggggattggttggatagagagaatattgatcatttcatacgatatgctcgcttttgtttccaagaatttacagaagtcaagcattggtttacaatcaatgaactgatgtctcttgctgcaggtcaatatataggaggtcagtttcctccaaatcatcattttcaattatctgaagcaattcaagcgaatcataatatgttgttggcgcatgctcttgcagtcctcgaatttcatcaattaggaattgagggagagataggttgtattcatgctttaaagccaggctatcctattgatgggcaaaaagaaaatattttggcagctaaacggtatgatgtttataataataaatttctattagatggaacttttttgggctactacagtgaggacacgctttttcacttgaatcaaatattggaagctaataattctagctttattattgaagatggtgatttagaaattatgaagagagctgcacctcttaatacgatgtttgggatgaattattatcgttcagaatttattcgtgaatacaaaggtgaaaatagacaagaatttaattcaacaggaataaaaggacagtcttcttttaaattaaatgctctaggtgaatttgtaaaaaaaactggtattccgacaacagattgggattggaatatttatcctcaagggttatttgatatgttgcttcgtatcaaagaagaatatcctcaacatccggtcatttatttaactgaaaatggtacagcccttaaagaagttaagccagagggcgagaatgatattattgatgacagtaagagaatccgttatattgagcaacatttacacaaagttttagaggctcgagatagaggagtcaatattcaaggctattttatatggtctttgcaagatcaattttcttgggcgaatggctacaataagcgatatggtcttttctttgttgattatgaaacacagaagagatatattaagaaaagtgctctttgggtaaaagggctaaaacggaattaa

SEQ ID NO: 2067 - DNA (genomic), 192 bp, Streptococcus pneumoniae; double-stranded, circular
  misc_feature (B) LOCATION 1...192
  hypothetical: NO
  anti-sense: NO
aagcaagtcatcaaaacaagagagtgttcacacactttaactgctaaaaaagaaaatgttgctcctcgtgaccaagaattttatgataaagcatataatctgttaactgaggctcataaagcctcgtttgaaaataagggtcgtaattctgattccaaaacccttagacaaattattagaacgcttgaatga

SEQ ID NO: 2068 - DNA (genomic), 489 bp, Streptococcus pneumoniae; double-stranded, circular
  misc_feature (B) LOCATION 1...489
  hypothetical: NO
  anti-sense: NO
aatagagtcatgaaaattaaagttgtaacagttgggaaactgaaagaaaagtatttaaaagatggtatcgcagagtattcaaaacgaatttctagatttgctaagtttgaaatgattgagttatcagatgaaaaaacaccagataaggccagtgaatcagaaaatcaaaagattttagaaatagaaggtcagagaattttatcaaaaattgctgaccgtgatttcgttattgtgttagccattgaagggaaaactttcttctcagaagaatttagtaagcagttagaagaaacttctataaaaggattttctactcttacttttattattgggggaagtttaggattgtcatcatctgtaaaaaatagagccaatctttctgtcagttttggtcgcctaaccttaccccatcagttaatgagactagttcttgttgaacaaatctatcgcgcttttacgattcagcagggattcccctaccataaatag

SEQ ID NO: 2069 - DNA (genomic), 864 bp, Streptococcus pneumoniae; double-stranded, circular
  misc_feature (B) LOCATION 1...864
  hypothetical: NO
  anti-sense: NO
aagttggtcatcggagagatatttattaaattaaagctgagtaataacagtatagaaagtaaggagagtaaaaatttgaagaaaaaatggttttttgcagattattatgacacaacaattattttacttgctttaatctctgttattctggtattacttggatttgctgaaatgattgatttggacaatccgccttatagtattattgatttagtaatctggggtgtttttgtaattgactatagttggcgcttttttacgactaaaagaaaatggcgctttattcttgaaaatatttttgatttattggctattctccctttaaatgctatttttacagtgtttcgattagggcgtatctttcgtttagctaaactaacaaaattactgaaactgactcgtttacttagaataattggacttacaggtaaattagaaagaaaaattagtagattcttacggacaaatggcctgatttatatcttgtatgttaatatctttattgttctagtagggagttcgattttatccgttgttgaagaaaaatccttctcagatagtctttggtgggctcttgtgacagtaactactgttggatatggggatattgttcctgcttccatttttgggaaatggctagcagttttactgatgcttgtcggtattggaacaatagggatgttaacaagtgccttgacgaacttttttgtaaaggataatccagatgaacagataaaacttgataaactcaaagatgaattatcgagccaaagaatattactagagaaacaatctacaaagatagaagaactacctttaatgatacccgatctgattgataaaaccttatccatatcaagatga

SEQ ID NO: 2070 - DNA (genomic), 891 bp, Streptococcus pneumoniae; double-stranded, circular
  misc_feature (B) LOCATION 1...891
  hypothetical: NO
  anti-sense: NO
tgggaggtcattcttatgactgaaaaactaatcaattcaaaaccaaatggtgtattcgcattgattctcattgagttgacaatcgtacttggtgtctttatatttataatgggtgttggttcggaaaacatttttggaattattatcggacctttactaatcgtaattgcagcgctaactcatgctggtttaaaagttgtcaaacctcaggaagctctggttctgacactctttggtaattatacaggtaccatcaaagaacctggtttttactttgtcaatcccttcagcgtagcagtcaaccctgcaaaccacactcgacttggacaaagtggtgatgttagcacaaaatctccttttttaggagctaaatcatcaaatgacaatgatgtaaatcttgaaattggcaagaaacacatttccctcaaagtcatgaccttgagcaattctcgtcaaaaaatcaatgattgcttaggaaaccctgtagaaatcggtatcgcggtaacttggagagttgtcgataccgctaaggcagtcttcaacgttgataactacaaagaatatctttcattgcaatgtgatagcgccctccgtaatattgtccgcatctatccttacgatgtgtctcctaatgtggatactacgggtgaacggcaagcaaatgaaagtagtctccgtggctctagcgaaattgttgctaaccgtattcgtgaaaaaatccaaagtcgtgttgaagatgctggcttggaaatccttgaagcacgtatcacttacctacctaatgctccaaaaattgctgccgttatgcttcaacgccaacaaacatctgccattattgatgcacgaaaaataaatgtaaatggtgctgtaggaatggttaaaatggcataa

SEQ ID NO: 2071 - DNA (genomic), 438 bp, Streptococcus pneumoniae; double-stranded, circular
  misc_feature (B) LOCATION 1...438
  hypothetical: NO
  anti-sense: NO
agacgggtcattattatccttcttggttcgcaccaaatggagattctacactttaaggagctttataaggaaaagaggctacaactgcaaggacaggggcaaaatggtaagggctatagtcaggcatttttattgggcttgacctttagttttgcttggacgccttgcgtggggccggttctggggtctgttttggccttggcggcttcaggtggttcangagcttggcagggagctggtctcatgttggtgtatacgctgggcttggcgctaccattcttgcttctagctctgacctctagttatgttttgaaacatttccgaaaacttcatccctatctcggaatcctcaaaaaagtgggtggttttctcattattgtgatgggactcttggttctgtttggaaatgcttcaattttaagtcaattatttgaataa

SEQ ID NO: 2072 - DNA (genomic), 1341 bp, Streptococcus pneumoniae; double-stranded, circular
  misc_feature (B) LOCATION 1...1341
  hypothetical: NO
  anti-sense: NO
ggtgattccatgaaaatagatataacaaatcaagttaaagatgaatttcttatatcattaaaaaccttgatttcctatccttcagtactcaatgaaggagaaaatggaacaccttttggacaagcaatccaagatgtcctagaaaaaactttagagatttgtcgagacataggtttcactacctatcttgaccctaaaggttattacggatatgcagaaatcggtcagggagcagagcttctggccattctctgtcatttggatgttgttccatcaggtgatgaagcagattggcagacaccgccatttgaagcaactatcaaagacggctgggtattcggacgtggtgtccaagatgataaaggtccttcgcttgcagctctctatgcagtaaaaagcttgctggaccaaggtattcagttcaaaaagcgcgtacgctttatctttggtaccgatgaggaaaccctctggcgctgcatggcacgctacaataccatcgaagaacaggccagcatgggctttgcacctgactcatcttttcctctgacctatgctgaaaaagggcttctacaggtcaaacttcatggccctggatcggatcaactagagcttgaagtaggaggcgcctttaacgttgtaccagacaaggccaactaccaaggtcccctctatgaacaggtttgtaacgatctcaaagaagctggttatgattaccaatccactgaacaaaccgtaacggttctcggagtgccaaagcatgctaaggatgctagtcaaggtatcaatgctgtcatccgactagctaccattcttgctcctctccaagaacaccctgctctcagctttcttgcaacacaagcaggtcaagacggcacaggaagacaaatctttggtgatatagcagatgaaccttctggtcacctatcctttaatgtcgcaggtctcatgatcaatcatgaacgttctgaaatccgtattgacattcggactcctgtcttagctgacaaggaagaactagtaaagttgcttacaagatgtgcacaaaactaccaactccgctacgaagagtttgactatctagcgcctctatacgtcgcaaaagacagtaaactcgttagcacactgatgcaaatctaccaagaaaagactggcgataacagtcctgctatttcatccggtggtgccacttttgctcgcaccatgccaaattgtgtagccttcggcgccttattcccaggagcgaagcagacagaacatcaggcaaatgaatgtgccgttctagaagatttgtaccgtgctatggatatttatgccgaagccgtctatcgacttgcaacttaa

SEQ ID NO: 2073 - DNA (genomic), 216 bp, Streptococcus pneumoniae; double-stranded, circular
  misc_feature (B) LOCATION 1...216
  hypothetical: NO
  anti-sense: NO
gggtgctccatattatgccgaggaccggaatcgaaccggtacgatcgttaccaatcgcaggattttaagtcctgtgcgtctgccagttccgccaccccggcctctctaagcgaacgacgggattcgaacccgcgacccccaccttggcaaggtggtgttctaccactgaactacgttcgcactgttttcttctatctaaaaatgccggctacatga

SEQ ID NO: 2074 - DNA (genomic), 216 bp, Streptococcus pneumoniae; double-stranded, circular; identical to SEQ ID NO: 2073
  misc_feature (B) LOCATION 1...216
  hypothetical: NO
  anti-sense: NO

SEQ ID NO: 2075 - DNA (genomic), 360 bp, Streptococcus pneumoniae; double-stranded, circular
  misc_feature (B) LOCATION 1...360
  hypothetical: NO
  anti-sense: NO
gatgttcccatggaaattccaattaagatcattcaggcaagcaagtctgatttgcctgagataggggcacttcagacctcgtcttttccagctgaaaagcagcaactttcccatattttagaagaaagtatccgtaagtgtgcggatacctttcttctagctagggatgaaaatcaacttttaggctatattttatcaagtccccagtcagacaatccgcaatgtctaaaagtacattctttagtcatcgagtctgaccatcagagacagggcttgggaacacttcttcttgcagccttgaaagaggtggcagttgagctggattacaaaggattcgtttggagatcatgtggagtcttc

SEQ ID NO: 2076 - DNA (genomic), 351 bp, Streptococcus pneumoniae; double-stranded, circular
  misc_feature (B) LOCATION 1...351
  hypothetical: NO
  anti-sense: NO
gcaaatcccattggaacaaaagtactatcaaatccaatagtaatagacttgttagactggtactttgaccaattatctccactagtttcgctagaatttttcccacaagctactaagaacaaagcagtcatcagactgactaatacaagcatccattttttcatccattttttcatccatttttcctcctatttaggttctactttcaataatacatctgcgatattttcagcaaactgcaaatcatgggtaaccacaatctgggtcatcccaagttccctattttgcaagattagcttctccacttccaaacgtaattctggatccagggcagaagttggttcatcgtag

SEQ ID NO: 2077 - DNA (genomic), 1500 bp, Streptococcus pneumoniae; double-stranded, circular
  misc_feature (B) LOCATION 1...1500
  hypothetical: NO
  anti-sense: NO
gaggatcccatgtctacagaacatatggaagaactaaatgaccagcagattgttcgccgtgaaaaaatggctgcgctccgcgaacaaggaatcgatcctttcggaaaacgttttgaacgtactgcaaattcacaagaattaaaagataaatatgccaacctcgataaagaacaattacacgataaaaacgaaacagctactatcgcaggacgcttggtaaccaaacgtggtaaaggaaaagttggttttgcccaccttcaagaccgcgaaggccagattcagatctacgttcgtaaggatgctgtcggtgaagaaaactacgaaatcttcaaaaaagcagaccttggtgacttccttggtgtcgaaggtgaagtgatgcgtacggatatgggagaactctctatcaaggcaacccacatcacacacttgtctaaggctcttcgtcctcttcctgagaaattccatggtttgacagatgttgaaacaatttaccgtaaacgttaccttgacttgatttctaatcgtgaaagctttgaacgctttgtcactcgttcaaaaatcatctctgaaatccgtcgttaccttgaccaaaaaggattccttgaagtggaaacacctgttcttcataatgaagccggtggtgctgctgcccgtccatttatcacccaccacaatgcccaaaacattgacatggtgcttcgtatcgcgactgagcttcacttaaaacgccttatcgtgggtggtatggaacgtgtctatgaaattggccgtatcttccgtaacgaaggaatggacgctactcataaccctgagtttacttctatcgaagtttaccaagcttatgcagacttccaagacatcatggacttgacggaaggcattatccaacacgctgctaaatcagttaagggcgatggcccagtcaactaccaaggtactgaaatcaagattaacgaaccatttaagcgtgttcatatggtggatgctatcagagaaattactggtgtcgatttctggcaagacatgactttagaagaagctaaagctatcgctgctgagaagaaagttccagttgagaaacactacactgaggttggtcacatcatcaatgccttctttgaagagtttgttgaagaaactttaatccaaccaacctttgtctatggacatccagtagctgtatctccactcgctaagaaaaatcctgaagaccaacgctttactgaccgtttcgagctctttatcatgactaaggagtacggtaatgcctttactgaactcaacgacccaatcgaccaacttagccgttttgaagcccaagctaaagccaaagaacttggtgatgatgaagcgacaggaatcgactatgactacattgaagctcttgaatacggtatgccaccaacaggtggtttgggaatcggtatcgaccgtctctgcatgctcctcactgatacaacaactatccgtgatgtattgctcttcccaacaatgaaataa

SEQ ID NO: 2078 - DNA (genomic), 288 bp, Streptococcus pneumoniae; double-stranded, circular
  misc_feature (B) LOCATION 1...288
  hypothetical: NO
  anti-sense: NO
gtacaccccatccattatcattgccctgaaaatatctcaaattttcaacgaaacagtcgaatcggtatttcgtttggaggaggacgagtgatgaacaagtataaagtgatttattatgtagtggtcatagctttattagtcagcgtatttctactgattgggatggacctaagctggtttaatccctatcaaagcgaccaatttgtttgggtctactttgctctcatcccagtaattgaatggattgaaaagaaatccaaaaatctagcaagtgaaaaaggagaatga

SEQ ID NO: 2079 - DNA (genomic), 594 bp, Streptococcus pneumoniae; double-stranded, circular
  misc_feature (B) LOCATION 1...594
  hypothetical: NO
  anti-sense: NO
gagaataccatgagttataaagatacggtacaaaaaatcctcgatgtaattggaggtgaaaaaaatgtcaatagagttacccattgtgtaacacgtttaagattagaattaaaagatgaaaatttagtcaatgatgatgatgtgaagaagataccaggtgtaataggtattatgaaaaagaatggacaatatcaaattatacttggtaatgatgtagctaattattataaagaattcgttaaacttggcaattttgaatccgattcagttgttcaagggcacaaagggaatattttagaaagaatcattgagtatatcgctggttccatgactccaatcattccagcaatgttagggggaggtatgctgaaagtcttggtaattattttaccaatgcttggtatattgcaatcagattctcagactattgcttttttgacattttttggggatgctccatattatttcttaccgctgttattagcttattctgcatcacaaaaattaaaagtaacatctacaatagctatgtctgtagcaggtgacttctccatccaaattttgttcaaatggtgcaatcaggaatcctcttag

SEQ ID NO: 2080 - DNA (genomic), 225 bp, Streptococcus pneumoniae; double-stranded, circular
  misc_feature (B) LOCATION 1...225
  hypothetical: NO
  anti-sense: NO
cggccaaccattctcgtgcatgtttgctgtgccccttgtagtacctatacactagaatatttgaccaagtatgcagatgtgaccatctattttgccaattctaatatccatcccaaggcagaataccataagcgggtctatgtcaccaagaaatttgttagtgattttaatgagcggacaggaaatacggttcagtacctagaagctccctacgaacccaattaa

SEQ ID NO: 2081 - DNA (genomic), 549 bp, Streptococcus pneumoniae; double-stranded, circular
  misc_feature (B) LOCATION 1...549
  hypothetical: NO
  anti-sense: NO
gagagaaccatgtctttaaaagatagattcgatagatttatagattattttacggaggatgaggattcaagtctcccttatgaaaaaagagatgagcctgtgtttacttcagtaaattcttcacaggaaccggctctcccaatgaatcaaccttcacagtcggctggtacaaaagagaacaatatcaccagacttcatgcaagacaacaggaattggcaaatcagagtcagcgtgcaacggataaggtcattatagatgttcgttatcctagaaaatatgaggatgcaacagaaattgttgatttattggcaggaaacgaaagtatcttgattgattttcagtatatgacagaggtgcaggctcgtcgttgtttggactatttggatggagcttgtcatgttttagctggaaatttgaaaaaggtagcttctaccatgtatttgttaacaccagtgaacgttattgtaaatgttgaagatatccgtttaccagatgaagatcaacagggtgagttcggttttgatatgaagcgaaatagagtacgataa

SEQ ID NO: 2082 - DNA (genomic), 192 bp, Streptococcus pneumoniae; double-stranded, circular
  misc_feature (B) LOCATION 1...192
  hypothetical: NO
  anti-sense: NO
ccgggaaccattgggcccggtttgggatttgggctgcgacccagggggtcttcgggatttaaaacaaagggattccggaatttggagggttggagaatttttaaccttggaaaggaggaaggggtgtattttaaaacaaccaaaaaaggtttgaaatccggggttccgggcaattttggtttctttccgtaa

SEQ ID NO: 2083 - DNA (genomic), 1083 bp, Streptococcus pneumoniae; double-stranded, circular
  misc_feature (B) LOCATION 1...1083
  hypothetical: NO
  anti-sense: NO
ttgcttgccatcctgaaaaagaactttgtaccaagctatgacgttgaaagttttgtaaactcaatcgaaaaacctcgtcgtatcatgctgatggttcaagctggacctggtacagatgctactatccaagcccttcttccacaccttgacaagggtgatatcttgattgacggaggaaacactttctacaaagatactatccgtcgtaatgaagaattggcaaactcaggtatcaactttatcggtactggagtttctggtggtgaaaaaggtgcccttgaaggtccttctatcatgcctggtggacaaaaagaggcctacgaattggtttcggatgttcttgaagaaatctcagctaaagcaccagaagatggcaaaccatgtgtgacttatatcggtcctgatggagctggtcactatgtgaaaatggttcacaacggtatcgagtacggtgatatgcaattgatcgcagaaagctatgacttgatgcaacacttgctaggcctttctgcagaggatatggctgaaatctttactgagtggaacaagggtgaattggatagctacttgatcgaaatcacagctgatatcttgagccgtaaagacgatgaagaccaagatggaccaatcgtagactacatccttgatgctgcaggtaacaagggaactggtaaatggacgagccaatcatctcttgaccttggtgtaccattgtcactgattactgagtcagtgtttgcacgctacatttcaacttacaaagaagaacgtgtacatgctagcaaggtgcttccaaaaccagctgccttcaactttgaaggagacaaggctgaattgattgaaaaaatccgtcaagccctttacttctcaaaaatcatttcatacgcacaaggatttgctcaattgcgtgtagcctctaaagaaaacaactggaacttgccatttgcagatatcgcatctatctggcgtgatggctgtatcatcccgtcctcgtttcttgcaaaagattacagatgcctacaaccgcgatgcagatcttgcccaccttcttttggacgagtacttcttggatgttactgctaa

SEQ ID NO: 2084 - DNA (genomic), 342 bp, Streptococcus pneumoniae; double-stranded, circular
  misc_feature (B) LOCATION 1...342
  hypothetical: NO
  anti-sense: NO
gaggctgccatgttagaattacgaaatatcaataaagtctttggagacaaacaaatcctgtctaatttcagtctaagtattcctgaaaagcaaatcctggctatcgttggaccttctggtggaggtaagacaactcttttacgtatgcttgcaggtcttgaaaccattgattcagggcaaatcttttataatggacaacctttagagctggatgaattgcagaagcgcaatctactgggatttgtcttccaagattttcaactatttcctcatctatcagttctggaaaatttgactttatcgcctgtgaagacccatgggaatgaagcaggaagaggctga

SEQ ID NO: 2085 - DNA (genomic), 249 bp, Streptococcus pneumoniae; double-stranded, circular
  misc_feature (B) LOCATION 1...249
  hypothetical: NO
  anti-sense: NO
ttaagtgccataatatccctctttttttcttcattaaatttatttaattatagcataaatattgatttcattcaatcttacattgatttagtgatttgttttagagaatttgttgtgttattccgtccttattttgccataaattgttttaagtgggacctcttatccttaccatttttacctcctaattttgagtataaaaaagacgatagagtttttaatttctatcgtctgagatttacatattaa

SEQ ID NO: 2086 - DNA (genomic), 381 bp, Streptococcus pneumoniae; double-stranded, circular
  misc_feature (B) LOCATION 1...381
  hypothetical: NO
  anti-sense: NO
ttaatagtcttcgaaaatctcttcaaaccacgtcagcgtcgccttaccgtatatatgttactgacttcgtcagttctatctgcaacctcaaaaccatgttttgagctgacttcgtcagtttcatctgcaacctcaaaaccatgttttgagctgacttcgtcagtttcatctacaacctcaaaaccatgttttgagctgacttcgtcagttctatccacaacctcaaaacagtgttttgagcaacctgcggctagcttcctagtttgcactttgattttcattgagtataaaaagatcttgggaaaagactcaatttcagtagaaaaggaagtaaatcttcccacaataaaacgcatagtatcaagttttttcaatacctga

SEQ ID NO: 2087 - DNA (genomic), 210 bp, Streptococcus pneumoniae; double-stranded, circular
  misc_feature (B) LOCATION 1...210
  hypothetical: NO
  anti-sense: NO
aaaaaagtctttaaaattataaaacgcatcatatcaagttttttcaaaaaccttgatatgatgcgttttattgtgggaatatttatttcattttctactaaaattatgtttttgaataacctctatcttagtagtttgtataatccccctcaatcagcttttacgataagctttaatactatgactataccattcttgcatttcttttga

SEQ ID NO: 2088 - DNA (genomic), 627 bp, Streptococcus pneumoniae; double-stranded, circular
  misc_feature (B) LOCATION 1...627
  hypothetical: NO
  anti-sense: NO
ggagtttacatgtcacaggataaacaaatgaaagctgtttctccccttctgcagcgagttatcaatatctcatcgattgtcggtggggttgggagtttgattttctgtatttgggcttatcaggctgggattttacaatccaaggaaaccctctctgcctttatccagcaggcaggcatctggggtccacctctctttatctttttacagattttacagactgtcgtccctatcattccaggggccttgacctcggtggctggggtctttatctacgggcacatcatcgggactatctacaactatatcggcatcgtgattggctgtgccattatcttttatctagtgcgcctatacggagctgcctttgtccagtctgtcgtcagcaagcgcacctacgacaagtacatcggctggctagataagggcaatcgttttgaccgcttctttatttttatgatgatttggcccattagcccagctgactttctctgtatgctggctgccctgaccaagatgagtttcaagcgctacatgaccatcatcattctgaccaaaccctttaccctcgtggtttatacctacggtctgacctatattattgactttttctggcaaatgctttga

SEQ ID NO: 2089 - DNA (genomic), 639 bp, Streptococcus pneumoniae; double-stranded, circular
  misc_feature (B) LOCATION 1...639
  hypothetical: NO
  anti-sense: NO
gagaattacatgaccaaatcagatacgattattgaactaaaaaaacagaaaattgtcgctgtcattcgaggaaatacaaaggaagaaggactacaagcctcgattgcttgtatcaagggcggtatcaaagctattgaaatcgcctataccaatcagtatgcaggacaaatcatcaaggaacttgtagacttgtatcaggacgatcagagtgtttgtatcggtgcaggtactgtgcttgatgccgtaactgctagagatgccattctagctggagcaaattacgttgtttctccatctttccatgctgaaactgcgaaaatgtgcaatctctacagcacaccgtacattccaggctgtattaccctcacagagatcacgactgcacttgaagccggtagtgaaatcatcaaactcttcccaggtagtactctcagtccagcatatatctctgcagtcaaggcaccgatcccacaagtttccgtaatggtaaccggaggagtcggcctaaacaacatccctcaatggttcgctgctggtgcagatgccgttggaattggtggcgaactcaataaactcgcttcccaaggcaactttgaccgcatcagcgagattgcccaacagtatattacactcagataa

SEQ ID NO: 2090 - DNA (genomic), 1167 bp, Streptococcus pneumoniae; double-stranded, circular
  misc_feature (B) LOCATION 1...1167
  hypothetical: NO
  anti-sense: NO
ttcttggtctttttgtttgcgctttcgcattatataataaacttacaaaaacaattcaaaaggagaacaattatggaagtcgtttcaagtgttctaaattggttttctagcaatattttgcagaatcccgcatttttcgtaggtttattggtgttgataggatatgcacttttgaaaaaacctgcccatgacgttttttcagggtttgttaaagcaacagtagggtatatgttgcttaacgtgggtgctggtggtttggttacaacctttcgtccaatcttagcagctcttaactacaaattccaaattggtgcagcggttatcgacccttactttggacttgctgcagcaaacaacaaaattgtagcagagtttccagattttgttggaactgcaactacagctctattgattggttttggaataaatatcttgctcgtagctcttcgaaagattacgaaggtaagaaccctctttattactggtcacatcatggtacaacaagctgcaacagtatctcttatggttctattcttagtaccacaattgcgcaatgcttacggtacagcagcgattggtatcatctgtggactttactgggcagttagttcaaatatgactgttgaggcaactcaacgcttgactggtggtggcggatttgcgattggtcaccaacagcaatttgcaatctggtttgtagataaagtagcaggacgctttggtaagaaagaagaaagtttagacaatcttaaattacctaagttcctctcaatcttccacgatacagttgttgcatctgctaccttgatgctcgtattcttcggagccattcttttaatcttgggtccagacattatgtctaataaagaagtcatcacttcaggaactctattcaatcctgctaaacaagatttctttatgtacattatccaaacagcctttaccttctcagtttacttgttcgttttgatgcaaggtgtccgaatgttcgtatctgagttgacaaacgccttccaaggtatttcaaacaaattgttgccaggttcattcccagcggttgacgttgcagcttcttatggatttggttctccaaatgctgtcttgtcaggatttacctttggttttgattggtcaattgattacaattgttttgctcatcgtctttaa

SEQ ID NO: 2091 - DNA (genomic), 633 bp, Streptococcus pneumoniae; double-stranded, circular
  misc_feature (B) LOCATION 1...633
  hypothetical: NO
  anti-sense: NO
ataatggtcttgtcaaaaaaacgagcacgaaaggtgctagaagaaatcattgccctcttcccagatgccaagcctagtcttgattttaccaatcattttgaactcctggttgcggtcatgttatcagcccagacgacagatgcagcggtaaataaggccacaccaggtctctttgttgcctttccaacaccccaagctatgtctgtagcgacagagagtgagattgcttcacatatttctcgcttgggattgtatcggaataaagctaaattccttaaaaaatgtgcccaacagttactagacgattttgatggtcaagtccctcagacacgtgaagaattggagagtttggcaggtgttggtcgcaagacagccaatgttgtcatgagtgtaggatttgggattccagcctttgcagtggatactcatgtggagcgtatttgcaaacaccacgatattgtcaaaaaatcagcgacgccacttgaggtggaaaagcgggtcatggatatcttgccgcctgagcagtggttagatgcccatcaggccatgatttattttggaagagccatttgccatccaaaaaatccagagtgtgaccagtacccacaattatatgattttagcaatttgtaa

SEQ ID NO: 2092 - DNA (genomic), 354 bp, Streptococcus pneumoniae; double-stranded, circular
  misc_feature (B) LOCATION 1...354
  hypothetical: NO
  anti-sense: NO
ggagaacacatgatacaggcagtctttgagagagccgaagatggcgagctgaggagtgcggaaattactggacacgccgagagtggcgaatacggcttagatgtcgtgtgtgcatcggtttctacgcttgccattaactttatcaattctattgagaaatttgcaggctatgaaccaatcctagaattaaacgaagatgaaggtggctatctgatggttgaaataccaaaagatcttccttcacaccagagagaaatgacccagttattctttgaatcatttttcttaggtatggcaaacttatcggagaactcttctgagttcgtccaaaccagagttatcacagaaaactaa

SEQ ID NO: 2093 - DNA (genomic), 372 bp, Streptococcus pneumoniae; double-stranded, circular
  misc_feature (B) LOCATION 1...372
  hypothetical: NO
  anti-sense: NO
aaagttaacattcctaattctgaaagtacaaaacctaagacttttgaaattgattgtttagtcggagaaaaacacgcatacgaaataaaatggtgggatgcaactacagatggagaccatataactaaagaacacactagaataaaagttattcataacaaaggatatataccaattcggttaatgttctactatccaaatagaactcaagctataaaaattcagcaaactttagaaacattgtataacggtattggagggaaatattatggagattctgcctgggaacatttaagagcagtgaccggtattgatttacttagtattctaacagatattgcaaataaaaaaacaggggtaaaatcaaaatga

SEQ ID NO: 2094 - DNA (genomic), 216 bp, Streptococcus pneumoniae; double-stranded, circular
  misc_feature (B) LOCATION 1...216
  hypothetical: NO
  anti-sense: NO
gtgtgtaacatgcaactaaaaaatcgtctaaaagagcttcgagctcgcgagtggtctcaatcaaaccgacctagccaaactggcaggggtttcagacagaccattagcctactagagcgggatgagtacaccccatccattatcattgccctgaaaatatctcaaattttcaacgaaacagtcgaatcggtatttcgtttggaggaggacgagtga

SEQ ID NO: 2095 - DNA (genomic), 1623 bp, Streptococcus pneumoniae; double-stranded, circular
  misc_feature (B) LOCATION 1...1623
  hypothetical: NO
  anti-sense: NO
ggtaaaaacatggaaatcatgtcgcttgcgattgctgtttttgccgtcatcattggtttagtcattggatatgtcagcatctcagctaagatgaaatcatctcaggaagctgcagagttgatgcttttaaatgctgaacaagaagcaactaatttacgtggacaagctgagcgtgaagcggatttacttgttaatgaagccaaacgtgaaagcaagtctcttaaaaaagaagcactattggaggccaaagaagaagccagaaaataccgtgaagaagtggacgctgaattcaaatcagaacgtcaagaactcaaacaaatcgaaagtcgtttgacagagagagctactagccttgaccgtaaggacgacaatttgacgagtaaagaacaaacacttgaacaaaaagaacaaagtatttctgatagagcgaaaaaccttgatgcgcgtgaagagcaattagaggaagtcgaaagacaaaaagaagcagaactagagcgtattggtgctctgtctcaggcagaagcacgagatattatcttggctcagacagaggaaaacttgaccagggagattgccagtcgcattcgcgaagctgagcaagaggtcaaggaacgttctgacaaaatggccaaggacatcttggttcaagctatgcaacgtatcgctggtgaatatgtagcggagtcaacaaactcaacagttcatctgccagacgatactatgaagggacgcattattggtcgtgaaggtcgtaacattcgtacctttgaaagtttgacaggggtcgatgtgattatcgacgatacaccagaagtggtgaccttgtcaggatttgatccgattcgtcgtgagattgcccgtatgactatggaaatgttgctcaaagatggtcgtatacatccagctcgtatcgaagagttggttgagaaaaaccgtcaagagattgacaataagattcgtgaatacggtgaggctgctgcctatgaaattggtgcgccaaaccttcatccagacttgatgaagattatgggacgtttgcagttccgtacttcatatggacaaaatgttttgcgccattcgattgaggttgctaagttggctggtatcatggcgagcgaacttggtgaaaatgcggctcttgcccgtcgtgctggattccttcacgatatcgggaaagccattgaccatgaggttgaaggtagccacgttgaaatcggtatggaattggcccgtaagtacaaggaacccccagttgtggtgaatacgattgctagtcaccacggagatgttgaagctgagagcgtgatagcagttatcgtcgctgcagcagatgccttgagcgcagcccgtccaggtgctcgtagtgagtctcttgaaagctacatcaagcgtctccatgatttggaagaaattgctaacggctttgaaggagtgcaaactagctttgcccttcaagcaggacgtgaaattcgtatcatggtcaatccaggaaaaatcaaggacgacaaagtcacaatcttggctcacaaagttcgtaagaaaattgaaaacaatctcgattatccaggaaatatcaaggtaaccgtgattcgcgagcttcgtgcagtagattatgctaaataa

SEQ ID NO: 2096 - DNA (genomic), 1257 bp, Streptococcus pneumoniae; double-stranded, circular
  misc_feature (B) LOCATION 1...1257
  hypothetical: NO
  anti-sense: NO
gaaaaaaacatagaaagtaagtatatggcactaacaacactcacgaaagaagagtttcagacttattctgatcaggtttcttctcgttcctttatgcaatctgtccagatgggggatttgctagaaaaaagaggggctcgaattgtttatcttgctttgaaacaagaaggagaaattcaagttgcagctctggtttatagcttgcccatgctgggtggtctgcatatggaactcaattcggggccgatttatacccaacaagatgctcttccagttttttatgcagagttaaaagaatatgccaagcaaaatggtgtattagagttgcttgtaaaaccttatgaaacttatcaaacttttgatagccaaggtaatccaatagatgctgagaaaaaaagtattattcaaggtttgactgatttaggttatcaatttgatggcttaacaacaggttacccaggtggagaaccagattggttatactataaagatttaactgaattaactgaaaagagtttgcttaaaagttttagcaaaaagggtaaacccttggtgaaaaaggctgaaacctttggcattcggttgaaaaagttaaaacgtgaagaactatcgatttttaagaatataacaaaagaaacctctgaacgtagagaatatagtgataaaagtttagaatattatgagcatttttatgatacttttggagaacaagcggagtttctcatagcaagcttgaatttttcggagtatatgagcaaattgcaaggtgaacaaagtaaactagaagaaaaattggacaagttgcgacttgatttgagtaaaaatcctcattctgagaaaaaacaaaatcaactgagagaatattctagtcaatttgaaacgtttgaagttcgaaaagcagaagcgcgagacttgattgaaaaatatggagaagaagatattgttttagctgggagtttatttgtttatatgcctcaggaaacgacttatctctttagtggttcctacactgagtttaataagttctatgcccctgcactgcttcaaaaatatgttatgttggaaagcataaaacgtggaatacctaaatacaacttcctaggcattcaagggatttttgatggaagtgatggtgttttgcgttttaaacagaattttaatggctatattgtacgcaaagcaggtactttccgttaccatccatcgcctttaaaatacaaagctatccagttactcaaaaaaatagtaggacgttaa

SEQ ID NO: 2097 - DNA (genomic), 1005 bp, Streptococcus pneumoniae; double-stranded, circular
  misc_feature (B) LOCATION 1...1005
  hypothetical: NO
  anti-sense: NO
ggaaaaaacatgaatgtcaaaaagataatgtcaatttttcaatccttttatgttgatgtcagtattgaggaactgactttgactttaccaatcagttttgtaaaaaggtttgagtatactcaaatgacttttcataaggaatcatttttattgattaaagaaaagagaagggggagtttgagttcatttgttactcaggctcgcactatgggtgaaaaagccaatatggatgttgttttggtgttttcgaagttatcagacagtgaaaaaaagcaattacttcaagctagagttccgtttgtagactttaagggaaacctcttcttccctccattgggactagtactcaatgcgaatgatactgaaatccctaaggaattaacacctagcgaacaattaacgtggattgcctttttattgccaaaaggtcaaaaagtagtaaatgttgatttgctttcacacgtcactggacttccaaactcaacaatttataggtgtttgaggacttttaaagctttatattggttaaacaagcaaaataagctttacacatatacggtgtcaaagaaagaattattcttaaaatccgtgtcatgtttatttaatcccatcaaaaaacggattttattgccagatggcgatataaagcagataaaatctgtttctaaccttctatatggtggtgcttatgctttgtcgcattcaacttttttagctgaaacggatgaaaatactagctatgtcatatggcagagaaaattcaatcagttatccttgccactttctcagcatgttttaaaaggaaagatgctagagatatggaaatatcgtccttttgtatctgagttttggaatgattttaaaaataatcatgataaacaatttgtagatccgatttctctttatttgaccttaaaagatgatgatgacccacgtatagaggaagagagtgaagcactagaaaatatgatattacagtatctgggagaagatgatgccagctaa

SEQ ID NO: 2098 - DNA (genomic), 1095 bp, Streptococcus pneumoniae; double-stranded, circular
  misc_feature (B) LOCATION 1...1095
  hypothetical: NO
  anti-sense: NO
acagaaaacattccagagtcagacaagactttggaatgttttggctctataatttctgtagtgggtaatcccaccccaggaattatagggtcgtttcttgtagaaaaaaagccccatatgacctataatgaaaagcgtctaaccaactcattagaaagggttcatatggaacaacttaagaataccacagatttgctcggattggaagacaaaaatatcaaaatcttgtctgttctgaaataccaaacccatctagtcgttcagccaaagttggattcccccgctcctccttgtcctcattgtcaagggaagatgatcaaatacgacttccagaaagcctctaaaattccgcttctcgactgtcagggtttacccacggtactgcatctcaaaaagcgccgctttcagtgcaagaattgccttaaggtggtcgtttctcaaacatccattgtcaagaaaaattgccagatttccaacatggtgagacaaaaaatcgctcagctcctccttgaaaagcagtctatgactgagattgcccacagattggcggtctcaacttccaccgtcatccgaaaactgagggaatttaagtttgaaaccgattggaccaagttgccaaaagttatgagttgggatgagtatagcttcaaaaagagcaaaatgagcttcattgcccaagattttgagtccaaatccatcctcgcaattttagacgggcgaactcatgcggtgattcgaaaccatttccaacgctatcagagagaggttcgggagctggtcgaggtcatcaccatggacatgtacagcccttattatcggctcgctaagcaactctttccaaaggcgaagattgttcttgaccgcttccacattgtccaacatctgagccgagctatgaaccgagtacgaatccaaatcatgaaccaatttgaccgaaaatccttggagtatcgggcgctcaagcgcttttggaaccctcgctttttcgtttctaggctcgggctaaatcagtccactggactgatttactacaccaggatagcttcaagctctgtcagaaacgattctatcagcccacgtttcgaatgcacttaa

SEQ ID NO: 2099 - DNA (genomic), 1923 bp, Streptococcus pneumoniae; double-stranded, circular
  misc_feature (B) LOCATION 1...1923
  hypothetical: NO
  anti-sense: NO
gagagaaacatgatttatcattttactgaagaatacgatattattgtaattggtgcgggacacgctggggttgaggcttccttggccgctagccgtatgggctgtaaggtcctgcttgcgaccatcaatattgaaatgctggctttcatgccttgtaatccctctatcggtggttctgccaaggggattgtcgtacgtgaagtcgatgccctcggtggcgagatggccaagactattgacaagacttacatccagatgaagatgctcaacacagggaaggggccagctgtccgtgctcttcgtgcgcaggctgacaaggaactttactctaaggagatgcgcaagacagttgaaaatcaagaaaatctgacccttcgtcaaaccatgattgatgagattttggtggaagatggcaaggctgtcggtgtgcgtacagccacccatcaagaatatgctgctaaggctgttattgtgacgacagggactgctctccgtggggaaattatcatcggagacctcaagtactcatcaggtcctaaccacagcttggcttctattaacctagctgacaatctcaaggaactgggtctcgaaatcggtcgtttcaagacaggaacccctccacgtgtcaaggcttcttctatcaattacgatgtgacagaaattcagccaggagacgaagtgcctaatcatttctcatacacttcacgtgatgaggattatgtcaaggaccaagtaccatgctggttgacctataccaatggtaccagtcatgagattatccaaaacaacctccaccgtgcgcctatgtttacaggtgtggtcaagggagtgggacctcgttactgtccatcgattgaggacaagattgtgcgctttgcggacaaggaacgtcaccaactcttccttgagccagaaggacgcaatacagaggaagtctatgttcaaggactttcaaccagtctgcctgaggatgtccaacgtgacttggttcattccatcaaaggtctggaaaatgcagagatgatgcgaacaggttatgctattgagtatgatatggtcttgcctcatcagttgcgtgcgactttggaaaccaagaaaatctcaggtctcttcactgctggtcagacaaatggaacgtcaggttacgaagaggcagcaggccaagggattatcgcgggtatcaatgcggctctgaaaatccaaggcaagcctgaattgattctaaaacgaagtgacggttacattggggtcatgatcgacgacttggtgaccaagggaaccattgaaccttaccgtctcttgaccagtcgtgctgaatatcgtctcattcttcgccatgacaatgctgatatgcgcttgactgagatgggccgtgagattggccttgtggacgatgaacgctgggctcgttttgaaatcaagaaaaatcaatttgataatgagatgaagcgtctagacagtatcaaactcaagccagtcaaggaaaccaatgctaaggttgaggaaatgggcttcaagccgttgacagatgcggtgacagccaaggaattccttcgccgtccagaagtttcttaccaagatgtggtggccttcatcggaccagctgcagaggaattagatgacaagattatcgaattgattgaaacagaaatcaagtacgaaggttacatctcaaaagccatggatcaggttgctaagatgaagcgcatggaagaaaaacgtattccagccaatatcgactgggatgacattgattctatcgcaaccgaagcccgtcagaagttcaaactcatcaatccagaaaccatcggccaagccagccgtatttcgggagtaaacccagcagatatttctattttgatggtgtatctggaaggtaaaaatcgtagtatttctaaaactcttcaaaaatcaaaatga

SEQ ID NO: 2100 - DNA (genomic), 912 bp, Streptococcus pneumoniae; double-stranded, circular
  misc_feature (B) LOCATION 1...912
  hypothetical: NO
  anti-sense: NO
aagatgaacattcaacaattacgctatgttgttgccattgccaatagtggtactttccgtgaagctgctgaaaagatgtatgttagtcagccgagtctgtctatttctgttcgtgatttggaaaaagagttgggttttaagattttccgtcggaccagctcagggactttcttgacccgtcgtgggatggaattctatgaaaaatcgcaagaattggttaaaggatttgatatttttcaaaatcagtatgccaatcctgaagaagaaaaagatgaattttctgttgctagccagcactatgacttcttgccaccaactattacggccttttcagagcgctatcctgactataagaacttccgtatttttgaatcaactactgttcaaatattagatgaagtggcgcaagggcatagtgagattgggattatctacctcaacaatcaaaataaaaaggggattatgcaacgggttgaaaaattaggtctggaggtcatcgaattgattcctttccatacccatatttatctccgtgagggtcatcctttagcccagaaagaggaattagtcatggaggatttagcggatttaccaacggttcgtttcactcaagagaaagacgagtacctttattattcagagaactttgtcgataccagcgctagctcacagatgtttaatgtgacagaccgtgccaccttgaatggtattttggagcggacggacgcctatgcgacaggttctggatttttagatagtgacagtgttaatggtattacagttattcgtctcaaggataacctagataaccgcatggtctatgttaaacgtgaagaagtggagcttagtcaagctgggactctcttcgtagaagtcatgcaagaatattttgatcaaaagaggaaatcatga

SEQ ID NO: 2101 - DNA (genomic), 216 bp, Streptococcus pneumoniae; double-stranded, circular
  misc_feature (B) LOCATION 1...216
  hypothetical: NO
  anti-sense: NO
aacaagaacatggcaaggtgcagcaactggtgctgcgggaggagctatacttggaggtgtggcctatgcagcgacatgttggtggtaattatggattttaaaagttttattattggtttagtagttggtatatttggtccttatatggatgatttaattagaaaaaaatttttaaagtcttcggagaagaaaacagaaaaatctattaaaaaataa

SEQ ID NO: 2102 - DNA (genomic), 1449 bp, Streptococcus pneumoniae; double-stranded, circular
  misc_feature (B) LOCATION 1...1449
  hypothetical: NO
  anti-sense: NO
cttaatgacattgcccaagcagccacttcttttaataggggaaatggaagtcaggcagaacaacgtggagaactcgatttagaacgagataaggcaatgaaagcggtcagtgaatatgtaggaaaaatggtgagagatgcctatgtaaaatcagatagaaaacgacataaaaatactgtagctctagttaaccagttgggaaacattaagaacaggtatttgaatgaaatagttcattcaacctcaaaaagccaactacaggaactgatgatgaagagtcaatcagaagtagatgaagctgtgtctaaatttgaaaaggactcattttcttcgtcaagttcaggatcctccactaaaccagaaactccgcagccggaaaatccagagcatcaaaaaccaacaactccatctccggataccaaaccaagccctcaaccagaaggcaagaaaccaagcgtaccagacattaatcaggaaaaagaaaaagctaagcttgctgtagtaacctacatgagcaagattttagatgatatacaaaaacatcatctgcagaaagaaaaacatcgtcagattgttgctcttattaaggagcttgatgagcttaaaaagcaagctctttctgaaattgataatgtaaataccaaagtagaaattgaaaatacagtccacaagatatttgcagacatggatgcagttgtgactaaattcaaaaaaggcttaactcaggacacaccaaaagaaccaggtaacaaaaaaccatctgctccaaaaccaggtatgcaaccaagtcctcaaccagaggttaaaccgcagctggaaaaaccaaaaccagaggttaaaccgcaaccagaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcaaccagaaaaaccaaaaccagaggttaaaccgcaaccagaaaaaccaaaaccagataatagcaagccacaagcagatgataagaagccatcaactacaaataatttaagcaaggacaagcaaccttctaaccaagcttcaacaaacgaaaaagcaacaaataaaccgaagaagtcattgccatcaactggatctatttcaaatctagcacttgaaattgcaggtcttcttaccttggcgggggcaaccattcttgctaagaaaagaatgaaatag

SEQ ID NO: 2103 - DNA (genomic), 671 bp, Streptococcus pneumoniae; double-stranded, circular
  misc_feature (B) LOCATION 1...671
  hypothetical: NO
  anti-sense: NO
tgcatctgcatatgggtatttataagaggaattatgacatatttagacgcttttaaatcaggtaccttggttttaccgagtgccctgctcttgcattttaaggaactatttccttctagcgacgattttctggtttggcaatttttctatttgcaaaatacgacaggcttagaagaaatgtcgccaagccagattgctgaaaggattggcaaggaaatttcggatgtcaaccagtccatttctaatctgacggaaaggggactgctccagtatcgtactatcgaattaaatggcgaaattgaattgctctttgatgctagtttggccttggaacgtttggatgacctgtttggagcagttcattcaagttcagaccagctaacacctcaaaaccagctcaaggatttggtggaaaccttccagcaggagttgggacgattgttgacgccttttgagattgaggatttgaccaagacactaaaggaagatggaaccagtgctgacttgattaaggaggctcttcgtgaagctgttttgaatggaaaaccaaactggaagtacattcaggcgattttgagaaactggcgccatgaaggaatcaagagtgtggctcaaattgaggccaagagagcagaaagagaagcaagcaaccctcagtcttcaccacgggt

SEQ ID NO: 2104 - DNA (genomic), 2190 bp, Streptococcus pneumoniae; double-stranded, circular
  misc_feature (B) LOCATION 1...2190
  hypothetical: NO
  anti-sense: NO
aataaacgcatgaaattagataaattatttgagaaatttctttctctttttaaaaaagaaacaagtgaactagaggactctgattctactatcttacgtcgctctcgtagtgatcgaaaaaaattagcccaagtaggtccgattcgaaaattctggcgtcgttatcatctaacaaagattatccttatactaggtttgagtgcaggattgctagttggaatctatttgtttgctgtagccaagtcgaccaatgtcaatgatttgcaaaatgccttgaaaactcggactcttatttttgaccgtgaagaaaaagaggctggtgccttgtctggtcaaaagggaacctatgttgagctgactgacatcagtaaaaacttgcagaatgctgttattgcgacagaagaccgttctttctataaaaatgacgggattaactatggccgtttcttcttggctattgtcactgctggacgttcaggtggtggctctaccattacccaacagctggctaaaaacgcctatttatcgcaggatcaaactgttgagagaaaagcgaaagaatttttccttgccttagaattaagcaaaaaatatagtaaggagcaaattctaaccatgtaccttaacaacgcttattttggaaatggtgtgtggggtgtagaagatgcgagtaagaaatactttggagtttctgcatcagaagtgagtctggatcaagctgcgactctggcagggatgctcaaggggccggaactgtataatcccttgaattctgtagaagattctactaatcggcgcgatactgtcttgcagaatatggttgcagcaggatatattgataaaaaccaagaaaccgaagctgctgaagttgatatgacttcgcaattgcacgataagtatgaaggaaaaatctcagattaccgttacccctcttattttgatgcggtggttaatgaagctgtttccaagtataatctaacagaggaagagattgtcaataatggctaccgcatttacacagagctggaccaaaactaccaagcaaatatgcagattgtttatgaaaacatatcgctatttccgagggcagaggatggaacgtttgctcaatcaggaagtgtagctctcgaaccgaaaacagggggagttcgtggagttgtcggtcaagttgctgacaatgataaaactggattccggaatttcaactatgcaacccaatcaaagcgtagtcctggttctacaattaagcctttagttgtttatacgccagcagttgaagcaggctgggctttgaataagcagttggataaccataccatgcagtatgacagctataaggttgataactatgcagggatcaaaacgagtcgagaagttcctatgtatcaagccttggcagaatcgcttaatctacctgctgttgccactgttaatgatttgggtgtcgacaaggcttttgaggcaggcgaaaaattcggactcaacatggaaaaggtcgaccgtgttcttggtgtcgccttgggaagcggtgttgaaaccaaccctcttcaaatggctcaagcatacgctgcctttgcaaatgaaggtttaatgcctgaagctcattttattagtagaattgaaaatgctagtggacaagttattgcgaatcataaaaattcacaaaaacgggtgattgataagtctgtagctgacaagatgaccagtatgatgttggggactttcaccaacggtaccggtattagttcatcgcctgcagactatgtcatggcagggaaaactggaacaactgaagcagttttcaatccggagtacacaagtgaccagtgggtaattggttatactccggatgtagtgattagccactggcttggctttccgaccactgatgaaaatcactatctagctggctctacttcaaacggtgcagctcatgtctttagaaacattgccaataccattttaccttatacgccaggaagtacctttacggttgaaaatgcttataagcaaaatggaattgcaccagccaatacaaaaagacaagtacaaaccaatgataatagccagacagatgataatttgtctgatattcgagggcgtgcgcaaagtctagtagatgaggctagccgggctatctcagatgcgaagattaaggaaaaggctcgaacgctaaagtggtattcagta

SEQ ID NO: 2105 - DNA (genomic), 456 bp, Streptococcus pneumoniae; double-stranded, circular
  misc_feature (B) LOCATION 1...456
  hypothetical: NO
  anti-sense: NO
agagggcgcatagtcaatttaaaaatgaataaaaaagagagacttgaaaaaattagaagattggtgacagattatcaaatcggcacgcaagaagaaattgtagaacatttgaaagaagcaggtatcactgccactcaggcgacggtatcccgagatatcaaagagttaggtattgtcaaaattcctttgagagacaacacctatgtctacgaattgccaaaatcaatcgtaaaaagtctgcaactggctgaagacaatatcgaatcggctgaattgatggataagatgatcaatctccaagttattccaggaaatacggcttttgtaaaagctcagttaatcgatacttttgcagacaagatttttagttgtttgactgatgatagctcgattttagtcattgccagaagtggaagtctagcagaggaaatctttgaacaagtaaaaaattggtag

SEQ ID NO: 2106 - DNA (genomic), 1107 bp, Streptococcus pneumoniae; double-stranded, circular
  misc_feature (B) LOCATION 1...1107
  hypothetical: NO
  anti-sense: NO
gagattagcatgaccataacaggtattatcgcggagttcaatccttttcataatggccataaatacctgctggatcaggcagagggactgaaaattgttgccatgtcagggaatttcatgcagcgtggagagcctgctattgtggataagtggacaaggacccagatggcgctggaaaatggcgcagacttggtagtggaattgccctttttagtcagtgttcaggcagctgatttctttggtcaaggagctatggatatcttggatcgcttgggcattgatagtctagtttttgggacagaggaagttcgagattatcagaaaattgctgacttatacacagagaaaggtgctgagatggagaaatttgtggaaaatctgcctgattccctttcctatccccagaaaacccaagctatgtggaaggaatttgctggtcttgatttttcaggtaatacccccaatcatgttcttgctctggcctatgccaaggcggttgcaggacgaaatatcaagctgcatccgattcagcgtcagggggcaggttaccattctgtgaataaagatgtggactttgcctcggcgacagccctccgtcaacatcagaaggaccaagatttcttagaacgttttatgccttctgttgccctatttgagcaggccagtaaggtgatctgggaagactattttcccttgctccgctatcaaatcttgtcaaatcccgacctaaccaccatctatcaggtcaatcaagaaatggctgtgcgcattaaagaagctattaaaacagcccagtctgtggaagaattggtcgagttagtgactaccaaacgttacaccaaggcgcgtgtcagacgcctattgacctatattttggtgcaggctagagaaaatgtcttgccagaagccattcatgtccttggatttactgaaaaaggcaggcaacatctcaagtctctgaaaggacaggtcaatctagtcagccgaattggcaaagaaccttgggatgctatgactcaaaaggttgaccagatttaccaactaggaaagccaagtatagcagagcaaaattttggcagagtgccgattagaatagaaacaaactaa

SEQ ID NO: 2107 - DNA (genomic), 996 bp, Streptococcus pneumoniae; double-stranded, circular
  misc_feature (B) LOCATION 1...996
  hypothetical: NO
  anti-sense: NO
aggagtagcatggaaactgcattaattagtgtgattgtgccagtctataatgtggcgcagtacctagaaaaatcgatagcttccattcagaagcagacctatcaaaatctggaaattattcttgttgatgatggtgcaacagatgaaagtggtcgcttgtgtgattcaatcgctgaacaagatgacagggtgtcagtgcttcataaaaagaacgaaggattgtcgcaagcacgaaatgatgggatgaagcaggctcacggggattatctgatttttattgactcagatgattatatccatccagaaatgattcagagcttatatgagcaattagttcaagaagatgcggatgtttcgagctgtggtgtcatgaatgtctatgctaatgatgaaagcccacagtcagccaatcaggatgactattttgtctgtgattctcaaacatttctaaaggaatacctcataggtgaaaaaatacctgggacgatttgcaataagctaatcaagagacagattgcaactgacctatcctttcctaaggggttgatttacgaagatgcctattaccattttgatttaatcaagttggccaagaagtatgtggttaatactaaaccctattattactattttcatagaggggatagtattacgaccaaaccctatgcagagaaggatttagcctatattgatatctaccaaaagttttataatgaagttgtgaaaaactatcctgacttgaaagaggtcgcttttttcagattggcctatgcccacttctttattctggataagatgttgctagatgatcagtataaacagtttgaagcctattctcagattcatcgttttttaaaaggccatgcctttgctatttctaggaatccaattttccgtaaggggagaagaattagtgctttggccctattcataaatatttccttatatcgattcttattactgaaaaatattgaaaaatctaaaaaattacattag

SEQ ID NO: 2108 - DNA (genomic), 243 bp, Streptococcus pneumoniae; double-stranded, circular
  misc_feature (B) LOCATION 1...243
  hypothetical: NO
  anti-sense: NO
tctacgagcatagtcttcttcagcttgttgatcatctgttttttctgcttttggttgttcagctggcttgtctggttttggtgcgggagctggattctcaggctcttcagttggtttttctggttgaggagccggcgctggttgtggttgttcagctggtttttctttaactttatcttcttctgctgcttttcgtttagcttcttcttctgcttttttacgatctgtcttgattttttctaa

SEQ ID NO: 2109 - DNA (genomic), 1218 bp, Streptococcus pneumoniae; double-stranded, circular
  misc_feature (B) LOCATION 1...1218
  hypothetical: NO
  anti-sense: NO
aacaggagcattggtcaacaaggagggcctatgaaattatccaaccgtgttttagaaatggaagaaagtgtgactttggctgctggagcccgtgccaaagcactgaaggctgagggcagagatattttgtctctaaccttgggtgagccagatttcactactcccaaaaatatccaagatgccgccattgcatcgattcgagatgggcgtgcttctttttatacagtaacctcaggtctgccagagcttaaggcggtggtcaatagctactttgagcgcttttacggctattctgtagcgccaaatcaagtgacagtcgctgcgggagccaaatattctctctataccttctttatggctgtggtcaatccaggtgatgaagtcatcatcccaaccccatactgggttagctatggagatcaggtcaagatggcagaaggcgttcccgtctttgtttctgctaaggaagacaatcactttaaggtgaccgtagagcagttagaagcagctcgcactgacaagaccaaggttttggtgctgaattcgccatctaatcccacaggtatgatttacacccgtgaggaactcttggcaattggaaactgggctgtagaaaatgatattctcatcctagcagatgatatctatggccgcttggtttataatggtcatgagttcacaccgatttctagcctatcggaagcgattcgcaagcaaacagtggtcatcaatggtgtgtctaaaacctatgccatgactggttggcggattggttatgccgttggagaagcagacattatcgctgccatgtccaagattgcaggtcaaacaacttcgaatccgtcagcagtagcccaatatgcagcagttgaggctctatcaggtgagcaagatactgtagaaagcatgcgtcaggcctttgagaaacgtcttaataccatctatcccctccttgcagaggtgccaggatttgaagtggtcaaaccacaaggggctttctatctattcccaaatgtcaaaaaggccatggagatgaaaggctacacggatgtgacagactttacaactgctatattagaagaagccgaagtggccttggtaacaggagctggatttggagcaccagaaaatgtccgcctcagctatgcgacagacctagacacgcttaaagaagcagtcgaacgcttgaaagcatttatgggtagtgagaatgattga

SEQ ID NO: 2110 - DNA (genomic), 408 bp, Streptococcus pneumoniae; double-stranded, circular
  misc_feature (B) LOCATION 1...408
  hypothetical: NO
  anti-sense: NO
ttcattggcattcggagtttatctgagattggtaatccgggatggacccctcacccaaatagtgctctacctccaagaatctctaatgtcgacgctagccctaaagctatttcggagagaaccagctatctccaagttcgtttggaatttctccgctacccacaagtcatccaagcacttttcaacgtgccctggttcggtcctccagtgcgtcttaccgcaccttcaacctgctcatgggtaggtcacatggtttcgggtctacgtcatgatactaaggcgccctattcagactcggtttccctacggctccgtctcttcaacttaacctcgcatcataacgtaactcgccggttcattctacaaaaggcacgctctcacccattaacgggctcgaacttgttgtag

SEQ ID NO: 2111 - DNA (genomic), 216 bp, Streptococcus pneumoniae; double-stranded, circular
  misc_feature (B) LOCATION 1...216
  hypothetical: NO
  anti-sense: NO
ggagaaggcatgaaacttaatgaagtaaaagaatttgttaaagaacttcgtggtctttctcaagaagaactcgcgaagcgcgaaaacgaattgaaaaaagaattgtttgaacttcgtttccaagctgctactggtcaattggaacaaacagctcgcttgaaagaagttaaaaaacaaatcgctcgtatcaaaacagttcaatctgaagcgaaataa

SEQ ID NO: 2112 - DNA (genomic), 234 bp, Streptococcus pneumoniae; double-stranded, circular
  misc_feature (B) LOCATION 1...234
  hypothetical: NO
  anti-sense: NO
ttttttgttttatacccaaatatgaatagagacgtagctaataagttgaataacatatttggaaaaatgagaaatagcaatattactagaacttttagaaacaatcaatatttaaaaagaaaaaagctcaaagaatttattaaaccatgttataatagatatagctataattttatttataacaagaggatagaaatgaccgaattagaaagaaaaaatcgaaaaattagctaa

SEQ ID NO: 2113 - DNA (genomic), 183 bp, Streptococcus pneumoniae; double-stranded, circular
  misc_feature (B) LOCATION 1...183
  hypothetical: NO
  anti-sense: NO
tttattttaatctattttaagggggttctcatgaaactaagaatatttgcggaagataagccggctaagaaggtatttgaatatcaattagaacttgctgatcgtacaattcttctatcgacagcactcttgtcaggtgctattgctttagcaggaatcttttctgctttgaaagaaaaataa

SEQ ID NO: 2114 - DNA (genomic), 651 bp, Streptococcus pneumoniae; double-stranded, circular
  misc_feature (B) LOCATION 1...651
  hypothetical: NO
  anti-sense: NO
aatattttaataattttcatgaactttcaattagctaaatattctttactgaagaaatttttagaaaatataggatttaccacactagaggaatatggtgccatcttcaaatacctgattgagaatgtcaagacggatcgtcagatcatctgttcgcctcactgtcatgatgacctcggaatggcagtggcaaatagccttgctgctgtcaagaatggtgcaggacgtgttgaagggactatcaatggtattagggagcgagctgaaaatgctgctttggaagaaattgcagtggctctcaatattcgccaagattactaccaagtagaaaccagtattgtcctaaatgagaccatcaatacgtcagaaatggtttctcgcttctctggtattccagttcctaaaaacaaagccgtcgttggtggcaataccttctcccacgaatctggtattcaccaagatggagtccttaaaaatcctctcacttatgagatcatcacacctgaattggttggtgttaagattccgcttggagaattatctggtcgccatgcttttgttgagaaactgagagaattggccctagattttacagaagaggatatcaaaccactctttgctaagttcaaggcactggccgataagaagtaa

SEQ ID NO: 2115 - DNA (genomic), 222 bp, Streptococcus pneumoniae; double-stranded, circular
  misc_feature (B) LOCATION 1...222
  hypothetical: NO
  anti-sense: NO
aaatatttaattttagagataaagagcttatcttttttaagtaagattgtaaatgggctgatacaaaatattgaggagaatttagaggatgatattgaaaggatattgaaatatttatatatatgtttatttaacgaaatattcattattaagaataaggtgaatttttttgatgatgtggaatttaatcagacacttagtgaatttttagataaattgtag

SEQ ID NO: 2116 - DNA (genomic), 777 bp, Streptococcus pneumoniae; double-stranded, circular
  misc_feature (B) LOCATION 1...777
  hypothetical: NO
  anti-sense: NO
cttgacttaattttttttttaatgtatattaagagacaggaggaatacaagtttatgatacgtatcgaaaatctcagtgtctcctacaaagaaacgttggcacttaaggatatttcactagtgctccatggaccaacaattaccggcatcattggtccaaacggcgctgggaaatcaacactattaaaaggtatgctgggaattatcccacatcaaggtcaggcatttctcgatgacaaggaagttaaaaaatccttacaccgaattgcctatgtcgaacaaaaaatcaatatcgactacaactttcccatcaaggtcaaggaatgcgtctcgttaggactatttccctctattcctctctttcgaagtttaaaggctaaacattggaagaaagtgcaagaggcccttgaaatcgtcggcctagctgactacgctgaacgtcaaattagtcaactgtctggaggtcaattccagcgggtcttgattgccagatgtttggtgcaggaagccgactatatcctcttggatgaaccctttgctgggattgactctgtcagtgaggaaatcatcatgaatacgctgagagatttgaaaaaagctgggaagacggttctcatcgttcaccacgacctcagcaagattccccactacttcgatcaagtcttacttgtcaatcgagaagtgattgcctttggtccaacaaaagaaacttttaccgaaaccaatctaaaagaagcttacggtaatcaactctttttcaatggaggtgacctatga

SEQ ID NO: 2117 - DNA (genomic), 408 bp, Streptococcus pneumoniae; double-stranded, circular
  misc_feature (B) LOCATION 1...408
  hypothetical: NO
  anti-sense: NO
ccatgcttaataaaaaggagaaaacaaatggaacttgtattaccaaataattatgttgtgattgatgaagaagagatgatgtaccttgatgggggtggtgttggttgtaactggtggaatagtagaggtagttttgcaacagttctggatgtaggtttggccatctatagtggtggtgcaacaatttattctgcttatgcgataaaaaaagctatctcagctaatagaggggctattacgagaacattacgtagtttaataattaaacatgtaggtagtgcagctggccatttagtcaatactgcactaaacgttgcactaactgttactggattttcactaggtggagcaatcgcatatggggctgattgggctgacggtagcttagatggttatatttttgcttaa

SEQ ID NO: 2118 - DNA (genomic), 678 bp, Streptococcus pneumoniae; double-stranded, circular
  misc_feature (B) LOCATION 1...678
  hypothetical: NO
  anti-sense: NO
atgaaattaatcgtttcagtaatgccaagaagtttagaggaggctcaggctctggatgccacgaggtacctggatgccgacatcattgaatggcgtgccgactatctgcctaaagaagcgattttgcaggtagctccagccatttttgaaaaattcgcaggccgtgagttggttttcacgctacgaactcgctccgaaggtggagaaatcgacctttctccagaagagtatatccatctaatcaaggaagttgcgcaattctatcaaccagactatattgattttgagtactatagctacaaggatgtttttgaggaaatgctgtacttcccaaatcttgttttgagttaccataatttccaagaaacacctgagaacatgatggaaatcttgtcagagttgacgatcctaaatccaaaacttgttaaggttgcggtgatggctcacacggagcaggatgtcttagacttgatgaactatacacgaggctttaaaaccctcaatcctgaacaggaatatgtgaccatttctatgggtaaggtgggcaaggtctctcgtatcactgcggatgtgactggttcgagttggtcttttgccagtctggatgaggttagtgcccctgggcagatttctctagctagcatgaaaaaaatcagggagattttggatgaagcttga

SEQ ID NO: 2119 - DNA (genomic), 675 bp, Streptococcus pneumoniae; double-stranded, circular
  misc_feature (B) LOCATION 1...675
  hypothetical: NO
  anti-sense: NO
acccattccttggattccgtgctcttcgtatctctatctctgagactggagatgctatgttccgcacacaaatccgtgctccttcttcgtgcgtctgttcacggtcaattgcgtatcatgttcccaatggttgcgctcttgaaagaattccgtgcagcgaaagcagtctttgatgaagaaaaagcaaaccttcttgctgaaggtgttgcagttgcggataacatccaagttggtatcatgatcgagattcctgcagcggctatgcttgcagaccaatttgctaaagaagttgacttcttctcaattggtacaaacgacttgatccaatatacaatggcagcagaccgtatgaacgaacaagtttcatacctttaccaaccatacaacccatcaatcctacgcttgattaacaatgtgatcaaagcagctcacgctgaaggtaaatgggctggtatgtgtggtgagatggctggtgaccaacaagctgttccacttcttgtcggaatgggcttggatgagttctctatgtcagcaacatctgtacttcgtacacgcagcttgatgaagaaactcgacacagctaagatggaagagtacgcaaaccgtgcccttacagaatgctcaacaatggaagaagttcttgaacttcaaaaagaatacgttaattttgattaa

SEQ ID NO: 2120 - DNA (genomic), 858 bp, Streptococcus pneumoniae; double-stranded, circular
  misc_feature (B) LOCATION 1...858
  hypothetical: NO
  anti-sense: NO
tgttatctaattagaaaatgctttttttgtaggaaatataatatgataaggtgtaaaaaagaaataaggagtttgtatatggctgaacaagacttagctatgcaagtattacaacaagtggtaaaactaccagttgttaaggttgatagttcgaaatttttagtggataagttttccaaagaattgggtccacaggacattcctaccttattggaacaaggtccaacgtctctcttatctcaagaaatcttagatcgagtagctaatgcttgtattcgggacaatgtattattagcgagtgggacttctgttttggcaggattacctggagggcttgctatggcaattaccattccagctgatgtggctcaattttatgctttctctctgaaattggctcaagaattaggttatatttatggttatgaggatctttgggtttcacgagaggagttgagtgaagatgctcaaaataccctcttgctttatctaggcgtaatgttaggggtgaatggaactgctgctttgctacgtgctggtggtataacaattgccaaacaggtaatgaaaacagtgcctaataaagctttaacaaagacgctttggtaccctattttgaaaaaagtcttaaaaatatttggtgtgaatcttaccaagggagggttggccaaaggaatggggaaatttattcctatcttgggtggtatcatttcaggtggtttaacctttgcaactatgaaaccaatgggggaaagcttgcagaaagaattatccaagctagtcaactatagtgaagttcaatatcaagaagatgttgaaacaatccgaaaagaggctgaaatcatcgaaggagagtaa

SEQ ID NO: 2121 - DNA (genomic), 195 bp, Streptococcus pneumoniae; double-stranded, circular
  misc_feature (B) LOCATION 1...195
  hypothetical: NO
  anti-sense: NO
gtaaatctaatactcaaaatcaaagaacaaactaggaagctagccgcaggttgctcaaaacactgttttgaggttgtagatgaaactgacgaagtcagtaaccatacatacggtaaggcgatgctgacgtggcttgaagagattttcgaagagtataaaatcaaattttatccaactgatccctccatttcatag

SEQ ID NO: 2122 - DNA (genomic), 2460 bp, Streptococcus pneumoniae; double-stranded, circular
  misc_feature (B) LOCATION 1...2460
  hypothetical: NO
  anti-sense: NO
ttttttataatgaaaacgattggtaatcgctatgttgtggtggatttagaggcaactagcacaggtagtaaggctaaaattatccaagtgggaattgtcgtgattgaggacggagaaatcgtcgatcactatacgacggatgtcaatccacatgaacccttggatgctcatatcaaagaactgacaggattgacagaccaacgtctggcgcaagcacctgatttttcgcaagttgccagaaaaatatttgacttggtggaggatgggatttttgtagcccataatgttcagtttgatgctaatctcttggcggaaaatttattttttgaaggctatgagctaagaaaccctcgtgttgatacggtcgaattggcccaggtctttttccctgaactggaaaaatatagcttgccgattttgtgtcgagaattaggaattcctcttaaacacgcacacacagccctttcagatgcccaagctacagcagaattacttctttttttacgggaaaagatgacccagcttcctaaaggtctcttggaacgcttgctggaaatggctgacgctctcctatatgagtcctacctggttattgaggaaacttatcgcaaccaatctatcctgagttctccagacttggtccaagttcaaggtctgtattttaagaaaacggcagcttctctggagctacgaaaactatctcaagacttttctaaaaatatttctctgttgaaccttgaagtgagggaggaacaagaaagttttgctaaagaggttggcttgctattgaaagatgaacctgtctttctgattcaagcgccgacagggattgggaaaacctatggctatctcttacccgctttatctcaatccaaagagcgacaaattgttcttagtgttccgacaaagattcttcaaaatcaaatcatggaagaagaaggtaaacgtctcaaggaagtgttccatacagatattcatagcttaaagggaccacaaaattatctgaagttggatgccttttatcattccttgcaggaaaatgatgaaaatcgcttatttagacgctttaaaatgcaagtcttggtctggcttactgagacagagacaggagatttggatgaaatcgggcaactctaccgttaccaacattttctagcagaccttcgtcatgatgggaatttatcatcccagagcttatttgtgacggaagatttttggaaacgtagtcaagaaagggcagagacttgcaagcttttagtgactaatcatgcctatctcgtgaccagacttgaagataatcctgaatttgtcagtgaccgtttactgattattgatgaagtccaaaagattttgttagctctagaaaatctgcttcaagagacctacgatatacaatctattatcgatttaattgataaggctttagtaggagaagaaaacagggttcaacaacggatactagaaagtattcgctttgagtgtctctacttgatagaacaatttcagtctggtaaatctaggaaaaatatcttagattctctggacaatctccatcagtatttttcagaattagaagtagaaggctttgatgagctggttcgctattttacagctgaaggtgattactggcttgaagtaactgaaacgagtcaaaagaaaattcagatttcttctacaaaatcaggccgtactcttctgtcctctttacttcctgagagttgccaagtcctgggagtatcggctactcttgagattagtcagagggtttctttggcagaccttttaggctatcctgaagctaaatttgtcaagattgaatctcggggaaaacaggaacaagaagtggtcatggtcaaagatttccctctggtaacagaaacctccttagaagtctatgccagagaggtagctgctttactagtggaaattcaagctttccagcaaccgattttggttctctttaccgctaaagacatgcttctagcagtatcggatttacttacagttagccacttggcccagtataaaaatggggatgttcatcagctaaagaaacgctttgaaaaaggtgaacaacaaatcttgcttggtgcagcaagtttctgggagggagttgatttttcaagccatccttttgtgattcaagttgtaccgaggcttcctttccaaaatcctcaagaacccttgacgaaaaagattaatcaagaactgaatcaagaagggaaaaatgccttttatgattatcaattgccaatggccattattcgtttaaaacaggctttgggaagaagtatgagacgtgaataccaacgttccttaactcttattttggataggagaatcgtcggaaaacgatacggcaaacaaatagtagcatctctagcagaagaagcgactgttaaaaccatctctcgatccgaagttgacgaggctattgatagattttttaatgaactttga

SEQ ID NO: 2123 - DNA (genomic), 648 bp, Streptococcus pneumoniae; double-stranded, circular
  misc_feature (B) LOCATION 1...648
  hypothetical: NO
  anti-sense: NO
agaattgttttcaacggatgcagaggaagaggaagaagatttcgaatcgggtatttaaagggtaaaagaatgataaaaaaggttacgattgaaaaaataaaatcgcctgagcgcttcttagaagtaccacttctgacgaaagaagaagtcggccaggcaatcgataaggttattcggcagttagaactcaaccttgactatttcaaggaagatttcccgacaccagctacctttgataatgtctatccaatcatggataacacggaatggaccaatggtttctggacaggagaactgtggttggcttatgaatacagtcaacaggatgcatttaaaaacatcgctcataaaaatgttctttctttcctggatcgtgtcaataagagagtagaattggatcaccatgatctcggcttcttgtacacaccgtcttgtatggctgaatataagataaatggagatggagaggctagagaagcaaccttgaaagctgcagataagttgattgaacgctatcaagaaaaaggtggttttattcaagcttggggagacttgggcaagaaagagcattaccgtttgattatcgactgcttgctcaatatccaactcttattctttgcttatcaagaaacaggcgatcaaaaatag

SEQ ID NO: 2124 - DNA (genomic), 246 bp, Streptococcus pneumoniae; double-stranded, circular
  misc_feature (B) LOCATION 1...246
  hypothetical: NO
  anti-sense: NO
aagactataataaagtcaaatatatacgacacaaatcagaaaggagaccagatgaatcgtgtgaaagaatttcgcaaggaactgggcatttcccagctcgagctcgccaaggatatcggtgtctcgagacagaccatcaatatgattgaaaacgacaagtacaatccaactctggaactctgtctcaatctcgcccgcagcctccaaactgacctcaacagtctcttttggaaggaagatttttaa

SEQ ID NO: 2125 - DNA (genomic), 2256 bp, Streptococcus pneumoniae; double-stranded, circular
  misc_feature (B) LOCATION 1...2256
  hypothetical: NO
  anti-sense: NO
agtggtataatactttttagaaagaacattttagaaaagagcatgcatatgattgcactagaagaaaaaattacaattttgccaactctcttcgtcgagaaacgagatgggagacgtgttgtatttgatgtggacaagattgacaaggctctccacaaggcggctgacaaggttatggatgtgacacccctggttgaaaaacgcctcaatgatctgactgagcgaattattacagaaattcatagtcgctttccacagggaattaagatttacgaaattcaaaatatcgtagaacatgaactccttgaagccaaagaatatgcgctggctgaggagtatattacttatcggacacagagggattttgagcgctcaaaagcgacggatatcaactttagtattcataaacttctcaacaaagaccagacagttgtcaatgaaaacgctaataaagacagtgatgtctttaacactcagcgtgatttgacagcagggattgttgggaaatcaatcggactgcaaatgcttcctaagcacgtagccaatgcccaccaaaagggggatatccactatcacgatttggactacagtccctatacccctatgaccaactgctgtttgattgattttaagggtatgttggaaaatggttttaagattggaaatgcagaggtagagagtcccaagtctatccagactgcgacagcacagatttctcaaatcattgccaacgttgcttctagccagtacggtggctgttcagctgaccgtatcgatgaaattttggcgccttatgcagagaagaattatcaaaaacatctcaaagatgcagaagagtgggtattgcctgaaaaacgggaagattacgcttggaagaaaacgcaaaaggacatctacgatgccatgcaatctcttgagtatgaaatcaatactctcttcacttcaaatggacaaacaccttttacttcgttaggttttggtctgggaaccagtcgttttgaacgagaaattcaaaaagctattttaaacattcgcatcaagggtcttggttcagaacaccgtacggctatctttcctaaacttattttcactctgaaaagaggccttaatttagaggaaggaactcccaactacgacatcaagcagttggctcttgagtgtgcaaccaaacggatgtatccagatgttttatcttacgataagattgttgacttgacaggatccttcaaggtgcctatgggttgccgttctttcctccaaggatggaaggatgaaaatggtgtagaagtcaattcaggtcgcatgaatctgggtgttgtgacggttaatctgcctcgtattgctcttgagtctgaaggtgatatgaataagttctgggaaatcttcaacgagcgaatgaatatcgcagaagatgctcttgtttaccgtgtcgaacgcactaaagaggcgacaccagcaaatgctcctattctttatcagtacggtgcttttggccatcgtctaggtaaagaagaaagtgttgaccagctctttaagaatcgtcgtgctaccgtttcgctgggctatatcggcttgtatgaagtagcgacagttttctttggtaacagctgggaaagtaatccagatgctaaggaattcacgctagacatcattcacgatatgaaacgccgtgtagaagagtggtcagaccaatatggctaccatttctctatctactcaacaccatccgaaagtctgacagaccgtttctgccgactagatatagacaagtttggctctattcctgatatcacagacaaggaatactacaccaactctttccactacgatgttcgtaaaaatccaacaccgtttgaaaaattggactttgagaaagtctatccagaagcaggtgcgtcaggtggtttcatccattattgtgagtatccagtccttcagcaaaatccaaaggccttggaagctgtctgggattatgcttatgaccgtgtaggctatctaggcaccaatactccgattgaccgttgctacaagtgtgactttgaaggggattttgaaccaactgagagagggtttgcttgtccaaactgtggcaatagcgaccctaaaacagtagatgtggtgaagcgaacttgtggctacctaggtaatcctcaagcaagaccgatggtcaacgggcgtcacaaggaaatcgctgcgcgtgtcaaacatatgaatggttcaacgattaaaatagctgggcatcaagtaacaaattag

SEQ ID NO: 2126 - DNA (genomic), 186 bp, Streptococcus pneumoniae; double-stranded, circular
  misc_feature (B) LOCATION 1...186
  hypothetical: NO
  anti-sense: NO
gaatcctccttttcctccttctattatagcacatttttaaatctaggtttgctagattctatgcttctatctatttattcggaaaagaaggcttttcttcagaagaaagctaatagcttatttgaaattttctcctctctgttggatagtcccgtctatctatgttataatgaaagaaggatttaa

SEQ ID NO: 2127 - DNA (genomic), 420 bp, Streptococcus pneumoniae; double-stranded, circular
  misc_feature (B) LOCATION 1...420
  hypothetical: NO
  anti-sense: NO
caacaaataataaaaatgttattcttatcacataagaaagcggtttcaataaaagagagaggaggacttattttgttgcattgttgctcaaggtgtgatttttttgaaagaaaaaataaaatgaaaacgaaaaaacatagattacttgctctagctcttatttcaagttttacattattgggagctgcatcagctgctgtacaatatccagatggaggagtatggacgtatggagaaggttcaggaggtggttgggctttttcaaattactatcatggtaaaaaatatcattattcttctcttgtaagtagatggaatagtcattcagataaaggagaagctcctgctggaaaaacctcctatgcatggatttggactaaatggggagaacaagtagcattttactgtgattatgactaa

SEQ ID NO: 2128 - DNA (genomic), 1320 bp, Streptococcus pneumoniae; double-stranded, circular
  misc_feature (B) LOCATION 1...1320
  hypothetical: NO
  anti-sense: NO
gaagaaataatgagtatgtttttagatacagctaagattaaggtcaaggctggtaatggtggcgatggtatggttgcctttcgtcgtgaaaaatatgtccctaatggaggcccttggggtggtgatggtggtcgtggaggcaatgtggtcttcgttgtagacgaaggactacgtaccttgatggatttccgctacaatcgccatttcaaggctgattctggtgaaaaagggatgaccaaagggatgcatggtcgtggtgctgaggaccttagagttcgagtatcacaaggtacgactgttcgtgatgcggagactggcaaggttttaacagatttgattaaacatgggcaagaatttatcgttgcccacggtggtcgtggtggacgtggaaatattcgttttgcgacaccaaaaaatcctgcaccggaaatctctgaaaatggagaaccaggtcaggaacgtgagttacaattggaactaaaaatcttggcagatgtcggtttagtaggattcccatctgtagggaagtcaacacttttaagtgttattacctcagctaagcctaaaattggtgcctaccactttaccactattgtaccaaatttaggtatggttcgcacccaatcaggtgaatcctttgcagtagccgacttgccaggtttgattgaaggggctagtcaaggtgttggtttgggaactcagttcctccgtcacatcgagcgtacacgtgttatccttcacatcattgatatgtcagctagcgaaggccgtgatccatatgaggattacctagctatcaataaagagctggagtcttacaatcttcgcctcatggagcgtccacagattattgtagctaataagatggacatgcctgagagtcaggaaaatcttgaagaatttaagaaaaaattggctgaaaattatgatgaatttgaagagttaccagctatcttcccaatttctggattgaccaagcaaggtctggcaacacttttagatgctacagctgaattgttagacaagacaccagaatttttgctctacgacgagtccgatatggaagaagaagcttactatggatttgacgaagaagaaaaagcctttgaaattagtcgtgatgacgatgcgacatgggtactttctggtgaaaaactcatgaaactctttaatatgaccaactttgatcgtgatgaatctgtcatgaaatttgcccgtcagcttcgtggtatgggggttgatgaagcccttcgtgcgcgtggagctaaagatggggatttggtccgcattggtaaatttgagtttgaatttgtagactag

SEQ ID NO: 2129 - DNA (genomic), 225 bp, Streptococcus pneumoniae; double-stranded, circular
  misc_feature (B) LOCATION 1...225
  hypothetical: NO
  anti-sense: NO
ccaacctccttttcgtttcatactcttcaaaaatctcttcaaaccgcgtcaacgtcgccttggccgctatatatgttactgacttcgtcagttctatctgcaacctcaaaacagtgttttgagctgacttcgtcagttctatctgcaacctcaaagcagtgctttgagcaacctgcggctagtttcctagtttgctctttgattttcattgagtatcagatttaa

SEQ ID NO: 2130 - DNA (genomic), 516 bp, Streptococcus pneumoniae; double-stranded, circular
  misc_feature (B) LOCATION 1...516
  hypothetical: NO
  anti-sense: NO
cacttgataatatgcgttttttctaagtggattagtagagtagaggatttttctcatataatactcttcgaaaatctctgcaaactacgtcagcttccatctgcaacctcaaaacagtattttgagctgacttcgtcagtcttatctgcaacttcaaaacagtattttgagctgacttcgtcagtcttatctgcaacctcaaaacagtattttgagctgacttcgtcagtcttatctgcaacctcaaaacagtattttgagctgacttcgtcagtcttatctgcaacctcaaaacagtattttgagctgacttcgtcagtcttatctgcaacctcaaaacagtattttgagctgacttcgtcagtcttatctgcaacctcaaaacagtattttgagctgacttcgtcagtcttatctacaacctcaaagcagtgctttgagcaacctgtggctagcttcctagtttgcgctttgattttcattgagtataagggaaagtatagtgaattgaaataa

SEQ ID NO: 2131 - DNA (genomic), 273 bp, Streptococcus pneumoniae; double-stranded, circular
  misc_feature (B) LOCATION 1...273
  hypothetical: NO
  anti-sense: NO
agtacgataatgatttttttaattcgtatgatttataatgcagtggatatttactccctgattttgatagccttcgctgtcatgtcttggtttccaggtgcctacgaatccagtttaggtcgttggattgtagcgttggtgaaaccagtgcttgctcccttgcaacgcctgcctttacagatagcgggtcttgatttatctgtttgggttgcgattgttttggttcgatttttaggagaaaacttagtgcgttttctggcgatgataggatga

SEQ ID NO: 2132 - DNA (genomic), 282 bp, Streptococcus pneumoniae; double-stranded, circular
  misc_feature (B) LOCATION 1...282
  hypothetical: NO
  anti-sense: NO
attgaggtaataaggatgagattagataaatatttaaaagtatcgcgaattatcaagcgtcgtacagtcgcaaaggaagtagcagataaaggtagaatcaaggttaatggaatcttggccaaaagttcaacggacttgaaagttaatgaccaagttgaaattcgctttggcaataagttgctgcttgtaaaagtactagagatgaaagatagtacaaaaaaagaagatgcagcaggaatgtatgaaattatcagtgaaacacgggtagaagaaaatgtctaa

SEQ ID NO: 2133 - DNA (genomic), 558 bp, Streptococcus pneumoniae; double-stranded, circular
  misc_feature (B) LOCATION 1...558
  hypothetical: NO
  anti-sense: NO
agattatcctttaccagcgccctttttcttttaaaaatgagaaaatttcggtataatagtcaaacaaggtcaaggtttaaagagagaggtgggtttgttatgagatttaaaaatacatcggatcatattgaggcctacatcaaggcgattttagatcaatctggtatcgtggagttgcaacggagtcagttggcagatacctttcaggttgttcctagtcagattaactacgtgatcaagacacgctttacggaaagtagaggctacttggttgaaagtaagcgtggtggcggaggctacattcgtataggacggattgagttttctagtcatcatgaaatgctccgggagctgctttactcgattggtgagcgagtcagtcaagaaatttatgaggatattctccagcttttggttgagcaggaattgatgaccaagcaggagatgaatttgctagaatcagtagctttggatcgcgttttaggagaagaagctccagttgttcgagcaaacatgctacgtcagatcatacaagaggtagatagaaaagggaagtaa

SEQ ID NO: 2134 - DNA (genomic), 402 bp, Streptococcus pneumoniae; double-stranded, circular
  misc_feature (B) LOCATION 1...402
  hypothetical: NO
  anti-sense: NO
ttaaaatccttttcaaaaaatcaccttttcttgatttttaatcctatttgctgtatgataagggaaaagaaaggagacagagatatggcttttaccaatacccacatgcggtctgctagttttggcattgttaccagcttgcctgatgacatcattgactctttttggtatattatcgaccatttcttaaaaaatgtctttgaattggaagaagaactcgagtttcaattgcttaataaccaaggaaagattaccttccacttttcaagtcaacacctccctacagccattgattttgactttaaccatcctttcgaccctcgttatcccccaagagtactggttttagacatggacggtagagaaactatcctcctcccagaagaaaatgacctattttaa

SEQ ID NO: 2135 - DNA (genomic), 435 bp, Streptococcus pneumoniae; double-stranded, circular
  misc_feature (B) LOCATION 1...435
  hypothetical: NO
  anti-sense: NO
gttatctcaatgttaatcggaatcccaaaagaaattaaaaataacgaaaaccgtgtcgccctcacacctgcaggtgttcatagcttagttagtcgtggtcatcgtgtccttatcgaaacaaatgctggtctcggttctggctttactgatgctgactatcaaaagcaaggagctgagattgtcgctactgctggtgaagcttgggcagcagagttggttgtgaaagtaaaagaacctttaagttctgaatacggttactttcgcgacgatcttcttctcttcacctacttgcacatggccgctgctccagaattagcagatgctatgttagcagcaaaaacaacaggaattgcctatgaaactgttcgtgacaatcaaggacaactaccgctcctcgttcctatgagtgaggttgcagatcgtatggctgtttaa

SEQ ID NO: 2136 - DNA (genomic), 594 bp, Streptococcus pneumoniae; double-stranded, circular
  misc_feature (B) LOCATION 1...594
  hypothetical: NO
  anti-sense: NO
aagtactcaatttacaagctaaaatgcgacagaaacgaaaataaaggagacgttggtaagaaggcagagaatctcattcaaggccaatttgaaggctctaaagcaatggaaaagtgctacacagatgtgacagaatttgccattccagcaagtactcaaaagctttacttatcaccagttttagatggctttaatagcgaaattatcgcctataatctttcaacttcgcccaacttagaacaagtgaagagtatgttagaacaggcctttacagagaagcactacgagaatacgattctccatagtgaccaaggctggcaataccgacacgattcttatcatcggttcctagagagtaagggaattcaagcatccatgtcacgtaagggtaacagcccagacaatggtatgatggagtccttctttgggattctgaaatcggaaatgttttacggttttgagaagtcgtttcagtcgcttaagcaattggaacaagctattatagactatattgattactacaacaataaacgaattaaggtaaaactaaaaggacttatccctgtgcaatacagaactaaatccttcggataa

SEQ ID NO: 2137 - DNA (genomic), 411 bp, Streptococcus pneumoniae; double-stranded, circular
  misc_feature (B) LOCATION 1...411
  hypothetical: NO
  anti-sense: NO
aagtactcaatttacaagctaaaatgcgacagaaacgaaaataaaggagacgttggtaagaaggcagagaatctcattcaaggccaatttgaaggatctaaaacaatggaaaagtgctacacagatgtgacagaatttgccattccagcaagtactcaaaagctttacttatcaccagttttagatggctttaacagcgaaattatcgcctataatctttcaacttcacccaacttagaacaagtacaaacaatgttggaacaggcattcacagagaagtactacgagaatacgattctccatagtgaccaaggctggcaataccgacacgattcttatcatcggttcctaagagtaagggaattcaagcatctatgtcacgcaagggaaacagccaagacaacggtatga

SEQ ID NO: 2138 - DNA (genomic), 594 bp, Streptococcus pneumoniae; double-stranded, circular
  misc_feature (B) LOCATION 1...594
  hypothetical: NO
  anti-sense: NO
aagtactcaatttacaagctaaaatgcgacagaaacgaaaataaaggagacgttggtaagaaggcagagaatctcattcaaggccaatttgaaggctctaaaacaatggaacagtgctacatagatgtgactgaatttgccattccagcaagtactcaaaagctttacttatcaccagttttagatggctttaatagcgaaattatcgcctataatctttcaacttcacccaacttagaacaagtacaaacaatgttggaacaggcattcaaagagaagcactacgagaatacgattctccatagtgaccaaggctggcaataccgacacgattcttatcatcggttcctagagagtaagggaattcaagcatctatgtcacgtaagggtaacagcccagacaatggtatgatggagtccttctttgggattctgaaatcggaaatgttttacggttatgagaagtcgtttcagtcgcttaagcaattggaacaagccattgtagactatattgattactacaacaataagagaattaaggtaaaactaaaaggacttagccctgtgcaatacagaactaaatccttcggataa

SEQ ID NO: 2139 - DNA (genomic), 1101 bp, Streptococcus pneumoniae; double-stranded, circular
  misc_feature (B) LOCATION 1...1101
  hypothetical: NO
  anti-sense: NO
acttcatcaatacctatgatttggagccaatggccaaacaagttattcctaaagcagcatttggctatatcgtctagtggggcggaagatactctcactttaagagagaatatccgcgcctttaaccacaaactcatcgttcctcatacactttgcgatgttgaaaatccaagtacagagattgaatttgcaggtgaaaaactatcttcaccaatcattatggcgcctgttgcggctcataaattggcaaatgaacagggggaagtggcgactgcgcgtggtgtgcatgagtttggttctctttatacaaccagctcttactctactgttgaccttccagagatttctgaagcccttcaagggacaccccattggttccaattttactttagtaaggatgacggtatcaaccgccacatcatggaccgtgtgaaggctgaaggttataaagcgattgtcttgacggcagatgctactgtaggggggaatcgtgaagtggataagcgtaatggttttgtcttcccagttggcatgccgattgttgaagaatacctgccagaaggtgctggtaaatcaatggactttgtttacaaatcagctaaacaacgcttgtctccacgcgatgtagaatttatcgctgaatactctggtcttcctgtgtatgtcaagggaccacaatgccgtgaggacgttgaacgttcacttgctgcaggagcttctggtatctgggtaaccaaccacggtggtcgtcaaatcgacggtggaccagctgcctttgactcgcttcaagaagtggcagaagcagttgatagacgtgtgccgattgtcttgaactctggtgttcgtcgtggtcaacacgtctttaaagccttggcttcaggagcagacttggtagctattggtcgccctgttatttatggcttggctctcggtggtagtgtcggtgtgcgtcaagtctttgaacacttgaatgcggaattgaagacagttatgcaattgtctggagctcagaccattgaagatgtcaaacactttaagctccgtcacaatccatacaacccaaccttcccagttgaccctcgtgacttaaaattgtattga

SEQ ID NO: 2140 - DNA (genomic), 228 bp, Streptococcus pneumoniae; double-stranded, circular
  misc_feature (B) LOCATION 1...228
  hypothetical: NO
  anti-sense: NO
gtcttgtcaatagtcttggccatctcgccaccgagggcatcgacttcacgtacgacaatccccttggcagaaccaccgatagagggattacaaggcatgaaagccagcatttcaatattgatggtcgcaagcaggaccttacagcccatacggctagcggccaaggaagcctcaaccccagcgtgtcccgcaccaattacaataatatcgtattcttcagtaaaatga

SEQ ID NO: 2141 - DNA (genomic), 411 bp, Streptococcus pneumoniae; double-stranded, circular
  misc_feature (B) LOCATION 1...411
  hypothetical: NO
  anti-sense: NO
tatactgttttcatgacagatttatcaaaacaattacttgaaaaagctcatggtgggttaaaaataaatccggatgagcaaagacgctatcttggtacttttgaggaaagagttcttggatatgtagatattgacacagcaaatagccctcagttagaaaaaggctttttatttattttagaaaaccttcaggaaaaagcagagccactatttgtgaagatttcaccaactatcgaatttgataagcaagttttctacttaaaagaagcaaaagaaactgatagtcaagccaccatagtatctgaagagcatattacttctccttttggcctggttattcatagcaatgcaccagttcaagtagaagaaataagaccttcgacttgcttttccaaaactttgggaagttaa

SEQ ID NO: 2142 - DNA (genomic), 774 bp, Streptococcus pneumoniae; double-stranded, circular
  misc_feature (B) LOCATION 1...774
  hypothetical: NO
  anti-sense: NO
gtgaagtcaatgccccgatcgctttgctggaaggatgagtacacggagtacatgcatgaaatatgccctggtcgtttaactcctgaagtaaccaggttgctgaatgaaaaatttggtacgaattataacaagagtcaaatcggtggcgtacgcaaacgtctagggttagcagttggaaaagtctatcaaggtcgattgctgacaaaggagcaacatgattatcttgtattgatccaaaaaaataagatttctcgtaatgtcgcaaatgaaatgaaccaaaaatttggcttatcgctaactgagaaacagattaagagttatcggagaaataataatctacatagtggtttgacaggaagattcgagaaaggtcagactcctcacaataaggggaagaagtaccccaatatgccaaaaaacggcgggcagttcaaaaaaggtaatcgacctccgaattatgtacctgtcggtactatcaactacacaacaaacggttatccaaaagaaaagattggagaacctaatcaatgggttttgaaacaccgcaaggtttgggaggaccatcacgggctgataccaaaagggtactcaatcgtttttctggacggtgataaaacaaactatgatatttcaaatctggcatgtttatctaagaacgaaattgctagaatgaatcaaaatcatttattcacgtccaacgctgatttgactaaatcaggtattggactaacaaaacttacaaataaaatcagagaggtagaaaaaaatggctag

SEQ ID NO: 2143 - DNA (genomic), 195 bp, Streptococcus pneumoniae; double-stranded, circular
  misc_feature (B) LOCATION 1...195
  hypothetical: NO
  anti-sense: NO
aaatttccaattcttggatctaaacaaacaccttttattacaacttcagcatttaaacttctcctctcagcaaaagaatctagttcattaaaaaaagcaacacggagagctaagaatgtgttagaaaaaagcttaattgcttctgcttcagtaggagaaactaacataacatttttaatattggcagtactatga

SEQ ID NO: 2144 - DNA (genomic), 2679 bp, Streptococcus pneumoniae; double-stranded, circular
  misc_feature (B) LOCATION 1...2679
  hypothetical: NO
  anti-sense: NO
ctcttcccaatggtattttttgattctttcctttataatgggtgtatggataagaaaaaattattattgattgatgggtcttctgtagcttttcgggcgttttttgcgctgtatcagcagttggaccgttttaagaatgcggctggtttgcataccaatgcgatttatggtttccagttgatgttgagtcatttgttggagcgggttgagccgagtcatattttggtggcttttgatgcgggaaagacgaccttccggacagagatgtatgcggactataagggtggtcgggccaagactcctgatgagtttcgtgagcaatttcctttcattcgtgagttgctggatcatatggggattcgtcactatgagctggctcagtatgaggcggatgacatcattgggacgctggataagctagcagagcaggatggttttgatattaccattgtcagtggggacaaggatttgattcagctgacggatgagcatacggtggttgaaatttccaagaaaggtgtggctgagtttgaggcctttacgccagattacctcatggaagaaatgggcctcacaccagctcagtttatcgatctcaaggcgctcatgggtgataagtcggataatatccctggggtgaccaaagtcggtgaaaagacgggtattaagctcttgctggagcatggttcgcttgaggggatttatgaaaatattgatggaatgaagacttctaagatgaaggaaaatctcatcaatgacaaggaacaggcctttttgtctaaaacactagcgaccattgataccaaggcaccgattgcgattggtttagaggacttggtctatagtggtccagatgttgaaaatcttgggaaattttacgatgagatgggattcaaacagctcaagcaggctttaaatgtgtcgtcagctgatgtggctaagggtttggattttactattgttgaccaaatcagtcaagatatgctgagtgaagagtctatcttccactttgagctttttggtgagaattaccatacggataatttggttggatttgcctggtcttgtggggataagctctatgccacagacaagcttgagctgttgcaagacccgattttcaaggatttcttagaaaaaacatctctgagagtttatgactttaagaaggttaaagttcttttgcaacgttttggtgtggatttgcaggcgcctgcttttgacatccgtttggctaaatacctcctttcgactgtggaggacaatgaaattgcgaccatcgctagtctttatggtcagacttacttggttgatgatgaaactttctacggtaagggtgttaaaaaggccattcctgaacgtgagaaattcttggaacacttagcttgtaaacttgctgttttggtagaaacagagcctattttacttgaaaaactcagcgaaaatgggcaattagagcttctttatgatatggagcaacctctggcttttgttcttgccaagatggaaattgctgggattgtggtcaagaaagagaccttgcttgagatgcaggctgaaaatgagcttgtcattgaaaaactgactcaagagatttacgagctggctggtgaggagtttaatgtcaactcgcctaagcagttgggcgtgcttctctttgagaaattgggacttcctctagaatacactaagaaaaccaagacaggttattcgacagcagtggatgtgttggagcgtctcgctcctattgctccgattgttaagaaaatcctggattaccgtcaaattgctaagattcaatctacttatgtaattggcttgcaggactggattttggctgatggaaagattcatactcgctatatgcaggatttgacccagaccgggcgtttgtctagtgtggatccaaacttgcaaaatattcctgcccgattggaacaagggcgcttgattcggaaggcttttgtgccagagtgggaggatagtgtgctactcagctctgactattcacagattgaattgcgcgttttggcgcatatttctaaggatgagcacttgattaaggccttccaagagggggcagatatccatacttcgacagccatgcgggtctttggcattgagcgtcctgataatgtgactgcaaatgaccgtcgcaatgccaaggcagttaactttggagtggtttatgggatttcagactttggcttgtctaataatttgggaattagtcgtaaggaagccaaagcctacattgatacctactttgaacgttttccaggtattaaaaactacatggatgaagtggtgcgggaggcgcgtgataagagctatgtagagaccctctttaagcgtcgccgtgagttgccagatatcaattcgcgcaacttcaatattcgtggttttgcggagcgaactgctatcaactcacctatccagggttcggcagcagatattctcaagattgccatgattcagctggataaagccttggttgcaggtggttatcagaccaagatgctgttacaagtgcacgatgaaatcgtccttgaagtgcctaaatctgaattggtagagatgaaaaaattggtgaaacaaaccatggaagaagccattcaactcagtgttcctcttatcgcagatgagaatgaaggggcaacctggtacgaggctaaataa

SEQ ID NO: 2145 - DNA (genomic), 276 bp, Streptococcus pneumoniae; double-stranded, circular
  misc_feature (B) LOCATION 1...276
  hypothetical: NO
  anti-sense: NO
atgacaccaatcacaaaaccaaccccaacaacttgtatggcaatatcgttagaaataccgaaaaggctacaagcaactgggataagaaggagggaacctccggcaatacctgaagcaccacaggctgagatagctgctaccacactgaggacaaaggctgtggcaaagtcaacaggaattccaagagtgttaactgcagcaagggtcaaaaggttaatggtaatcgctactccagccatattgatagtagaaccgagtgggatagaaacagaatag

SEQ ID NO: 2146 - DNA (genomic), 1170 bp, Streptococcus pneumoniae; double-stranded, circular
  misc_feature (B) LOCATION 1...1170
  hypothetical: NO
  anti-sense: NO
atgaagccaattgaccgtttttcttatctaaagaataatcgggtgtcgcaagatacctcatctctggtacagtgctacctcccgattatcggtcaggaggcactgagcctttatctttatacgattagtttttgggataatggtagaaaggaatatcttttttcaagtatcctcaatcatctcaactttgggatggatagactgataaaatcattgaaaatcttatctgcttttaatctcttgactctctatcaaaagggggatgtttatcagctagccctccatgctcctctatctagtcaagacttcttggggcatcctgtttatcgcagactcttagagaaaaagattggcgatgtagctgtggaggatttgaaagttgaaagtgctgatggtgaagaaatacctgtctcactcaatcaagtctttccagaattggcagaactaggcagtcaagaataccttggtctcaagaagaaagtggccaacgattttgacttggaccattttcgtcagcttatggctcgagatggacttcgctttgcggatgagcagtccgatgtcttaaacctctttgccattgccgaggagaagaaatggacttggtttgaaacctatcaattggccaagtcaacagctgtttctcaggttatttcaaccaaacgcatgcgtgaaaaaattgctcaaaaaccagtttcctctgactttagtcttaaggaagcgatcattatcaaagaagccaaaagtaaaactgccctgcagttcttggcagaaatcaagcaaacacgcaagggaaccattacccaaacagaaagagaactcttgcaacagatggctggcttgggtttgctggacgaagtcatcaatatcattcttttattgacctttaataaggtcgattcggcaaatatcaatgagaaatatgccatgaaggtagccaatgactatgcctatcaaaagattcattcggcagaagaggcagtcttgcgcatccgtgagcgaggacagaaagcaaaaacacaaaaacagaatcagactgccccagcaaaaaccaatattcctaaatggagtaatcctgaatataaaaatacgtcatccgctgaggaattagaagagatggaacgccaaaccctagaattattagcaaaattagataacggaggtgattag

SEQ ID NO: 2147 - DNA (genomic), 252 bp, Streptococcus pneumoniae; double-stranded, circular
  misc_feature (B) LOCATION 1...252
  hypothetical: NO
  anti-sense: NO
gaggatacaataatgaagaaaactgtttataaaaaattgggtatttcaattattgcgagtactttattggctagccagttatcgacagtatctgctttgagtgttatttctagtacaggtgaagaatatgaggtaagtgagacactagaaaaaggtccaggatctaatgattcttcattatctgagatttcaccaacatatggttcatactaccaaaagcaatcagaagtattatcggtaatgatgatttga

SEQ ID NO: 2148 - DNA (genomic), 330 bp, Streptococcus pneumoniae; double-stranded, circular
  misc_feature (B) LOCATION 1...330
  hypothetical: NO
  anti-sense: NO
ttgtccacaatgatgatggctcttatacgcccgaaatcgaagagatttattatggatcataaggcttatatgtacgttctggagtgtcgtgatggatcctactatataggctatacgactgatatgagaagacgcctcgctatccacaatagtgggaagggagccaaatatacacgagcacgcttgccagtcaaacttatctatgctcaaggttttgccagtaaggaagaagccatgtcggctgaagctcttctcaagcgtaagaagaggccacagaaggaagaatttttatctgaaaatcaagatagaaatttactccgtttattttga

SEQ ID NO: 2149 - DNA (genomic), 995 bp, Streptococcus pneumoniae; double-stranded, circular
  misc_feature (B) LOCATION 1...995
  hypothetical: NO
  anti-sense: NO
ttaaaacaatgacttcaactaaacaacacaaaaaagttatccttgtcggtgatggtgctgtaggttcatcttacgcttttgcacttgttaaccaaggaattgcacaagagcttggaattatcgaaattccacaattgcatgaaaaagctgttggtgatgcgcttgaccttagtcacgcccttgccttcacttcacctaaaaaaatctatgcagctcaatactctgactgtgcagacgctgaccttgttgtgatcactgcaggtgcacctcaaaaaccaggtgaaactcgtcttgaccttgtaggtaaaaaccttgctatcaacaaatcaatcgtaactcaagttgttgaatctggtttcaaaggtatcttccttgttgctgctaacccagttgacgttttgacttactcaacttggaaattctctggtttccctaaagaacgcgttatcggttcaggtacttcacttgactcagctcgtttccgtcaagcacttgctgaaaaattggatgtggatgctcgttcagtgcacgcctacatcatgggtgaacacggtgactctgagttcgctgtttggtcacacgctaacatcgctggtgtaaaccttgaagaattccttaaagacactcaaaatgttcaagaagctgaattgattgaattgttcgaaggtgttcgtgatgcagcctacacaatcatcaacaaaaaaggtgcaacatactacggtatcgcagtagcccttgctcgtatcactaaagcaatccttgacgatgaaaacgcagtacttccactttcagtattccaagaaggtcaatacggagttgagaatgtctttatcggtcaaccagctgttgttggtgcacatggtatcgttcgtccagtaaacattccattgaacgatgcagaaactcaaaaaatgcaagcatctgctaaagaattgcaagctattattgacgaagcatggaaaaatccagaattccaagaagcttctaaaaactaa

SEQ ID NO: 2150 - DNA (genomic), 225 bp, Streptococcus pneumoniae; double-stranded, circular
  misc_feature (B) LOCATION 1...225
  hypothetical: NO
  anti-sense: NO
tacgaaacaattgctaaaacatttatagaaattaattttactttcccaatcgatttgttctcatcttatttcaatctgctatataatagtccatgctgtggctggattcttttcagcctacttatactcttcgaaactctcttcaaaccacgtcagcttcaccttgccgtaggtatggttactgacttcgtcagttctatccacaacctcaaaacggtgttttga

SEQ ID NO: 2151 - DNA (genomic), 396 bp, Streptococcus pneumoniae; double-stranded, circular
  misc_feature (B) LOCATION 1...396
  hypothetical: NO
  anti-sense: NO
tacgaaacaattgctaaaacatttatagaaattaattttactttcccaatcgatttgttctcatcttatttcaatccgctatatattatggtatcgaatcttcatcagaatgataaaattaatcaattaatatctgattacaaacagaatatgaaagctttttatatcactattgaaaaatttatacgagatgatgaaagccttaagtgttattttacaaaggttatttcaagtcgttccaaggtaacaagtctagatcagattgaagctgataaaacgatacaaagaaaatattcaagtgagctaaaaaaatttattggattttataatgagattatttgtgaggaaaatagtttcctacatgtacgaaagaggtggtcgagttggtttaggtag

SEQ ID NO: 2152 - DNA (genomic), 633 bp, Streptococcus pneumoniae; double-stranded, circular
  misc_feature (B) LOCATION 1...633
  hypothetical: NO
  anti-sense: NO
cctatgacaatcgaactattgactccctttaccaaggtagagttggagccagaaatcaaggagaaaaaacgcaaacaagttgggattttaggggggaattttaaccctgttcacaatgcccatctcattgttgcggatcaagtacggcaacagttgggactggatcaagttctgctcatgcctgaataccaacctcctcacgttgataaaaaggaaaccatccctgaacaccatcgtctcaagatgcttgagttggcaattgagggaattgacggcctagtcattgaaaccattgagttggagcgcaagggtatttcctacacctacgacaccatgaagattttgacagagaagaatccagatacggattattactttatcatcggtgccgacatggttgactatctgcctaagtggtaccgaattgatgaactggttgacatggttcagtttgtgggggttcagcgtccacgctacaaggtagggacttcctatccagttatctgggtggacgtaccgctcatggatatctcgtccagcatggtgcgtgccttccttgcccaaggtcggaaacccaactttctcctacctcagccagtgctagactacatcgagaaggaggggctctactga

SEQ ID NO: 2153 - DNA (genomic), 591 bp, Streptococcus pneumoniae; double-stranded, circular
  misc_feature (B) LOCATION 1...591
  hypothetical: NO
  anti-sense: NO
ctgatgacaatgaaagcgatgaaaacgatgatgcggattactgataatcaacacaagattattaaagaaaaatttgttgaagaatatcctaaactaagcaatcttcttttagacagaaccttggaaagtctatcccaagatgaacgtattttcatttttccaaatgatttgactcatactccagatttggataaaaaacaaaagattttggaaacgatcaatcaggaaatcaagacaggaaatgtgattggttttcttggatatggtcaggaaagattaacgatttcctcacgattttctgatgagagtaatgaccattttttgcattatctcttaaacaaggttcttcatatcaatctcactagtttagatgttgctttgtctcgtgaagagaggctttatcaacttttgatgtatctcttccccaagtatctacaagctgctattcgaaaaggtctttataaggaatatcatcgattttctcataacgacagtcatgttaagggagtgattgatgtaagaaaccatcctcaagaaaaatcttcctttcacgggaaatattgcctacacaacgagagagttcacctatga

SEQ ID NO: 2154 - DNA (genomic), 366 bp, Streptococcus pneumoniae; double-stranded, circular
  misc_feature (B) LOCATION 1...366
  hypothetical: NO
  anti-sense: NO
aggatgacaattaaactagtagcaacggatatggacggaaccttcctatatgggaatggacgctttgatatggatcgtctcaagtctctattggcttcctacaaggaaaaagggatttactttgcggtggcttcgggtcggggatttctgtctctggaaaaattatttgctggtgttcgtgatgacattattttcatcgcggaaaatggcagtttggtaaagtatcaaggtcaggacttgtatgaagcgactatgtctcgtgacttttatctggcaacttttgaaaagctgaaaacgtcaccttatgtagatatcaataaactgctcttgacgggtaagaaggttcatatgtctagatacggttga

SEQ ID NO: 2155 - DNA (genomic), 207 bp, Streptococcus pneumoniae; double-stranded, circular
  misc_feature (B) LOCATION 1...207
  hypothetical: NO
  anti-sense: NO
agacggacaatcttggccggaataccgacaaccgtcacatcactaggtacatctgctacgacaactgctgcagcaccgaccttggcattttcaccaatttccacaggcccgataacttgggcatgggctgatatgagggctccctttcgtacagtcggatggcgtttgccacagtctttccctgttcccccgagagtcactccgtga

SEQ ID NO: 2156 - DNA (genomic), 219 bp, Streptococcus pneumoniae; double-stranded, circular
  misc_feature (B) LOCATION 1...219
  hypothetical: NO
  anti-sense: NO
acacgagcaatccaaatcgggtcacgcctgctggtttttaggcagctagagcgtaagaagtgttattttttgcagttatatttaactgagcgtttacgtcgccacacgagtcgcaaaatatgcctcataatgcctgtcgaatccgtaacgaccccaaaagacaataaaactattataccttatctaactcaaaaatgcaaaaagaaatcacatacctaa

SEQ ID NO: 2157 - DNA (genomic), 2505 bp, Streptococcus pneumoniae; double-stranded, circular
  misc_feature (B) LOCATION 1...2505
  hypothetical: NO
  anti-sense: NO
aaatttcccttttgtggtataatagataaagtgaggaaatccatgcaaaatcaattaaatgaattaaaacgaaaaatgctggaatttttccagcaaaaacaaaaaaataaaaaatcagctagacctggcaagaaaggttcaagtaccaaaaaatctaaaaccttagataagtcagtcattttcccagctattttactgagtataaaagccttatttaacttactctttgtactcggttttctaggaggaatgttgggagctgggattgctttgggatacggagtggccttatttgacaaggttcgggtgcctcagacagaagaattggtgaatcaggtcaaggacatctcttctatttcagagattacctattcggacgggacggtgattgcttccatagagagtgatttgttgcgcacttctatctcatctgagcaaatttcggaaaatctgaagaaggctatcattgcgacagaagatgaacactttaaagaacataagggtgtagtacccaaggcggtgattcgtgcgaccttggggaaatttgtaggtttgggttcctctagtgggggttcaaccttgacccagcaactaattaaacagcaggtggttggggatgcgccgaccttggctcgtaaggcggcagagattgtggatgctcttgccttggaacgcgccatgaataaagatgagattttaacgacctatctcaatgtggctccctttggccgaaataataagggacagaatattgcaggggctcggcaagcagctgagggaattttcggtgtagatgccagtcagttgactgttcctcaagcagcatttttagcaggacttccacagagtcccattacttactctccttatgaaaatactggggagttgaagagtgatgaagacctagaaattggcttaagacgggctaaggcagttctttacagtatgtatcgtacaggtgcattaagcaaagacgagtattctcagtacaaggattatgaccttaaacaggactttttaccatcgggcacggttacaggaatttcacgagactatttatactttacaactttggcagaagctcaagaacgtatgtatgactatctagctcagagagacaatgtctccgctaaggagttgaaaaatgaggcaactcaaaagttttatcgagatttggcagccaaggaaattgaaaatggtggttataagattactactaccatagatcagaaaattcattctgccatgcaaagtgcggttgctgattatggctatcttttagacgatggaacaggtcgtgtagaagtagggaatgtcttgatggacaaccaaacaggtgctattctaggctttgtaggtggtcgtaattatcaagaaaatcaaaataatcatgcctttgataccaaacgttcgccagcttctactaccaagcccttgctggcctacggtattgctattgaccagggcttgatgggaagtgaaacgattctatctaactatccaacaaactttgctaatggcaatccgattatgtatgctaatagcaagggaacaggaatgatgaccttgggagaagctctgaactattcatggaatatccctgcttactggacctatcgtatgctccgtgaaaagggtgttgatgtcaagggttatatggaaaagatgggttacgagattcctgagtacggtattgagagcttgccaatgggtggtggtattgaagtcacagttgcccagcataccaatggctatcagaccttagctaataatggagtttatcatcagaagcatgtgatttcaaagattgaagcagcagatggtagagtggtgtatgagtatcaggataaaccggttcaagtctattcaaaagctactgcgacgattatgcagggattgctacgagaagttctatcctctcgtgtgacaacaaccttcaagtctaacctgacttctttaaatcctactctggctaatgcagattggattgggaagactggtacaaccaaccaagacgaaaatatgtggctcatgctttcgacacctagattaaccctaggtggctggattgggcatgatgataatcattcattgtcacgtagagcaggttattctaataactctaattacatggctcatctagtaaatgcgattcagcaagcttccccaagcatttgggggaacgagcgctttgctttagatcctagtgtagtgaaatcggaagtcttgaaatcaacaggtcaaaaaccagggaaggtttctgttgaaggaaaagaagtagaggtcacaggttcgactgttaccagctattgggctaataagtcaggagcgccagcgacaagttatcgctttgctattggtggaagtgatgcggattatcagaatgcttggtctagtattgtggggagtctaccaactccatccagctccagcagttcaagtagtagttctagcgatagcagtaactcaagtactacacgaccttcttcaagggcgagacgataa

SEQ ID NO: 2158 - DNA (genomic), 210 bp, Streptococcus pneumoniae; double-stranded, circular
  misc_feature (B) LOCATION 1...210
  hypothetical: NO
  anti-sense: NO
tntnnnntnnnnnnnnnnnnnnnnnnnnnnnntnnnnnnnnnnnnnnnnnnnnnnnnnnnnnnnnnnnnnnnnnnnannnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnattttataacaagccaaaaacagcggatcatgtggtag

SEQ ID NO: 2159 - DNA (genomic), 579 bp, Streptococcus pneumoniae; double-stranded, circular
  misc_feature (B) LOCATION 1...579
  hypothetical: NO
  anti-sense: NO
atgtctcaaatcgaaagaatcaaacaggctatcatggcggattcgcagaatgccagctatacagagcgtggcattgagcctctctttgcagcgccaaaaactgctcgcatcaatatcatcggtcaggctccgggacttaaaactcaagaagcaggcctttactggaaagataaaagtggtgaccgcttgcgggactggctaggtgtggatgaagataccttttacaattcaggttattttgctgttttgcctatggatttctactttccaggacatggcaagtcgggtgatcttccgcctcgtacaggttttgcagaaaaatggcatccgcaggtcttacaggaattgcctgatattcagttaaccctcttgattgggcaatatgcccaagcctactatttacaggagaaaatcagtgggaaggtaacggagagggtgaaacactataaagactatctgccagcctattttccgctagttcacccatcaccacgaaatcaaatctggatggccaaaaatccttggtttgaggcagaagtagtgccagatttgaaaaaaagaattaaaaccattttatag

SEQ ID NO: 2160 - DNA (genomic), 654 bp, Streptococcus pneumoniae; double-stranded, circular
  misc_feature (B) LOCATION 1...654
  hypothetical: NO
  anti-sense: NO
gcttatcaaataggagaaaccatgacctctatcacagcgatttttttcgatttggatggaaccctcgttgatagttctatcgggattcacaatgcctttacctatacctttaaagagctgggggtgcctagccctgatgccaaaactattcgtggttttatgggaccacctctcgaaagtagttttgcgacctgcctgtccaaagaccaaatttctgaagccgtgcagatatatcgttcttactataaggcaaaaggcatctatgaagctcaactctttcctcagattatagacttgcttgaggagttatcgagcagttatccactctacatcaccacgacaaaggatacatctactgctcaagacatggcaaaaaacttggaaatccatcatttctttgatggcatttatggttctagccctgaagcaccccataaggcagatgtcattcaccaagccttgcagacacatcaactagcaccagaacaagccatcatcatcggagataccaagtttgatatgctgggagctcgagaaacaggtattcagaaattggccatcacttggggatttggagagcaagcagatctactaaactatcaacctgattatatcgctcacaaacccttagaggttttggcgtattttcaatag

SEQ ID NO: 2161 - DNA (genomic), 966 bp, Streptococcus pneumoniae; double-stranded, circular
  misc_feature (B) LOCATION 1...966
  hypothetical: NO
  anti-sense: NO
agtcatcaaataaagaaagactctaaggagaatcctatgaaattcaatccaaatcaaagatatactcgttggtctattcgccgtctcagtgtcggtgttgcctcagttgttgtggctagtggcttctttgtcctagttggtcagccaagttctgtacgtgccgatgtggtcaatccgaccccaggtcaagtcttacctgaagagacatcgggaacgaaagagggtgacttatcagaaaaaccaggagacaccgttctcactcaagcgaaacctgagggcgttactggaaatacgaattcacttccgacacctacagaaagaactgaagtgagcgaggaaacaaactcttctagtctggatacactttttgaaaaagatgaagaagctcaaaaaaatccagagctaacagatgtcttaaaagaaactgtagatacagctgatgtggatgggacacaagcaagtccagcagaaactactcctgaacaagtaaaaggtggagtgaaagaaaatacaaaagacagcatcgatgttcctgctgcttatcttgaaaaagctgaagggaaaggtcctttcactgccggtgtaaaccaagtaattccttatgaactattcgctggtgatggtatgttaactcgtctattactaaaagcttcggataatgctccttggtctgacaatggtactgctaaaaatcctgctttacctcctcttgaaggattaacaaaagggaaatacttctatgaggtagacttaaatggcaatactgttggtaaacaaggtcaagctttaattgatcaacttcgcgctaatggtactcaaacttataaagctactgttaaagtatacggaaataaagacggtaaagctgacttgactaatctagttgctactaaaaatgtagacatcaacatcaatggattagttgctaaagaaaactgtcgaaaaagccgttgcagacaacgttaa

SEQ ID NO: 2162 - DNA (genomic), 651 bp, Streptococcus pneumoniae; double-stranded, circular
  misc_feature (B) LOCATION 1...651
  hypothetical: NO
  anti-sense: NO
ggagatcaaatcatgaatcttttgattatgggcttacctggtgcaggtaagggaactcaagcagcaaaaatcgtagaacaattccatgttgcacatatctcaacaggtgatatgttccgcgctgcaatggcaaatcaaactgaaatgggtgttcttgctaagtcatatattgacaagggtgaattggttcctgacgaagttacaaatggaatcgtaaaagaacgcctttcacaagatgatattaaagaaacaggattcttattggatggttacccacgtacaattgaacaagctcatgccttggacaaaacattggctgaacttggcattgaactagaaggtgttatcaatattgaagtgaaccctgacagcctcttggaacgtttgagtggccgtatcatccaccgcgtaactggagaaactttccacaaggtctttaacccaccagttgactataaagaagaagattactaccaacgtgaagatgataagcctgagacagtaaaacgtcgtttggatgttaatattgctcaaggagaaccaatcattgctcactaccgtgccaaaggtttggttcatgacatcgaaggtaatcaagatatcaatgatgtcttctcagatattgaaaaagtattgacaaatttgaaataa

SEQ ID NO: 2163 - DNA (genomic), 1992 bp, Streptococcus pneumoniae; double-stranded, circular
  misc_feature (B) LOCATION 1...1992
  hypothetical: NO
  anti-sense: NO
aatgtacaaatagaactagaggtttctaaattacgaatgctattaaccaaacgagaagaacaattattgaaggctttcctacatgtagggaagctttcaatgcaagatatgactgaaatcttacaggtttcatctagaacaatttatcgaactttatcagatttgacagatagcatggagcaatatggaatcgaaataacgaagcatgggaaatactatattttgactggagagttggatgatttgccgacagaacttgaagtgttagttgagtatagtccccaagaaagacaagagttgattacctatcgccttctgactgagagtggttttgtcaccaatgaagcattgcaagagtgcacgaaagtcagtaatgtaactattattcaggatatttcagatattgataagcgtcttttagactttgatctgaaaattgaacgacaaaaaggttatcggatttctggtgattcagttggtaagagaagatttttggctattttactgacaaactgtatctcagtagcagatttttcaaccggtaattttgggagctttgatattttagaagcagatagaactaggctggccagtcagattgttaataagcaactgtcaggttttccagatatggatgctaggatgaagatgttttttgcgatcttgttatctcttataggtcaggagcaaaacattgaaaattcacctaatactagtaagcaggctttggaaatttctcaaaaaatttttcaagcttactctaagcagactgcacaattttatagtattcaggaaattatctattttgcgagcatcttggatgaattaatcattaaacgtcaggacaatccgctctttacggagaaatttgatggtgaatttttctacaatatttcaaatctgattgatacggtttccatgtataccaagattgacttttttaaggacaaggttttattcaattttcttttccatcatattcggctcagtttaggcgtccctatcctttttcagagtgaaaatttgccagaatctgtccagattttagttgaaaggaataaatttctttatacagtcatcagtcttttagtgaatgatatttttccgaaatatcttcatacagactatgagtatggcatgattgccctacattttatctctagcttaggccgtagtccagagatttatccagtccgtgttttgcttttaacggatgaacgtcgggtcactagagatttattagtcagtaaaattaagagtgttgctccttttgtagagttgatagatattcagtctctagtagattaccacagtattgatctcagtcagtatgattatattttatctaccaagccgctgactaatcaggaaatcgatgtaatttctagttttccaaccgtcaaagaattgcttgaattacaggaacgacttcagtatgtacaggcacatcgtacaattgtcgcgcgtgatgctatcgctccagagaaaagttatgacttgcaagattatttaatatctagtagtcagcttttgagtcaattcgagttggttcaattggagaataatcaatcatttgagcatacggtagaacaaatcatccaatatcagaagaatgtgagtgacagagattacctaacaagaaaattgttatctcacttccagaatagtcctatggctattcctaatactggtctggtgcttttacatagtcagtctagcaaagtaacaacaaatagttttactatgtttgaactcaaactacctatctccgcattgtcaatgaaacgagaggaagaagaggtcaaaaggtgtctgctaatgctaatgtctaaagaagctagcgaggaagcgagagatttaatgacagctatcagtcagtcgattattgaaaatcatctttatacagagatttacaagacgggaaatcaatccattatttatcagatgctaaatactatttttaacgaaaaaattaagaaattggagaactaa

SEQ ID NO: 2164 - DNA (genomic), 198 bp, Streptococcus pneumoniae; double-stranded, circular
  misc_feature (B) LOCATION 1...198
  hypothetical: NO
  anti-sense: NO
agtaggcaaatcccctattttcaaaaagtttatcatttttattttaatttcttggatgagaaaaaagacatatttatgaaaaagctccatcgtgcttttaatgtgttctcttgttttcaaactcgtaaaaagggagccactgagcctaactcgctctctcatttcaaagcttgtgaaaaaagaccgttggggtcttaa

SEQ ID NO: 2165 - DNA (genomic), 336 bp, Streptococcus pneumoniae; double-stranded, circular
  misc_feature (B) LOCATION 1...336
  hypothetical: NO
  anti-sense: NO
atttttaaaatgaaaaaaatgatgacattcttgaaaaaagctaaggttaaagcttttacattggtggagatgttggtggtcttgctgattatcagcgtgcttttcttgctctttgtacctaatctgaccaagcaaaaagaggcagtcaatgacaaaggaaaagcagctgttgttaaggtggtggaaagccaggcagaactttatagcttggaaaagaatgaagatgctagcctaagcaagttacaagcagatgggcgaatcacggaagaacaggctaaagcttataaagaataccatgataaaaatggagtagcaaatcgtaaagtcaatgattaa

SEQ ID NO: 2166 - DNA (genomic), 813 bp, Streptococcus pneumoniae; double-stranded, circular
  misc_feature (B) LOCATION 1...813
  hypothetical: NO
  anti-sense: NO
gagtttaaaatgaaacaactaaccgttgaagatgccaaacaaattgaattagaaattttggattatattgatactctctgtaaaaagcacaatatcaactatattattaactacggtactctgattggggcggttcgacatgaaggctttatcccttgggacgacgatattgatttatccatgcctagagaagactaccaacgatttattaacatttttcaaaaggaaaaaagcaagtataagctcctatccttagaaactgataagaactactttaacaactttatcaagataaccgacagtacgactaaaattattgatactcgaaatacaaaaacctatgagtctggtatctttatcgatattttccctatagatcgctttgatgatcctaaggtcattgatacttgttataaactggaaagcttcaaactgctgtctttcagtaaacataaaaatattgtctataaggatagccttttaaaagattggatacgaacagccttttggttgctccttcgaccggtttctcctcgttattttgcaaataaaatcgagaaagaaattcaaaaatatagtcgtgaaaatgggcagtatatggcttttattccttcaaaatttaaggaaaaggaagtcttcccaagtggtacctttgataaaacaatcgatttaccctttgagaatttaagccttcctgcacctgaaaaatttgatactattttgacacaattttatggagattatatgaccctaccaccagaagaaaaacgcttctacagtcatgaatttcacgcttataaattggaggattag

SEQ ID NO: 2167 - DNA (genomic), 192 bp, Streptococcus pneumoniae; double-stranded, circular
  misc_feature (B) LOCATION 1...192
  hypothetical: NO
  anti-sense: NO
ttaattaaaattatggagaatatagacatgtttaaatcaaatcatgagcgaagaatgcgttattccattcgtaaatttagtgtaggagtagctagcgtagctgttgccagtctttttatgggaagtgttgtacatgcgacagagaaagagggaagtacccaagcagccaatgtcattaagttagtgatctaa

SEQ ID NO: 2168 - DNA (genomic), 4590 bp, Streptococcus pneumoniae; double-stranded, circular
  misc_feature (B) LOCATION 1...4590
  hypothetical: NO
  anti-sense: NO
ggaattaaaatgaaaaaaagtacagtattgtcattaaccacagctgcagttattttagcagcctatgcccctaatgaggtagtcttagcagacacatctagctctgaagatgctttaagcatctctgataaagaaaaagtagtagtagataaggaaacagaaaataaagagaaacataaagatatccatagtgctatggaaacttcacaggattttaaagagaagaaaatagcagtcattaaggaaaaagaagttgttagtaaaactcctgtgatagacactaaaactagcaatgaagaaaattccaataaatcccaaggagatcatacggactcatttgtgaataaaaacacagaaaatcccaaaaaagaagataaagttgtctatattgctgaatttaaagataaagaatctggagaaaaagcaatcaaggaactatccagtcttaagaatacaaaagttttatatacttatgatagaatttttaacggtagtgccatagaaacaattccagataacttggacaaaattaaacaaatagaaggtatttcatcggttgaaagggcacaaaaagtccaacccatgatgaatcatgccagaaaggaaattggagttgaggaagctattgattacctaaagtctatcaatgctccatttgggaaaaattttgatggtagaggtatggtcatttcaaatatcgatactggaacagattataggcataaggctatgagaatcgatgatgatgctaaagcctcaatgagatttaaaaaagaagacttaaaaggaactgataaaaatttctggttgagtgataaaatccctcatgcgttcaattattataatggtggcaaaatcactgtagaaaaatatgatgatggaagggattattttgacccacatgggatgcatattgcagggattcttgctggaaatgatactgaacaagatatcaaaaactttaacggcatagatggaattgcgcctaatgcacaaattttctcttataaaatgtattctgacgcaggatctgggtttgcgggtgatgaaacaatgtttcatgctattgaagattctatcaaacacaacgttgatgttgtttcggtatcatctggttttacaggaacaggtcttgtaggtgagaaatattggcaagctattagggcattaagaaaagcaggcattccaatggttgtcgctacgggtaactatgcgacttctgcttcaagttcttcatgggatttagtagcaaataatcatctgaaaatgaccgacactggaaatgtaacacgaactgcagcacatgaagatgcgatagcggtcgcttctgctaaaaatcaaacagttgagtttgataaggttaacattggaggacaaagttttaaatacagaaatataggggcctttttcgataagaataaaatcacaacaaatgaagatggaacaaaagctcctagtaaattaaaatttgtatatataggcaaggggcaagaccaagatttgataggtttggatcttaggggcaaaattgcagtaatggatagaatttatacaaaggatttaaaaaatgcttttaaaaaagctatggataagggtgcacgcgccattatggttgtaaatactgtaaattactacaatagagataattggacagagcttccagctatgggatatgaagcggatgaaggtactaaaagtcaagtgttttcaatttcaggagatgatggtgtaaagctatggaacatgattaatcctgataaaaaaactgaagtcaaaagaaataataaagaagattttaaagataaattggagcaatactatccaattgatatggaaagttttaattccaacaaaccgaatgtaggtgacgaaaaagagattgactttaagtttgcacctgacacagacaaagaactctataaagaagatatcatcgttccagcaggatccacatcttgggggccaagaatagatttacttttaaaacccgatgtttcagcacctggtaaaaatattaaatccacgcttaatgttattaatggcaaatcaacttatggctatatgtccggaactagtatggcgactccaatcgtagcagcttctactgttttgattcgaccaaaattgaaggaaatgcttgaaaaacccgtattaaaaaatcttaaaggtgatgataaaatagaccttacaagtcttacaaaaatagccctacaaaatactgcaagacctatgatggatgcaacttcttggaaagaaaaaagtcaatactttgcatcacctagacagcagggggcggggctaattaatgtggccaacgctttgagaaatgaagttgtagcgactttcaaaaacacggattctaaaggtttggtaaattcatatggttccatttctcttaaagaaataaaaggtgataaaaaatactttacaattaagcttcacaatacatccaacaggcctttaacctttaaagtttcagcatcagcggtaactacagattctctaactgacagactaaaactggatgaaacatataaagatgaaaaatctccagatggtaagcaaattgttccagaaattcatccagaaaaagtcaaaggggcaaatattacatttgagcatgacactttcactataggggcaaattctagctttgatttaaatgcggttataaatgttggggaggctaaaaataaaaataaatttgtagaatcatttattcattttgagtcagtagaagaaatggaagcattaagctccaatggcaagaaaaccgacttccaaccatctttatcaatgcccctaatgggatttgctgggaattggaaccacgaaccaatccttgataaatgggcttgggaagaaggatcaaaatcaaaaacaatggaaggttatgatgatgacggtaaaccaaaaattccaggaaccttaaataaggggattggtggagaacatggtatagataaatttaatccagcaggagttatccaaaatagaaaagataaaaatagaacatctctagatcaagatccagacttatttgcctttaacaaccaaggtgttcatgcagaatccactagtggttctaagattgctaacatttatcctttagattcaaatggaaatcctcaagatgctcaactagaaagaggactaactccatctccacttgttctaagaagtgcagaagaaggactaatttcaattgtaaacaccaacaaagaaggagaaaaccaaaaagaccttaaagttgtatcaagagagcacttcataagaggaattctaaattctaagggaaatgacgctaagggtatcaaatcatccaaactaaaagtttggggtgacttgaaatgggatggactcatctataacccaagaggtagagaagaaaatgccccagaaagtaaggataaccaagatccagctactaagatacgaggacaatttgaaccgattgcggaaggtcaatatttctataaatttaaatatagattaactaaagattacccatggcaggtttcctatattcctgtaaaaattgataacacagcccctaagattgtttcggttgatttttcaaatcctgaaaaaattaagctaatcacaaaggatacttatcacaaggtaaaagatcaatacaagaatgaaactttatttgctagagatcaaaaagaacatcctgaaaaatttgatgagattgcaaatgaggtgtggtatgcaggagctgctcttgttaatgaagatggagaggttgagaaaaatcttgaagtaacttatgcaggtgagggtcaaggaagaaataggaagcttgataaagatgggaatactatctatgaaattagcggagcaggagatctaagaggaaaaatcatcgaagtaatcgccctagatggagcaagcaactttaccaaaatccataggattaaatttgctaatcaagctgatgaaaaagggatgatttcctattatctagtagatcctgatcaggattcatctaaataccaaaagcttggcgaaattcctgaatctaaatttaagaatttaaaaaatgttaaagatgatagcctaaacaaagagacagctgaggtggaaaataaccttttagtagataatcagtctatcgaaggaaaatctctctttaatattcataaaactatttcaacaattagagactttgaaaataaagacctaaagaaactcattaaaaagaaatataagcaagaagacgactttgtaaatggtggaacaagaacagtagagcgtgattataaatacgatgataaaggaaatataatagcctacgatgatgggactgatctagaatatgaaactgagaaacttgacgaaatcaaatcaaaaatttatggtgttctaagtccgtctaaagatggacactttgaaattcttggaaagataagtaatgtttctaaaaatgccaaggtatattatgggaataactataaatctatagaaatcaaagcgaccaagtatgatttccactcaaaaacgatgacatttgatctatacgctaatattaatgatattgtggatggcattagcttttgcaggagatatgagattatttgttaa

SEQ ID NO: 2169 - DNA (genomic), 1440 bp, Streptococcus pneumoniae; double-stranded, circular
  misc_feature (B) LOCATION 1...1440
  hypothetical: NO
  anti-sense: NO
ggaattaaaatgagtattttagaagttaaaaatctgagtcacggttttggtgaccgtgcaatttttgaagatgtgtccttccgtctcctcaagggagaacatatcggcctggtcggtgccaatggtgaaggaaaatcaacctttatgagtatcgtgactggtaaaatgctgccagatgaaggaaaggttgagtggtccaaatatgtgacggctggttacttggatcagcactctgtccttgctgaaagacagtcggtgcgtgatgttctccgtacggcttttgatgagcttttcaaagctgaagctcgtatcaatgacctctatatggaaatggctgaagacggtgcggatgttgatgctctcatggaagaagtaggagaacttcaagaccgtctggagagtcgtgatttctataccttggatgctaagattgacgaagtagcgcgtgctcttggtattatggactttggcatggatacggatgtaacttctttgtcaggtgggcaaagaaccaaggtgcttttggcaaaacttctccttgaaaagcctgatattttgctgttggacgagccgaccaactacttggatgctgagcatattgattggctcaagcgctatctccaaaactatgagaatgcctttgttctcatttcgcacgatattccattcctcaatgacgttatcaatattgtctatcatgtggaaaatcaacagctgacgcgttactctggtgactactaccagttccaagaagtttatgctatgaagaaatctcagctagaggcagcctacgaacgccagcagaaagagattgcagacctcaaggactttgtggctcgtaataaagcccgtgttgcaactcgtaatatggctatgtctcgtcaaaagaaattggataagatggatattatcgaactccaaagtgagaaaccaaaaccatcctttgatttcaaaccagctcgtacaccagggcgctttatcttccaagccaagaacttgcaaattggttacgaccgtcctcttactaagcctttaaatcttaccttcgaacgcaatcaaaaggttgcgattattggtgctaatggtattggaaaaacaactctcttgaagagtctcttgggcattatctcgccaatcgctggggaagtggagcgtggagattatttagaacttggttattttgagcaggaagtagaaggtggtaatcgccaaactcctcttgaagctgtctggaatgcctttcctgcccttaatcaagcagaagtccgtgcagcccttgcccgttgtggtttgacaaccaaacatattgaaagccagattcaagtattatcagggggagagcaagccaaggttcgtttctgtctcttgatgaatcgtgaaaacaacgttttagtgctggacgagccgcaccaaccatttggatgtggatgcaaaggatga

SEQ ID NO: 2170 - DNA (genomic), 1287 bp, Streptococcus pneumoniae; double-stranded, circular
  misc_feature (B) LOCATION 1...1287
  hypothetical: NO
  anti-sense: NO
ggttctaaaatgagggaaccagattttttaaatcattttctcaagaagggatatttcaaaaagcatgctaaggcggttctagctctttctggtggattagattctatgtttctatttaaggtattgtctacttatcaaaaagagttagagattgaattgattctggctcatgtgaatcataagcagagaattgaatcagattgggaagaaaaggaattaaggaagttggctgctgaagcagagcttcctatttatatcagcaatttttcaggagaattttcagaagcgcgtgcacgaaattttcgttatgatttttttcaagaggttatgaaaaagacaggtgcgacagctttagtcactgcccaccatgctgatgatcaggtggaaacgattttgatgcgcttgattcgaggaactcgcttgcgctatctatcaggaattaaggagaagcaagtagtcggagagatagaaatcattcgtcccttcttgcattttcagaaaaaagactttccatcaatttttcactttgaagatacatcaaatcaggagaatcattattttcgaaatcgtattcgaaactcttacttaccagaattggaaaaagaaaatcctcgatttagggatgcaatcttaggcattggcaatgaaattttagattatgatttggcaatagctgaattatctaacaatattaatgtggaagatttacagcagttattttcttactctgagtctacacaaagagttttacttcaaacttatctgaatcgttttccagatttgaatcttacaaaagctcagtttgctgaagttcagcagattttaaaatctaaaagccagtatcgtcatccgattaaaaatggctatgaattgataaaagagtaccaacagtttcagatttgtaaaatcagtccgcaggctgatgaaaaggaagatgaacttgtgttacactatcaaaatcaggtagcttatcaaggatatttattttcctttggacttccattagaaggtgaatcaattcaacaaatacctgtttcacgtgaaacatccatacacattcgtcatcgaaaaacaggagatgttttgattcaaaatgggcatagaaaaaaactcagacgtttatttattgatttgaaaatccctatggaaaagagaaactctgctcttattattgagcaatttggtgaaattgtctcaattttgggaattgcgaccaataatttgagtaaaaaaacgaaaaatgatataatgaacactgtactttatatagaaaaaatagataggtaa

SEQ ID NO: 2171 - DNA (genomic), 387 bp, Streptococcus pneumoniae; double-stranded, circular
  misc_feature (B) LOCATION 1...387
  hypothetical: NO
  anti-sense: NO
tataataaaataatagaaaacgctattaaaagaaggagggggatgtcggtgatggaacatttgtttaaattcttacttttagcaccgtacttttattttgataactggattgaaaaggccaacagaaatagtaagttttttccaattttttattatttttactggatttacatccccttctattctctttttagccttgcttggacagttgtttcagttctgtttttcaataccgtcttgagaaatgtgacagatatcaagttatggggcatttggtttctttttattctgctagctattggtatgaattggttaacttattcctgtttcaaagaaatgtttcgcttgagacaggaactagggaagtctaagggtggaaggcattga

SEQ ID NO: 2172 - DNA (genomic), 327 bp, Streptococcus pneumoniae; double-stranded, circular
  misc_feature (B) LOCATION 1...327
  hypothetical: NO
  anti-sense: NO
actggtaaaatacacaaaatcggtgaactcacgaggtgcgtcacaaatggactggatggagcaagagcaagaacgtggtatcacgatcacatctgctggcggacaacagctcaatggaacaaccaccgcgtaaacatcatcgacacaccaggacacgtggacttcacaatcgaagtacaacgttctcttcgtgtattggatggtgcggttaccgttcttgactcacaatcaggtgttgagcctcaaactgaaacagtttggcgtcaacaactgagtacggagtccacgtatcgtatttgccaacaaaatggacaaaatcggtgctga

SEQ ID NO: 2173 - DNA (genomic), 666 bp, Streptococcus pneumoniae; double-stranded, circular
  misc_feature (B) LOCATION 1...666
  hypothetical: NO
  anti-sense: NO
ggaggtaaaatcgtgggtcaaaaagtacatccaattggtatgcgtgtcggcatcatccgtgattgggatgccaaatggtatgctgaaaaagaatacgcggattaccttcatgaagatcttgcaatccgtaaattcgttcaaaaagaacttgctgacgcagcagtttcaactattgaaatcgaacgcgcagtaaacaaagttaacgtttcacttcacactgctaaaccaggtatggttatcggtaaaggtggtgctaacgttgatgcactccgtgcaaaacttaacaaattgactggaaaacaagtacacatcaacatcatcgaaatcaaacaacctgatttggatgctcaccttgtaggtgaaggaattgctcgtcaattggagcaacgtgttgctttccgtcgtgcacaaaaacaagcaatccaacgtgcaatgcgtgctggagctaaaggaatcaaaactcaagtatcaggtcgtttgaacggtgcagatatcgcccgtgctgaaggatactctgaaggaactgttccgcttcacacacttcgtgcagatatcgattacgcttgggaagaagcagatactacatacggtaaacttggtgttaaagtatggatctaccgtggtgaagttcttccagctcgtaaaaacactaaaggaggtaaataa

SEQ ID NO: 2174 - DNA (genomic), 282 bp, Streptococcus pneumoniae; double-stranded, circular
  misc_feature (B) LOCATION 1...282
  hypothetical: NO
  anti-sense: NO
gagatcaaaattaagctcgtgtttggaaaattttctctaatagctttcaagagcttggactctgtaatggtatccagtgccgaggttgcatcatctaggatgagaaacggagcttggcgcaagactgctcgggcgatagacaatctttgtttttgtccacctgagaaatttcgcccccctgcctcaactagagcatccaagagtccttccttttcactgacaaaatccttagcttgcgcaatctccaaggcctgccagagttcctggtcagatacttcttga

SEQ ID NO: 2175 - DNA (genomic), 270 bp, Streptococcus pneumoniae; double-stranded, circular
  misc_feature (B) LOCATION 1...270
  hypothetical: NO
  anti-sense: NO
tcctccaaaatagtttatacgggaacaagcccgtgtcctcttagtgaacagataatattccaatcccctagtaatggactaaacactatgggcacgagtggactcgaaccaccgacctcacgcttatcaggcgtgcgctctaaccacctgagctacgcgcccaagtcaaaaacttggtacaaagaacaaagttcaaagcgggtgacgagaatcgaactcgcgacaacagcttggaaggctgtagttttaccactaaactacacccgctaa

SEQ ID NO: 2176 - DNA (genomic), 1128 bp, Streptococcus pneumoniae; double-stranded, circular
  misc_feature (B) LOCATION 1...1128
  hypothetical: NO
  anti-sense: NO
tttaacaaaataaaggagaaaaacatggttaaatacggtgttgttggagcagggtattttggagctgaattggctcgctatatgcaaaagaatgatggagcagagattactcttctctatgatccagataatgcagaggcgattgcagaagaattgggagcaaaagtagcaagttccttagatgagttggtttctagcgatgaagtagattgtgttatcgtcgccactccaaataatcttcataaggcaccggttattaaggctgcacagcatggtaaaaatgttttctgtgaaaaaccaattgcgctttcttatcaagattgtcgcgagatggtagatgcgtgtaaagaaaacaatgtaacctttatggcaggacatattatgaatttctttaatggtgttcatcatgcaaaagaactcattaatcaaggagttatcggagacgttctatattgtcatacagctcgtaatggttgggaagaacaacaaccgtcagtatcatggaaaaaaattcgtgaaaaatcaggtggtcacttgtatcaccacatccatgaattggattgcgttcaattccttatggggggcatgcctgaaactgtaaccatgacaggtggaaatgtggcccatgaaggtgaacatttcggtgatgaagatgatatgatttttgtcaatatggaattttctaataagcgttttgccttgttagaatggggttcagcttatcgttggggtgaacattatgtcttaatccaaggaagcaaaggtgccatccgcttagacttattcaactgtaaaggaactcttaagctagatgggcaagaaagctatttcttgattcacgaatcgcaagaagaagatgatgatcggactcgtatctatcatagtacagagatggatggagcaattgcttatggtaaaccaggtaaacgtactccattatggctatcatctgtcattgataaagaaatgcgctatctgcatgagattatggaaggagctccagtatcagaagaatttgcaaaacttttgacaggtgaagctgccctagaagcaattgctactgcagatgcttgtacccagtctatgtttgaagatcgcaaagtaaaattgtcagaaattgtaaaataa

SEQ ID NO: 2177 - DNA (genomic), 1326 bp, Streptococcus pneumoniae; double-stranded, circular
  misc_feature (B) LOCATION 1...1326
  hypothetical: NO
  anti-sense: NO
gacaacaaaatcaagctcttgcaagaattgaaagagcaggttgaggttgggactgccattaatgctagtaacattgaacattccaaagcacgtggcgacttaggcatttcttatgaccaagaagttcttcgtttgattgacaaattcaatgaattagggatttttgttggttccgttgtcattacacaatacactggccaacccgctgcagatgccttccgcaaccaacttgagaaaaacggaattgattcttatcttcattatccaatcaaaggatatccgacggatatggatcacatcatttcctcaaaaggcatgggcaaaaacgactacatcaaaaccagtcgcaacttgattgtcgtaaccgctcctggacccggttctggaaaattggcaacgtgtatgtccaatatgtaccacgaccaaatcaatggcatcaagtctggctacgctaaatttgaaaccttccctgtttggaatcttccccttcatcatccagttaacttggcttatgaagctgccacagctgaccttgatgatgtcaacatgattgaccccttccatcttcaaacctatggagaaaccactgtcaactacaaccgtgatatcgaaatcttcccagtgctcaagcgcatgttggaacgtattctcggaaaatcaccatacgcttcaccgacagatatgggtgtcaacatggttggtttcgctattacagatgacgaggctgctgtcgaagcttctaaacaagaaatcatccgccgttactatcaaacagttcttgacttcaaagctgaaaaagttggcgaagctgccgtcaagaaaattgagttgctcatgaacgacctcggtatcacacctgcagaccgtaaggttgctgtcgttgcgcgccaaaaagcagaagaaactggtggaccagccctagcctttgaattgccaaatggggaaatcgtcactggtaagaactcagaactctttgggcctacagccgctgccttgatcaacgccatcaaaaaatcagctgacatcgctaaagaagtaaaactaatcgagcctgaagttgttaagccaatccaaggtcttaaaatcgatcatctcggtagccgcaatccacgccttcattcaaatgaaattctgattgcacttgctatcacagctacagaaaatcctgatgctgcccgcgctatggaagaactcggcaacctcaaaggaagcgaagcccactcaaccatcatcttgactgatgaagacaagaatgtccttcgtaaactgggtatcaacgtaacctttgacccatactaccaatacgaccgcttatatcgtaagtaa

SEQ ID NO: 2178 - DNA (genomic), 900 bp, Streptococcus pneumoniae; double-stranded, circular
  misc_feature (B) LOCATION 1...900
  hypothetical: NO
  anti-sense: NO
atattaaaaataattcctttagatatttccataagagttcctcctcttcataagtctatcctatcacaaaaacgaaagaaaaacaattacgaacgaaagtttaatttgttgttttttgctttttattttggtagaataaaacggaggtgtaaaatgaaaagattggaacaaattattaaattagtatcagaacatgaaaagatcgacgttaatacattatcggaaaaattaaatgtatcgaaagtaacgattagaaaagatttagataaattagagtcaaaaggtttattacacagagagcatggatatgctgtattaaatagtggagatgacttaaatgtacgtttgtcaattaactatgaaattaagagaaaaattgttcaggaagcagtaaaattggtgtcagataatgaaacaataatgatagaatctggatcgacctgtgctttacttgctgaggaaatttgcaagcaaaaaagaaatgttacgattgtaacaaattcattttttatagcaaattttgtgagagcttatgattcatgtcgtattattgttcttggtggagagtttcagaaggattcacaggttactgtgggacctttattaaaagaaatgatacagacttttcatgtgcgtcaagcttttgttgggacagatggctacgataaagagatgggctttacaggaaaagatttaatgcgcagtgaggtagttcaatatatttcagcagcgtcggataaagtcattgtactaactgactcaagtaaatttgataaaaggggtacagtaagaagatttgctttaagtcaagtctatgaagtaataacagacgaaaaactttctaaacaaaatatagctacattagaaaatgctgggataatggttaaggtagtttcgtaa

SEQ ID NO: 2179 - DNA (genomic), 240 bp, Streptococcus pneumoniae; double-stranded, circular
  misc_feature (B) LOCATION 1...240
  hypothetical: NO
  anti-sense: NO
ccattaaaaatcaaacaaattttcagaatatttaggcttgttggcacaaatttttcatttttttttgaatatatgattcaaattgtcgttcgaagtgtcaaagactacagtgaaaataggaaatttgacgcagaaactttggagtttaggaagacatacagtaaaatgaaatacggacggaacaatgtgattttggaattcaaattaaattataacaatattgtagaagtatcattctag

SEQ ID NO: 2180 - DNA (genomic), 912 bp, Streptococcus pneumoniae; double-stranded, circular
  misc_feature (B) LOCATION 1...912
  hypothetical: NO
  anti-sense: NO
cccataaaaatatacaggaggcctgataaaatggcaatcgtttcagcagaaaaatttgtccaagcagcccgtgacaacggttatgcagttggtggatttaacacaaacaatcttgagtggactcaagctatcttgcgcgcagcagaagctaaaaaagctccagttttgatccaaacttcaatgggtgctgctaaatacatgggtggttacaaagttgctcgcaacttgatcgctaaccttgttgaatcaatgggtatcactgtaccagtagctatccaccttgaccacggtcactacgaagatgcacttgagtgtatcgaagttggttatacttcaatcatgtttgacggttcacaccttccagttgaagaaaatcttaaattggctaaagaagttgttgaaaaagcacacgctaaaggtatctcagtagaagctgaagttggtactatcggtggtgaagaagacggaatcatcggtaaaggtgaattggctccaatcgaagacgctaaagcaatggttgaaactggtatcgacttcttggcagctggtatcggtaacatccacggtccttacccagtaaactgggaaggtcttgaccttgaccacttgcaaaaattgacagaagctcttccaggattcccaatcgtattgcacggtggatcaggtattcctgatgagcaaatccaagcagctatcaaacttggtgttgccaaagttaacgttaacacagaatgccaaatcgcattcgctaacgcaactcgtaaatttgctcgtgactacgaagcaaacgaagcagaatacgacaagaaaaaactcttcgacccacgtaaattcttggctgacggtgtaaaagctatccaagcatcggttgaagaacgtatcgacgtattcggttcagaaggtaaagcataa

SEQ ID NO: 2181 - DNA (genomic), 276 bp, Streptococcus pneumoniae; double-stranded, circular
  misc_feature (B) LOCATION 1...276
  hypothetical: NO
  anti-sense: NO
nnnnaannnnnnnnnaaaaaaaaaaaaannnannnnnnnnaaaagggaaannaaaaaaaagagggaaannngaaggggggggagaaaanggggagggagggaaaggaggaagaaggnggggtganggnngggggggggaaaagaaggaaaaaaagggtgttgngggaggtntggggaaaaagggggaaggaaaaggnggggnnggggggaggttgggagggggaaagaaaggaagaaangggaatgggggtgggtgtgggggaaagtgaaaaaaaa

SEQ ID NO: 2182 - DNA (genomic), 888 bp, Streptococcus pneumoniae; double-stranded, circular
  misc_feature (B) LOCATION 1...888
  hypothetical: NO
  anti-sense: NO
aaagcaaaaatgaacggtattatcaacttaaaaaaagaagcaggaatgacctcgcatgatgcggtttttaaactgcgtaagattttgggaaccaagaaaattggtcatggcggaaccttggatccggatgtggtgggtgttttgccgattgcggttggcaaggcgacacgcatggtcgagtttatgcaggacgagggtaagatctatgagggggaaatcactctgggttattccacgacgactgaggatgctagtggggaagtggtcgcagaaacccctgttttgtctcccttggatgaaaagcttgttgatgaagcgattgctagcttgactgggcctattacccagattccccctatgtattcggcagttaaggttaatggtcgcaagctctatgagtatgcgcgtgctggtcaggaagtggagcgtccagaacgtcaggtgaccatttatcaatttgagcgaacaagtccgatttcttatgatggccaacttgcccgattcacttttcgtgtaaaatgcagtaaagggacttacatccgtactttgtcagttgatttgggtgaaaagcttggttatgcggctcatatgtcccatttgactcgtactagtgctgctggcttacaattagaagacgctctttccttggaggaaattgctgaaaaagtagaggctgggcaattagattttctccatcctttagagattgggacaggtgaccttgtcaaagttttcctaactccagaagaggctacagaagttcgctttggtcgttttattgagctagaccaaacggacaaagaactggctgcctttgaagatgataaattgttagccattctagaaaaacggggcaatctctataagccaaggaaggtttttagctag

SEQ ID NO: 2183 - DNA (genomic), 273 bp, Streptococcus pneumoniae; double-stranded, circular
  misc_feature (B) LOCATION 1...273
  hypothetical: NO
  anti-sense: NO
tataaaaaaattcaaactagaattcttcttagaaaaggccgttttaagtgctatcattgctcaaaaatggaggtcgctgagacttctatcgtcaagaagaatcatcaaattccttgtatcatcaaccaaaagattgatcagaagctaattgaaaagacttctatgaccgacattgatcatcagttgtctatttcaacttcaactgtcattcgcaagatcaatgattttcactttgagcatgatttttcgcgtcttcctgagattatgtcctag

SEQ ID NO: 2184 - DNA (genomic), 204 bp, Streptococcus pneumoniae; double-stranded, circular
  misc_feature (B) LOCATION 1...204
  hypothetical: NO
  anti-sense: NO
gttnnnnnnnnnnnnnnnnnnnnnnnnnnnnnnnnnnncaaaaaaannnnnnnnnnnngnnnnnnnnnnnngngggnnnnnggggngnggggngnnggggggggggggggggggggggngggggggggggggggggggggggggggngggnngggggggggggggggnggggggggggggnggggngggngggggggggggggg

SEQ ID NO: 2185 - DNA (genomic), 327 bp, Streptococcus pneumoniae; double-stranded, circular
  misc_feature (B) LOCATION 1...327
  hypothetical: NO
  anti-sense: NO
atannnnnnnnnnnnnnnnnnnnnnnnnnnnnnnnnnnnnntgggggnaannnaatannnnnaannnnnnnnnaaaaaaaaaaaaannnannnnnnnnaaaagggaaannaaaaaaaagagggaaannngaaggggggggagaaaanggggagggagggaaaggaggaagaaggnggggtganggnngggggggggaaaagaaggaaaaaaagggtgttgngggaggtntggggaaaaagggggaaggaaaaggnggggnnggggggaggttgggagggggaaagaaaggaagaaangggaatgggggtgggtgtgggggaaagtga

SEQ ID NO: 2186 - DNA (genomic), 1002 bp, Streptococcus pneumoniae; double-stranded, circular
  misc_feature (B) LOCATION 1...1002
  hypothetical: NO
  anti-sense: NO
ttnnnnnnnnnnnnnnnnnnnnnnnnnnnnnnnnnnnnnacagtaattttctttggtttgctagctacgaatacagtatttgcagataactctgaagtatggcagtttgtccaagaaaacggtagaacctattacaaaaagggggacctcaaagaaacctactggcgagtgattgatggtaagtactattattttgattctctatctggagagatggttgtcggctggcaatatatcccgtttccatctaaaggtagtacaattggtccttacccaaatggtatcagattagaaggttttccaaagtcagagtggtactacttcgataaaaatggagtgctacaagagtttgttggttggaaaacattagagattaaaactaaagacagtgttggaagaaagtacggggaaaaacgtgaagattcagaagataaagaagagaaacgttattatacgaactattactttaatcaaaatcattctttagagacaggttggctttatgatcagtctaactggtattatctagctaagacggaaattaatggagaaaactaccttggtggtgaaagacgtgcggggtggataaacgatgattcgacttggtactatttagatccaacaactggtattatgcaaacaggttggcaatatctacgtaataagtggtactacctccgttcctcaggagcaatggccactggctggtatcaggaaggtaccacttggtattatttagaccagccaaatggcgatatgaaaacaggatggcaaaaccttgggaacaaatggtactatctccgttcgtcaggcgccatggtgactggctgggtgaaagatgactcaacttggtattacctaaatgcaggtaatggagacatgaagacaggttggttccaggtcaatggcagatggtactacgcttatagctcaggtgccttggcagtgaatacgaccgtagatggctattctgtcaactataatggcgaatgggttcggtaa

SEQ ID NO: 2187 - DNA (genomic), 204 bp, Streptococcus pneumoniae; double-stranded, circular
  misc_feature (B) LOCATION 1...204
  hypothetical: NO
  anti-sense: NO
nnnnnnnnnnnnnnnnnnnnnnnnnnnnnnnnnnnnnnnnnannnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnattttataacaagccaaaaacagcggatcatgtggtagaggaggaagcacacgatgactggatctaa

SEQ ID NO: 2188 - DNA (genomic), 1416 bp, Streptococcus pneumoniae; double-stranded, circular
  misc_feature (B) LOCATION 1...1416
  hypothetical: NO
  anti-sense: NO
gtgaaaaaaatgacaaaaacacttccaaaagactttattttcggtggcgcaacagctgcttatcaagcagaaggtgctacacatactgatggaaaaggaccagttgcttgggataaatatcttgaggataactactggtacactgccgaaccagctagtgatttttacaatcgatatccagttgacctcaagctagcagaagagtatggtgtcaatggtattcgaatttctattgcttggtcacgtattttcccgactggttacggccaagtaaatgctaaaggtgttgagttttatcataatttatttgcagagtgtcacaaacgtcatgttgagccttttgtaactcttcatcactttgacactccagaagctctccactcaaatggagacttcttaaaccgtgaaaatatcgaacattttgtagactacgctgccttctgttttgaagaatttccagaagtaaactattggacaacctttaatgaaattggaccaatcggtgatggtcaatatttggttgggaaattccctccaggtatccagtacgaccttgccaaagtctttcaatcacaccacaatatgatggtgtctcatgcacgcgcggtaaaattgtacaaagagaaaggctataaaggggaaattggtgttgttcacgccctgcctactaaatatcctctagatcctgaaaatccagcagatgttcgtgcagctgagttggaagatatcatccacaataaattcatcttagacgcaacttatctaggtcgctattcagctgaaaccatggaaggtgtcaaccatatcttattagtcaatggtggtagtttggatcttcgtgaagaagattttacagcattagaagctgcaaaagacttgaatgatttcctaggaatcaactactatatgagtgactggatggaagcctttgatggagaaactgaaattatccataatggtaaaggtgaaaaaggaagctctaagtatcaaatcaaaggtgttggtcgtcgtgtagctcctgactatgtaccacgcacggattgggattggattatctaccctcaaggtttgtatgaccaaatcatgcgcgtgaagaaagattatcctaactataagaaaatctacatcactgaaaatggtcttggatataaagatgagttcgttgataacactgtttacgatgatggtcgtattgattacgtgaaacaacacttggagatcttgtctgatgcgattgcagatggagctaatgtaaaaggttacttcatttggtcattaatggatgtcttctcatggtcaaacggttatgagaaacgttatggtctcttctacgtagattttgaaactcaagaacgttatcctaagaaatcagctcactggtacaagaaagtagcggaaactcagattatagactag

SEQ ID NO: 2189 - DNA (genomic), 258 bp, Streptococcus pneumoniae; double-stranded, circular
  misc_feature (B) LOCATION 1...258
  hypothetical: NO
  anti-sense: NO
aaagaaaaaatcgaaaaattagctaagaaatattctgataacttaaacatcaaagttcaagagagagttcgtgaaatggcaaatgataataagagccattatttgatatacagagttttaggtatttcatttgaagaaggagaaaatatcgatttgtatcaaaataaaggtcgttttttatacaaatatgctggttcatttttagaagaagctgcagtactatcctttaacgaaaaatttggtacagaaaatacttaa

SEQ ID NO: 2190 - DNA (genomic), 237 bp, Streptococcus pneumoniae; double-stranded, circular
  misc_feature (B) LOCATION 1...237
  hypothetical: NO
  anti-sense: NO
ggagaaaaaatgagttacgaacaagaatttatgaaggaatttgaagcttgggtcaatacccaaatcatgattaacgacatggcgcacaaggaaagccaaaaagtttacgaagaagaccaggacgagcgtgccaaagatgccatgattcgctacgagagtcgcttggatgcttatcagttcttgcttggtaagtttgaaaacttcaaagtaggcaagggattccatgatttgccagaa

SEQ ID NO: 2191 - DNA (genomic), 888 bp, Streptococcus pneumoniae; double-stranded, circular
  misc_feature (B) LOCATION 1...888
  hypothetical: NO
  anti-sense: NO
aaggaaaaaatgacaaaaaaagttggtgtcggtcaggcacatagtaagataattttaataggggaacatgcggtcgtttacggttatcctgccatttccctgcctcttttggaggtggaggtgacctgtaaggtagttcctgcagagagtccttggcgcctttatgaggaggataccttgtccatggcggtttatgcctcactggagtatttggatatcacagaagcctgcattcgttgtgagattgactcggctatccctgaaaaacgggggatgggttcgtcagcggctatcagcatagcggccattcgtgcggtatttgactactatcaggctgatctgcctcatgatgtattagaaatcttggtcaatcgagctgaaatgattgcccatatgaatcctagtggtttggatgctaagacctgtctcagtgaccaacctattcgctttatcaagaacgtaggatttacagaacttgagatggatttatccgcctatttggtgattgccgatacgggtgtttatggtcatactcgtgaagccatccaagtggttcaaaataagggcaaggatgccctaccgtttttgcatgccttgggagaattaacccagcaagcagaagttgcgatttcacaaaaagatgctgaaggactgggacaaatcctcagtcaagcgcatttacatttaaaagaaattggagtcagtagccctgaggcagactttttggttgaaacgactcttagccatggtgctctgggtgccaagatgagcggtggtgggctaggaggttgtatcatagccttggtaaccaatttgacacacgcacaagaactagcagaaagattagaagagaaaggagctgttcagacatggatagagagcctgtaa

SEQ ID NO: 2192 - DNA (genomic), 1092 bp, Streptococcus pneumoniae; double-stranded, circular
  misc_feature (B) LOCATION 1...1092
  hypothetical: NO
  anti-sense: NO
ggcagaaaaatgaaaaccaaactaccgactgaatggcaagaactgagtgaccaactcggtttccaagaattcacccccattcaaactcaactatttgatccccttcttactggagaaaacctcctaggagtgagccaaaccggaactggtaagaccctagcgtatctcctaccaagtcttctcagactacaaaagaaaaaagcccaacaactcttgattctagcaccaaacacggaacttgctggacagatttttgatgtatgtaaaacgtgggcagaagctatcggattgactgctcaactcttcctttcaggttcaagtcagaaacgacaaattgaacgccttaaaaaggggccagaaattctgattggaactcctggccgtatctttgaactcattaaacttaaaaaaatcaagatgatgaatgtggaaaccatcatcctggatgaatttgaccaattactagatgattctcagattcactttgtagaaaaaatcactcactacgcacctcgtgaccaccaactggtctacatgagtgccacgaccaagtttgatcaagaaaagattgtgccgaatacacgcactattgatctctctaatcaaaaattggacaatatccagcatttctacatgcaggtagaccaacgtcatcgagtggatatactacgaaaactggctcatgtagaggatttccgtggtctagtcttcttcaatagcctgtcagaccttgggaatgccgaggaaaaactacagtatcgtgatatattggctgtttccctcgctagtgatgttaatgttaaatttagaaaagtcatcttagaaaagtttaaagataaccaactaaccctgcttcttgcaactgaccttttggctcgtggaattgatatcgatagcctagaatgtgtcgtaaactttgatattcctagagatagcgaaacctacacacaccgtgctggccgtactggccgtatgggcaaggaaggatatgttattactctcgtcactcatccagaagaaatcaaaaaacttaaaaagtttgcaagtatccgagaaattgtcctaaaaaaccaagaactctatatcaaataa

SEQ ID NO: 2193 - DNA (genomic), 660 bp, Streptococcus pneumoniae; double-stranded, circular
  misc_feature (B) LOCATION 1...660
  hypothetical: NO
  anti-sense: NO
agtatgaaaattttaattgtagaagatgaagagatgatccgtgagggggtcagtgattatttgacggattgtggctatgaaactattgaggcagcggacggtcaggaagctctggagcaattttctagctatgaggtggccctggttttactggatatccagatgcccaagcttaacggcttagaagttctagctgagattcgtaaaaccagtcaggttcctgtcttgatgttgacagcttttcaggatgaggaatacaagatgagtgcctttgcctctttggcagatggctatctggaaaaacctttctccctctccctcttaaaagtgagggtggacgcgattttcaagcgctactacgatacaggacgaatcttttcttacaaggataccaaggtggactttgaaagctacagtgcaagcctcgcaggtcaagaagtgcctatcaatgccaaagagttggaaattctggactatctagtgaaaaatgaaggccgggccttgactcggtctcagattatcgatgccgtctggaaagcgacagatgaggttccctttgaccgtgttattgatgtttatatcaaggaattgcggaaaaagctagacttggattgtatcctcactgtgcgcaatgttggttataaattggagcgaaaatga

SEQ ID NO: 2194 - DNA (genomic), 528 bp, Streptococcus pneumoniae; double-stranded, circular
  misc_feature (B) LOCATION 1...528
  hypothetical: NO
  anti-sense: NO
aaaatgaaaatcgcaattatcggatattctggttctggtaagtcaactctagcagaaaagttatctaactactactccattccaaaactgcacatggacacactccaatttcaacctggttggcaagacagtgaccacgaatggatgttaaccgagataaaaaactttctcaccaagcataaagcttgggtcatcgatggtaattattcttggtgctactaccaagaacgaatgcaagaagctgaccaaatcatctttctcaatttttggccattgacctgtctctttagagcctttaagcgttatcttaaataccgtggaaaagtcagagaaagtatggcggcagattgccctgaacgctttgactgggagtttatcagatggattctttgggatggacgtagcaaaactcaaaaagaaaattaccaaaaactttgccaagaatattcacataaagtcactattcttcgaaatcagagagagctagatcaatttctggataagaaaaggaagtcctacaattcataa

SEQ ID NO: 2195 - DNA (genomic), 777 bp, Streptococcus pneumoniae; double-stranded, circular
  misc_feature (B) LOCATION 1...777
  hypothetical: NO
  anti-sense: NO
ataaagaaaatcccgttgcaagacggggttttgtgttataatagagacatgaaaacaaatgatattgtctatggtgtccacgccgttaccgaagccctccttgcaaatacaggaaacaaactctacctccaagaagatctccgaggtaagaatgttgagaaagtcaaggaactagctacagaaaagaaggtgtccatttcttggacatcaaaaaaatctctctctgagatgactgaaggtgctgttcatcaaggttttgttctacgagtgtctgaatttgcctatagcgagctagattacatccttgcaaaaacacgccaagaagaaaatccacttctattgattctagatggtctaaccgatccccataatctgggttctatcttgcgaacagccgatgcgaccaatgtttcaggtgtcatcattcccaagcaccgtgctgtcggagtaactcctgtcgttgccaaaacagccacaggtgctattgaacacgttccaattgcccgagtgacaaacctcaatcaaaccttatataaactcaaggatgaaggcttctggacctttggaacggatatgaacggtactccttgctacaagtggaatacaaaagggaaaatcgccctcatcattggaaatgaaggaaaaggtatctctagcaacatcaaaaaacaagtcgatgagatgattaccattccgatgaatggacatgttcaaagccttaatgccagtgttgctgcggccattctcatgtacgaagttttccgaaatagactataa

SEQ ID NO: 2196 - DNA (genomic), 333 bp, Streptococcus pneumoniae; double-stranded, circular
  misc_feature (B) LOCATION 1...333
  hypothetical: NO
  anti-sense: NO
tccgagaaaatcttgcaacgcttagaagtctataaaaactatcaacatttatatgacttgcgaatgacaattctattaaacctttccacactctatctatacaatcaagataaaaacatgtgtaagcaaatctgctacactttactggaggacgccaagaataagaaaagctacgataggctggctatctgctatgtccgcattgggatttgtagggataatgcgaaacttatccaaaaagggttctcactcctagagctgaccgaggaaacttctatgctgtctcatctcaaaaaagaagtagagatctattaccaagcgaaggaaagataa

SEQ ID NO: 2197 - DNA (genomic), 621 bp, Streptococcus pneumoniae; double-stranded, circular
  misc_feature (B) LOCATION 1...621
  hypothetical: NO
  anti-sense: NO
ggagagaaaatgtctgcaatagaacgtattacaaaagctgctcacttaattgatatgaacgatattatccgtgaagggaatcctactctacgcgcgattgctgaggaagtcactttccccctatctgaccaggaaatcatcctaggcgaaaagatgatgcaattccttaaacattcccaagatcctgtcatggctgaaaaaatgggactccgcggtggtgttggactggctgctccccagttagatatctcaaaacgcattatcgctgttttggtacctaatattgttgaagaaggcgaaactccacaggaagcctacgatttggaagccattatgtacaatccaaaaatcgtctctcactctgttcaagatgctgctcttggcgaaggagaaggttgcctgtctgttgaccgtaacgtgcctggctatgttgttcgccatgcccgcgttactgttgactactttgacaaagatggagaaaaacaccgtatcaaactcaaaggctacaactccattgttgttcagcatgaaattgaccacattaacggtatcatgttttacgatcgcatcaatgaaaaagacccatttgcagttaaagatggtttactgattcttgaataa

SEQ ID NO: 2198 - DNA (genomic), 552 bp, Streptococcus pneumoniae; double-stranded, circular
  misc_feature (B) LOCATION 1...552
  hypothetical: NO
  anti-sense: NO
caggagaaaataaacatgtcacgtattggtaataaagttatcgtgttgcctgctggtgttgaactcgctaacaatgacaacgttgtaactgtaaaaggacctaaaggagaacttactcgtgagttctcaaaagatattgaaatccgtgtggaaggtactgaagtaactcttcaccgtccaaacgattcaaaagaaatgaaaactatccacggaactactcgtgcccttttgaacaacatggttgttggtgtatcagaaggattcaagaaagaacttgaaatgcgtggggttggttaccgtgcacagcttcaaggatctaaacttgttttggctgttggtaaatctcatccagacgaagttgaagctccagaaggaattacttttgaacttccaaacccaacaacaatcgttgttagcggaatttcaaaagaagtagttggtcaaacagctgcttacgtacgtagccttcgttcaccagaaccatataaaggtaaaggtatccgttacgttggtgaattcgttcgccgtaaagaaggtaaaacaggtaaataa

SEQ ID NO: 2199 - DNA (genomic), 792 bp, Streptococcus pneumoniae; double-stranded, circular
  misc_feature (B) LOCATION 1...792
  hypothetical: NO
  anti-sense: NO
aaggagaaaatcatgccagtaatgaaaatcgagtattactcacaagtattggatatggagtgggggatgaatgtcctctaccctgatgccaatcgagtgagagaaccagagtgtgaagatattcccgtcttgtaccttttgcacgggatgtctggaaatcataatagttggcttaagcggaccaatgtagaacgcttgcttcgaggaactaatctcatcgttgttatgcccaataccagcaatggttggtacaccgatacccagtatggttttgactactacacggctctagcagaggaattgccacaggttctgaaacgcttcttccctaatatgactagcaagcgtgaaaagacctttatagctggtctttctatgggaggctacggctgtttcaaactggctcttgcgacaaatcgtttttctcatgcagctagtttttcaggtgccctcagctttcaaaacttttctcctgaaagtcaaaatctgggaagtccagcctactggagaggtgtttttggagagattagagactggacaactagtccctattctcttgaaagtctggctaaaaaatcggataaaaagaccaaactttgggcgtggtgtggcgaacaggatttcttgtacgaagccaataatctcgcagtgaaaaatctcaaaaaactaggttttgatgtgacctatagccatagcgctggaactcacgagtggtactactgggaaaaacaattggaagtttttttaacaactctaccaattgatttcaaattagaagagagactgacttag

SEQ ID NO: 2200 - DNA (genomic), 366 bp, Streptococcus pneumoniae; double-stranded, circular
  misc_feature (B) LOCATION 1...366
  hypothetical: NO
  anti-sense: NO
agggttgaaataaggaggagaaacatgactcaagctgaacgaattagggaatattatagagagcaccctgctgcctcatatgatgaagtggctgaggtcgttggtacaacaaatagtaatgtgagagcgaacctggccaaagacatcaaggcaggcagatgcgttcgcttggaagataagtcatacgattactcgccttactataaccatacacaggcactcactgagttggttgactggaagaatgacaacagacgtgagtgggtggatatgctgacaagagcagcagagaaagaaacggatagcaacgttatgcgtttgttaatcaaagaagcaaataaattgatgaaagaggtgactaagtag

SEQ ID NO: 2201 - DNA (genomic), 294 bp, Streptococcus pneumoniae; double-stranded, circular
  misc_feature (B) LOCATION 1...294
  hypothetical: NO
  anti-sense: NO
atgaacgaaatttgtcatttatttatttattcggttcttaaaggttactctcttgaaggatggaagaaaataaatggtagttggtactattatagacaacatgataaacaaacgggttggcaggagataaatgatacttggtattatttagacagttccggtaagatgcttacagattggcaaaaagtaaatggaaaatggtattatctcaattcaaatagagcaatggttacaggtagccaaactatcgatggtaaagtttataacttcgcttcatctggtgagtggatttga

SEQ ID NO: 2202 - DNA (genomic), 837 bp, Streptococcus pneumoniae; double-stranded, circular
  misc_feature (B) LOCATION 1...837
  hypothetical: NO
  anti-sense: NO
gaaatagaaatgaaattaagaagaagtgatcggatggttgtcatttccaactatttgattaataatccttataaactaactagtctcaatacttttgctgaaaagtatgagtctgctaaatcatccatctcagaagatatcgtcattatcaaacgcgcctttgaggaaattgaaatcggtcatatccagacagtgactggggctggcggaggtgtcatcttcacaccgtctatttcgagtcaggatgctaaggaaatggttgaagacttgcgtaccaagttgtcagaaagtgaccgtatcttgccaggtggttatatctatctgtctgatttgcttagcacaccagccatcttgaaaaatattggtcgtattattgccaaaagctttatggaccaaaaaattgacgcggttatgaccgtagcaactaagggtgtgccacttgcaaatgcagttgccaatgtcctcaatgtctcttttgtcattgtgcgccgtgacctgaaaattaccgaaggttcaactgttagcgtcaactatgtttcaggttcaagtggtgaccgtatcgagaaaatgttcctttcaaaacgtagtcttaaggcaggcagccgtgtcttgattgtggatgacttcttgaaaggtggcggaacggtcaacggtatgattagtctcttgcgcgagttcgactcagaactggcaggtgtagcggtctttgcggacaatgcccaagaagaacgtgaaaagcagtttgactacaagtcactcttgaaggtaactaatattgatgtcaagaaccaagccatcgatgttgaggttggcaatatctttgacgaagataaataa

SEQ ID NO: 2203 - DNA (genomic), 1095 bp, Streptococcus pneumoniae; double-stranded, circular
  misc_feature (B) LOCATION 1...1095
  hypothetical: NO
  anti-sense: NO
ggagaagaaatgaaaccctcaattcatagtttggcacatcaaaccatgcaggaatgggtattggagcagggagaaaagaaattccgtgcagatcaaatctgggaatggctctaccgtaaacgtgtgcagtcatttgaagaaatgaccaacctttccaaggatttgattgctaagctcaatgaccagtttgtggtcaatcccttgaaacaaggtattgtgcaagagtctgctgatggtacagtcaaatatctctttgaattgcccgacggtatgttaattgagactgtactcatgcgtcaacactatggtttatctgtctgtgtgaccactcaggtcggctgtaatatcggttgtaccttctgtgcctctggtttgattaagaagcaacgtgacctcaataacggtgaaatcgtagcgcaaatcatgctggttcagaaatactttgctgagcgtggtcaggatgaacgcgtcagccatatcgttgtcatgggaatcggtgagccctttgataattacaacaatgtcttgaatttctttcgtactatcaatgatgataaaggaatggctatcggtgctcgtcacatcacggtttcaacctcaggtttggctcataaaattcgtgactttgctgatgaaggggttcaggtcaatcttgccgtgtctcttcacgcacctaacaatgaacttcgttcaagtatcatgaagattaaccgtgcctttccgattgaaaaactctttgctgctattgaatactacattgagacaacaaaccgtggtgtaacctttgaatatatcatgcttaatgaagtcaacgacggtgtagaacaagccttggaattgactgaattgctcaagaacatcaagaaattgtcttatgtaaacttgattccttataacccagttagtgagcatgaccaatatagccgtagtcccaaagagcgcgtgttggctttctatgatacgcttaagaaaaaaggggtcaactgtgtggttcgtcaagagcatggtacagatattgacgcagcttgtggacaattgcgctctaacacaatgaaacgtgaccgccagaaggcagtcgcagcggtaaatccttaa

SEQ ID NO: 2204 - DNA (genomic), 219 bp, Streptococcus pneumoniae; double-stranded, circular
  misc_feature (B) LOCATION 1...219
  hypothetical: NO
  anti-sense: NO
gacagagaaatatcttttttcttattgatttctccactagttggctcctcttctcctactaaaatcttcaaaagagtagacttacctgcaccatttttcccaacaagggcaatccgatctcgttcatcaacctgcaggttgatattatcgaaaagaacctctcctgcaaaagaacgttcaattttattagcttgtaaaataatcatacaagtagtatag

SEQ ID NO: 2205 - DNA (genomic), 714 bp, Streptococcus pneumoniae; double-stranded, circular
  misc_feature (B) LOCATION 1...714
  hypothetical: NO
  anti-sense: NO
gcaggagaaattggaagaatgaataagcaggaactgattaaacgtatcgaggatttgccttatacagaggggcctatcgcagatacaatcgaaattaatagaaattggatattgaaatcaattgaacagctagccgaatccgaaataggtcacgcagatgaagctccacgctacgtaaagaacatactagcacgattgcgagaattgccattgcatgatagagagttttggttaaaggctatcatgagcgaatttgaacaggattttagccatgcaaaatggcgagagggctacgagcaaggtaaaattgagggtatggttgaacgtgaaaaagtcatagttccgcagtgtgtggcggaatatatagaatttaaaaagaaaaacaattttcatgtttacggtgcaatgagagtaattgaagatcattatgataagaaagttcctgattggttttacgaaaataacatcgaaaaattctgtcttgcttggcttgacggctacgaggttgaaaaagagaagcggtattttgttaagattaaagggaatattaaagaaaatatgttggtttatggagaacttttgaaaaggtatttctttacaaaaagctttagtttagacgatgttatatattcccacacccgtaaagaactagaaaatgcaaaaatcggctgggtgtttgattgtgaagggtttgagattgaggaggtggagtga

SEQ ID NO: 2206 - DNA (genomic), 978 bp, Streptococcus pneumoniae; double-stranded, circular
  misc_feature (B) LOCATION 1...978
  hypothetical: NO
  anti-sense: NO
aaaggagaaattatgaaaacatctcttaaactttatttcactgccctagtggccagcttcttgctcctacttggtgcatgtagtacaaactcaagcactagtcagacagagaccagtagctctgctccaacagaggtaaccattaaaagttcactggacgaggtcaaactttccaaagttcctgaaaagattgtgacctttgacctcggcgctgcggatactattcgcgctttaggatttgaaaaaaatatcgtcggaatgcctacaaaaactgttccgacttatctaaaagacctagtgggaactgtcaaaaatgttggttttatgaaagaacctgatttagaagctatcgccgcccttgagcctgatttgattatcgcttcaccacgtacacaaaaattcgtagacaaattcaaagaaatcgccccaaccgttctcttccaagcaagcaaggacgactactggacttctaccaaggctaatatcgaatccttagcaagtgccttcggcgaaactggtacacagaaagccaaggaagaattggccaagctagacaagagcatccaagaagtcgctactaaaaatgaaagctctgacaaaaaggcccttgcgatcctccttaatgaaggaaaaatggcagcctttggtgccaaatctcgtttctctttcttgtaccaaaccttgaaattcaaaccaactgatacaacatttgaagactcacgccacggacaagaagtcagctttgaaagtgtcaaagaaatcaaccctgacatcctctttgtcatcaaccgtacccttgccatcggtggggacaactctagcaacaacggtgtcctagaaaatgcccttatcgctgaaacacctgctgctaaaaatggtaagattatccaactaacaccagacctctggtatctaagcggaggcggacttgaatcaacaaaactcatgattgaagacatacaaaaagctttgaaataa

SEQ ID NO: 2207 - DNA (genomic), 660 bp, Streptococcus pneumoniae; double-stranded, circular
  misc_feature (B) LOCATION 1...660
  hypothetical: NO
  anti-sense: NO
gaaggagaaatcatgactttattacaattacaagatgttacctaccgttataagaatactgctgaagcagtcctatatcagatcgattataattttgaacccggaaaattttacagtattattggggaatcaggagcaggaaaatccacactcttgtccctacttgctggtctagatagtcctgttgaaggttctatcctttttcaaggagaggatattcgtaagaagggctattcttaccatcgcatgcaccatatttccctggtctttcaaaattataacttgatagattatctttctccgctggaaaatatccgcttggtcaacaaaaaggcaagcaagaatacacttcttgagcttggtttggatgaaagccagatcaagcggaatgttctccagttatcaggtggtcaacagcaacgtgttgccattgctcgcagtttggtctcagaagctccagttattctagctgatgagccaacaggaaatctggatcctaaaactgctggagatattgtcgaactactcaaatcacttgcccagaaaacaggtaaatgtgtgattgtcgtaactcacagtaaagaagtggcacaagcgtcagatattacacttgaattaaaggataagaaactgactgaaacgcgcaatactagtaaataa

SEQ ID NO: 2208 - DNA (genomic), 453 bp, Streptococcus pneumoniae; double-stranded, circular
  misc_feature (B) LOCATION 1...453
  hypothetical: NO
  anti-sense: NO
tatatggaaatcaaagatattcttaatgtgagtctgatccagacggatttacagatgcagagcaaagaagaggtttttgaggcattagctcaactattggttgagacgggttatgtgtctgatagagaccaatttatcgaagttctttatcagagagaggcagaaggacagaccggtattgggaattatattgctattccccatagcaagagttctgctgtggagaaggcgggggtagtcatagctataaatcacaatgagattccttgggagaccattgatgggaaaggggtcaaagtaattgtactctttgcagttggtgatgatacagaagctgctagggagcatttgaagaccttatcactctttgctcgaaaacttggtaatgacgaagttgttgccaaattagttcgggctcagacatctgatgatgtgattgcagctttttgttaa

SEQ ID NO: 2209 - DNA (genomic), 198 bp, Streptococcus pneumoniae; double-stranded, circular
  misc_feature (B) LOCATION 1...198
  hypothetical: NO
  anti-sense: NO
aatatggaaattaatgtgagtaaattaagaacagatttgcctcaagtcggcgtgcaaccatataggcaagtacacgcacactcaactgggaatccgcattcaaccgtacagaatgaagcggattatcactggcggaaagacccagaattaggttttttctcgcacattgttgggaacggttgcatcatgctagggtag

SEQ ID NO: 2210 - DNA (genomic), 516 bp, Streptococcus pneumoniae; double-stranded, circular
  misc_feature (B) LOCATION 1...516
  hypothetical: NO
  anti-sense: NO
cacatggaaatttcattattaacagatgttggtcagaaacgaacaaataaccaagactatgtcaaccactatgtcaatagagctggacgtaccatgattattttagctgatgggatgggaggtcatcgtgcagggaatatcgctagtgaaatggcggtcacagacctgggtgtagcttgggttgatacccagatcgatacagtcaatgaagtgcgtgaatggttcgcccattacctagaaattgaaaatcaaaagattcaccagcttggtcaggatgaagcttacagaggcatgggaactactttggaagtccttgctattattgataatcaggctatctatgctcatattggtgattcgcgtatcggcttgattcgtggagaagaataccatcagttgacgagcgatcattccttggttaatgaattgctcaaggctggtcaattgacaaccagaagaggcagaagctcatccgcaaaaaaatattatcacccagtctattgggcaaaaagatga

SEQ ID NO: 2211 - DNA (genomic), 192 bp, Streptococcus pneumoniae; double-stranded, circular
  misc_feature (B) LOCATION 1...192
  hypothetical: NO
  anti-sense: NO
gcaatggaaatgatggaactaccaagtcaggatattttgatttttacaaaacaaattcgtcattggattcttagtgaacaagttatttcaggagaaagaaaacttttcttccgggaagatactccaaaagagattttagatatgtacgaaaacattaaatctaaacttgattgtgcttaccaagaagtttag

SEQ ID NO: 2212 - DNA (genomic), 726 bp, Streptococcus pneumoniae; double-stranded, circular
  misc_feature (B) LOCATION 1...726
  hypothetical: NO
  anti-sense: NO
agtaaggaaataatcatgacagccactagtcttgggttatcaaatattgaaatagttgtcaggattgttttatcagtagtcattggtagtataattggtttagagagagggagcaaatcccagcctgcaggcatccgaacttatagtattgtttgtctagctgcatgtttgattatgatgacgaatgaatacgtatcttataaatttgggacaggagatcctacacgattaggagctcaagttatatcaggtgtgggttttctaggcgctggaacgattcttattacagataaaaagaaaattacaggtctgacaactgcagcaggcatttgggcttcggcaggaattggattagctattggagtaggtttttatgagggagctcttttagtagccatttctgtttggggtgtgatatccatgttccaaccactaaaaaaatatctgcaaaatcgttctaaaatgattgaattgtatatagtagttaaatctacagaagcctataatcgtgtattggtttattgtgcagaaaatggtatcagaatgaccgattcaagaacagcgtttggagatgttaattctgacagaattgaatactttgatgttccggacaaaaaaatagcgtcatttattactctggaattatcaggtagatttgaacatcttcgactgatggaagaaattgctaatattgtaggtgttatttatgtcgaagaaattagctga

SEQ ID NO: 2213 - DNA (genomic), 1332 bp, Streptococcus pneumoniae; double-stranded, circular
  misc_feature (B) LOCATION 1...1332
  hypothetical: NO
  anti-sense: NO
gagaaggaaatgttagaattgcttaaatcaatcgatgattttgcttggggaccgcccctcttgattttattggtcggaacagggatttacctaaccatgcggctaggactcttgcaggttttgcgtctgcccaaggcctttcagcttatttttatccaggataagggacatggtgatgtatccagttttgcagctctgtgtacagccttggcatcaactgttggaacaggaaatatcataggagttgcgacggctatcaaggttggtggaccaggagctctattttggatgtggatggcggctttctttggaatggctaccaagtatgcggaaggactcttggccatcaaataccgcaccaaggacgaccatggtgcagtagcgggaggtcccatgcattatatccttctagggatgggagaaaagtggcgaccacttgctgttttgtttgcagtancaggagtattggttgctctcttgggaatcggaaccttcacccaagtcaactcgattacagaatctatccaaaatacaacgacgatttcgccagccatcacagctctcgtcttgtctgtctttgtagcgattgcagtctttggtggactcaagtctatttctaaggtttcaactactgttgttccttttatggccatcatttatatcttaggaactcttacagttattttctttaatatcggaaaaatccctggcacaatcgctttagtctttacctcagcttttagtccccttgctgcggtaggtggatttgctggtgctagcgttcggatggctattcaaaatggtgtggcgcgtggtgtgttctcaaacgaatctggtctgggttctgctcatattgcagctgcagctgccaagacaaatgaaccagtagagcaaggtttgatttccatgacaggaacctttattgataccctcatcatttgtactctaactggtttgaccatcttggtaactggagtttggagtggtgacttgaatggggttgccttgactcagtcagctttctcaacagtcttttcacactttggccctgccctcttgaccatcttccttgtgctttttgcctttacaacgattctaggttggaactattacggagaacgctgttttgagttcctctttggggttcgctttatctggctctaccgtgtggtttttgtgctcatggtcttgttaggaggatttatcgagttggatatggtctggattatcgcagatatcgttaacgccttgatggctctgccaaacttgattgccctcttggtcttgtcgccagtcgttattgctgaaactaaaaagtattttgacaaataa

SEQ ID NO: 2214 - DNA (genomic), 948 bp, Streptococcus pneumoniae; double-stranded, circular
  misc_feature (B) LOCATION 1...948
  hypothetical: NO
  anti-sense: NO
agaggtgttttcatgtcttatcaagatttaaaagagtgtaaaatcatcacagcctttattactcccttccacgaggatggttccatcaactttgatgctattccagccttgattgagcatttattggaccatcatacggatggaattcttctcgcagggaccactgctgagagtccaactttgacccacgatgaggagttggagttatttgcggctgtacaaaagattgtcaatggacgagttcctttgattgcgggtgtaggtactaatgatacgcgtgactctatcgagtttgtcaaagaagtagcggaattcggcggttttgctgctggtcttgctattgttccttactacaacaaaccttctcaagaaggaatgtatcagcattttaaagccattgcagatgcttctgacctaccaattattatctataacattccagggcgtgtggttgttgaattaactccagaaaccatgcttcgcttggctgatcatccaaatattatcggtgtcaaagaatgtactagcttggctaatatggcttacttgattgagcacaaaccagaagagttcttggtctatactggtgaggatggagatgctttccatgccatgaaccttggggcggatggggttatttctgttgcctctcatacaaatggggatgaaatgcacgagatgtttattgccattgcagaaagtgatatgaagaaagccgcagctattcaacgtaaattcattcctaaggttaatgctctcttctcttatccaagtcctgctccagttaaggcagttttgaactacatgggatttgaagctggaccaactcgtctacctcttgttccagcaccagaagaagatgctaaacgcattatcaaggttgtcgtagatggcgactacgaagcgaccaaggcaactgtaacaggtgtcttaagaccagattactaa

SEQ ID NO: 2215 - DNA (genomic), 774 bp, Streptococcus pneumoniae; double-stranded, circular
  misc_feature (B) LOCATION 1...774
  hypothetical: NO
  anti-sense: NO
cgggaacccttatccttgggatggattcatatctgcgacagtaagatgagtaatgtagataagattcgaaaaatacatattatcgtatgttggatgtatatatttttatcattcagggcgattataaatgacacggagtattttttgcttatttttttagcttttatctactcaatagtatcactacctctatattctgtgaaaaataaaatagtatctatctgtctagccataaattcgattctgttaatgagtttccccattttaatcaataagtttttcccagaaagttttttgacttataccgtattaataagtgtttttatcctagagttagcaatctttcatttaattggggaagattttgctactaaattgactaacgaatataagaaaattagtcagtttagaagcaaggtgtctcaatctccttggataaaatatttagagatttctagttttatattaactatatttccatctattctttatggtacagttgataatcatgtactgactcttatctttttgataaaaatttgtgcagataccacgataaaatttttattcatcagattatttgacacaagtactttaatgaagaggagaatattttttcttttcgcattggatgttatagtttacttatttttaggatatcttttagtgattcaaaaagcaggctatttgttttcggttttacttcttttttctaatttttcagttccatttatcaaagaaaaggaatacgaattatttaaaaatagcaagtaa

SEQ ID NO: 2216 - DNA (genomic), 225 bp, Streptococcus pneumoniae; double-stranded, circular
  misc_feature (B) LOCATION 1...225
  hypothetical: NO
  anti-sense: NO
tcttttcgaattccttttactgtcccaataagttctctacgcccctcaggatccaacatactcgttgcttcatctaagattaaaatagctggtcttagggctacaacacctgcaatggccacacgttgcttttggccacctgatagacgcgctggctctctctttttaaagtccaacatgccaactaaagccagagcttcttccactctctttttcatttcttga

SEQ ID NO: 2217 - DNA (genomic), 1329 bp, Streptococcus pneumoniae; double-stranded, circular
  misc_feature (B) LOCATION 1...1329
  hypothetical: NO
  anti-sense: NO
tctatgcgaattggtttatttacagatacctattttcctcaggtttctggtgttgcgaccagtattcgaaccttgaaaacagaacttgaaaagcagggacatgctgtttttatctttacgacgacagataaggatgtcaatcgctacgaagattggcaaattatccgcattccaagtgttcctttctttgcttttaaggatcgtcgctttgcctaccgaggttttagcaaggcacttgaaattgctaaacagtatcagctagatattatccatactcagacagaattttctcttggcctgttggggatttggattgcgcgtgaattgaaaattccagtcatccatacctatcacacccagtatgaagactatgtccattatattgctaaggggatgttgatccggccgagtatggtcaagtatctggttagaggtttcctgcatgatgtggatggggttatttgccctagtgagattgtccgtgacttgctatctgattataaggtcaaggttgaaaaacgggtcattcctactgggattgaattagccaagtttgagcgtccggaaatcaagcaggaaaatttgaaagaactgcgtagtaaactagggattcaagatggtgaaaagacgttgcttagtctttcgagaatctcctatgaaaaaaatattcaagcagttttagtagcctttgctgatgttctgaaagaggaagacaaggttaaactggtagtagctggggatggcccttatctgaatgacctcaaagagcaagcccagaacctagagattcaagactcagttatctttacagggatgattgctcctagtgagacggctctttactataaagcggcggatttcttcatttcggcatcgacaagcgaaacgcaaggtttgacctacttggaaagcttagccagtggaacacctgtcattgctcacggaaatccttatttgaacaacctcatcagtgataaaatgtttggaaccttgtactatggagaacatgatttggctggtgctattttggaagccctgattgcaacaccagacatgaacgagcataccttatcagagaaattgtatgagatttcagctgagaactttgggaaacgagtgcatgagttttatctggatgccattatttcaaataacttccagaaagatttggctaaagatgatacggtcagtcagcgtatctttaagacagttttgtatcttccgcaacaggtggttgctgtacccgtaaaaggctctagacgcatgttgaaggcttcaaaaacacagttgatcagtatgagagactattggaaagaccatgaagaatag

SEQ ID NO: 2218 - DNA (genomic), 210 bp, Streptococcus pneumoniae; double-stranded, circular
  misc_feature (B) LOCATION 1...210
  hypothetical: NO
  anti-sense: NO
ctcaagcccttacttcatgcagatgaaacttcttatagggtgctagagagtgatagtcagctgacctactattggacctttttgtctgggaaagctgagaatcaagcaatcacgctgtaccaccatgatcagcgtcggagtggtttagtagtacaagaattcctaggagattattctggctatgtgcattgtgatatgttgcggcagtaa

SEQ ID NO: 2219 - DNA (genomic), 1137 bp, Streptococcus pneumoniae; double-stranded, circular
  misc_feature (B) LOCATION 1...1137
  hypothetical: NO
  anti-sense: NO
ctgtttagaatgagggaaaatatgaagattgtaattgcaccggattcgtttaaggaaagcttgacagctcaacaggtagctgaagcaataaaaagaggcttccaacaatcgatagcagatgtagaatgtctcctctgccctgttggtgatgggggagaaggtactgtagatgctatccgacattctcttgacctaaaagaaaaatggatccaagtgacagacccttctggacaaaaagaagccatgcgctattttcaaaaaggggaactggcactatttgaagtagctgacttggttggtcttggaaaaattccgctagagaaacgaaatccacttcaaatccaaacttgtggtattggagagttgattctccatctcatttctaaagggattaaagatatttatatcggtgttggtggcacggccagtaatgatggaggactggggattgctgctggtttaggttatcaattttatgatagggatggaaatgtcttgcctgcttccggtcaatccttattaaacttagcttctgtttcaacagaaaatcgctataaaattcctgaaggtgttcaaattcatattttagcagatgtcgtgagtcccttatgtggtcatcaaggtgcgacttacacttttggcaatcaaaaaggtctacatccgactatgtttgcagtcgtagatcaggcgatccaagatttttatgaaaaattctcacctgcaacattagaaattaaaggagcaggagcaggtggaggccttgctggtggtttgtgtgcctttgctcaggcaagtatcgtgtctggaattgatacctgcttggacttaatcaactttgataagaaagtttcagatgctgacttggttgttgttggagaaggaagacttgatagtcaaagctttgctgggaaagcgcctataggtgttgcaataagaacccctgttggagttcctgttattgctatttgcggtagtcttgctgaagatttacctcccctaccatttgaaaatatccaagctgtcttttctattttggagaaaagtgaacctttagaagatagtttgaaaaatgccagtctctatctggagcgcacggctgccaatattgggcacttattaaatatgtgcaagatttag

SEQ ID NO: 2220 - DNA (genomic), 1269 bp, Streptococcus pneumoniae; double-stranded, circular
  misc_feature (B) LOCATION 1...1269
  hypothetical: NO
  anti-sense: NO
aaacttagaatgagaaaaattgttatcaatggtggattaccactgcaaggtgaaattactattagtggtgctaaaaatagtgttgtggccttaattccagctattatattggctgatgatgtggtgactttggattgtgttccagatatttcggatgtagccagtcttgtcgaaatcatggaattgatgggagctactgttaagcgttatgacgatgtcttggagattgatccaagaggtgttcaaaatattccaatgccttatggtaaaattaacagtcttcgtgcatcttactatttttatgggagcctcttaggccgttttggtgaagcgacagttggtctaccgggaggatgtgatcttggtcctcgtccgattgacttacaccttaaggcgtttgaagctatgggtgccactgctagctacgagggagataacatgaagttatctgctaaagatacaggacttcatggtgcaagtatttacatggatacggttagtgtgggagcaacgattaatacgatgattgctgcagttaaagcaaatggtcgtactattattgaaaatgcagcccgtgaacctgagattattgatgtagctactctcttgaataatatgggtgcccatatccgtggggcaggaactaatatcatcattattgatggtgttgaaagattacatgggacacgtcatcaggtgattccagaccgcattgaagctggaacatatatatctttagctgctgcagttggtaaaggaattcgtataaataatgttctttacgaacacctggaagggtttattgctaagttggaagaaatgggagtgagaatgactgtatctgaagacagcatttttgtcgaggaacagtctaatttgaaagcaatcaatattaagacagctccttacccaggctttgcaactgatttgcaacaaccgcttacccctcttttactaagagcgaatggtcgtggtacaattgtcgatacgatttacgaaaaacgtgtaaatcatgtttttgaactagcaaagatggatgcggatatttcgacaacaaatggtcatattttgtacacgggtggacgtgatttacgtggggccagtgttaaagcgactgacttaagagctggggctgcactagtcattgttgggcttatggctgaaggtaaaactgaaattaccaatatcgagtttatcttacgtggttattctgatattatcgaaaaattacgtaatttaggagcggatattagacttgttgaggattaa

SEQ ID NO: 2221 - DNA (genomic), 819 bp, Streptococcus pneumoniae; double-stranded, circular
  misc_feature (B) LOCATION 1...819
  hypothetical: NO
  anti-sense: NO
aagactagaatgagtgaaataggctttaaatacagtattttagcgtcgggttccagtggaaattctttttatctggaaacctcaaaaaagaagcttttagtagatgcaggcttgtctggcaagaaaattaccagtctgctagctgaaattaaccgtaagccagaagacctggatgccatcttgattacccatgagcattcagatcatatccatggagtaggcgttttggctcgcaagtatggtatggatctttatgccaatgaaaagacctggcaagctatggaaaatagtaaatatcttggcaaggtggattcttcgcaaaagcatatttttgaaatgggtaaaaccaaaacctttggagatatcgacatcgagagttttggtgtaagccatgatgcagtcgcaccgcagttctatcgctttatgaaggatgataagagttttgtccttttgacagatacaggttatgtcagtgaccgtatggcgggcattgtcgaaaatgcggatggctatcttatcgaggccaaccatgatgtagagattttgcgatcaggttcttacgcttggcgactcaaacaacgaatcctatctgaccttggtcacctttctaacgaggacggtgctgaagctatgattcggacgctaggaaatcgtactaagaagatttaccttgggcatttatctaaggaaaacaatatcaaggaactggctcatatgaccatggtcaatcagctggctcaagctgatctgggagtcggagtagactttaaggtttatgatacctcaccagataccgcaacaccattgacagagatatag

SEQ ID NO: 2222 - DNA (genomic), 1176 bp, Streptococcus pneumoniae; double-stranded, circular
  misc_feature (B) LOCATION 1...1176
  hypothetical: NO
  anti-sense: NO
gagaatagaatggcgaaaaaaccaaaaaaattagaagaaatttcaaaaaaatttggggcagaacgtgaaaaggccttgaatgatgctcttaaattgattgagaaagactttggtaaaggatcaatcatgcgtttgggtgaacgtgcggagcaaaaggtgcaagtgatgagctcaggttctttagctcttgacattgcccttggctcaggtggttatcctaagggacgtatcatcgaaatctatggcccagagtcatctggtaagacaacggttgcccttcatgcagttgcacaagcgcaaaaagaaggtgggattgctgcctttatcgatgcggaacatgcccttgatccagcttatgctgcggcccttggtgtcaatattgacgaattgctcttgtctcaaccagactcaggagagcaaggtcttgagattgcgggaaaattgattgactcaggtgcagttgatcttgtcgtagtcgactcagttgctgcccttgttcctcgtgcggaaattgatggagatatcggagatagccatgttggtttgcaggctcgtatgatgagccaggccatgcgtaaacttggcgcctctatcaataaaaccaaaacaattgccatttttatcaaccaattgcgtgaaaaagttggagtgatgtttggaaatccagaaacaacaccgggcggacgtgctttgaaattctatgcttcagtccgcttggatgttcgtggtaatacacaaattaagggaactggtgaccaaaaagaaaccaatgtcggtaaagaaactaagattaaggttgtaaaaaataaggtagctccaccgtttaaggaagccgtagttgaaattatgtacggagaaggaatttctaagactggtgagcttttgaagattgcaagcgatttggatattatcaaaaaagcaggggcttggtattcttacaaagatgaaaaaattgggcaaggttctgagaatgctaagaaatacttggcagagcacccagaaatctttgatgaaattgataagcaagtccgttctaaatttggcttgattgatggagaagaagtttcagaacaagatactgaaaacaaaaaagatgagccaaagaaagaagaagcagtgaatgaagaagttacgcttgacttaggcgatgaacttgaaatcgaaattgaagaataa

SEQ ID NO: 2223 - DNA (genomic), 816 bp, Streptococcus pneumoniae; double-stranded, circular
  misc_feature (B) LOCATION 1...816
  hypothetical: NO
  anti-sense: NO
aaggatagaatgatgcaggcattgacaaatccttttcctataggctctagttccctcattcactgtatgaccaatgagatttcttgtgagatgctggcaaatgggattttggctctgggatgcaaacctgtcatggcagatgatccccgtgaagttcttgattttactaagcaaagccaggctctcttcatcaatttggggcatttgtcagctgagaaggaaaaagcaatccgcatggcagctttgtatgcaaaccaatcttctctcccgatggtagtagatgcggttggcgtaacgacttcatccattcgtaagagcttagttaaagaccttttagactatagacctacggtccttaaaggaaacatgtcagaaattcgaagtcttgttggattaaagcatcacggcgttggggtcgatgcgagtgctaaagatcaagaaacggaggatttgcttcaagtcttgaaagactggtgtcagacctatcctggtatgccattcttagtcacaggtcccaaggaccttattgtttcggagaatcaagttgctgtacttgagaatggctgtactgaattagactggataacagggacaggagacttggttggagccttaacagctgtttttctcagccaaggaaagactggttttgaagcttcttgcttagcagtctcttatctcaatatcgctgctgagaaaatagttgttcaaggaatgggattggaagaatttcgttaccaagtactcaatcagctttcgctcctaagaagagatgaaaattggctagataccatcaaaggagaggtttatgaatag

SEQ ID NO: 2224 - DNA (genomic), 738 bp, Streptococcus pneumoniae; double-stranded, circular
  misc_feature (B) LOCATION 1...738
  hypothetical: NO
  anti-sense: NO
ggacaaagaatgattgaatacaaaaatgtagcactgcgctacacagaaaaggatgtcttgagagatgtcaacttacagattgaggatggggaatttatggttttagtagggccttctgggtcaggtaagacgaccatgctcaagatgattaaccgtcttttggaaccaactgatggaaatatttatatggatgggaagcgcatcaaagactatgatgagcgtgaacttcgtctttctactggttatgttttacaggctattgctctttttccaaatctaacagttgcggaaaatattgctctcattcctgaaatgaaggggtggagcaaggaagaaattacgaagaaaacagaagagcttttggctaaggttggtttaccagtagccgagtatgggcatcgcttacctagtgaattatctggtggagaacagcaacgggtcggtattgtccgagctatgattggtcagcccaagattctcctcatggatgaacccttttcagccttggatgctatttctcgcaagcagttgcaggttctgacaaaagaattacataaagagtttgggatgacaacgatttttgtgactcatgatacggatgaagccttaaagttggcagatcgtattgctgttttgcaggatggagagattcgtcaggtgtcgaatcctgagactattttaaaagctcctgcaacagactttgttgcagacttgtttggaggtagtattcatgactaa

SEQ ID NO: 2225 - DNA (genomic), 363 bp, Streptococcus pneumoniae; double-stranded, circular
  misc_feature (B) LOCATION 1...363
  hypothetical: NO
  anti-sense: NO
aataaaagaatatntaacgacttccaagcttcaaaaatgaatttaaacatttacacaagccccttgttagcctttgtttttgtcttcataggagagtttgtggcttatactttatatggtattagtttgttagctctcatcggacttgctagaaattttggagaggctggtcaaaatcttgcaagctacttgcagaccttgcatcagagcttgacggataaaacaagtgactttcgtttaattttaggattactggcctttggttttattcttaacactgtgttcagatggacaagaaaagttgagaaaagacctattcgaaccttgggattttatagagagatttcctcagcaatcttctga

SEQ ID NO: 2226 - DNA (genomic), 894 bp, Streptococcus pneumoniae; double-stranded, circular
  misc_feature (B) LOCATION 1...894
  hypothetical: NO
  anti-sense: NO
gtgggaagaattatcagatcaggtgtaaagatggaacatcttggaaaagtatttcgtgaatttcgaacaagtggaaattattctttaaaggaagcagcaggcgaatcctgctctacctctcagttatctcgctttgagcttggggagtctgacctggcagtctcccgtttctttgagattttggataacattcatgtaacaatcgaaaatttcatggataaggcaaggaattttcataatcatgaacatgtgtctatgatggcacagattatcccactttactattcaaacgatattgcaggttttcaaaagcttcaaagagaacaacttgaaaagtctaagagttcgacgactcccctttattttgagctgaactggattttgctacaaggtctgatttgtcaaagagatgcgagttatgatatgaagcaggatgatttggataaggtagcagattatctcttcaaaacagaagaatggaccatgtatgagttgattcttttcggtaacctctatagtttctacgatgtagactatgtcactcggattggtagagaagttatggagagggaggaattttaccaagagattagtcgccataagagattagttttgattttggccctcaattgttaccagcattgtttagagcattcttctttttataatgccaactattttgaggcttatacagagaagattattgacaaaggtattaagctttatgagcgtaatgttttccattatttaaaaggttttgccttatatcaaaaaggacagtgtaaagaaggctgtaagcagatgcaagaggccatacatatttttgatgtgttaggtcttccagagcaagtagcctattatcaggaacactacgaaaaatttgtcaaaagttaa

SEQ ID NO: 2227 - DNA (genomic), 291 bp, Streptococcus pneumoniae; double-stranded, circular
  misc_feature (B) LOCATION 1...291
  hypothetical: NO
  anti-sense: NO
cctatgagaattatgggattggacgtcggttcaaaaacggtaggggtggcgattagcgatccgcttggttttacagctcaagggcttgaaatcatccagataaatgaagaacaaggccaatttggttctgaccgcgttaaggaattggttgatacttacaaggtggaacgatttgtagtgggcttgcctaaaaacatgaacaatacaagtggaccgcgcgtagaagctagtcaagcatacggagcaaagctagaagagttttttggtttaccagtagactatcaggagtga

SEQ ID NO: 2228 - DNA (genomic), 201 bp, Streptococcus pneumoniae; double-stranded, circular
  misc_feature (B) LOCATION 1...201
  hypothetical: NO
  anti-sense: NO
aatgcgagaatgaaagcactttgtatttttttattgaatatgttagcttggacagtgcttgcaatgataatccgtggagggctagatggatttgataggcatacttggagtactattttaattgcttcgctgttcggggtatatgattataagcccatagataaaaatagaaaaaagtccaaaagaaaaaagaaaaaatag

SEQ ID NO: 2229 - DNA (genomic), 573 bp, Streptococcus pneumoniae; double-stranded, circular
  misc_feature (B) LOCATION 1...573
  hypothetical: NO
  anti-sense: NO
gagcagagaatgacaaaacgttgttcgtgggtcaagatgaccaacccgctctacatcgcctatcatgatgaggagtggggccagcccctccatgatgaccaagcattgtttgagttgttgtgtatggaaacctatcaggcaggcctgtcttgggaaacggtactcaacaaacgccaagctttccgagaagcatttcatagctatcaaattcactcagtcgcagagatgactgacactgaattggaagccatgctggagaatccagctatcattcgaaatagagccaagatttttgctacacgcgctaacgcccaagcttttctacagttacaggcagagtacggctcttttgatgcctatctttggtcttttgttgaggggaaaattgtcgttaacgatgttcctgattatcgccaagcgccagctaaaacacccttatctgagaaattagccaaagatctcaaaaaacgaggcttcaagttcacaggcccagtcgccgtattgtcttttctacaggctgcagggctagttgatgaccacgagaatgattgtgagtggaaaggtcttaaatga

SEQ ID NO: 2230 - DNA (genomic), 873 bp, Streptococcus pneumoniae; double-stranded, circular
  misc_feature (B) LOCATION 1...873
  hypothetical: NO
  anti-sense: NO
gaggagagaataaagaaattagccaaaagaattagtagaaaagaatgggggatgattttactagccattctctttacttgcttttcggtctatctagagttggaagtgccgacctatatctcgaaaattacggatttgctaggtagtcaagaaactaatttagatgagttgtggcagccggcaagcatgatgatgggaatgtcctttcttgccttcttgtccgtagttgcagttggattttttgcatcccgagtggcggcttcttatactagtaggctgagaagtgatatttttaaccgagttttggattactcgcagacagagattaagaaattttcaattcctagcctcttgacgcgtactaccaatgacattactcaagttcaaatgttgattactatgggcttgcaagtggtaacgcgtggttcaattatggctatctgggctattgggaagattttaggtcattcagaatactggctctgggccgtacttgtggtagtgattgtcaacgtcctgatgacgaccgttttgatgacgctagcctttccaaaacagtccttgattcaggggttgacagataaactgaacagtatcactcgtgagagtttaacaggtattcgtgtcgttcgtgcctacaatgcagaggattatcaaaatgaaaaatttgcagcagtaaatgatgaattgacccgtttgaatttgtttgtcaaccgtcttatggctattttgaatcctatcatgatggggatttcaagtggtttgagtgtagcgatttactggattggggcctatgtgattaacgacgctgctccgatagcgcgtctgcctctctttagtgacatgattgttttcatgtcttatgccatgtag

SEQ ID NO: 2231 - DNA (genomic), 285 bp, Streptococcus pneumoniae; double-stranded, circular
  misc_feature (B) LOCATION 1...285
  hypothetical: NO
  anti-sense: NO
aaacggagaatgagaaatatggctttgacagcaggtatcgttggtttgccaaacgttggtaaatcaacactatttaatgcaattacaaaagcaggagcagaggcagcaaactacccatttgcgactattgatccaaatgttggaatggtggaagatccagatgaacgcctacaaaaactaactgaaatgataactcctaaaaagacagttcccacaacatttgaatttacggatattgcagggattgtaaaaggagctttcaaaaggagaagggctagggaataa

SEQ ID NO: 2232 - DNA (genomic), 1065 bp, Streptococcus pneumoniae; double-stranded, circular
  misc_feature (B) LOCATION 1...1065
  hypothetical: NO
  anti-sense: NO
acaaggagaatcacaatggtagaattgggaatttcaacatttggggaaataacggagcttgaagggactggacaaacttacagtcatgctgaacgcattcgccagttggtggcagagattgagctggctgacaaggttggtttggacgtatatgggattggcgagcaccatcgggcggattttgcagtatcagccccagagattgtcctggccgctggggcagtcaataccaagaaaatccgtttgaccagtgcagtcagcattctgtcaagcatggacccgattcgtttgttccaacagtatgccactatcgatgctttgtcaaatggacgatcggagattatggctggaaggggctctttcacggaatctttccctctgtttggttatgacttgaaagactacgactctctttttgatgagaaattagacttgcttcagttagtcaatgaaaagaccaagttagactggcaaggtcgattgactcaaacgattgctggtaaagaagtttatcctcgtccagttcaggacaaattgcccatgtggatagctacaggtggtcatgtcgaatcaacagtgaagattgctcaggctggtctaccgattgtatatgctattattggtggtaatccacgttattttaaaaagttgattcaggcttatcgtgagattggaagcgaagcgggtcatgctgacaaagacttgaaagtgggagcccattcttgggggtggattgcggaagatggtgagcaggcggtgaaagattatttccatccgactaagcaagtggtggatgctatttccaaagaccgtccgcactggcaggaattgcgttatgagcaatatttggagcaggtagggccaaatggcgccatgtttgttggcaatccagatcaggtggccgaaaaattgattcgcatgatagaggatttaggattggaccgcttcatgcttcatctaccgcttggttctatgcctcatgaccaggttctgagagctattgaactcttcggaacacaagttgcacccaaagtacgagcttattttgctatgaaagaggcttaa

SEQ ID NO: 2233 - DNA (genomic), 750 bp, Streptococcus pneumoniae; double-stranded, circular
  misc_feature (B) LOCATION 1...750
  hypothetical: NO
  anti-sense: NO
aaaaggagaatgaatatgaaaaagaaacgtagattgttatttttgatgtctattgtcttgggggggttcttgggcatgtttgtagggatgtttaaggcacgtgtcgaatcccacgaaattattttagatgtaaaagccttgatgccatggatatcagctatttgtttactgataggtttcattagtatgtttttgactttcaatttcttaaagaaaagcagaaaatttcattccttgtatcaagaggaaatggatgacgatctgaatgaaacctattatgtgcaaatgtatcggaatcttgagtttggaaccattgcttttaatattacaggtgtagcgattccattggctatttttatttcattaagtgaggtgattatattgcatacaaaccctcaaacatttttcctttctttcttactctttgtggtattcttagtcgctcaaaaatctctttttaaaaccattgcgattgttcgtcagtttgatttggaatttttcgctacaccaaaggatgtcttgaactatataaattcttatgatgaaggggagcgtcaggctaatttggaacagagttttcgaattttattccaattacaccaatatgtcttaccagccttatatatttttcttattatcatttctttcttgacaggagagattcagttactagctttcttgcttgtaggagccatccatgtttatatcaatgtgatgcagttacctatggtaaaacgttatttcaaataa

SEQ ID NO: 2234 - DNA (genomic), 405 bp, Streptococcus pneumoniae; double-stranded, circular
  misc_feature (B) LOCATION 1...405
  hypothetical: NO
  anti-sense: NO
aaaaggagaatccttatgggtaaattatcctcaatccttttaggaaccgtttcaggtgcagctcttgccttgtttttaacaagtgataagggcaaacaagtttgcagtcaggctcaagattttctagatgatttgagagaagatccggagtatgccaaggagcaagtctgtgaaaaactgacagaagttaaggagcaggctacagattttgttctgaaaacaaaagaacaggttgagtcaggtgaaatcactgtggacagtatacttgctcaagctaaatcctatgcttttcaagcgacagaagcatcaaaaaatcaattaaataatctcaaggaacaatggcaagaaaaagccgaagctcttgatgactcagaagagattgtgattgatataacagaagaataa

SEQ ID NO: 2235 - DNA (genomic), 843 bp, Streptococcus pneumoniae; double-stranded, circular
  misc_feature (B) LOCATION 1...843
  hypothetical: NO
  anti-sense: NO
gctatgggaattgctctagaaaatgtgaattttacatatcaagaaggtactcccttagcttcagcagctttgtcggatgtttctttgacgattgaagatggctcttatacagctttaattgggcacacaggtagtggtaaatcaactattttacaactcttaaatggtttattggtgccaagtcaagggagtgtgagggtttttgataccttaatcacctcgacttctaaaaataaagatattcgtcaaattagaaaacaggttggcttggtatttcagtttgctgaaaatcagatttttgaagaaacggttttgaaggacgttgcttttggaccgcaaaattttggagtttctgaagaagatgctgtgaagactgcgcgtgagaaactggctctggttggaattgatgaatcactttttgatcgtagtccgtttgagctgtcagggggacaaatgagacgtgttgccattgcaggcatacttgccatggagccagctatattagtcttagatgagccaacagctggtctagatcctctagggagaaaagagttgatgaccctgttcaaaaaactccaccagtcagggatgaccatcgtcttggtaacgcatttgatggatgatgttgctgaatatgcgaatcaagtctatgtaatggaaaagggacgtttagtaaaggggggcaaaccaagtgatgtctttcaagacgttgtttttatggaagaagttcagttgggagtacctaaaattacggccttttgtaaacgattggctgatagaggcgtgtcatttaaacgattaccggttaagatagaggagttcaaggagtcgctaaatggatag

SEQ ID NO: 2236 - DNA (genomic), 306 bp, Streptococcus pneumoniae; double-stranded, circular
  misc_feature (B) LOCATION 1...306
  hypothetical: NO
  anti-sense: NO
gtttcaaccttgcggtcgtactccccaggcggagtgcttaatgcgttagctacggcactaaaccccggaaagggtctaacacctagcactcatcgtttacagcgtggactaccagggtatctaatcctgtttgctccccacgctttcgagcctcagcgtcagttacaagccagagagccgctttcgccaccggtgttcctccatatatctacgcatttcaccgctacacatggaattccactctcccctcttgcactcaagttaaacagtttccaaagcctactatggttaagccacagcctttaa

SEQ ID NO: 2237 - DNA (genomic), 495 bp, Streptococcus pneumoniae; double-stranded, circular
  misc_feature (B) LOCATION 1...495
  hypothetical: NO
  anti-sense: NO
tacactttgatttctaagacattgttagaaattagattaaattccttaatcgatttgcgcatgttttatttcatttcactatactttagattggaaaataaggaatcacataaatcgcaagaaatagggaatctgattcgtgtttataaccgttcaaaaagagaagaggctgaaagtgagccacttaatctttatgtcgaagatgaaaagggcaatctcctggcaggtttgatagcagagacttttggaaattggctagaactagaaatcgagtatttgtttgtaaaagaggaactgcgaggacaaggaatcggttcaaaactattgcaacaggcagaaagtgaagctaagaatcgaaattgttgttttgcctttgtcaatacttaccagttccaggcaccggacttttatcagaaacatggctacaaggaagttttttctttgcaagactatctctacattaggcaaagatattattaccaaaagaatctgtaa

SEQ ID NO: 2238 - DNA (genomic), 303 bp, Streptococcus pneumoniae; double-stranded, circular
  misc_feature (B) LOCATION 1...303
  hypothetical: NO
  anti-sense: NO
ttcttcttgatcataaatatcttcttgccacggttcttttgccataccttactccttgtttttttttacttttcttattacaatataaatatgaacatgaaaatcacacttatacctgaacgatgtatcgcctgtggactttgccaaacttattctgatttatttgattaccacgataatggaatcgtgcgtttttacgatgaccctgaccaactggaaaaagaaatttctcctagtcaggatgtcttagaggctgttaaaaattgcccaactcgcgccctgattggaaaccaggaagcctaa

SEQ ID NO: 2239 - DNA (genomic), 252 bp, Streptococcus pneumoniae; double-stranded, circular
  misc_feature (B) LOCATION 1...252
  hypothetical: NO
  anti-sense: NO
cagggcttgatggaagttcaggctagctccaatctaaaagaatttttaagcaagcagaatcatcaggccaagatttcttcaactgatgaggttcaggttttgttccttaaaaagacacccaaaatcatatccctagtcaaggaatggaatcctactattgatctgattggtttcaaactgctggttgatgttaccgaagatcatctggttgacattgcacgaaaaatcttatcaagaatcaagcagatttaa

SEQ ID NO: 2240 - DNA (genomic), 3243 bp, Streptococcus pneumoniae; double-stranded, circular
  misc_feature (B) LOCATION 1...3243
  hypothetical: NO
  anti-sense: NO
ttcctattgattttacaatatgtttattggagtgtatacatgcaaacaaaaacaaagaagctcattgtgagtttgtcttcacttgttttatcaggatttttattaaaccattatatgacagttggagcggaagaaacgactacgaatactattcagcaaagccagaaggaagttcagtatcagcaaagggatacaaaaaatttagttgaaaatggtgattttggtcagacggaggacggaagcagtccgtggacaggaagcaaagctcaggggtggtcaacttgggtagaccagaagaatagttctgcagatgcctcaactcgagtcattgaggctaaggatggggctatcactatctcaagccctgagaaattaagggcagcggttcaccgtatggttcctattgaagctaagaaaaagtataaactgcgtttcaagattaaaacagataataaagtcgggattgccaaagttcgtatcattgaggaaagtggtaaggacaagcgattgtggaattctgcaacgacgtcaggaacaaaggactggcagaccattgaagcagactatagcccgactttagatgttgataaaatcaagctggagttattctatgaaacaggaactgggactgtttcctttaaggatattgagctggtagaggtagcagaccagctttctgaggattctcaaacagataaacagcttgaggaaaagattgatttaccaattggaaaaaaacatgttttttctcttgcggactatacttataaggtagaaaatcctgacgttgcttcagtcaaaaatggaattttagaacctcttaaggaagggacaaccaatgtcattgtcagtaaagatggcaaggaagtgaaaaagattcctttgaagattctagcctctgttaaggatgcatacacagcccgtttggatgactggaatggcatcatcgctgggaatcaatactatgattctaaaaatgaacagatggccaaattaaaccaggaattggaaggaaaggtagctgatagcctatctagtatttcaagtcaggcggaccgcacctatttgtgggaaaaattttcaaattataaaatgtctgcaaatctgactgccacttatcggaaattggaggagatggccaagcaagtgaccaatccttcttctcgttattatcaagatgaaactgtcgttcgaacagtcagggattccatggaatggatgcataaacatgtctacaatagtgaaaagagcattgttgggaactggtgggattatgaaatcggtacacctcgtgccatcaacaataccttgtctctgatgaaagaatacttctctgatgaggaaattaaaaaatatacagatgtaattgaaaaatttgtaccagaccccgaacatttccgaaagacgactgataacccatttaaggctctaggtggaaacttagttgatatgggaagagtaaaagtaatagctggtttactgcgtaaagatgatcaagaaatttcttctaccattcgctcgattgagcaagtgttcaagttggtagaccaaggtgaaggtttttatcaagatggatcctatatcgaccacaccaatgttgcctatacgggtgcttatgggaatgttttgattgatggcctgtctcaactgttgccagtcattcaaaagaccaagaatccaatcgataaagataaaatgcaaaccatgtaccactggattgataaatcgtttgctcctttgctggtgaatggagagctgatggatatgagtcgtggacgctcgatcagtcgtgcaaatagcgaggggcacgtggccgcagtagaagtactaagagggattcaccgaatagcggatatgtctgaaggagaaaccaaacaacgtttgcagagtcttgtgaagaccattgttcaatcggatagttattatgatgtctttaagaatttgaagacttataaggatatcagtttgatgcaatccttgttaagtgatgcaggagtcgcaagtgttccaagaacaagttacctatctgcctttaacaagatggataaaacagccatgtacaatgcagagaaagggtttggatttggcttgtcactcttttccagtcgtaccttgaattacgaacacatgaacaaggaaaataaacgtggttggtatacgagtgatgggatgttctatctttacaatggcgatttgagtcactatagcgatggctactggccaacagttaatccatataagatgcctggtacaacagagacggatgctaagagagcggatagcgatacaggtaaagttttaccgtctgctttcgttggaacgagcaaactagatgatgccaatgcgacagcaaccatggatttcaccaactggaatcaaacattgactgctcataagagctggtttatgctgaaggataagatcgcctttttaggaagcaatatccaaaacacttcaacagatactgctgcaactacaattgaccagagaaaactggaatcaagtaatccatataaagtctatgtcaatgataaagaagcctcccttacagaacaagaaaaggattatcctgaaacccaaagtgtctttttagaatcgtccgattcgaaaaagaatattggttactttttctttaagaagagttcaatcagtatgagtaaggctttgcaaaagggagcctggaaggatatcaatgaaggacagtcagacaaggaagttgaaaatgaatttcttacgattagtcaggctcataagcaaaatggagattcttatggctatatgctcatccctaacgtggatcgtgccaccttcaatcaaatgataaaagagttagaaagtagcctcatcgaaaataacgaaacccttcagtctgtttatgatgctaaacaaggagtttggggcattgtgaaatatgatgattctgtctctactatttccaaccaattccaagttttgaaacgtggagtctataccattcgaaaagaaggggatgaatataagattgcctactataatcctgaaacccaggaatcagctccagatcaggaagtctttaaaaagctagagcaagcagctcagccacaagtacagaattcaaaagaaaaggaaaaatctgaagaggaaaagaaccattcggatcaaaagaatctccctcagacaggagaaggtcagtcaatcttggcaagtctagggttcttgctacttggggcattttatctattccgtagaggaaagaacaactaa

SEQ ID NO: 2241 - DNA (genomic), 264 bp, Streptococcus pneumoniae; double-stranded, circular
  misc_feature (B) LOCATION 1...264
  hypothetical: NO
  anti-sense: NO
ttccaattgatcataagaaatacaactactgtccaaatcataccaattatgaacggtattacaaatttatatgtttgtatttctaatgatatcatagctgataccatcgccgatacaaatgcagacaacaatactgaggtaacaaaattccttaccgcttcatcatttttgacacaactatcatgctcagctaatataatttctctatatctagctaaatattctattggaatattatcaataaaatcttttgatgttctatag

SEQ ID NO: 2242 - DNA (genomic), 1416 bp, Streptococcus pneumoniae; double-stranded, circular
  misc_feature (B) LOCATION 1...1416
  hypothetical: NO
  anti-sense: NO
cgagaattgatgatgaaatacctcgaaggtgaagaaatcactaacgaagaattgaaagctggtatccgtaaagcgactatcaacgttgaattcttcccagtattgtgtggttcagccttcaaaaacaaaggtgttcaattgatgcttgatgcggttatcgactaccttccaagtccacttgacatcccagcaatcaaaggtattaacccagatacagacgctgaagaaactcgtccagcatctgacgaagagccatttgcagctcttgccttcaagatcatgactgacccattcgtaggtcgtttgacattcttccgtgtttactcaggtgttcttcaatcaggttcatacgtattgaatacttctaaaggtaaacgtgaacgtatcggacgtatccttcaaatgcacgctaacagccgtcaagaaatcgacactgtttactcaggtgatatcgctgctgccgttggtttgaaagatactacaactggtgactcattgacagatgaaaaatctaaaatcatccttgagtcaatcaacgttccagaaccagttatccaattgatggttgaaccaaaatctaaagctgaccaagacaagatgggtatcgcccttcaaaaattggctgaagaagatccaacattccgcgttgaaacaaacgttgaaactggtgaaacagttatctcaggtatgggtgaacttcaccttgacgtccttgttgatcgtatgcgtcgtgagttcaaagttgaagcgaacgtaggtgcgcctcaagtatcttaccgtgaaacattccgcgcttctactcaagcacgtggattcttcaaacgtcagtctggtggtaaaggtcaattcggtgatgtatggattgaatttactccaaacgaagaaggtaaaggattcgaattcgaaaacgcaatcgtcggtggtgtggttcctcgtgaatttatcccagcggttgaaaaaggtttggtagaatctatggctaacggtgttcttgcaggttacccaatggttgacgttaaagctaagctttatgatggttcatatcacgatgtcgactcatctgaaactgccttcaagattgcggcttcactttcccttaaagaagctgctaaatcagcacaaccagctatccttgaaccaatgatgcttgtaacaatcactgttccagaagaaaaccttggtgatgttatgggtcacgtaactgctcgtcgtggacgtgtagatggtatggaagcacacggtaacagccaaatcgttcgtgcttacgttccacttgctgaaatgttcggttacgcaacagttcttcgttctgcatctcaaggacgtggtacattcatgatggtatttgaccactacgaagatgtacctaagtcagtacaagaagaaattattaagaaaaataaaggtgaagactaa

SEQ ID NO: 2243 - DNA (genomic), 609 bp, Streptococcus pneumoniae; double-stranded, circular
  misc_feature (B) LOCATION 1...609
  hypothetical: NO
  anti-sense: NO
acacagttgatgagtatatcccagaaccagaacgtgacactgacaaaccattgcttcttccagtcgaggacgtattctcaatcactggacgtggtacagttgcttcaggacgtatcgaccgtggtatcgttaaagtcaacgacgaaaactatattgttggtatcaaagaagaaaacctcgaaccccttgtttccgggtgttgaaatgttccgtaaacaacttgacgaaggtcttgctggagataacgtaggtgtccttcttcgtggtgttcaacgtgatgaaatcgaacgtggacaagttatcgctaaaccaggttcaatcaacccacacactaaattcaaaggtgaagtctacatccttactaaagaagaaggtggacgtcacactccattcttcaacaactaccgtccacaattctacttccgtactactgacgttacaggttcaatcgaacttccagcaggtactgaaatggtaatgcctggtgataacgtgacaatcgacgttgagttgattcacccaatcgccgtagaacaaggtactacattctctatccgtgagggtggacgtactgttggttcaggtatggttacagaaatcgaagcttaa

SEQ ID NO: 2244 - DNA (genomic), 3510 bp, Streptococcus pneumoniae; double-stranded, circular
  misc_feature (B) LOCATION 1...3510
  hypothetical: NO
  anti-sense: NO
atggtgaccttattagatttattctcagaaaatgatcagattaaaaaatggcatcaaaatttaacagataagaaaagacaactaatacttggtttatcaacatctactaaggctcttgcaattgcaagcagtttagaaaaagaagataggattgtgttattgatgtcaacttatggagaagcagaaggacttgttagtgatcttatatctatcttgggtgaggaactcgtctatccatttttggtagatgatgctcctatggtggagtttttgatgtcttcacaggaaaaaattatttcacgggttgaagccttgcgttttttgactgattcatctaagaaagggattttagtttgtaatatcgcagcaagtcgattgattttaccgtctcccaatgcattcaaagatagtattgtaaaaatctcagttggtgaagaatatgatcaacacgcgtttatccatcagttaaaggaaaatggctatcgaaaagttactcaagtacaaactcagggcgaatttagtcttcgaggagatattttagatatttttgaaatatcccagttagaaccttgtcgaattgagttttttggtgatgaaattgatggtatcaggtcatttgaagtagaaacacaattatcgaaagaaaataagacagaactcactatctttccagctagtgatatgcttttgagagaaaaggattatcaacgaggacagtcagctttagaaaaacaaatttcaaaaactttatcacctattttgaaatcatacctagaagaaattctttcaagttttcaccaaaaacaaagtcatgcagactctcggaagtttttatctttgtgctatgataagacatggactgtctttgattatattgaaaaagatactccaatattctttgatgattatcaaaaattgatgaatcagtatgaagtctttgaaagagaattagcgcagtactttacagaagaattacagaatagtaaagcattttctgatatgcagtatttttctgatattgaacaaatctataaaaaacaaagtccagtgacctttttttctaatcttcaaaagggtttaggaaatctcaaatttgacaaaatttatcaattcaatcaatatcctatgcaggaatttttcaatcagttttcttttctaaaagaagaaattgaacgatataaaaaaatggattacaccattattctgcagtctagcaattcaatgggaagtaaaacattggaggatatgttagaggaatatcagattaaattggattctagagataagacaaatatctgtaaagaatctgtaaacttaatagagggtaatctcagacatggttttcattttgtagatgaaaagattttattgataactgaacatgagatttttcaaaagaaattaaagcgtcgttttcgaagacaacatgtttcaaatgcagagagattaaaagattacaatgaacttgaaaaaggggactatgttgtccatcatatccatgggattggtcaatatctaggaattgaaaccattgaaatcaagggaattcatcgtgattatgtcagtgtccaataccaaaatggtgatcaaatttctattcccgtggaacagattcatctactgtccaaatatatttcaagtgatggtaaagctccaaaactcaataaattaaatgacggtcattttaaaaaggccaagcaaaaggttaagaaccaggtagaggatatagctgatgatttaatcaaactctactctgaacgtagtcagttgaagggttttgctttctcagctgatgatgatgatcaagatgcctttgatgatgctttcccttatgttgaaacggatgatcaacttcgtagtattgaggaaatcaagagggatatgcaggcttctcagccaatggatcgacttttagttggggatgttggttttggaaagactgaagttgctatgcgtgcagcctttaaagcagtcaatgatcacaaacaggttgtcattctagttccgacgacggttttagcgcaacagcactatacgaattttaaggaacgattccaaaattttgcagttaatattgatgtgttgagtcgctttagaagtaaaaaagagcagactgcaacacttgaaaaattgaaaaacggtcaagtcgatattttgattggaacacatcgtgttttgtcaaaagatgttgtgtttgctgatttgggcttgatgattattgatgaggaacagcgatttggtgtcaagcataaggaaactttgaaagaactgaagaaacaagtggatgtcctaaccttgaccgctacgccaatccctcgtaccctccatatgtctatgctgggaatcagagatttatctgttattgaaactccgccgactaatcgctatcctgttcagacctatgttttggaaaagaatgatagtgtcattcgtgatgctgtcttgcgtgaaatggagcgtggaggtcaagtttattatctttacaacaaagttgacacaattgttcagaaggtttcagaattacaggagttgattccggaggcttcgattggatatgttcatggtcgaatgagtgaagtccagttggaaaatactctattagactttattgagggacaatacgatatcttggtgacgactactattattgagacaggggtggacattccaaatgctaatactttatttattgaaaatgcggaccatatgggcttgtcaaccttatatcagttaagaggaagagtcggtcgtagtaatcgtattgcttatgcttatctcatgtatcgtccagaaaaatcaatcagtgaagtctctgaaaagagattagaagcgattaaaggatttacagaattgggctctggctttaagattgcaatgcgagatctttcgattcgtggagcaggaaatcttttaggaaaatcccagtctggtttcattgattctgttggttttgaattgtattcgcagttattagaggaagctattgctaaacgaaacggtaatgctaacgctaacacaagaaccaaagggaatgctgagttgattttgcaaattgatgcctatcttcctgatacttatatttctgatcaacgacataagattgaaatttacaagaaaattcgtcaaattgacaaccgtgtcaattatgaagagttacaagaggagttgatagaccgttttggagaatacccagatgtagtagcctatctgttagagattggtttggtcaaatcatacttggacaaggtctttgttcaacgtgtggaaagaaaagataataaaattacaattcaatttgaaaaagtcactcaacgactgtttttagctcaagattattttaaagctttatccgtaacgaacttaaaagcaggcatcgctgagaataagggattaatggagcttgtatttgatgtccaaaataagaaagattatgaaattttagaaggtttgctgatttttggagaaagtttattagagataaaagagtctaaggaagaaaattccatttga

SEQ ID NO: 2245 - DNA (genomic), 438 bp, Streptococcus pneumoniae; double-stranded, circular
  misc_feature (B) LOCATION 1...438
  hypothetical: NO
  anti-sense: NO
actaaactgatagtaacatgtagcgaaaggggtaggtacatgattaaaatttatacagtctcaagttgtactagctgtaaaaaagcaaaaacctggctcaatgcccaccagttaagttataaagaacaaaaccttggtaaagaaggaattacgagagaagaattactggatattctaaccaaaacagataacggaatagccagcatcgtttcgtctaaaaatcgctatgccaaagcccttggagtggatattgaagatttgagtgtcaatgaagttctcaatctgattatggaaacaccgagaattttaaagagcccaatccttgtagatgaaaaacgcctgcaagttggctacaaggaagacgatattcgtaccttcctaccacgctctgtccgtaatgtagaaaatgcagaagcacgtttgcgtgcagctctataa

SEQ ID NO: 2246 - DNA (genomic), 234 bp, Streptococcus pneumoniae; double-stranded, circular
  misc_feature (B) LOCATION 1...234
  hypothetical: NO
  anti-sense: NO
aagtctatgatacacattatcgttaatacatttatagaaaaggatatgactggagcagttgttgaagtgttgtatgccagtgctgaccaagataaggtacaagctaaatatgaagaactagctgcacaataccccgaaaattatttagctatctatgatgtaccgctggatacggatttgaatacactagatcattacccgtctgtgtttattgaaaaagaggagtttgagtag

SEQ ID NO: 2247 - DNA (genomic), 444 bp, Streptococcus pneumoniae; double-stranded, circular
  misc_feature (B) LOCATION 1...444
  hypothetical: NO
  anti-sense: NO
acgcctatgatagaaatcaagcgaattcaacaacagcctgacctagctcaagccatctacgctgttatggcagctgtttacctagtcagtccttggactctggagcaaatccaagcagatctgtcccaagaccagacttggtatgcattggcttatgatggggcagaagtgattggatttctagctgtgcaggagaatctttttgaagcagaagtcctgcaaatcgctgtcaaaggagcttatcagggtcagggaattgcgtcagccttgtttgctcaattgccgacagataaggagattttcctcgaagtcagaaagtcaaatcaacgagcgcaagcattttacaagaaagaaaaaatggcggtcatcgctgatcgaaaggcctactaccatgacccagtcgaggacgccattatcatgaagagagaaatagatgaaggatag

SEQ ID NO: 2248 - DNA (genomic), 531 bp, Streptococcus pneumoniae; double-stranded, circular
  misc_feature (B) LOCATION 1...531
  hypothetical: NO
  anti-sense: NO
atagatatgatgtccgaagtacaaagagctgcacgtattctatatatgttgagagtgaactttaatggtctatatcgtgtgaattctaagaaccaatttaatgttccatatggacgttataagaatcctaaaattgttgatgaggaattgatatctgctatttcagtttatctaaataacaatcaactagaaattaaagtgggagattttgaaaaggcaattgtagatgttcgaacaggagattttgtgtattttgaccctccatatattccattgtctgagacgagtgcatttacgtcttatactcatgagggattctcttttgcagatcaagtaagattaagagatgcctttaagagactgagtgatacaggagcttatgttatgttatcaaattcttctagtgctttagtagaggagttgtataaggattttaatatacattatgttgaagctacccgaactaatggagcaaaatcttcaagtcgaggaaaaatttctgaaattatagtcacaaattatgaaaaataa

SEQ ID NO: 2249 - DNA (genomic), 666 bp, Streptococcus pneumoniae; double-stranded, circular
  misc_feature (B) LOCATION 1...666
  hypothetical: NO
  anti-sense: NO
ataagtatgattgatttttatttttttctcgtcgggagcattctcgcttcctttcttggtttggtcattgaccgttttccagagcaatccattatcagttcagccagtcactgcgattcctgtcagactcgcttgcgtcccttagatttgattccgattctctcacaggtcttcaatcgctttcgctgtcgctactgcaaagttcgctatcctgtctggtatgccctctttgaattagtcttaggactcctctttctgctttactcttgggaattgctttccttggggcaagtcgtcctaatcaccgctggtttgaccttgggtatctacgactttcaccatcaggaatatcccttactggtctggatgactttccacctaatcctaatagcttcctctggctggaatctggtcatggtctccttccttgctcttggaattttggctcattttatcgatatccgcatgggcgcaggagatttcctctttttagcttcttgtgctctagtctttagcgtaacggagttactgatcttgattcagttcgcttctgcgacgggtattctggcctttctcctgcaaaagaaaaaggaaagacttcctttcgtgcctttcctcttacttgctacttgtttgattatttttggtaagctactgcttgtttga

SEQ ID NO: 2250 - DNA (genomic), 744 bp, Streptococcus pneumoniae; double-stranded, circular
  misc_feature (B) LOCATION 1...744
  hypothetical: NO
  anti-sense: NO
aataagatgatactaaagaaggaaataactatgaaaccagaaacattttacaacttgcttgccgagcagaatcttccactttcgaaccagcaaaaagaacaatttgaacgttattttgagctcttggtcgagtggaatgagaagattaatttgacggcgattacggacaaggaagaagtttatctcaaacatttttacgattcgattgcacccattcttcaaggtttgattcccaatgaaactatcaaacttcttgatatcggggctggggcaggatttcctagtctaccaatgaaaattctctatccggagttagatgtgaccattattgattcactcaataagcgcatcaacttcctacaactcttggctcaagaactggatttgaacggagttcatttctaccacggacgtgccgaagattttgcccaagacaagaacttccgtgctcaatatgattttgtaacagctcgtgcggttgcccgtatgcaggtcctatctgaattgactattccctaccttaaggttggtggcaaactattggcactcaaggccagcaatgcgcctgaggaattattagaagctaagaatgccctcaatctcctttttagtaaggtcgaagacaatctcagntacgccctaccgaatagagatccgcgctatatcacagtggtagaaaagaaaaaagaaacaccaaataaatatccacgtaaggctggtatgccaaataaacgcccactttaa

SEQ ID NO: 2251 - DNA (genomic), 1014 bp, Streptococcus pneumoniae; double-stranded, circular
  misc_feature (B) LOCATION 1...1014
  hypothetical: NO
  anti-sense: NO
gtcaagatgattgctgttaaaacttgcggaaaactctattgggcaggtgaatatgctattttagagccagggcagttagctttgataaaggatattcccatctatatgagggctgaaattgctttttctgacagctaccgtatctattcagatatgtttgatttcgcagtggacttaaggcctaatcctgactacagcttgattcaagaaacgattgctttgatgggagacttcctcgctgttcgcggtcagaatttaagacctttttccctaaaaatctgtggcaaaatggaacgagaagggaaaaagtttggtctaggttctagtggcagcgtcgttgtcttggttgtcaaggctttactggctctctataatctttcggttgatcagaatctcttgttcaagctgactagcgctgtcttgctcaagcgaggagacaatggttccatgggcgaccttgcctgtattgtggcagaggatttggttctctaccagtcatttgatcgccagaaggtggctgcttggttagaagaagaaaacttggcgacagttctggagcgtgattggggattttttatctcacaagtgaaaccaactttagaatgtgatttcttagtgggatggaccaaggaagtggctgtatcgagtcacatggtccagcaaatcaagcaaaatatcaatcaaaattttttaagttcctcaaaagaaacggtggtttctttggtcgaagccttggagcaggggaaagccgaaaaagttatcgagcaagtagaagtagccagcaagcttttagaaggcttgagtacagatatttacacgcctttgcttagacagttgaaagaagccagtcaagatttgcaggccgttgccaagagtagtggtgctggtggtggtgactgtggcatcgccctgagttttgatgcgcaatcaaccgaaaccttaaaaaatcgttgggccgatctggggattgagctcttatatcaagaaaggataggacatgacgacaaatcgtaa

SEQ ID NO: 2252 - DNA (genomic), 732 bp, Streptococcus pneumoniae; double-stranded, circular
  misc_feature (B) LOCATION 1...732
  hypothetical: NO
  anti-sense: NO
gagaagatgataatgtcaatatataaactttataaagatattgaaagaaaaacgatgtcgcctgctaaaaaagcaatggctaaaaatgattattttgcgttttatgttggaagaccgttatcctatcttttaacagttccttttttaaaaacgaatattactcccaatcaagtatcttatttatctatagcccctttgattcttggatttctgacaatgacatttacaactaatttcattctattattgctggcatggtttctattttttttatggaacttactagatggagtagatgggaacttagctagatatcgggagcaatactcgaaggatggaagtgtagtagatgcaatggcaggctatgtggctatggtgctgacgtattttggtgcaggaatagtagcaactcatctaaatggctcagatatgtatgtgattttgggtgctttatctggaatttctttgatttttccaagattggtgatgcataagtatatcaacacagtagcacgaaatgagtctgtcaataacattaaagataaatcaaattttagtactataaaactactggctttaaatatgacatcaattacaggtattcctcaggttttactactagtaacgattttaacaaatcagtgggaattttttactttagtatatttcacgattaattttttattaatgatattttcgttatattcattatttaaaaaggagaatgtttag

SEQ ID NO: 2253 - DNA (genomic), 684 bp, Streptococcus pneumoniae; double-stranded, circular
  misc_feature (B) LOCATION 1...684
  hypothetical: NO
  anti-sense: NO
gagaagatgatttcaaagagattagaattggtagcttcctttgtgtcacagggggctattttactagatgtgggaagtgaccatgcttatctgcctatcgagttggttgagagaggccaaatcaaaagcgctattgcaggtgaggtggtggaaggtccctatcagtctgcggttaaaaatgttgaggctcacggcctaaaggagaaaatccaagtccgtttagccaatggcttggcagcttttgaagagactgaccaagtgtctgtcattaccattgctggcatgggtggtcgtttgattgctaggattttagaagaaggtttggggaagttagctaatgtagagcgtttgatcctccagcccaataatcgtgaagacgacttgcgtatctggctacaggatcatggattccagattgtagcagaaagcatcttagaagaagctggaaagttttatgagattttggtggtggaagcaggacaaatgaagctatcagccagtgatgttcgctttggtcccttcttgtccaaagaagtcagtccagtatttgtccaaaaatggcaaaaagaagctgagaagctagagttcgccctcggacaaatcccagaaaaaaatctggaagaacgtcaagttctagtagataagattcaagctatcaaggaggtgctccatgttagcaagtga

SEQ ID NO: 2254 - DNA (genomic), 204 bp, Streptococcus pneumoniae; double-stranded, circular
  misc_feature (B) LOCATION 1...204
  hypothetical: NO
  anti-sense: NO
cttatggtgatgataaaactcttgaagctttacaaaaaggatcctcttttaggtaaaataaatgcaattaaaaatggtgccgttgctgtaattccagataatacaccgttagcagcctcatgcactccagcaccactttcaataaactatactattgaagaatacctaaatcttttaggaaatgcatgcaaaaatgcgaaataa

SEQ ID NO: 2255 - DNA (genomic), 204 bp, Streptococcus pneumoniae; double-stranded, circular
  misc_feature (B) LOCATION 1...204
  hypothetical: NO
  anti-sense: NO
cttgaggtgatgaaaatggcaaccgataaaaatagaataatgattagcttggatgataaaaatctagagaaacttgaaaatttagtagaagatgctagagatagaaggggaatgcgactaacaaagtcccaggttattgaattactcctaaataccgttgattatttcgatgatattatgggggctatttactcaaaaaaataa

SEQ ID NO: 2256 - DNA (genomic), 3309 bp, Streptococcus pneumoniae; double-stranded, circular
  misc_feature (B) LOCATION 1...3309
  hypothetical: NO
  anti-sense: NO
tatagggtgatgaaaaattccaacgaggctgagatgaaattactttatactgatattcggacttctttgacagaaattctaacaagagaggcagaagagctagttgcagctggcaagcgggtcttctacattgcccccaactctctttcttttgaaaaggaacgcgccgtgctagaatacttgtcccagcaggcttctttttcgattaccgtcacgcgctttgctcaaatggctcgctatctggtcttgaatgatttaccagctaaaactactcttgatgatatcggtcttgggttggccttttacaaatgccttgccgaactcgatcccaaggacttgcgtgtttatggcgctattaagcaggatcctcaattgatccagcagttaattgagctttaccatgagatgaccaaatctcagatgagttttttggacttggagaatttaacagatgaggataagagggcggatttactcttgatttttgagaaagtaacagcctatcttaatcaaggtcagttagcccagggaagtcagttgtcccatttgattgaggctattgagaatgacaaggtaagtagtgattttaatcaaatcgccttggtcattgacggctttactcgtttttctgctgaggaagagcgggttgtggacttacttcacggcaaaggtgttgagattgttatcggggcttatgctagtaagaaagcctataccagtccttttagcgagggcaatctctaccaagccagcgtaaaatttctccatcatctggcttctaaataccaaacgcctgctcaggactgttctcaaactcatgagaagatggatagttttgacaaggcctctcgtttgttggagtcttcttatgacttttcagaactcgctttggatgtcgatgagaaagaccgtgaaaatttacaaatctggtcttgtttgacgcaaaaggaggagttggagctagtagcccgtagtattcgtcagaaattacatgagaactcagacctgagctacaagcattttcgtattctcttgggggatgtagcttcttaccagttatctctcaaaaccatttttgaccagtatcagattcctttttatcttggtagaagcgaagccatggctcatcatcccttgactcagtttgtcgagtctattttagctttaaaacgttaccgttttcgtcaggaggatttgatcaatcttcttagaactgatttgtatactgacctcagtcagtctgatattgatgcttttgagcaatatatccgctatcttggtatcaatggcttgccagcctttcagcaaaccttcaccaaatcccaccatggaaaatttaatcttgagcgtttgaatgtcctccgcctgagaattttagcacctcttgaaaccctctttgccagccgaaaacaaaaggctgaaaacctcctacaaaaatggagtgtctttctaaaagaaggagctgtgactaagcagttacaagatttgacaaccactttggaagctgtagaacaggaaagacaaaccgaagtttggaaggctttctgccatgttttagaacaatttgcgactgtttttgctggttcacaggttagtctggaagacttcctagccttgctccattctggaatgagtttgtcccaataccgtaccattccagcaacagtggacactgttctggtgcagagttacgatttgattgcaccattgactgctgactttgtctatgctattggactaactcaggacaatttaccaaaaatttctcaaaacaccagtcttctgacagatgaagaaaggcaaaacctaaaccaaacgaccgaagaaggcgttcaattactgattgccagcagtgaaaatctcaagaaaaatcgctacactatgctttccttggtcaattctgctcgtaagcagttgttcttgtcggctccaagcctttttaacgaaagtgaaagtaaggaatctgcctatcttcaagagttgatccattttggatttaggcggagagagaagaggatgaatcacaaaggactgtctaaggaggatatggggtcctatcacagtcttttgtctagtctggttgcctatcaccagcagggtgagatgagcgatactgagcaagatttgacttttgtcaaggttctgtcgcgtgtcataggtaaaaaactagatctgcaaggtctggaaaatccagctatcccaaccagtccaagcagcaagaccttaaccaaggacaccttgcaagctctctatcctgccaaacaggagttttacctgtctacgtcgggtttgacagagttctatctcaatgaatacagttatttcctacgctacgttttaggcttgcaggaggaattacgtttgcgtcctgatgcccgtagtcacgggaatttcttgcatcgtatctttgaacgcgccttacagttgcctaatgaagattcctttgaccaacgtctagaacaagctattcaagaaaccagtcaagaacgcgaatttgaagctatttatcaagaaagtttggaagcccagtttaccaaggaagttttgcttgatgttgcacggacgactggacatattctccgacacaatccagccatcgaaaccatcaaagaagaagcaaattttggtggaaaagaccaagcctttattcaattagacaatggacgcagtgtctttgtacgaggcaaggtggaccggattgaccgtttgaaagctaatggagcgataggagtagtagactacaaatccagtctgactcagttccagtttcctcatttctttaatgggctcaattctcagttaccaacctatcttgctgccctaaaaagagaaggggagcagaactttttcggcgccatgtacttggaaatggctgaacctatccaatctctgatggcggtaaaaagtctggcaggagcagtggtagaagccagcaaatctatgaaataccaagggctcttcttggaaaaagaaagcagttatttaggcgaattttataacaaaaacaaggctaatcaactgacagatgaggaatttcagctcctactggactacaatgcctatctttacaagaaagctgctgagaagattttagcaggccggttcgccatcaatccttatactgaaaatggcagaagcattgccccatacgtccagcaacatcaggctattacaggctttgaagccaattaccatctgggccaagcccgtttcctagaaaagttggacctagctgatggcaagcgtctggtcggagaaaaactcaagcaagcttggtttgaaaaaataagagaggagttaaatcgatga

SEQ ID NO: 2257 - DNA (genomic), 867 bp, Streptococcus pneumoniae; double-stranded, circular
  misc_feature (B) LOCATION 1...867
  hypothetical: NO
  anti-sense: NO
aacgatacgatagaaagaataatgaacaatatgactgatttaaaagcaattcaggcttgtagtttggagatggctgaatattttgtggccttttgcaaggaacatgatttactttgctatctctgtgggggaggcgctattggtgcccttcgaaacaaggggttcattccttgggacgacgacctagacttttttatgcctcgtaaagattatgagaaattagcagaattatggcctcgttatgcagatgaacgttatttcttgtcaaagagttacaaggattttgttgatcgtaatctttttattaccattcgtgacaaggaaaccacctgtatcaagccttatcagcaggatttggatttgccacatggtctggccttggatgttttgcctttggattattatccgaaagatccagctgagcggaaaaaacaggttcgttgggccttgatttattcactcttttgtgcgcaaactattccagaaaagcatggtgctctcatgaaatggggaagtcgcattttactgggtttgactccaaaatctctccgttatcgcatctggaaaaaagctgagaaagaaatgactaagtatgatttggctgattgtgatggcattacagaattatgctcaggtcctggctacatgagaaacaagtacccaatcacatcttttgaagacaatcttttcttgccatttgaaggaacaaagatgcctattccaatcggctatgatgtctatctcagaactgcttttggggattatatgacgcctccaccagcagacaagcaggtaccgcatcatgatgttgtcatcgctgatatggataagtcttatacagaatacaagggagaatatggtggctaa

SEQ ID NO: 2258 - DNA (genomic), 1215 bp, Streptococcus pneumoniae; double-stranded, circular
  misc_feature (B) LOCATION 1...1215
  hypothetical: NO
  anti-sense: NO
tatagaacgattttttacatgaatgataaaacagaggtaaatatgacaatcggtattgataagattggttttgcgaccagtcaatatgtcttgaaattacaagacttagcagaagcgaggggaattgaccctgaaaaattaagtaaaggactcttactcaaggaattgagtattgcgcccctaactgaggacatcgtgaccttggcggccagtgctagtgactctattttaactgagcaagaaagacaagaagttgacatggtcattgtggctaccgagtcaggaattgaccagagtaaggctgcggccgtctttgtgcatggcttgctgggcatccagccctttgctcgtagtttcgagattaaagaagcctgctatggggcgacagctgccctccattatgccaaattgcatgtggaaaattctccggagtccaaggtattggtcattgccagtgatattgccaaatatggtattgaaactccgggagaaccaactcaaggtgctggaagtgtagctatgttgattacacaaaatccacgcatgatggcctttaataatgacaatgtagctcagacccgtgacatcatggatttctggcgaccaaattactcgacaactcctcatgtaaatggtgtctattctacccaacaatacttggatagtttgaaaacgacttggcttgaatatcaaaaacgctaccagcttactttggatgattttgctgctgtttgtttccacttgccttatcctaaattagcgctaaaaggcttgaaaaaaatcatggataagagcctgcctcaagagaaaaaagacctcttacaaaagcattttgaccagtctattctctacagtcaaaaggtggggaatatctacacaggttcacttttccttggacttttgtctctcttggaaaatacagatagcttgaaagctggggataaaatcgccctttatagttacggaagtggagctgtggctgagttcttcagtggtgaattggttgaaggatatgaagcttatttggataaagaccgcttgaacaagctcaaccaacgaactgccctatccgttgcagactatgaaaaggtcttttttgaggaagtaaacttggatgaaacaaactctgcccagtttgctggctatgaaaatcaagattttgccttggttgaaattcttgaccaccaacgccgttatagcaaggttgaaaaataa

SEQ ID NO: 2259 - DNA (genomic), 954 bp, Streptococcus pneumoniae; double-stranded, circular
  misc_feature (B) LOCATION 1...954
  hypothetical: NO
  anti-sense: NO
ctattagcgattgtcactgtaaataatatccttgtagcaagcaatttttctcctagacttgaaataaagcgcatttctctatataataaatacttatatagaaaacaccttttagaaagatacctatgcttccatatccattttcctttttttcatgtatttggttggtatcgtaagcccctgtccaaacgtttcgagctcaactggttccaacttctctttaccagtatcttccttatcagcttgtctatggtacccattgctatccaaaacagctcccaggagacctatccgctagaaacttttatcgataatgtctatgaacctctgacagataaggttgtccaggatctctctgaacatgctacaattgtcgatggcacattaacttatactggaacagttagtcaagcctcttctattgtgattggtccaagtcaaatcaaggaattacctaaggacttgcaactgcatttcgatacaaatgagctagtcatcagcaaggaaagcaaggaactgacccgcatctcttaccgagccattcagactgagagtttcaaaagcaaagacagcttgacccaagcaatttctaaagactggtaccaacaaaatcgtgtctatatcagcctcttcctagttctcggtgcgagcttcctctttggtttgaatttctttatcgtctctctaggagctagtcttctcctttatatcactaagaaatcacgcctcttttcatttagaacctttaaagagtgctatcactttatcttgaactgtttaggattgccgactctaattacacttattttgggattatttggccaaaatatgacaaccttgattactgtacaaaatattctttttgttctgtatctggtcactatcttttataaaacacatttccgtgatccaaattaccataaatacggagatttttatgcccgttacgattaa

SEQ ID NO: 2260 - DNA (genomic), 207 bp, Streptococcus pneumoniae; double-stranded, circular
  misc_feature (B) LOCATION 1...207
  hypothetical: NO
  anti-sense: NO
aaatcagcctttttttcaacaaaaatacgtttatccatcaattcttattcctttatttcagctcttgcaatattcccaaacagccttgaggttgttattttaaaccctgcaacttttcccagacaatttcgtaaacatctgttagttcacctagttctctacagagtgaaaaggtctgggggaccttttcagcctgagtccttttag

SEQ ID NO: 2261 - DNA (genomic), 1347 bp, Streptococcus pneumoniae; double-stranded, circular
  misc_feature (B) LOCATION 1...1347
  hypothetical: NO
  anti-sense: NO
gtttgtcagatgaaaagctggaagaattggctgataaaaatcaattattgcgtttacaagaagaaaaggaaaggaagaatgcgtaaattcttaattattttgttgctaccaagttttttgaccatttcaaaagtcgttagcacagaaaaagaagtcgtctatacttcgaaagaaatttattacctttcacaatctgactttggtatttattttagagaaaaattaagttctcccatggtttatggagaggttcctgtttatgcgaatgaagatttagtagtggaatctgggaaattgactcccaaaacaagttttcaaataaccgagtggcgcttaaataaacaaggaattccagtatttaagctatcaaatcatcaatttatagctgcggacaaacgatttttatatgatcaatcagaggtaactccaacaataaaaaaagtatggttagaatctgactttaaactgtacaatagtccttatgatttaaaagaagtgaaatcatccttatcagcttattcgcaagtatcaatcgacaagaccatgtttgtagaaggaagagaatttctacatattgatcaggctggatgggtagctaaagaatcaacttctgaagaagataatcggatgagtaaagttcaagaaatgttatctgaaaaatatcagaaagattctttctctatttatgttaagcaactgactactggaaaagaagctggtatcaatcaagatgaaaagatgtatgcagccagcgttttgaaactctcctatctctattatacgcaagaaaaaataaatgagggtctttatcagttagatacgactgtaaaatacgtatctgcagtcaatgattttccaggttcttataaaccagagggaagtggtagtcttcctaaaaaagaagataataaagaatattctttaaaggatttaattacgaaagtatcaaaagaatctgataatgtagctcataatctattgggatattacatttcaaaccaatctgatgccacattcaaatccaaaatgtctgccattatgggagatgattgggatccaaaagaaaaattgatttcttctaagatggccgggaagtttatggaagctatttataatcaaaatggatttgtgctagagtctttgactaaaacagattttgatagtcagcgaattgccaaaggtgtttctgttaaagtagctcataaaattggagatgcggatgaatttaagcatgatacgggtgttgtctatgcagattctccatttattctttctattttcactaagaattctgattatgatacgatttctaagatagccaaggatgtttatgaggttctaaaatga

SEQ ID NO: 2262 - DNA (genomic), 888 bp, Streptococcus pneumoniae; double-stranded, circular
  misc_feature (B) LOCATION 1...888
  hypothetical: NO
  anti-sense: NO
aggtgtcagatggcagtgtctctaaatgatattaaaacaaaaatcgcctcaacaaaaaatacgagtcaaatcactaatgccatgcaaatggtatcggctgctaagctaggtcgctctgaagaagctgctcgcaacttccaagtttacgctcagaaagtgcgtaaacttttgacagatatccttcatggtaatggagctggtgcttcaactaatccgatgttgattagccgttctgtgaagaagacaggctatatcgttatcacttcagaccgcggtttggttggaggttataattcctctattttgaaagctgttatggagttgaaagaagaataccacccagacggtaaaggttttgaaatgatctgtatcggtgggatgggagctgatttctttaaggctcgcggtattcaaccactttatgaattacgtggcttggcagaccaacctagctttgatcaagttcgtaagattatttcaaaaactgttgaaatgtaccaaaatgaactctttgatgagctttatgtttgctacaaccaccatgtcaatacgctaaccagtcaaatgcgtgtggaacaaatgcttccgattgttgacttggatccaaatgaagcggatgaagagtacagcttgacttttgaattggaaaccagccgagaagaaattctggagcagttgttgcctcagtttgcagaaagtatgatttacggtgccattatcgatgccaagacagctgagaatgctgcgggtatgacagccatgcaaacagcgacagataatgctaagaaagtcatcaatgatttgacaattcagtataaccgtgccagacaggcggctattacacaagaaattacagaaatcgtagcaggtgctagtgccttagaatag

SEQ ID NO: 2263 - DNA (genomic), 909 bp, Streptococcus pneumoniae; double-stranded, circular
  misc_feature (B) LOCATION 1...909
  hypothetical: NO
  anti-sense: NO
gtgactaagatgttgtttgatcaaattgcaagcaataaacgaaaaacctggattttgttgctggtatttttcctactcttagctcttgttggttatgcggttggttatctctttataagatctggacttggtggtttggttatcgcactgattatcggctttatctacgctttgtctatgatttttcaatcgacagagattgtcatgtccatgaatggagcgcgtgaggtggatgagcaaacggcaccagacctctaccatgtagtggaagatatggctctggtcgctcagattcctatgccccgtgttttcatcattgatgatccagccttaaatgcctttgcgacaggttctaatcctcaaaatgcggctgttgctgcgacttcaggtctactagctatcatgaatcgtgaagaactagaagctgttatgggacatgaagtcagtcatattcgtaattatgatatccgtatttcgactattgcagttgcccttgctagtgctatcaccatgctttctggtatggcaggtcgtatgatgtggtggggtggagcaggtcgcagacgaagtgatgatgaccgagatggaaatggtcttgaaatcattatgctagtggtttccctactagctattgtactggcacctctcgctgcaaccttggttcagctcgctatttctcgtcagagggaatttctggcagatgcatctagtgttgagctgactcgcaatccccagggaatgattaatgccctagataagttggacaatagcaaaccgatgagtcgccacgtcgatgatgctagcagtgctctttatatcaatgatcccaagaaaggtggggggttccaaaaactcttttatacccacccacctatctcagaacggattgaacgtttaaaacagatgtaa

SEQ ID NO: 2264 - DNA (genomic), 654 bp, Streptococcus pneumoniae; double-stranded, circular
  misc_feature (B) LOCATION 1...654
  hypothetical: NO
  anti-sense: NO
gagaataagatggcatttattgaaaaaggtcaagaaatcgatatggaagtcatcaaggctgaaacccaattgtctgcggaagccttgagactcaaggaaagccgtgacagggaattggcagatattatttcaggggaagatgaccgtattctcttggtgattggtccttgctcttctgataatgaagaggcggtcttggaatatgctcgccgtttatccgccttgcaaaagaaggtagcggataagattttcatggtcatgcgcgtgtatactgctaagcctcgtaccaatggagacggctataaaggattagttcaccagccagatacttctaaggctccaagcctgattaatggcttgcaggctgtgcgccagttgcactaccgcgtgattacagagactggtttgacaacggcagatgagatgctttatccgtcaaatctgatcttggtggatgacttggtcagctaccatgccgttggagctcgttctgtggaagaccaagagcaccgctttgtggcttctgggattgatgcaccagtagggatgaaaaatccaacctcaggaaatttgggtgttatgtttaacgccatctatgctgctcaaaacaagcaaacttccttaatcatgggcaggaagttggaacatcagtaa

SEQ ID NO: 2265 - DNA (genomic), 879 bp, Streptococcus pneumoniae; double-stranded, circular
  misc_feature (B) LOCATION 1...879
  hypothetical: NO
  anti-sense: NO
gagaataagatgaagattattgtacctgcaaccagtgccaatatcgggccaggttttgactcggtcggtgtagctgtaaccaagtatcttcaaattgaggtctgcgaagaacgagatgagtggctgattgaacaccagattggcaaatggattccacatgatgagcgtaatctcttgctcaaaatcgctttgcaaattgtaccagacttgcaaccaagacgcttgaaaatgaccagtgatgtccctttggcgcgcggtttgggttcttccagctcggttatcgttgctgggattgaactagccaaccaactgggtcaactcaacttatcagaccatgaaaaattgcagttagcgaccaagattgaagggcatcctgacaatgtggctccagccatttatggtaatctcgttattgcaagttctgttgaagggcaagtctctgctatcgtagcagactttccagagtgtgattttctagcttacattccaaactatgaattacgtactcgcgacagccgtagtgtcttgcctaaaaaattgtcttataaggaagctgttgctgcaagttctatcgccaatgtagcggttgctgccttgttggcaggagacatggtgaccgctgggcaagcaatcgagggagacctcttccatgagcgctatcgtcaggacttggtaagagaatttgcgatgattaagcaagtgaccaaagaaaatggggcctatgcaacctacctttctggtgctgggccgacagttatggttctggcttctcatgacaagatgccaacaattaaggcagaattggaaaagcaacctttcaaaggaaaactgcatgacttgagagttgatacccaaggtgtccgtgtagaagcaaaataa

SEQ ID NO: 2266 - DNA (genomic), 1236 bp, Streptococcus pneumoniae; double-stranded, circular
  misc_feature (B) LOCATION 1...1236
  hypothetical: NO
  anti-sense: NO
aaaagtaagataggagcattcatgcagtattcagaaattatgattcgctacggtgagctgtcaaccaagggcaaaaatcgtatgcgtttcatcaataaacttcgcaataatatttcagacgttttgtctatctatccccaagttaaggtaacagcagatcgcgaccgtgcccacgcttacctcaatggagcagattacacagcagtagcagaatcgctcaaacaagtatttggaattcaaaacttttcccctgtttataaggttgaaaaatctgtagaagttctgaagtctgctgtccaagagattatgcaggacatctacaaggaaggcatgacctttaaaatctctagcaagcgtagcgaccacacctttgaattggacagtcgtgaactcaaccaaacgcttggaagggctgtattcgaagccattccaaacgtacaagctcaaatgaaaagtcctgacatcaatcttcaggtggagatacgtgaagaagcagcctatctttcttatgaaaccgttcgaggggcaggtggattaccagtgggaacttctggtaagggcatgctcatgttgtcagggggaatcgattcccctgtagctggctatctagcgcttaaacgaggggtagatatagaggcagttcactttgccagcccaccttacacgagtcctggtgctcttaaaaaagcccaagatttgacccgtaaattaaccaaatttgggggaaatatccagtttatcgaagttccttttacagagattcaagaggaaatcaaagccaaagcgccagaagcctaccttatgaccttgacgcgtcgttttatgatgcgtattactgaccgtattcgtgaggtacgaaatggtttagttatcatcaatggggaaagtctaggtcaagtagccagccaaacccttgaaagtatgaaggctatcaatgctgttaccaacactcccatcattcgtcctgtggttaccatggacaagttggaaatcattgacatcgcccaggaaatcgatacctttgacatttcaatccaaccgtttgaagactgttgtaccatttttgcaccagatcgtccaaaaacaaatcctaaaattaagaatgcggagcagtacgaagcgcgtatggatgttgaaggcttggttgagcgagcagtggctggaatcatgattactgaaatcacacctcaagccgaaaaagatgaagttgatgacttgattgacaatctgctctaa

SEQ ID NO: 2267 - DNA (genomic), 501 bp, Streptococcus pneumoniae; double-stranded, circular
  misc_feature (B) LOCATION 1...501
  hypothetical: NO
  anti-sense: NO
gggggtaagattatgaaatatgatttatatgataattgtattgaacttctaaaagaacgcgaagttacaattgaagatatggcagcgttagtaatattttcacaacaaaaatattaccctgaattaactcttgacgacgcttcatatgcaattcaacgtgtactaaaaaaacgtgaagttcagaatgtaattatgacaggaattgagttagataagttagctgaagcacaaaaactatctccagaatttcaaaagattatggagaaagataatccattgtatgggattgatgaagtaatcgtcttatcgatattgaatttatatggttctattgcctttacaaattatggctatttagataaattaaaaccactgattttagaaagattgaatgagaatcacgaaggtgtttgtaatgtatttctagatgatattgttggtgcaatagccgcagcagcatgtagtaaaattgcacacaatcatgctagtgatgaaatataa

SEQ ID NO: 2268 - DNA (genomic), 222 bp, Streptococcus pneumoniae; double-stranded, circular
  misc_feature (B) LOCATION 1...222
  hypothetical: NO
  anti-sense: NO
aggttaaagatgtcaaaacaaaagaaatttgaggaaaatctagcagaactggaaaccattgtccaaagtttggaaaatggtgaaattgctctggaagatgcgattactgcctttcaaaagggcatggtcttgtcaaaagagctccaagctacgctggacaaggctgaaaagaccttggtcaaggtcatgcaagaagacggaacagaaagtgattttgaatga

SEQ ID NO: 2269 - DNA (genomic), 1791 bp, Streptococcus pneumoniae; double-stranded, circular
  misc_feature (B) LOCATION 1...1791
  hypothetical: NO
  anti-sense: NO
tgtcaaaagatacaaggtataagagcctgcaagagatgtttaacattgcgaatgaatggagggtttcaaatgaaagagttttataaaaaaagatttgctcttacagatggaggagcaagaaatttaagtaaagcaacactggcttcatttttcgtttattgtataaacatgcttcctgccatattacttatgatttttgctcaggaagttttggaaaatatgggcaaaagcaatggcttttatatagtattctcagttttgattttgatagcaatgtatattttgctttctatcgaatacgataaattatataacacaacctatcaagaaagtgcagatttaagaataaggacagcggagaatttatcaaaattacctctatcttacttttctaaacatgacatttccgacatttcacaaacaatcatggctgatattgaaggcatagagcatgcaatgagccactcaataccaaaggtgggcggcatggtactgtttttcccattaatatctgtaatgatgctagcgggcaatgtcaagatgggtttagctgtaattattccatctattttaagctttatatttatacctttatctaaaaaatatcaggttaatggacagaatagatattatgatgtcttaagaaaaaactcagaaagctttcaagaaaatatcgaaatgcaaatggagattaaagcatataatttatcgaaggatattaaagatgacttatataaaaaaatggaagatagtgagaaagtacacttaaaggcggaagtaactacaattttaactttgtctatatcttcaatatttagctttatatctcttgctgttgtgatatttgtcggcgtaaatctaattattaataaagagataaattctctctaccttataggatatttactagctgctatgaagataaaagactctttagatgcatctaaagagggcttgatggaaatattttatttatcgcccaaaatagaaagattaaaagaaattcaaaatcaagatttacaagaaggcgatgactatagcttaaaaaaatttgatattgatctaaaagatgttgagtttgcctacaataaagacgaaaaagttttaaatggtgtaagttttaaagctaagcagggagaggtcactgctttggtaggtgcaagtggctgcggtaaaacaactatcttgaaacttatatcaagactttatgattatgacaagggacaaatcttaatcgatggcaaagatataaaggaaatatcaacagaatccctttttgataaggtgtctattgttttccaagatgtggttctctttaatcaaagcgttatggaaaatattagaatcggtaagcaagatgcaagtgacgaagaggttaaaagagcagcaaaacttgcaaattgcacagattttatagaaaaaatggataaaggtttcgatacagttattggtgaaaacggagctgagctatcaggaggagaaagacaaagattatcaatagccagagccttcttaaaagatgcgccgatattgatcttagatgagataacagcaagccttgatgttaacaacgagaaaaagattcaagagtctttaaataatttagttaaagataaaactgttgtaatcatttcacatagaatgaaatccatagaaaatgcagacaagatagtagttcttcaaaacggaagagtagaaagcgaaggtaagcatgaagagcttttacaaaaatcaaaaatttacaaaaatttaatagaaaagacaaaaatggcagaagaatttatttattag

SEQ ID NO: 2270 - DNA (genomic), 261 bp, Streptococcus pneumoniae; double-stranded, circular
  misc_feature (B) LOCATION 1...261
  hypothetical: NO
  anti-sense: NO
gtcaaaaagatgttcaaagattttatccaatctatttatgaaaaagtttatattataaatttcgaaaaatgctctcaaataccgtgtttgacgagtgaagaattgaaaagtcttggaaaatggtatgtctcgactggtaaagaatggatttgtcattcagatgctgatctggaagaatttaaaaatctatttttaaattttatcaatcctgaagaatgggatactatctcctttgattcagattttatgccgtttcaataa

SEQ ID NO: 2271 - DNA (genomic), 885 bp, Streptococcus pneumoniae; double-stranded, circular
  misc_feature (B) LOCATION 1...885
  hypothetical: NO
  anti-sense: NO
gagaaaaagatgagaaatgtaagagttgcaaccattcagatgcaatgcgctaaggatgtggcaacaaatatccaaaccgcagagcgtttagtacgtcaggctgctgagcaaggagcccaaattattctcttgcccgagttgtttgaacatccctatttctgtcaggaacgtcagtatgactactaccagtatgcccaatctgtagcggaaaatactgccattcagcattttaaggtgattgctaaggaactacaagttgttttaccaatcagtttctatgaaaaagatggtaatgtcttgtataactctattgccgtcattgatgcagatggggaagtgctgggcgtttatcgaaagacccacataccagatgaccattattatcaagaaaaattctatttcacgcctggtaacactggtttcaaggtctggaatactcgctatgctaagattggtatcggtatctgttgggatcaatggttccccgaaacagcccgctgtcttgctctgaatggggcagaattgctcttttatccaacagccatcggttcagagccgattttggatacagatagttgtggtcactggcaacgtactatgcaagggcacgcagcagcgaatattgttccagtcatcgcagccaatcgttatggtttagaggaggttactcctagtgaggaaaatggcggacagagttccagtcttgacttctacggttcctcctttatgacggatgaaacaggagctattctagaacgagctgaaagacaagaagaagctgttctgttagctacttatgacctagacaagggagcaagtgaacgcctaaactggggcttgtttcgagatagaagaccagaaatgtatagacaaattacagattag

SEQ ID NO: 2272 - DNA (genomic), 768 bp, Streptococcus pneumoniae; double-stranded, circular
  misc_feature (B) LOCATION 1...768
  hypothetical: NO
  anti-sense: NO
aatagaaagattgatactatgacaaaaattaagattgtaaccgattcatctgttactattgaacctgaactagtaaagcaattagatattacaattgttccattatctgtaatgattgataatgttgtttattctgatgcggatttgaaagaagaaggtaaatttcttcagttgatgcaagaaagtaagaatcttccgaaaacaagtcagccacctgtaggtgtctttgctgagatttttgaagacctatgcaaagatggtggccagattcttgctattcatatgtcccatgctctttcgggtacggtagaagcagcacgccaaggtgctagcctatctactgcagatgtgactgttgttgatagttccttcactgaccaagccctgaaattccaagttgttgaggctgcgaagttagctcaagaaggtaaagatatggaggcaattttatctcatgtagaagaggttaaaaaccatacagagctttatattggtgtttcaactttggaaaatcttgtcaaaggtggacgaattagccgtgtaactggcttgttgagctctcttctcaatatccgtgttgtcatgcaaatgaaagaccatgaattgcagccaatggttaaaggtcgtggaactaaaacatttaaaaaatggttagatgagttgataacatcgctttctgaacgtgctgtagcagagattggaatttcatattctggtagtgatngattgggcaaaagagatgaaagaaagcttacaagcttatgttga

SEQ ID NO: 2273 - DNA (genomic), 579 bp, Streptococcus pneumoniae; double-stranded, circular
  misc_feature (B) LOCATION 1...579
  hypothetical: NO
  anti-sense: NO
agaggaaagatgagtactttagcaaaaatagaagcgctcttgtttgtagcgggtgaagatgggattcgggtccgccagttagctgaactcctctctctgccaccgacaggcatccagcaaagtttaggaaaattagcccagaagtatgaaaaggacccagattccagtttggctttgattgagacaagtggtgcttatagattggtgaccaagcctcaatttgcagagattttgaaggaatactctaaggcgcctatcaaccagagcttgtctcgggctgcccttgagaccttgtccattattgcctacaaacagccgattacgcggatagaaattgatgccatccgtggagttaactcgagtggagccttggcaaagttgcaggcttttgacctgataaaggaagacgggaaaaaggaagtattggggcgccccaacctctatgtgactacggattatttcctagattacatggggataaaccatttagaagaattaccagtgattgatgagcttgagattcaagcccaagaaagccaattatttggtgaaaggatagaagaagatgagaatcaataa

SEQ ID NO: 2274 - DNA (genomic), 795 bp, Streptococcus pneumoniae; double-stranded, circular
  misc_feature (B) LOCATION 1...795
  hypothetical: NO
  anti-sense: NO
tttatgaagattcctctcttaacttttgcaaggcataaatttgtttatgtcttgcttactttgctttttcttgctttggtttatcgtgatgttttgatgacttatttcttttttgatattcatgcgcccgatctagctaaattcgatggacaagcaattaaaaatgacttattaaaatcagcattagattttcgtattctccagttcaatctaggtttttatcaatcatttattattccaatcatcattgttttgctaggttttcaatatattgagctgaaaaataaagttttacgattgagtattggaagagaagtgagctatcaagggttaaaaagaaagttgactttgcaagttgcaagtatcccttgtttgatatatttagtgactgtgctgataattgcaattataacctatttccttgggactttttctcctcttggatggaattctctattttctgatggaagtggtttacaaagactcctagatggagagataaaaagctatttgttctttacttgtgtcctactaatcggtattttcatcaatgcaatctattttttacaaatagttgattatgtggggaatgtgactcgttcggcaatcacctatttgatgtttctttggcttggttctatgctgctctatagtgccttgccttactatatggttcctatgacgagtttgatgcaagctagctatggggatgtaagtttgatgaaactctttactccttatatcctttatattgtcccttatatggtgcttgaaaaatatgaagataatgtttaa

SEQ ID NO: 2275 - DNA (genomic), 723 bp, Streptococcus pneumoniae; double-stranded, circular
  misc_feature (B) LOCATION 1...723
  hypothetical: NO
  anti-sense: NO
acgatgaagattgatattttaaccctctttccagagatgttttctccactggagcactcaatcgttggaaaggctcgagaaaaagggctcttggatatccagtatcataattttcgagaaaatgctgaaaaggcccgtcatgtagatgatgagccctacggaggcggtcagggcatgttgctcagagcacaacctattttcgattcctttgatgctattgaaaagaaaaatccgcgcgttattctcctcgatcctgctggaaagcagtttgatcaggcttatgctgaagatttggctcaagaggaagagctaatctttatctgtgggcactatgagggttatgatgagcgcattaagaccttggtaacagatgagatttccctaggcgactatgtcctcactggtggagaattggcagctatgaccatgattgatgctacagttcgcctgattccagaagtgattggcaaggagtctagccaccaagatgatagtttttcttcaggtcttttagaatatcatcagtacacacgtccctatgattatcgaggcatggtcgtgccagatgtattgatgagtggccatcatgaaaagattcgtcagtggcgattgtacgagagtttaaagaaaacctacgagcgcagaccggatttacttgaacattatcaactgacagtagaagaagaaaaaatgctggcagaaatcaaagaaaacaaagaataa

SEQ ID NO: 2276 - DNA (genomic), 225 bp, Streptococcus pneumoniae; double-stranded, circular
  misc_feature (B) LOCATION 1...225
  hypothetical: NO
  anti-sense: NO
aagatgaagattatgctgctaaatatacacgagcgaagtactattattctaagtcgagggaaaaagtttatacgattcctgacttgcttcaaaggtgataaaatggaaaatttattagacgtaatagagcaatttttgagtttgtcagatgaaaagctggaagaattggctgataaaaatcaattattgcgtttacaagaagaaaaggaaaggaagaatgcgtaa

SEQ ID NO: 2277 - DNA (genomic), 801 bp, Streptococcus pneumoniae; double-stranded, circular
  misc_feature (B) LOCATION 1...801
  hypothetical: NO
  anti-sense: NO
gagatgaagattggatttatcggtttggggaatatgggtgctagcttggcaaaatctgtcttgcagactaggacgtcagatgagattctccttgccaatcgtagtcaagctaaggtagatgctttcattgcagactttggtggtcaggcttccagcaatgaaaaaatgtttgcagaagcagatgtgatttttctaggagttaagcctgctcagttttctgaactgctttctcaataccagaccatccttgaaaaaagagaaagtcttcttttgatttcgatggcagctggattgaccttagaaaaactagcaagtcttatcccaagccaacaccgaattattcgtatgatgcctaatacccctgcttctatcgggcaaggagtgattagttatgccttgtctcctaattgcagggctgaggacagtgagatcttttgtcagcttttagccaaggctggtctcttggttgaattaggagaaagcttaatcaatgcagcgacaggtcttgcaggttgtggaccagcctttgtctatctctttattgaggccttggcagatgcaggtgttcagacgggattaccacgagaaacagccttgaaaatggcagcccaaactgtggtaggagctgggcaattggtcctagaaagccagcaacatcctggagttttgaaagatcaagtttgtagtccaggcggttcgactattgctggcgtagcaagcctagaagcgcatgcttttcgaggcacagtcatggaggcagttcatcaagcctataaacgaacacaagaactaggtaaataa

SEQ ID NO: 2278 - DNA (genomic), 198 bp, Streptococcus pneumoniae; double-stranded, circular
  misc_feature (B) LOCATION 1...198
  hypothetical: NO
  anti-sense: NO
ttggatgagataggattccaaggtgctagcgctccctcacgtaaggttttgctggcatctggcactaccaaatcagtatccacctccagcttgatgcccaagccgtcacactcactacaagagccaaaaggagcattgaaagagaagagacgaggctctaactctgggacagtaaaaccacaaactggacaggcataa

SEQ ID NO: 2279 - DNA (genomic), 540 bp, Streptococcus pneumoniae; double-stranded, circular
  misc_feature (B) LOCATION 1...540
  hypothetical: NO
  anti-sense: NO
aaagtggagattatgagttattttaaaaaatataaattcgataaatcccagttcaaacttggtatgcgaacctttaaaacaggtattgctgtttttctagttctcttgatttttggcttttttggctggaaaggtcttcaaattggtgctttgacagccgtttttagcctgagggagagttttgatgagagtgttcattttgggacttcgcgtattctaggaaatagtatcggtggactctatgccttggtcttcttcttattaaatacttttttccacgaagccttttgggtgaccttggtagttgttccaatctgcaccatgttaaccattatgacaaatgtagccatgaataacaaagcaggggttattggtggtgtagcagctatgttaatcattaccctatcaattccaagtggcgagacaattttgtacgtgtttgtgcgtgtattagaaacgtttatgggagtttttgtcgcaattatcgtaaattacgatattgatcgtattcgtctctttttagagaaaaaagaaaaataa

SEQ ID NO: 2280 - DNA (genomic), 5904 bp, Streptococcus pneumoniae; double-stranded, circular
  misc_feature (B) LOCATION 1...5904
  hypothetical: NO
  anti-sense: NO
ataaaggagataaaagtgtttaaaaaagaccgtttttcaattcgtaagattaagggagttgtaggctctgtatttcttggaagccttttgatggctccttctgtagtggacgcagccacctatcactatgtaaataaagagattatttcacaagaagctaaagatttaattcagacaggaaagcctgacaggaatgaagttgtatatggtttggtgtatcaaaaagatcagttgcctcaaacagggacagaagcatctgttttgacagcttttggtttgctgactgttgggagcttgcttttaatctacaagagaaagaaaattgctagcgtctttctagttggagctatgggattggtagttcttcctagtgcaggggctgtagacccagttgcgaccctagcgctggctagtcgagagggtgttgttgaaatggagggctatcgctatgttggttatctatcaggtgacatcctcaaaacgcttggcttggacactgttttagaaaaaacctcagcaaaacctggagaggtgactgtagtcgaagttgagactcctcaatcaacaacaaatcaggagcaagctaggacagaaaaccaagtagtagagacagaggaagcacctaaaacagaagaaagtccaaaggaagaaccaaaatcggagataaaacctactgacgacacccttcctaaagtagaaaagggaaagaaaatccncnnaaccgctccagttgaagaagtaggtggagaagttgagtcaaaaccagaggaaaaagtagcagttaagccagaaagtcaaccatcagacaaaccagctgaggaatcaaaagttgaaccaccagtagaacaagcaaaaggcccagaacaacccgtgcaacctacacaagctgagcaaccaaggataccaaaagattcatcacaaccagaagatcctaaagaagataggggagcggaagatacaccgaaacaagaagatacacagccagaagtagtagaaacaaaagatgaggctgctaatcaacctgttgaagaaccaaaagttgaaacgcctgctgtagaaaaacaaacggaaccaaaagttgaacaagtaggtgaaccagtcgagccaagtgaagacgaaaaggcaccagtctctccagaaaagcaaccagaagctcctgaagagaaggctgtagaggaaacaccgaaaccagaagataaaataaagggtattggtactaaagaaccagttgataaaagtgagttaaataatcaaattgataaagctagttcagtttctcctactgattattctacagcaagttacaatgctcttggacctgttttagaaactgcaaaaggtgtctatgcttcagagcctgtaaaacagcctgaggtaaatagcgagacaaataaacttaaaacggctattgacgctctaaacgttgataaaagtgaattacaggaacaattaagagttgctgaacaaaaacaacaagctgactatagcgctaaaacttggagggaattcaaaattgctgaacttcaagctaaagaaatcaacaaccaaactacaccacttcctaaacaaagtgaaatagatgcagctactaaggctcttcaagacgctcttcaagctcttgctgtagataaaactgtattacaaaacgctattaacacagctaatagcaaacgtgaagaagagtatactgctcagacatggaaagcgttagaagatgctcttacagcagtgaatcctgttaatgaagatgaaactgcaactcaaagcaaagtagacgaagctactagaaacttagaagaagctatcaataacctagttctattaactgaaaaaccggtattaacatttattgagactgataagaaagcattagaacgtgaagtagttgctaagtattctctagaaaaccaaaataaaacaaaaattaaatcaatcacagctactctgaaaaaaggagaaacagttgttagcactgtagagcttataggcgatgatgtaactaatgaaactataacctctgcatttaagaatctagagtactacaaagaatacaccctatctacaactatggtttacgatagaggtgacggtgatgtaacagaaatcttagataatcaaccaatccaactagatcttaaaaaagttgagcttaaaaatattaaacgtacagatttaatcaaatacgaaaatggaaaagaaactaatgaatcactaataacaactgttcctgatgataagcggaattattatttaaaaataacttcaaagaatcaaaaaactacattactagctgttaaaaatatagaagaaactacggttaacggaacacctgtatataaagttacagcaatcgcagacaatttagtctctagaactgctgataataaatttgaagaagaatacgttcactatattgaaaaacctaaagtccacgaagataatgtatattataacttcaaagaattagtggaggctattcaaaacgatccttcaaaagaatatcgtctgggacaatcaatgagcgctagaaatgttgttcctaatggaaaatcatatatcactaaagaatttacaggaaaacttttaagttctgaaggaaaacaatttgctatcactgagttggaacatccattatttaatgtgataacaaacgcaacgataaataatgtgaattttgaaaatgtagagatagaacgttctggtcaagataatattgcatcattagccaatactatgaaaggttcttcagttattacaaatgtcaaaattacaggcacactttcaggtcgtaataatgttgctggatttgtaaataatatgaatgatggaactcgtattgaaaatgttgctttctttggcaaactacactctacaagtggaaatggctctcatacagggggaattgcaggtacaaactatagaggaattgttagaaaagcatatgttgatgctactattacaggaaacaaaacacgcgccagcttgttagttcctaaagtagattatggattaactctagaccatcttattggtacaaaagctctcctaactgagtcggttgtaaaaggtaaaatagatgtttcaaatccagtagaagttggagcaatagcaagtaagacttggcctgtaggtacggtaagtaattctgtcagctatgctaagattatccgtggagaggagttattcggctctaacgacgttgatgattctgattatgctagtgctcatataaaagatttatatgcggtagagggatattcgtcaggtaatagatcatttaggaaatctaaaacatttactaaattaactaaagaacaagctgatgctaaagttactactttcaatattactgctgataaattagaaagtgatctatctcctcttgcaaaacttaatgaagaaaaagcctattctagtattcaagattataacgctgaatataaccaagcctataaaaatcttgaaaaattaataccattctacaataaagattatattgtatatcaaggtaataaattaaataaagaacaccatctaaatactaaagaagttctttctgttaccgcgatgaacaacaatgagtttatcacaaacctagatgaagctaataaaattattgttcactatgcggacggtacaaaagattactttaacttgtcttctagcagtgaaggtttaagtaatgtaaaagaatatactataactgacttaggaattaaatatacacctaatatcgttcaaaaagataacactactcttgttaatgatataaaatctattttagaatcagtagagcttcagtctcaaacgatgtatcagcatctaaatcgattaggtgactatagagttaatgcaatcaaagatttatatttagaagaaagcttcacagatgttaaagaaaacttaacaaacctaatcacaaaattagttcaaaacgaagaacatcaactaaatgattctccagctgctcgtcaaatgattcgtgataaagtcgagaaaaacaaagcagctttattactaggtttaacttacctaaatcgttactatggagttaaatttggtgatgttaatattaaagaattaatgctattcaaaccagatttctatggtgaaaaagttagcgtattagacagattaattgaaatcggttctaaagagaacaacattaaaggttcacgtacattcgacgcattcggtcaagtattggctaaatatactaaatcaggtaatttagatgcatttttaaattataatagacaattgttcacaaatatagacaatatgaacgattggtttattgatgctacagaagaccatgtctacatcgcagaacgcgcttctgaggtcgaagaaattaaaaattctaaacatcgtgcattcgataatttaaaacgaagtcaccttagaaatactatactcccactactgaatattgataaagcacatctttatttaatttcaaattataatgcaattgcctttggtagtgcagagcgattaggtaaaaaatcattagaagatattaaagatatcgttaacaaagctgcagatggttatagaaactattatgatttctggtatcgtctagcgtctgataacgttaaacaacgactactaagagatgctgttattcctatttgggaaggttataacgctcctggtggatgggttgaaaaatatggccgctataataccgacaaagtatatactcctcttagagaattctttggtcctatggataagtattataattataatggaacaggagcttatgctgctatatatcctaactctgatgatattagaactgatgtaaaatatgttcatttagaaatggttggtgaatacggtatttcagtttacacacatgaaacaacacacgtcaacgaccgtgcgatttacttaggtggctttggacaccgtgaaggtactgatgctgaagcatatgctcagggtatgctacaaactcctgttactggtagtggatttgatgagtttggttctttaggtattaatatggtatttaaacgcaaaaatgatgggaatcagtggtatattacagatccaaaaactctaaaaacacgagaagatattaatagatatatgaagggttataatgacactttaactcttcttgatgaaattgaggctgaatctgtgatttctcaacaaaataaagatttaaatagtgcatggttcaaaaaaatagatagagaataccgtgataacaataaattaaatcaatgggataaaattcgaaatctaagtcaagaagagaaaaatgaattaaatattcaatctgttaatgatttagttgatcaacaattaatgactaatcgcaatccaggtaatggtatctataaacccgaagcaattagctataacgatcaatcaccttatgtaggtgttagaatgatgaccggtatctacggaggtaatactagtaaaggtgctcctggagctgtttcattcaaacataatgcttttagattatggggttactacggatacgaaaatgggttcttaggttatgcttcaaataaatataaacaacaatctaaaacagatggtgagtctgttctaagtgatgaatatattatcaagaaaatatctaacaatacatttaatactattgaagaatttaaaaaagcttacttcaaagaagttaaagataaagcaacgaaaggattaacaacattcgaagtaaatggttcttccgtttcatcatacgatgatttactgacattgtttaaagaagctgttaaaaaagatgccgaaactcttaaacaagaagcaaacggtaataaaacagtatctatgaataatacagttaaattaaaagaagctgtttataagaaacttcttcaacaaacagatagctttaaaacttcaatctttaaataa

SEQ ID NO: 2281 - DNA (genomic), 1416 bp, Streptococcus pneumoniae; double-stranded, circular
  misc_feature (B) LOCATION 1...1416
  hypothetical: NO
  anti-sense: NO
gagaaggagatgagttcaggtaaaattgctcaggttatcggtcccgttgtagacgttttgtttgcagcaggggaaaaacttcctgagattaataatgcacttgtcgtctacaaaaatgacgaaagaaaaacaaaaatcgtccttgaagtagccttggagttaggagatggtatggttcgtactatcgccatggaatcaacagatgggttgactcgtggaatggaagtattggacacaggtcgtccaatctctgtaccagtaggtaaagaaactttgggacgtgtcttcaacgttttgggagataccattgacttggaagctccttttacagaagacgcagagcgtcagccaattcataaaaaagctccaacttttgatgagttgtctacctcttctgaaatccttgaaacagggatcaaggttattgaccttcttgccccttaccttaaaggtggtaaagttggacttttcggtggtgccggagttggtaaaactgtcttaatccaagaattgattcacaacattgcccaagagcacggtggtatttcagtatttgctggtgttggggaacgtactcgtgaggggaatgacctttactgggaaatgaaagaatcaggcgttatcgagaaaacagccatggtctttggtcagatgaatgagccaccaggagcacgtatgcgtgttgcccttactggtttgacaatcgctgaatacttccgtgatgtggaaggccaagacgtgcttctctttatcgataatatcttccgtttcactcaggctggttcagaagtatctgcccttttgggtcgtatgccatcagccgttggttaccaaccaacacttgctacggaaatgggtcaattgcaagaacgtatcacatcaaccaagaagggttctgtaacctctatccaggctatctatgtgccagcggatgactatactgacccagcgccagcaacagccttcgctcacttagattcaacaacaaacttggaacgtaagttggtacaattgggtatctacccagccgttgacccacttgcttcaagctcacgtgccttggcacctgaaatcgttggagaagagcactatgcagttgctgctgaagtaaaacgtgttcttcaacgttaccatgaattgcaagatatcattgctatccttggtatggatgagctttctgatgaagaaaagaccttggttgctcgcgcccgtcgtatccagttcttcttgtcacaaaacttcaacgttgcggaacaatttactggtcagccaggttcttatgttccagttgctgaaactgtacgtggctttaaggaaatccttgatggtaaatacgaccacttgccagaagatgccttccgtggtgtaggttctatcgaagatgtgattgcaaaagctgaaaaaatgggattttaa

SEQ ID NO: 2282 - DNA (genomic), 858 bp, Streptococcus pneumoniae; double-stranded, circular
  misc_feature (B) LOCATION 1...858
  hypothetical: NO
  anti-sense: NO
aacgaggagatggatatgacgaaaatagctcttctttcagatattcatggaaataccaccgccttggaggctgttttggcagatgctcagcagctaggagtggatgaatactggcttttgggagatattctcatgccagggacaggacgtaggaggattttggacttgttggatcaactaccgattacggctagagttttgggaaactgggaagacagtctttggcatggtgtccgtaaggaattggacagtactcgccccagtcaacgctatctcttgcgccagtgccagtatgttttagaggaaatttccctagaagaaattgaagtgctccacaatcaacctcttcaaattcatcgtcagtttggggatttgacggtgggaattagccatcatctgcctgataagaactgggggcgagagttgattcatactggcaaacaagaggagtttgaccgcttggtgactcatcctccctgtgatattgctgtttatggacatattcaccagcagttgcttcgttacgggactggtgggcaattgattgtcaatccgggttcgattggccaacctttctttttggacgctcagctacggaaggacttgcgggcccagtatatgattttggagtttgatgacaaaggcctggtagatatggacttccgacgggtagactacgatgtggcagcggaattgcagctggctaaagacctgagacttccctattttgaggtttactatgaaagtctggtcaatgggatccaccatactcatcatcaggaatttttgagagaattggctcagaaagagggctgcgaccgggagttagacgactggttgaaaagtggtaacgattga

SEQ ID NO: 2283 - DNA (genomic), 462 bp, Streptococcus pneumoniae; double-stranded, circular
  misc_feature (B) LOCATION 1...462
  hypothetical: NO
  anti-sense: NO
aagggggagattatgggtaaaccgatgttagtctttaagcgttttggtcatcaaattcacctgatggtgcaaaaggaagccaaacgttgcggcattgaatttatgggtgggccgcaaggtcaggttgtgcattttttggataatcgcgagaaaaaccaagacttggtcttgattaaagatatcgatcaggaactcaatattaccaagtctgttgctagtaatctggttaagcgtatagtgcaaaattgtttggtggaattggaggcgagtcctgttgataagcgggctaagtttgttcgtctgacggacaaagcacgttctcagatgcaacaggttaaggctttttttgaacgcatagacaagcagttgatggaagatattgatgaagatgaattactgatttttgagaaggttctcggtcaactacaggcaaaatatcaagggaataggaggagagaataa

SEQ ID NO: 2284 - DNA (genomic), 981 bp, Streptococcus pneumoniae; double-stranded, circular
  misc_feature (B) LOCATION 1...981
  hypothetical: NO
  anti-sense: NO
gacttatggataatcctaaactcagaggaaacctgtcattattggaagcgacctcggcaaacaggtggacggggagtcgtttctacctgtagttatgaggcaagagcttttggtgtccattctgccatgagttccaaggaagcttatgaacgttgtccccaggctgtctttatctcagggaattatgagaaatacaagtctgtgggactccggattcgagctatttttaagcgctatacagatttgattgaacccatgagcattgacgaagcctatttggatgtgacagaaaataaactcggtatcaagtcagcggtcaaaattgctcgcctcattcaaaaagatatctggaaagaactccatctaactgcttccgcaggcgtttcttacaacaaattcttagctaaaatggcgagtgattatcaaaaaccacatggtttgacagtgattctacctgaacaggctgaggattttctcaaacaaatggatatttccaaatttcatggagtaggaaaaaagacagtagaacgtcttcatcaaatgggcgtttttactggtgctgatttacttgaagttcctgaggtaaccctaatagaccgttttggtagactaggctatgatctgtatcgaaaggctcgtggcattcacaactctccagtcaaatccaatcgcatccgtaaatcaatcggcaaggagaaaacctacgggaagattctccgtgccgaggaagatatcaaaaaagagctgactcttctatcagaaaaagtcgctctcaatctacatcaacaagaaaaagctggaaaaattgtcattttgaaaatccgctacgaagacttttcaactcttaccaaacgaaaaagtcttgctcaaaaaacacaagatgctagtcagataagccaaatagccctgcaactctatgaagaattaagcgagaaagaaagaggtgtccgcctattggggattaccctgactggattttaa

SEQ ID NO: 2285 - DNA (genomic), 222 bp, Streptococcus pneumoniae; double-stranded, circular
  misc_feature (B) LOCATION 1...222
  hypothetical: NO
  anti-sense: NO
cgcaaatggatctggcctccacaagctgggcaggtgtatgcttgcttctcaagtttatcctctaacacatttaccaattctcccctagtatctctcgcaacaaacatgaattccctccttttctatatcattcgtaaaaaagaaaaaagatcaggaaaattcctaatcttcatgtgtgtttacttgattttcttagctagtaaggtcgcaaagcgtagttga

SEQ ID NO: 2286 - DNA (genomic), 357 bp, Streptococcus pneumoniae; double-stranded, circular
  misc_feature (B) LOCATION 1...357
  hypothetical: NO
  anti-sense: NO
acgccgtggatacggctccgctcgtgtcgtccgacacccctgccccccttccgccgctgcgcgcgcagcagatcgccttcgaacaggccctgcccgcgcaccgaccgccggcgcccaggccaccgttcgacaagggcgacgaaacgacagaggccgaagagcccgccgcgaacagcgacgcgccgacctcgacgcctctcgccgaccagcccgcggcgcctgccgccgaccggccgccgaccaatnggcaagcccccgtgccagttgccgcggaagcaacgccaacgccaacgccaacgccaacgccaacgccaacgccaacgccaacgccaacagtgttgccgtccggatcggtag

SEQ ID NO: 2287 - DNA (genomic), 360 bp, Streptococcus pneumoniae; double-stranded, circular
  misc_feature (B) LOCATION 1...360
  hypothetical: NO
  anti-sense: NO
agaacgtggatatcaacggctggttggttgtctgctgctgttgagaagacttgtgatttagatgttgggattgtagtgttgcgatcgataagttttgtaaatactccacccattgtttcgataccaagtgacaatggcgttacatcaagaaggacaacatccttgacatcaccagtaatcacaccaccttggatagccgcacccatagcaactacttcatcagggtttactgatttgtttggttctttaccagtttcagctttaacagcttcaacaacggcagggatacgagttgaaccaccaacaaggataacttcgtcgatttctgacaagctcaaacctgcatctgaaagggcttga

SEQ ID NO: 2288 - DNA (genomic), 282 bp, Streptococcus pneumoniae; double-stranded, circular
  misc_feature (B) LOCATION 1...282
  hypothetical: NO
  anti-sense: NO
ctcgagtggatatccacatcagcgctttttaccttggcatcaaaggtcacaatccccttattgccaccagaaatttccagttgttccaaggcatttttggtcccttgttcccagaccaacaaatccgccccatggagtttgtctgcatgcttttccaaatacttatctaggtctgttgaagccgattcctccgctccctccatgataaagctgatattgacaggtaaatcatcatggtgctgcatatattttctcaaagcactcaagcgagctgtgatatga

SEQ ID NO: 2289 - DNA (genomic), 879 bp, Streptococcus pneumoniae; double-stranded, circular
  misc_feature (B) LOCATION 1...879
  hypothetical: NO
  anti-sense: NO
agatggtggatacggatattgaggatattatccgtcgcttctaccgaaaggagctctaggatgatcaaattgtggagacgttataaaccctttatcaatgcaggggttcaggagttgattacttaccgagtcaactttattctctatcggattggcgatgtcatgggggcttttgtggccttttatctctggaaggctgtctttgattcttcgcaagagtctttgattcagggcttcagtatggcggatatcaccctctacatcatcatgagttttgtgaccaatcttctgactagatccgattcgtcctttatgattggggaggaggtcaaggatggctccattatcatgcgtttgttgcgaccagtgcattttgcggcctcctatcttttcaccgagcttggttccaagtggttgatttttatcagcgttggccttccatttttaagtgtcattgtcttgatgaaaatcatatcgggtcaaggtattgtagaggtgctaggattaactgtcctttatctttttagcttaacgctcgcctatctgattaactttttctttaatatttgctttggattttcagcctttgtgtttaaaaatctttggggttccaacctacttaagacttccatagtggcttttatgtcggggagtttgattcccttggcattctttccaaaggttgtttcagatattctttcctttttgcctttttcatccttgatttatactccagttatgatcattgttggaaaatacgatgccagtcagattcttcaggcactccttttgcagttcttctggctcttagtgatggtgggattgtctcagttgatttggaaacgggtccagtcctttatcaccattcaaggaggttag

SEQ ID NO: 2290 - DNA (genomic), 201 bp, Streptococcus pneumoniae; double-stranded, circular
  misc_feature (B) LOCATION 1...201
  hypothetical: NO
  anti-sense: NO
gcttgtcggattgcccaactgcgctccactaattcttgcaactccataattagtatcctaataaaaaaatgcgacatcctcgaaaggacgtcgcaacgtggttccaccttcatttatgtacctcaaaagagagggacacctctgatcggctctaacgtggccaccgttttatgttttcataaaaaactcaagagtagtatc

SEQ ID NO: 2291 - DNA (genomic), 213 bp, Streptococcus pneumoniae; double-stranded, circular
  misc_feature (B) LOCATION 1...213
  hypothetical: NO
  anti-sense: NO
aaaactaggattttatactcaatgaaaatcaaagagcaaactaggaagctagccgcaggttgctcaaaacactgttttgaggttgtggatagaactgacgaagtcagctcaaaacatggttttgaggttgtagatgaaactgacgaagtcagtaaccatacctatggcaaggtgaagctgacgtggtttgaagatattttagaagagtattaa

SEQ ID NO: 2292 - DNA (genomic), 1041 bp, Streptococcus pneumoniae; double-stranded, circular
  misc_feature (B) LOCATION 1...1041
  hypothetical: NO
  anti-sense: NO
tgttggaggatatataaaatgaagctttttaaaaaaatgatgcaagtcgtactagccacatttttcttcggtttgctagggactagtacagtatgtgcagatgattctgaaggatggcagtttgtccaaaaaaatggtagaacctactacaaaaagggggatctaaaagaaacctactggagagtgatagatgggaaatactattattttgatcctttatccggagagatggttgtcggctggcaatatatacctgctccacacaagggggttacgattggtccttctccaagacaagagattgcttttagaccagattggttttactttggtcaagatggggtactacaagaatttgttggcaagcaagtgttagaagcaaaaactgctacaaataccaacaaacatcatggggaagaatatgatagcccagcagagaaacgagtctattattttgaagatcagcgtagttatcatactttaaaaactggttgggtttatgatgatggggactggtattatttgcagaaggatggtggctttgattctcgcatcaacagattgacggttggagagctagcacgtggttgggttaaggattaccctcttacctatgatgaagagaagctcaaacctgctccatggtactacctagatccagcaactggcatcatgcaaacaggttggcaacatcttggtaataaatggtactatctccgttcatcaggagctatggcaactggctggtatcaagatggttcaacttggtactatttagatgctgaaaatggcgatatgaaaactggttggcaaaaccttgggaacaaatggtactatctccgttcatcaggagctatggcaactggttggtatcaggaaggttcgacttggtactatctaaatgcaagtaatggagatatgaaaacaggctggttccaagtcaatggtaactggtactatgcctatgattcaggtgctttagctgttaataccacagtaggtggttactacttaaactataatggtgaatgggttaagtaa

SEQ ID NO: 2293 - DNA (genomic), 657 bp, Streptococcus pneumoniae; double-stranded, circular
  misc_feature (B) LOCATION 1...657
  hypothetical: NO
  anti-sense: NO
aaagaagggatgacaagtatgagaaaaaaaacaattggagaggttttacgattagatagaatcaatcagggattgagtttagatgaattgcagaaaaagacagaaatccagttagatatgttggaagcaatggaagcagacgatttcgatcaacttccaagtcctttttacacgcgttctttcttgaaaaaatatgcatgggctgttgagttagatgaccaaattgttttggatgcttatgattctgggagtatgattacttatgaggaagtagatgttgatgaagatgagttgacaggtcgtagacgttcaaataagaaaaagaagaaaaaaacatcatttttacctttattttattttatcctttttgctttatcgattttaatttttgtgacttattatgtttggaactatattcaaactcaaccagaggagccttctctttctaattacagtgtggttcaatcaacaagttcaactagctctgttccccactcctcaagtagtagttcttctagtatagaatcagctataagtgtatcaggcgaaggaaatcatgtagaaatcgcttataagacaagtaaggaaacagttaaattgcaattggcagtttcagatgttagcaagttgggtcagtgtttcagaaagcgaacttga

SEQ ID NO: 2294 - DNA (genomic), 741 bp, Streptococcus pneumoniae; double-stranded, circular
  misc_feature (B) LOCATION 1...741
  hypothetical: NO
  anti-sense: NO
agtagagggataatggaactatttaaaacatggaagaaaaatatggttctctatggtcttaaatctcaaattggaactgtctaccgaaacaatgataggacaacaagcttttatgatgttgggaattttctatacctagcaggggagttggattccagattttgggaagattttgttagaaaatatggtttagattataagattattatttcagaaaatactaattggcaagattttctgcatcgaaaagtggggctaaattcttttactcgctattcttttaaagataaggcaaattttcaagttgaatttttaaataatctagttactcatttagaggaaggttacaatattgtgcctattgataatcatatttataactgcttttctacggaagaatggtcacaggatttacagggggattttgagtcctatcaggattttgttttaaaaggtggatttggctttgtgattcttaaaaataatgaactgattgctgggatttcctcagggttagtttaccgtaaagcagttgaagtggaagttgcaactagaccaaacgaacaaggaaatggatttgctaaaaagcttggtgctgcaatgattctagagagtttaaatagagatatgtttccactttgggatgctcataatgaggcttccaaaaaagtagcagaatttttaggatatgagttatctgaaccttatgaagcttttgaactagaggaaattttgatataa

SEQ ID NO: 2295 - DNA (genomic), 1452 bp, Streptococcus pneumoniae; double-stranded, circular
  misc_feature (B) LOCATION 1...1452
  hypothetical: NO
  anti-sense: NO
aacgtggggattataataaagttaatcaaggacgaagagagaagaaaaatggaagcggttttagcaatagatttaggtgcgacttctggaagagcaatcgttggttacctttctgaaaataaactagtaatggaagaaataaatcgcttttctaatctacctattagagtaaaagggcatttatcttgggatattgactttctactagctaaaattcttgaaagtatccgcttggctaatactagttacaagattttatctatcggtattgacacatggggagttgattttggactgattgataatgaaggtaagctgttattacaacctgttcattatcgtgatgaaagaacaaagggagtgttaaaggaaatatctgaaatgactgaattagaaaaactgtattcagagacaggaaatcagattatggagataaataccttgtttcaactctttaaggcacgtcaagaatctcctgactctttctataagaccaataagattcttttaatgccagatttgtttaattatctcttgacaggtaagtttgctacagaaaaaagcattgcttcaacaactcaattatttgatcctaggagtcaaaattggaatcagaatatcttaaaactatttgaattggattcatctttacttcctgaaattgtttcagagggaaatgttcttggaaggataaaagaggagtatggtttaggcgatattcctgttgtgaatgtttgtagtcatgatacagcaagcgcgattgtctcagtacctaagacagaaggtagtttatttatttcatcaggtacttggtctttggttggagtggaacttacttcaccgattcttactaccgaatccttcagttatggatttacaaatgaagtcggtaaagatggagtgattacatttctgaagaattgtacagggttgtggatcatagaggaactaagacgttcatttgaacgaagagggaaagcctattcttttgatgatattaggacaatggtggagaaagaaaaagaaaatcttcctctgattgatactgaatcaactgaatttgcaacagaatctgatatgcacaagactttgacagaatatctagcttatcatcatgaaactagagagtggacagatggacaactatttaagattgtttatgaaagcctagctgaaacgtataggaaagcgatagagttactagaagaactaactcataaggtttataagaggatatatgtgattggaggaggtgctagagccagttactttaaccaaatgattgctgatagaactggtaaagaggttcttacaggttcgactgagggtacagctgtggggaatattgttgtgcagctattgagtcaaggtaaaataaacgaggatacagagttaaaggatattatgacaaatattgctgatacacaatattattatcctcagctatcataa

SEQ ID NO: 2296 - DNA (genomic), 198 bp, Streptococcus pneumoniae; double-stranded, circular
  misc_feature (B) LOCATION 1...198
  hypothetical: NO
  anti-sense: NO
gaaaaggggataaagattntgcgcggaagaaagcgacgaaggaatcttgactatgtacttgtccaagcggaagcaaccgccattgtaagatgcgtggggagcgggatttcgaaggagttcccaaaaaagcgggaagttattcgaccgcaacccgcgaaggggagttacgcaagggccgataaaacatcctgggggtag

SEQ ID NO: 2297 - DNA (genomic), 753 bp, Streptococcus pneumoniae; double-stranded, circular
  misc_feature (B) LOCATION 1...753
  hypothetical: NO
  anti-sense: NO
atgaaagttttaattttagaagatgttattgaacatcaagtgagactagagagaatattggatgaaatttcgaaagaatcgaatattccaatatcatacaagacaacgggaaaagtccgtgaatttgaagaatacattgaaaatgatgaagtaaatcaactttatttcctagatatcgatattcatggaattgagaaaaagggatttgaagtggctcagctcattcgtcattacaatccttacgctattatcgtctttatcactagtcgatcagagtttgcgactctaacctataaataccaggtatcagccctagattttgttgataaggatatcaatgatgagatgtttaagaagagaattgagcaaaatatcttctacacgaagagtatgttacttgaaaatgaagatgttgtagattatttcgactacaattacaagggaaatgatttaaaaattccttaccatgatattttgtatattgaaacaacaggggtatctcataaattgcgcattattggtaagaattttgcaaaagagttttatggtaccatgacagatattcaggaaaaggacaaacatactcagcgattttattctcctcacaagtcatttttggtaaatataggcaatatcagagaaattgatcgaaaaaacttagaaattgttttctatgaagaccatcgttgtcctatttcaagattaaaaattagaaaattaaaagatattttagagaaaaaatctcaaaagtga

SEQ ID NO: 2298 - DNA (genomic), 1095 bp, Streptococcus pneumoniae; double-stranded, circular
  misc_feature (B) LOCATION 1...1095
  hypothetical: NO
  anti-sense: NO
tatacttacttatggagaaaatacatgaaacgtgagattttactggaacgaatcgacaaactaaaacaactcatgccctggtatgttctggaatactaccaatctaagctggctgtgccctacagttttacaaccctgtacgaataccttaaggaatatgaccgatttttcagctgggttttggagtctggtatttcaaacgctgataaaatatccgatattcctttatcagttttggaaaatatgtctaagaaagacatggaatcctttatcctttatctacgtgaacgtcccttgctgaatgctaatacaacaaaacaaggtgtttcacagacaactatcaatcgaaccttatcagcactttctagtctttacaagtatctaaccgaggaggttgaaaacgatcagggggaaccttatttctatcgtaatgtaatgaaaaaagtttcaaccaagaaaaagaaagaaacccttgctgccagagctgaaaatatcaagcaaaaactctttctaggtgatgaaacagaaggttttctaacttatatcgatcaagagcacccacaacagctttcaaatcgagctctctcatcattcaacaaaaataaagaacgagatttagccattattgcccttctcttggcatctggtgttcgcttatctgaagctgttaatctagatctaagagatctcaatctaaaaatgatggttattaatgttactcgaaaaggtggcaaacgtgactcagtcaatgtcgctgcttttgctaaaccttatttagagaattatctggccattcggaatcaacgctataaaacggaaaaaacagatacagccctttttttaactctctacagaggtgttcctaatcgtatcgatgcttctagcgttgagaaaatggttgctaaatactcagaggattttaaagtacgtgtaacaccccataaactgcgccatacgctagcaactaggctctatgatgcgactaaatcacaagttttagtcagtcaccaactaggacatgccagcacacaagtcactgacctctatacccatattgttaatgatgaacaaaagaatgctctagatagtttatga

SEQ ID NO: 2299 - DNA (genomic), 1206 bp, Streptococcus pneumoniae; double-stranded, circular
  misc_feature (B) LOCATION 1...1206
  hypothetical: NO
  anti-sense: NO
aatgattacttgtcatttcagagcatttttgttaatcgcataagttttcttttgtatgccttgagtagtcccctattcaaggtatatttttttggaggtagtgagatgagcgattcaaaatatatgaaattagcaataaaactggcacaaaaaggggctggttacgtcaatcccaatcctatggttggcgcaattattgtaaaagataatcacattatcggacaaggttatcatgagttttttggtggcccacatgctgagagaaatgctcttaaaaactgtagaaaatcccctgtcggagcgacgctttatgtaacacttgaaccctgttgtcacttcgggaaaacacctccctgtatagatgctataatcgatagtggtattacaagagtagtcattggaagcctagactgtaatcctattgtatctggaaaaggagtaaagatacttgaggaaaataatcttcaagttactgttggaattttagaaaatgagtgtcttaacttaataaaaagttttagaaagtatattacccagcatgtaccctatgtttttatgaaatatgcaatgtcaatggatggaaaaatagccactaaaacaaatcaatccaaatggattactgaagaagaagcaagaaagcatgtgcatcagttacgacaccatgttagtgcaattatggtgggagtcaatactgttattcaagacgatcctttgctgacatgtagattggaggaagggaaaaatcctatccgtatcatatgcgatacacatttacgaactcctcttacctctaaaatcgtaaaaacagcaaatgatattaaaacttacattgccacttcctctgaagacaaaaataaaatgaagctatatcaaaatcatggctgtgaaatactttccataaagaaaaaaggcaatcatatagacttatcgagtttaatgcaacatctaggaaacatgcagattgatagcctagttctagaagggggcagtctaatgaattggagtgctttggaacaacaaattgttgatgagctgaaaatatatattgcaccaaaaatttttggaggcagtgccaagtttcctgtcggaggtgaaggcatttctttgccaaatgacgctattagattgaaaccttatgctttttctcaaataggaaatgactatctcatagaaagtgaagtgatttatccatgttcacaggaataa

SEQ ID NO: 2300 - DNA (genomic), 405 bp, Streptococcus pneumoniae; double-stranded, circular
  misc_feature (B) LOCATION 1...405
  hypothetical: NO
  anti-sense: NO
tggagttacttaaaaaaagatgtcaagcagccgttagctgttaatcagctacaattgagtgcggcttttactccaggatttgaatcagcttttcatgttaatatggaagatagtcaagcagctatgcgagatggcagcatttttgaatattgcaaattacacgatgtggtcattcaagcatggtctgtcttacaattcgggtattttaaagggaattttgttggaaatgagaaatttcaagctttaaatcaagtacttgatcgtttagctattaaatatggagtaacctcttcaactattgccatttcttggatattgcgttatccagcaaaaatgcaggcagttgtaggtaccacaaatcctaagcacttgagagaagttagccaagcgcaaactttagcttaa

SEQ ID NO: 2301 - DNA (genomic), 264 bp, Streptococcus pneumoniae; double-stranded, circular
  misc_feature (B) LOCATION 1...264
  hypothetical: NO
  anti-sense: NO
attttctacttcttctgccaaggattgtctgattccttcttcatggatttgttccaagagttgatttgccttgctcaaaagactttctacttcttccttgctatctgtcgcagattattggttgctatctaccatgtactcctaaaacaggagagttataatccaagattacaaggccttacagaaataagaaatccagataagacaatgttcgtccaagacgctattcgcttcgcacaacagcacggattcaatatgctttaa

SEQ ID NO: 2302 - DNA (genomic), 822 bp, Streptococcus pneumoniae; double-stranded, circular
  misc_feature (B) LOCATION 1...822
  hypothetical: NO
  anti-sense: NO
gttcaatacttcattgataaaggtgttcaaggtctttatgtcaatggttcttctggtgaatgtatctaccaaagcgttgaagatcgcaagttgattttggaagaagtcatggcggtagccaaaggtaaattgaccattattgcccatgttgcttgcaataatactaaagatagtatggaacttgctcgccatgctgaaagcttgggagtagatgctattgcaacgattccaccaatttacttccgcttgccagaatactcagttgccaaatactggaacgatatcagttctgcagctccaaacacagactacgtgatttacaacattcctcaattggcaggggttgctttgactccaagcctttacacagaaatgttgaaaaatcctcgtgttatcggtgttaagaactcttctatgccagttcaagatatccaaacctttgtcagccttggtggggaagaccatatcgtctttaatggtcctgatgagcagtttctaggaggacgcctcatgggtgctagggctggtatcggtggtacttatggtgctatgccagaactcttcttgaaactcaatcagttgattgcggataaggacctagaaacagcgcgtgaattgcagtatgctatcaacgcaatcattggtaaactcacttctgttcatggaaatatgtacggtgtcatcaaagaagttttgaaaatcaatgaaggcttgactattggatctgttcgttcaccattgacaccagtgactgaagaagatcgtccagttgtagaagaagctgctgccttgattcgtgaaaccaaggagcgcttcctctaa

SEQ ID NO: 2303 - DNA (genomic), 1443 bp, Streptococcus pneumoniae; double-stranded, circular
  misc_feature (B) LOCATION 1...1443
  hypothetical: NO
  anti-sense: NO
attcgatacttcagtagacgaatacggttcttatggaagttatgggaaaaagaaaaaataggttgggggatagagatgaatggaaaactagtaaagccttcattggccatagtccagagttttcttgttattttattggcttatctacttagcactgtgagagaaacagagattgtttcaacaacagctattgtactttatatcctccactattttgccttttatatcagtgattatggacaggatttctttaaaaggggatatttgattgaacttgtccagacattgaaatatatcctattctttgcgctagcgattagtatttctaattttttcttagaagatcgatttagtatttccagaagaggcatgatttacttcctcctattacatgttctcttagtctatgtgctaaaccgatttatcaagtggtattggaagcgggcttatcccaactttaaaggaagtaagaagattctcctacttacagcaacttctcgtgtcgaaaaggtattggatagactaatagaatcagatgatgttgttggggagttggtagccgtcagtgttttagataaaccagattttcagcatgattatttaaaggttgtagcagagggggagatcgtaaactttgcgactcatgaggtggtcgatgaagtctttatcaatcttccaagtgaaaaatacaatattggagagcttgtctctcagtttgaaacgatgggagttgatgtaacagtcaatctaaatgctttcgattgtatcttggcacataacaagcaaatttgtgagatggcaggactaaacgttgtgactttttctacaacattttataagactagccatgtgattgctaagcgggttattgatattatcggttccctggtaggtttgatactatgtggtctagtcagtattgtactggttcctttgattcgaaaggatgggggctctgctatttttgctcagacgcgtattgggaaaaatggtcgccatttcactttttacaagtttcgctctatgtgtgtggatgctgaggagaaaaaaagagaactcatggaacaaaataccatgcagggtggaatgtttaaggtggatgaggatccacgtatcacgaaaattggtcattttatacggaagacgagcttggacgagctaccacagttttacaatgttctaaagggagatatgagtttggtagggacacgaccaccaacagtggacgagtatgagcactataccccagaacaaaaacgtcgcctaagttttaaacctggcataacaggtctatggcaggtcagcggacgaagcgagatcaagaatttcgatgaggttgtcaaattagatgtggcctatatagacggttggacaatttggaaagatattgaaattttattgaagacagttaaagttgtattgatgaaggatggagcgaagtag

SEQ ID NO: 2304 - DNA (genomic), 216 bp, Streptococcus pneumoniae; double-stranded, circular
  misc_feature (B) LOCATION 1...216
  hypothetical: NO
  anti-sense: NO
agaatgtacttcgtcatcgcagagttcaatgctaattggtttacacatcggaactccaagagaagctactttctccatcatatcaaattcaaatttttttataatctaacttcgacttatcagaaacacgcaagaaatatttttactgattttgatctgtcacacaatattttttatcatctgaccagcctttatttatggctatcttactactaa

SEQ ID NO: 2305 - DNA (genomic), 213 bp, Streptococcus pneumoniae; double-stranded, circular
  misc_feature (B) LOCATION 1...213
  hypothetical: NO
  anti-sense: NO
gaaacacactttatatctttgttttttgtgactactgtcgatggcaacttgcgaggttacccaacgacaaaagttaaaatttgtaaagcgagcaaagatttcttggagaatccctcccttctttttggcgtgaaaattgaccaagccaatactgtatttcaggtcacgaaaactagtctctatgccccatctactggcgtagagattttttaa

SEQ ID NO: 2306 - DNA (genomic), 213 bp, Streptococcus pneumoniae; double-stranded, circular; identical to SEQ ID NO: 2305
  misc_feature (B) LOCATION 1...213
  hypothetical: NO
  anti-sense: NO

SEQ ID NO: 2307 - DNA (genomic), 213 bp, Streptococcus pneumoniae; double-stranded, circular; identical to SEQ ID NO: 2305
  misc_feature (B) LOCATION 1...213
  hypothetical: NO
  anti-sense: NO

SEQ ID NO: 2308 - DNA (genomic), 909 bp, Streptococcus pneumoniae; double-stranded, circular
  misc_feature (B) LOCATION 1...909
  hypothetical: NO
  anti-sense: NO
cagacgcacttaaagggcaaggactctaagatgcagggacaaatcattaaagccttggctgggttctactatgtagagagtgatggccaagtctatcaaacacgcgcgcgtgggaatttccgtaaaaaagggcataccccttacgttggggactgggtagatttctctgccgaggaaaattcagaaggctatattctcaagattcacgaacggaaaaacagtctggtccgtccgcctattgtcaatatcgaccaagctgtagtaatcatgtccgtcaaggaacctgattttaacagcaatttgctggatcgtttcttggttcttttggagcacaagggcatccatcccattgtctatatttccaaaatggatttgttggaagataggggagaactggatttttaccagcagacctatggtgacatcggctatgactttgtgaccagtaaagaggaactcctgtctttgttaacaggcaaggttacggtctttatggggcagacaggtgttgggaagtcaactcttctcaataaaatcgcaccagacctcaatcttgaaacgggagaaatttcagacagtctaggtcgcggtcgccataccactcgagctgttagtttttacaatctcaacgggggtaaaatcgcagatacaccaggattttcatccttggactatgaagtatcaagggctgaagacctcaatcaggctttcccagagattgctactgttagccgagattgtaagttccgtacttgtacccatacccatgagccgtcttgtgccgtcaaaccagctgttgaagagggtgttattgcaaccttccgttttgacaattacctgcaattccttagtgaaattgaaaatcgtagagaaacctataaaaaagtcagcaaaaaaattccaaaataa

SEQ ID NO: 2309 - DNA (genomic), 210 bp, Streptococcus pneumoniae; double-stranded, circular
  misc_feature (B) LOCATION 1...210
  hypothetical: NO
  anti-sense: NO
aagtataacttatactctttgaaaatctcttcaaaccacgtcagcttcgccttgctgtatatatggttactgacttcgtcagttctatccacaacctcaaaacagtgttttgagctgacttcgtcagttctatccacaacctcaaaacagtgttttgagctgactgcggctagctttctagtttgctctttgatttttattgagtattag

SEQ ID NO: 2310 - DNA (genomic), 828 bp, Streptococcus pneumoniae; double-stranded, circular
  misc_feature (B) LOCATION 1...828
  hypothetical: NO
  anti-sense: NO
ccaagtaactttttggaggaaatgatgaaacttttatttattttgatttcaatggtattagtatcgctttatatggtgataacttccgttgaccatcgagaagagattttatttggtaactatccttctgttgatgtgacaggaatgatgataaatcaaccagtagctagtcgcgaagaggtgacagaggctttgagtcacttggcggtagagcacaatagtctcattgctcgtcgaatcgttgagccaaatgaagctggagaaacacgctttacctatgccacttatggtgagggaaagcttccagaaggtctgaccatttcctccaaggagagtgcagaaacgagtgatttattagggtcttacttgattgtatcaggaagtttggatggagtgagcttacagaccaccttgaaagagcttggttatcaaggctttgtttcgaatggagaagatccattttcgatagtcttactattgacggccacccctatggtgctactgagtttagctatttttctgctgacctttatgagtctgaccctgatttatcggatcaaatcccttcgtcaggcagggattcgcttaatanctggtgagagcttgtttggagttgctctcagaccagtgttagaagatgtgagacagcttatctgctcagtgctggtatccagtcttttgggattggggattctctggtatcaaggtgccttgtttatggcaacggtgcaactggtcatcattgctcttctactttatggattgcaccttggcagggatttctaccttactaagtgtcgtctatctacttggtttacaggaaaatag

SEQ ID NO: 2311 - DNA (genomic), 633 bp, Streptococcus pneumoniae; double-stranded, circular
  misc_feature (B) LOCATION 1...633
  hypothetical: NO
  anti-sense: NO
ttttccaacttttgtggtgatnanggccccatcgtgagtgatgacgtctatttcgcgagtactctcaggcgtggagtacctgcagcagaagcaggtatggaccgtgttcaggcagattacactggaatgcttgggactgttatgaatgctcttgtgatggcagattcattgcaacaagttggggttgatacgcgtgtacaaacagctattgctatgcaacaagtggcagagccttatgtccgtggacgtgcccttcgtcaccttgaaaaaggccgtatcgttatctttggtgctggaattggttcaccatacttctcgacagatacaacagcggcccttcgtgcagctgaaatcgaagcagatgccatcctcatggctaaaaatggcgtcgatggtgtgtacaatgccgatcctaagaaggacaagacagccgttaagtttgaagaattgacccaccgtgatgttatcaacaaaggtcttcgtatcatggactcaacagcctcaaccctctcaatggacaacgacattgacttggttgtcttcaacatgaaccaatcaggcaacatcaaacgtgttgtatttggtgaaaatatcggaacaacagtttcaaataatatcgaagaaaaggaataa

SEQ ID NO: 2312 - DNA (genomic), 660 bp, Streptococcus pneumoniae; double-stranded, circular
  misc_feature (B) LOCATION 1...660
  hypothetical: NO
  anti-sense: NO
atgaaaaactttacaaatattaagttcaaagagaatggggaatttaatcatttccctgggaatacagttgtagcaaatctttatactaaacaagatttgatggaagttgttgatattattcaatcacgttatagagaattaccatttatcgataagtttactttaactccaaggaattctattcacatgactgtaattgaattgttgtgccatgaaaatcgtgaaacggagttttggagcagtaatcttcctctagatacacctttacaggaaatacatgattactttgctaaacaacttgaaatttttccattgttggatgaagaaattcatatgcgtataactgaaatgggaaaacaaaacatactagttgaacctgcagatgaagcttctgcaaagagattagaagaaattcgtacttatgtctcagaaaaagcaggtgtttgtttccctaatcatgatagatatcaattccatatttcaattgggtatcttcggattcctctaaccgaagaggaggaagaagagtttactaaagtcagagcagaattaactgaaattttattagagaagattccaactattactgtaaaccgtattgactatactgtatttgaagatatgagacaatttgttccatatcacgaaaaatttaaataa

SEQ ID NO: 2313 - DNA (genomic), 1011 bp, Streptococcus pneumoniae; double-stranded, circular
  misc_feature (B) LOCATION 1...1011
  hypothetical: NO
  anti-sense: NO
atccactttgttactaacctcatgcgtaactttccagttgtttcagacggaccctttactcctgaagactatgttggccgtatcaactatgaattggctaatgactttgggaacctccttaaccgtacgttttccatgattaataagtactttgatggacaaatccctgcctatgtagaaggtgtgactgaatttgatcatgttcttgctgaggttgcagaacaatcaatcgcagacttccatacacacatggaagcagttgactatccacgtgcgcttgaagcagtctggactctgatctctcgtaccaataaatacatcgatgagaccgcaccatgggtcttggccaaggatgaagctcttcgtgaccaattggcaagtgtcatgagccacttggcagccagcattcgtgtagttgctcacttgattgaaccatttatgatggaaactagtcgtgcagttttgactcaacttggtttggaagaagtttctagtcttgaaaacttgagtttggctgacttcccagcagatgtgactgtagttgccaaaggaacacctatctttccacgtctaaatatggaagaagaaatcgcctatatcaaggaacaaatggaaggcaataaaccagcagtcgaaaaagaatggaatccggacgaagttgagctcaaactaaacaaggatgaaatcaagtttgaagactttgacaaggttgaaatccgtgtggcagaagtcaaagaagtgtctaaagtagaaggttcagataagttgcttcaattctgcttggatgctggtgatggagaagatcgtcagattctttcaggaattgccaaatactatccaaatgaacaagaattggtcggcaagaaagttcaaatcgttgctaacctcaaaccacgtaaaatgatgaaaaaatatgtcagccagggtatgattctctcagctgaacatgatggcaaattaacccttctcacagttgatccagctgtaccaaatggaagtgtgattgggtaa

SEQ ID NO: 2314 - DNA (genomic), 915 bp, Streptococcus pneumoniae; double-stranded, circular
  misc_feature (B) LOCATION 1...915
  hypothetical: NO
  anti-sense: NO
cccaatcttgtaaaagaagggagaaggagaatggttaaagaacgtaatttaactcgctggatatttgttttgccagctatgattatcgtaggattactctttgtttatccgtttttctcgagtattttttatagctttaccaataagcatttgattatgcctaattataaatttgttggtttggctaactataaagctgtgctatcagatcccaacttctttaatgcgttctttaattcaattaagtggaccgttttctcattagttggtcaagttttagtagggtttgtattggctttagctcttcacagagtacgccacttcaagaaattatataggaccttattgattgttccttgggcatttcctaccatcgttattgccttttcttggcagtggattctaaacggggtttatggctacttacctaatctaatcgtaaaattaggtttaatggaacatacacctgcatttttgacagatagtacatgggcattcctatgtttggtgtttatcaacatttggtttggagcaccaatgattatggttaatgtgctttcagctttgcaaacagtaccagaagaacaatttgaggctgctaagatagatggtgcttcaagttggcaggtgttcaagtttatcgtctttccacatattaaagtggttgtaggacttctagttgttttgagaactgtatggatctttaataactttgacattatctacctcattactggtggtggaccagccaatgctacaacgacgcttccaatttttgcttacaacctgggctggggaactaaattgttgggtcgtgcttcagcagttacagtattgctctttatcttcttggtggcgatttgctttatctactttgctatcatcagtaagtgggaaaaggagggtagaaaataa

SEQ ID NO: 2315 - DNA (genomic), 1047 bp, Streptococcus pneumoniae; double-stranded, circular
  misc_feature (B) LOCATION 1...1047
  hypothetical: NO
  anti-sense: NO
aaatcacttgtcaattctgccaaactacttacaactttgatgaaaaggacctggaggaactcattcgtgacaaatcttaatacaccttttatgattggcaatgttgagattcccaatcgtaccgttttagcgcctatggctggcgtgaccaactcagcctttcgtaccatcgcaaaagagctcggagctggactcgttgtaatggaaatggtctctgacaagggaatccaatacaacaacgaaaaaaccctgcacatgcttcatatcgatgagggcgaaaaccctgtctctatccaacttcttggtagcgatgaagacagcctagcacgcgcagcagaattcatccaagaaaataccaagaccgatatcgtcgatatcaacatgggctgccctgtcaacaaaatcgtgaagaacgaagctggtgctatgtggctcaaggatcctgacaagatctactctatcatcaacaaggtccagtctgtccttgatatcccacttactgtcaaaatgcgtaccggctgggcggacccatctcttgcagtagaaaatgccctcgctgctgaggctgcaggtgtttctgccctcgccatgcatggccgtacccgtgaacaaatgtatactggccacgcagaccttgagaccctttacaaggttgcccaagctctaaccaagattccattcatcgccaacggtgatatccgtactgtccaagaagccaagcaacgcatcgaagaagttggtgctgacgcagtcatgattggccgagctgccatgggaaatccttacctcttcaaccaaatcaaccattactttgaaacaggagaaatcctacctgatttgacctttgaagacaagatgaagatcgcctacgaacacttgaaacgattgattaacctcaaaggagaaaacgtcgcagttcgtgaattccgcggcctcgctcctcactatctccggggaacatctggcgctgccaaactccgtggagccatttcgcaagctagcaccctggcagagattgaagccctcttgcaattggaaaaagtataa

SEQ ID NO: 2316 - DNA (genomic), 2013 bp, Streptococcus pneumoniae; double-stranded, circular
  misc_feature (B) LOCATION 1...2013
  hypothetical: NO
  anti-sense: NO
tacccacttgtttaccagtatcgtgaatttaagacaagtattagacatataagaaaaaggaataagatgacagaagaaatcaaaaatctgcaggcacaggattatgatgccagtcaaattcaagttttagagggcttagaggctgttcgtatgcgtccagggatgtacattggatcaacctcaaaagaaggtcttcaccatctagtctgggaaattgttgataactcaattgacgaggccttggcaggatttgccagccatattcaagtttttattgagccagatgattcgattactgttgtggatgatgggcgtggtatcccagtcgatattcaggaaaaaacaggccgtcctgctgttgagaccgtctttacagtccttcacgctggaggaaagttcggcggtggtggatacaaggtttcaggtggtcttcacggggtggggtcgtcagtagttaatgccctttccactcaattagacgttcatgttcacaaaaatggtaagattcattaccaagaataccgtcgtggtcatgttgtcgcagatcttgaaatagttggagatacggataaaacaggaacaactgttcacttcacaccggacccaaaaatcttcactgaaacaacaatctttgattttgataaattaaataaacggattcaagagttggcctttctaaatcgcggtcttcaaatttcaattacagataagcgccaaggtttggaacaaaccaagcattatcattatgaaggtgggattgctagttacgttgaatatatcaacgagaacaaggatgtaatctttgatacaccaatctatacagacggtgagatggatgatatcacagttgaggtagccatgcagtacacaactggttaccatgaaaatgtcatgagtttcgccaataatattcatacacatgaaggtggaacgcatgaacaaggtttccgtacagccttgacacgtgttatcaatgattatgctcgtaaaaataagttactgaaagacaatgaagacaacctaacaggggaagatgttcgcgaaggcttaactgcagttatctcagttaaacacccaaatccacagtttgaaggacaaaccaagaccaaattgggaaatagcgaagtggtcaagattaccaatcgcctcttcagtgaagccttctccgatttcctcatggaaaatccacagattgccaaacgtatcgtggaaaaagggattttagctgccaaggctcgtgtggctgccaagcgtgcgcgtgaagtcacacgtaaaaaatctggtttggaaatttccaaccttccagggaaactagcagactgttcttctaataaccctgctgaaacagaactcttcatcgtcgaaggagactcagctggtggatcagccaaatctggtcgtaaccgtgagtttcaggctatccttccaattcgcggtaagattttgaacgttgaaaaagcaagtatggataagattctagctaacgaagaaattcgtagtcttttcacagccatgggaacaggatttggcgcagaatttgatgtttcgaaagcccgttaccaaaaactcgttttgatgaccgatgccgatgtcgatggagcccacattcgtacccttcttttaaccttgatttatcgttatatgaaaccaatcctagaagctggttatgtttatattgcccaaccaccaatctatggtgtcaaggttggaagcgagattaaagaatatatccagccgggtgcagatcaagaaatcaaactccaagaagctttagcccgttatagtgaaggtcgtaccaaaccgactattcagcgttataaggggctaggtgaaatggacgatcatcagctgtgggaaacaaccatggatcccgaacatcgcttgatggctagagtttctgtagatgatgctgcagaagcagataaaatctttgatatgttgatgggggatcgagtagagcctcgtcgtgagtttatcgaagaaaatgctgtctatagtacacttgatgtctaa

SEQ ID NO: 2317 - DNA (genomic), 444 bp, Streptococcus pneumoniae; double-stranded, circular
  misc_feature (B) LOCATION 1...444
  hypothetical: NO
  anti-sense: NO
gaaactattgtgtatactattataaaatcaaatataaaaaaatttagtttattaacgatatttattgttgctggtcaattattgctaatttatgcagcaactattaatgctctggtgttgaatgaattaattgcgatgaatttagagcggtttttgaaattgtcaatctaccaaatgattgtctggtgtgggataatattccttgactgggtagtgaaaaattatcaggttgaagtgatccgaaagtttaatctaaaaattcgaaatagagttgccacagacatctctaactctacctatcaagaatttcatagtaaatcatcaggaacatatctttcgtggctaaataatgatgttcacactttaaatgatcaggcttttaaacaactttttttagtaataaaaggagatttctggtactatatttgcagttgtgactcttaa

SEQ ID NO: 2318 - DNA (genomic), 246 bp, Streptococcus pneumoniae; double-stranded, circular
  misc_feature (B) LOCATION 1...246
  hypothetical: NO
  anti-sense: NO
ggagatattgtaggttcacaaaatcagtatttttggattattggtggagctacagatttatataattctaaagaggagataggttattcagtctcagaagttgtacatattttatcagaaagtttgtcggttaattgtaaagaatcaaaaactcttaaacaaatatttgaaactgctttactcgaggttaaagatgaaatcggtttaaactcatataaattaacagagtatagtaaaatgaaataa

SEQ ID NO: 2319 - DNA (genomic), 906 bp, Streptococcus pneumoniae; double-stranded, circular
  misc_feature (B) LOCATION 1...906
  hypothetical: NO
  anti-sense: NO
caaagtattgtaaaaaagaaaaggagtttcattatgaagaaaaagaatggtaaagctaaaaagtggcaactgtatgcagcaatcggtgctgcgagtgtagttgtattgggtgccggggggattttactctttagacaaccttctcagactgctctaaaagatgagcctactcatcttgttgttgccaatgaaggaagcgtggcatcctctgttttattgtcagggacagtaacagcaaaaaatgaacaatatgtttattttgatgctagtaagggtgatttagatgaaatccttgtttctgtgggcgataaggtcagcgaagggcaggctttagtcaagtacagtagttcagaagcgcaggcggcctatgattcagctagtcgagcagtagctaaggcagatcgtcatatcaatgaactcaatcaagcacgaaatgaagccgcttcagctcaggctccacagttaccagcgccagtaggaggagaagatgcaacggtgcaaagcccaactccagtggctggaaattctgttgcttctattgatgctcaattgggtgatgcccgtgatgcgcgtgcagatgctgcagcgcaattaagcaaggctcaaagtcaattggatgcaacaactgttctcagtaccctagagggaactgtagtcgaagtcaatagcaatgtttctaaatctccaacaggggcgagtcaagttatggttcatattgtcagcaatgaaaatttacaagtcaagggagaattgtctgagtacaatctanccaacctttctgtaggtcaagaagtaagttttacttctaaagtgtatcctgataaaaaatggactgggaaattaagctatatttctgactgtcctaaaaacaatggtgaagcagctagtccagcagccgcggaataa

SEQ ID NO: 2320 - DNA (genomic), 918 bp, Streptococcus pneumoniae; double-stranded, circular
  misc_feature (B) LOCATION 1...918
  hypothetical: NO
  anti-sense: NO
gaggtcattgttatgatacaatggtggcaaattttacttctcactttgtactcagcttatcaaatctgtgatgagttgacgatcgtttcatctgcaggttcccctgtatttgctggtttcattactggtttaatcatgggagatgtgactactggtttacttatcggtggtaacttgcaactgttcgttcttggggttggtaccttcggtggtgcttctcgtatcgacgcaacttctggtgcggttcttgcgacagccttctctgtttcacaaggaattgatgcaccgcttgcaattactacaatcgctgtaccagtagcagctctcttgacttacttcgacgttcttggtcgtatgactactaccttctttgctcaccgtgtggatgctgcaatcgaacgctttgactataaaggtattgaacgcaactacttgcttggtgcgattccgtgggctctatctcgtgcccttccagtcttctttgcccttgcttttggtggtgcctttgtacaatcagtagtagacttcgttgaagcctacaaatgggttgcagatggcttgacactcgcaggacgtatgcttccaggtcttggatttgcaatcttgcttcgttaccttccagttaaacgtaaccttcactaccttgctatgggatttggtttgacagctatgttgactgttctttactcatatgtaacaggtcttggtggcgctgttgctggtatcgtaggtactcttcctgctgaagttgctgaaaaaattggtttcgtgaacaacttcaaaggtttgtctatgattggtatttctatcgtaggtattttccttgcagtgcttcacttcaaaaatagccaaaaagtagctgtagcagcaccttctacaccatcagaaagtggggaaatcgaagatgacgaattctaa

SEQ ID NO: 2321 - DNA (genomic), 399 bp, Streptococcus pneumoniae; double-stranded, circular
  misc_feature (B) LOCATION 1...399
  hypothetical: NO
  anti-sense: NO
gatgtaattgtatgtaaaggagacgtcatgttaaatagtattgtaaccattatttgtattgcccttatcgcgtttatcttgttttggtttttcaaaaagcctgaaaaatctggacaaatagcccagcaaaaaaacggataccaagagattcgagtggaagtcatgggaggctatactcctgagttgattgtcctcaagaaatcagtgccagcccgcattgtctttgaccgcaaggatccttcaccatgtctggatcaaattgtttttccagattttggtgtacatgcgaacctgccaatgggggaagagtatgtagtggaaatcacgcctgaacaggctggagagtttggctttgcttgtggtatgaacatgatgcacggcaagatgattgtagagtag

SEQ ID NO: 2322 - DNA (genomic), 1353 bp, Streptococcus pneumoniae; double-stranded, circular
  misc_feature (B) LOCATION 1...1353
  hypothetical: NO
  anti-sense: NO
gaggtgattgtgattggtaatgtagtaagtattgactcacaacctaagatgataacgactgccaagggagacatcaaggccaacagtccaagtaatgtgttgatgtctttcaaagctgatgatcagttgagtatttacctaaagcacaacgatttttcccaagagcatgaactccttaaagatatcaagatcggcaacactctttttaaaaaaggtgagctcccttctaactttgattcagtcgtaaaagtttactttgaaagtgtgttaggtgttgctttctctagccaggcgatgctggacggcatggaaacttttttctcagaacgttcttacaatccagtcattgagtatatggaaaaggctgctgaaaaatgggatggtcgtaaacgaattgaccgaatgcttcaggtttacctgggggctgaagatatccctttagtttctaaaatcgctcaaatgtggctagttggtgcagttgctaaagtttatgatccatacgttaagtttgactatgttctggatctagtcggtggacaaggagttgggaaaacatccctccttcaaaaattgggtggcgaatggtatacggatgccgtaacagatttctctaataaagataattacgacattatgttaaagagtctaatcgtcaacgacgacgaaatggtggccagtaatcggatgagctttgcagaaactaaggcctttatttctaaaactagcctacgttatcgtaaaccatacatgaaacgcacagaagagtttgccaaaaacttcattttagctagaactactaaccaaacagaatacctcaaggacaaaaccggtgaacgtcgttttctaccagttatggcagatagtaaacggcaaaaaaaacatccaatggaaatcgagccagagacaattgaacaaatctggggcgaagccgttacaatctatcgtgctggtgctgatttgatgtttgatgaaaatacagaggatgaactgaatatctaccgtgaacagttcatgtatcgtgatgaagttgaattacaagtgcttgaatatcttgatatgcccgtccctgaaaattggcaaaactggtctattcagcaacaacatcaatacacaagtaaatatttcgataatagtagcgactttgatcctggaagcaaaaaactagataaggtctcaactcgtgaaatgatgtacaacttatttatgagaaattcgaatgacaggaagctgtcaacgaagattaacatgatcatggataatcatcctgattggaaaaaaagtgttttccgggcaggaggtaaaagtacaaaagggttcgtaagagtgaaagattcggaaaaaactaatcggtag

SEQ ID NO: 2323 - DNA (genomic), 399 bp, Streptococcus pneumoniae; double-stranded, circular
  misc_feature (B) LOCATION 1...399
  hypothetical: NO
  anti-sense: NO
ataaagattgtaatgattgagattaagttcaatccagttatattgaataataatgctgagacaaccccaaataaggagatgacggtcatgactggaagtaatacgctaaatgatctactaacagctggtggaatattttcaccaaggttcatttgtaaagctttaacatttgataattcaatgaataattctgttgcaataatcgctacgataaccccggcgaacattgcgcctgtacctgtgttgttgaatgaaagaacacctgaaatgtttacagcatcttttgctccgtcaggaactacagaaactgtatttggcatcatcacaattaaagaaactaatgatagcattgatgctgctaacgggttttcgaaatctctgtttttagctaagaaataa

SEQ ID NO: 2324 - DNA (genomic), 201 bp, Streptococcus pneumoniae; double-stranded, circular
  misc_feature (B) LOCATION 1...201
  hypothetical: NO
  anti-sense: NO
acaaccgttgttaacaatcacatactcattctggaggtcgagtcccagttttttgtagtaggggaggacaccgaaaagggggcgacccgtacagagaaccagtttgacacctttttcaatggcttggtgaatagcagcgatgtgagcctgtgggatttccttggcttcattgaggagggttccatccatatccaaggctag

SEQ ID NO: 2325 - DNA (genomic), 1239 bp, Streptococcus pneumoniae; double-stranded, circular
  misc_feature (B) LOCATION 1...1239
  hypothetical: NO
  anti-sense: NO
gaaggagttgtgatgaaagtatttcttcaaaatagagattttaggcaattaactatcaaccagtggatttcaacgcttggggatacgattttttatctggcctttctgaattatgtggcagatgcgtcttttgcacctttggcgattttactcattacgatttcagaaaccctgccccaaattttacaaatctttctgggagttttggcagattttcaacatcatcgtgtcttgaaatacacagtcattagttttgcaaaatttttgctttactctatcgtttctttatcactttcagggcagtctttctccttgttgctagtagcatttatttgtctgcttaacctcttgtctgacacattgagttacttttcaggagccatgctcactccgattttcattagaattattgggcaagaccatctggcagaagctattggctttaaacagtcaactgttagtttagtgaaaacaatcagtaatatcctaggaggagtcttactaggcattctatccatccagtttatttccttactgaacgctcttacctttttaatcgcatttttaggtatcctcttcataaaaactgacctcttgaaagtagaaaaaacgattagctatcaagaaggactctctgtaaaatccttttgccagcatttgctccaatcatcaaaattgatatggaatatgaataaggtgctcttggttttgtttattatctctactagtcaagcagtgataaatgttacggttcctatttccactctatttttaaggaaccagccctttttgaatttacaaacaggtcaatctcttgccttgctatccacttttgaactgtcagccctgattgtcggaagccttgtaagtggctatctgcaacataccatttccataaaaacagctctctatgcctcacttgtcatccagttgcttcttctagtaggatttgccacagttcgttttgactggattctcatctttagtaccttggatgcctttttcgcaggtgttctctctcctagattgcaagaactcgtttttaaacaaatacctgaggagtcaatgggagcagttcaatcctctatcggtgccattacggttgttttacctagcttatttacaatagctttggtaaccattgctactagctttggaactctggcagttagctttgttttattgctatttcttctagttgcctttgttatgcttctgaatattcgtgaaagtatttag

SEQ ID NO: 2326 - DNA (genomic), 321 bp, Streptococcus pneumoniae; double-stranded, circular
  misc_feature (B) LOCATION 1...321
  hypothetical: NO
  anti-sense: NO
ccctcttctgtcagaaatgctgcaattccttctctaatcatttcctcgtcatctgcaactaaaatgttcatctctctccctttctactaccagaactccatacatctatttcctatatgctatttgaaaatttcctaccagcctatcatctatgataatggaatggatttcatttatccgctactttttgtcaacaacaacgtcaatacaagaaaatcattcatcttgcagcttatactcttcgaaaatctcttcaaaccacgtcagctctatctacaatctaaaaacagtgttttgagcaacctgcggctagctgcctag

SEQ ID NO: 2327 - DNA (genomic), 474 bp, Streptococcus pneumoniae; double-stranded, circular
  misc_feature (B) LOCATION 1...474
  hypothetical: NO
  anti-sense: NO
ctccattctgtggtgaagagtctgcctgctcagactattcagattggaactttaggtgttgatttttcgcgtctgattccagggattttgattatctctatgaatagtggtgcttatgtttcggagactgttcgtgccggaatcaatgcggttccaaaaggtcagctagaggcggcttattcgctagggattcgtcctaaaaatgcgatgcgttatgtgattttgccacaagcagtcaaaaatatcttgccagcattggggaacgaatttatcaccattatcaaggacagctccctcttatcagctattggggtcatggagttgtggaatggggctacaacagtttctacaacaacctatctacctttaacaccacttttatttgcagcattttactacttgattatgacctctattctgacagtagccttgaaagcttttgaaaaacatatgggacaaggagataagaaataa

SEQ ID NO: 2328 - DNA (genomic), 207 bp, Streptococcus pneumoniae; double-stranded, circular
  misc_feature (B) LOCATION 1...207
  hypothetical: NO
  anti-sense: NO
atacgttctgttacttccatgaccagattcatatcgtgttcaatcaacatgattgtaatcttaaattcatctttgatacgacgaattaactcagtcaattcggctgtttcctgtgggttcatacctgctgctggttcatctaagaagagaattttaggttccgtagcaagggcacgaacaatttccaaacgacgttgttgtccgtag

SEQ ID NO: 2329 - DNA (genomic), 249 bp, Streptococcus pneumoniae; double-stranded, circular
  misc_feature (B) LOCATION 1...249
  hypothetical: NO
  anti-sense: NO
accgtctctgtaggcagaatgacagctccacccttttccaactcttgtctaatcctgtccatcatcaaccacgaccatcctatcttgaccaaattggtctttgagtgttcgaacttttttttcaggaagatgttttctaaaaagttcgggaacactttgaccttgcttgtatccaatttcaaggtaaatcttaccaccatccttgagatagtcttttgcatcttccgcaattctacagtaaatagctag

SEQ ID NO: 2330 - DNA (genomic), 219 bp, Streptococcus pneumoniae; double-stranded, circular
  misc_feature (B) LOCATION 1...219
  hypothetical: NO
  anti-sense: NO
aatatatctgttaaaataaggataatgaaaaagaaaagggtttcacgaatgaagaaaaatcgtggaattcaaaaattagctatattagtattactaggtgtttttatgtttagtaatacaattccttaccaacagtttattcagaagaatagacaattggagattcgagtgcaatcgcaaaagaagtccaatggtcttgatgttgggaaggctgattga

SEQ ID NO: 2331 - DNA (genomic), 969 bp, Streptococcus pneumoniae; double-stranded, circular
  misc_feature (B) LOCATION 1...969
  hypothetical: NO
  anti-sense: NO
ggttatgacttatgtgcgactatcttgcgctatgtcgcacctgacaaggctggaaattttgccaatgttatcttgggatttgatgactttgatagttatgtaggcaatagtcccaagcatggagcaagtgtaggtcctgtagcgggtcgtattgcaggtgcgacctttgagctcaatggtaagacctatgaccttgaggttaataatgctagcaactgtaatcacagtggttcaactggttgggattccagcttgtttgaagttgaagaagtaagcgatcatggcttgactctctacacagagcgtacagatgggacaggagggttccctggaaatctcaagatttggatcagttatcacttggaagaaactggtgcctatgaaatcagctacaaggtaacgaccgatcaggatacgctggtcaatccaaccaaccacagctatttcaacttgtctggtgatttcacgcagacgattgaccgtcatgtcttccaactaaacacagagggcatttactcaatcgctcctgacggtgttcctgccaaaactccagaagccaaccgtgatgtggtcaaacacgtctacaatggtaccttgttgaaggatatctttgcagaagaagatgagcaaatccagctggcatcaggtttggatcatccatttgcccttcctgcaggccatgacaatgctggattcctttatgaccaaaattcaggtcgcttcctgcttttcaagacagaagctccttgctttgtggtctacacagcaaactttgtggatgaaagtgtcatcataggaggtcagccaatgctacagcacaatgggattgctcttgaagcgcaagctttaccagatgccattcacagtgaccttaaaggccaagtcattcttaaagctggtcaaaccttcaccagtaagacacgttatgaacttgttgtgaagtcttcacgccaccgcggaattctcaat

SEQ ID NO: 2332 - DNA (genomic), 225 bp, Streptococcus pneumoniae; double-stranded, circular
  misc_feature (B) LOCATION 1...225
  hypothetical: NO
  anti-sense: NO
atctttcctgtccaaatgttccaggtaaacctcagattgcctatgattttgagacaacagaccggattttggcagaagtgtttgcttacttcaccaaacctcttggaattaaattgccaccttattttgatattgttcactttgatcaagcggcagctattttcaacaaatatccgctcaagtttgtcaactgcgttaactctatcggaaacggcctctatatag

SEQ ID NO: 2333 - DNA (genomic), 241 bp, Streptococcus pneumoniae; double-stranded, circular
  misc_feature (B) LOCATION 1...241
  hypothetical: NO
  anti-sense: NO
gcaacctgtggtgaagagagacaaaatggctaagtcaaactttgaaaaagtagaatcagttgttggctgggttcgtgataagaaaatcacaggctaccgtatctctaaagaaacgaatgcgcgtgaaatgtctatcattgctctggcgcagggtcgtgcaaaagtaaaaaatatttcatttgaaacagccctaggcctaattgatttctatgaaaaaaattatgaaaaatttgaagattaa

SEQ ID NO: 2334 - DNA (genomic), 360 bp, Streptococcus pneumoniae; double-stranded, circular
  misc_feature (B) LOCATION 1...360
  hypothetical: NO
  anti-sense: NO
cacaaacctgtgtttttgataaacagttgcttgggcctattctctgcgacctactctcgtaggcaccccttctcccgaagttacggggtcaatttgccgagttccttaacagcaattcttccgatggtcttaggattctctcctcacctacctgtgtcggtttgcggtacgggcacagagctcctggatagagacttttcttggcagcatgaaatcagatatttcggtagtaaactacctcaccattacaccccagacttaacgaaagacggattttcctatctttcatcctcagtgcttagacgtacttccaataacgtacgcatatcctatcctcctgcgtcatcccatttctcataa

SEQ ID NO: 2335 - DNA (genomic), 783 bp, Streptococcus pneumoniae; double-stranded, circular
  misc_feature (B) LOCATION 1...783
  hypothetical: NO
  anti-sense: NO
ctatttactgtagaattgcggaagatgcaaaagactatctcaaggatggtggtaagatttaccttgaaattggatacaagcaaggtcaaagtgttcccgaactttttagaaaacatcttcctgaaaaaaaagttcgaacactcaaagaccaatttggtcaagataggatggtcgtggttgatgatggacaggattagacaagagttggaaaagggtggagctgtcattctgcctacagagacggtttatggtctttttgccaaggccttagacgaaaaagcagttgaccatgtttaccagctcaaacgtcgtcctagagacaaggcgctcaatctcaatgttgcctctttagaggatatcttgcacttttctaagaatcagccagcttatctacaaaaacttgtagagacctttttgccaggtcccttgaccattattctcgaagccaatgaccgagttccctattgggtaaattctgaccttgcaactattggatttcggatgcccagtcaccctatcacactggatttaattcgagagacaggtcccttgattgggccgtctgccaatatctcaggtcaggcaagtggtgtaacctttgaacaaattctgaaggattttgaccaagaggttctgggtctggaagacgatgcttttctaactggacaggattcaactattgtggatttgtctggagacaaggtgaaaatcttacgccaaggcgcaattaaacgagaagatattcttgctcggttgccagagatttcttttgaggaggcttga

SEQ ID NO: 2336 - DNA (genomic), 297 bp, Streptococcus pneumoniae; double-stranded, circular
  misc_feature (B) LOCATION 1...297
  hypothetical: NO
  anti-sense: NO
gcactcgacttgactaatgttcaactttactaccacatcatcatcccacaagtcttaagaagactgctaccgcaggctatcaatcttgtcactcggatgattaaaaccacttcattagttgttttgattggggttgtggaagtgaccaaagttggacaacaaatcatcgatagcaatcgcctgaccatcccaactgcttcattttggatttatggaaccattctagtcttatatttcgcagtttgctaccctatttccaaactatccactcacttagaaaaacattggagaaactaa

SEQ ID NO: 2337 - DNA (genomic), 312 bp, Streptococcus pneumoniae; double-stranded, circular
  misc_feature (B) LOCATION 1...312
  hypothetical: NO
  anti-sense: NO
gtatgtactgttaaggagagaatcatgcccgtaagaaaattacaatcctatgaggtagactatcaagaagaattaaaccagcagcttcctcattaccaagcttatacacctgaagcgcaatctgatgccaatctcaaggaaatcctattttttattaatatcgctgttttttgtatctgtattgctatctttagttttatctttttagcattaaaattatcaactgctcttgcctttgccgcagcaatcggattcagcttacttgttttaaaagttcaacggtctattatcaaacgaaaacgtagaagataa

SEQ ID NO: 2338 - DNA (genomic), 318 bp, Streptococcus pneumoniae; double-stranded, circular
  misc_feature (B) LOCATION 1...318
  hypothetical: NO
  anti-sense: NO
gaaagaactgttggtttcatcgctgcgatgtgcattgacaattgtttagcaagtgcttcgtctccaccttcaacaactgaaataacaccgatacgtccaccgttatgttggtatgctccaaagtgttgtgcgtctgttttttcaatcaatgcaaagcgacggaatgagattttctctccgatagttgctgttgcagatacgtatgcagcttcaagagtttcacctgaaggcattatcaaagcaagagcttcttcattgttagcaggttttccttcagcaatgactttagctgtagtatttaccaattcaacgaattga

SEQ ID NO: 2339 - DNA (genomic), 858 bp, Streptococcus pneumoniae; double-stranded, circular
  misc_feature (B) LOCATION 1...858
  hypothetical: NO
  anti-sense: NO
agaccgactgtctttgctggggtcattttacacgtaatgctgggttcgacttatgcttggagtgtttatcgtaaccctattattgaaaaaacgggatgggatcaggcttctgttgccttcgcctttagtctagcaatcttttgtttgggcttatcggctgcatttatggggcgtttggtagaaaaatttggtccgaaagtcatggggagtctatctgcttttctatacgcaggtggaaatatcttaacaggatttgcaatagaccgtcaggaactgtggttgttgtatctagcttatggcattttaggtgggcttggtttgggagcaggttatattacccctgtgtcaacgattataaaatggtttcctgataaacgtggtctcgcaacaggtttagcgattatggggtttggttttgcttctttattgactagtcccatagcgcaacacctcatcgcaggggtatggattgtagaaactttttatattttaggagcaagttactttattatcatgctcctagcttcacaattcattaagcgtccaaatgagcaagagcttgcaattttatcttcttcagggaaagaaaaaacagcctctttgacgcaaggaatggctgcaaatcaggctctaaaaagcaatcggttttatatgctttggattattttctttatcaacatancttgtggtttaggcttaatttcagcggcatcgccaatggcacaggaaatggctggcttgtctacaagtcatgcagcagtaatggtgggtgttttggggattttcaatggatttggtcgcttgctctgggcgagtttgtctgactatatcggtccgcctctaacctttaatatatga

SEQ ID NO: 2340 - DNA (genomic), 258 bp, Streptococcus pneumoniae; double-stranded, circular
  misc_feature (B) LOCATION 1...258
  hypothetical: NO
  anti-sense: NO
ttccttgctgttaacttgcccctttatacctttcttataagcccagtgagccgcaaccccgtactcagccacctcgtgcatttccttggttcgaatctggaattcaatcggcccttttggtccataaacagtcgtatggatagactgataaccattggccttgcggttggcaatatagtctttgaagcgacctggcatcggtttccaaaattcatgcacgtaaccaagcatggcataaacatcactttgggtatctaa

SEQ ID NO: 2341 - DNA (genomic), 1929 bp, Streptococcus pneumoniae; double-stranded, circular
  misc_feature (B) LOCATION 1...1929
  hypothetical: NO
  anti-sense: NO
aaggcagctgtcttagctaagattcaagaacaaggtaagttgaccaaggaattggaagaagctatcttagttgccgaaaaattagcagacgttgaagaactctatcttccttataaggaaaagcgtcgtaccaaggcaaccattgcccgtgaagctggactctttcctcttgctcgcttgattttgcagaatatagttgacttagagaaagaagctgaaaagttcgtctgtgaaggatttgcgactggcaaggaagccttgaccggtgcagttgatattttggtcgaagccttatcggaagatgtgaccttgcgttctatgacttatcaggaagtgctgagacactctaaactcacttctcaagccaaggatgaaagtcttgatgaaaagcaggtttttcagatttattatgatttttcagagacagttggaactatgcaaggctatcgtaccttggctctcaatcgtggggagaaacttggtgtcttgaagatcggttttgaacatgcgacggaccgtattcttgccttctttgctactcgtttcaaggtgaaaaatgcttatattgatgaagttgttcagcaatccgttaagaaaaaggtcttgcctgctattgagcgtcgtattcggacagaattaactgagaaagctgaagagggagctatccaacttttttctgacaatctgcgcaatctcctcttggttgctccactgaaagggcgcgtggttcttgggtttgacccagcctttcgtacaggtgccaagctagctgtcgtggatgcaacaggaaaaatgctgacaactcaggttatttatcctgttaaaccagcatcagctcgtcaaatcgaagaagccaagaaagatttagcagatttaattggtcaatacggtgtagagattattgccattggaaatggaacggccagtcgtgaaagtgaagcttttgtagcggaagttctgaaagatttccctgaagtcagctatgttatcgttaatgaaagtggtgcttctgtctattctgccagcgaacttgctcgtcaggagtttccagacttgaccgttgaaaaacgctctgccatttctatcgcccgtcgtttgcaagatcctcttgcggaattggtcaaaatcgatcctaagtcaattggtgtcggtcaataccaacacgatgtcagtcagaagaaactctctgagagtctggactttgttgtcgatacagtggttaaccaagttggtgtcaatgtcaatacagctagcccagctcttctttcacacgtagctggactcaataaaaccatttctgaaaatatcgtcaaataccgtgaggaagagggaaaaatcacttcacgctcccaaatcaagaaagttcctcgtctgggagccaaggcctttgagcaggctgctggtttccttcgtatccctgaaagtagcaatatccttgataatacaggagttcacccagagaattacactgcagttaaggaactcttcaaacgtttagatattaaagacctaaacgaagaagcccaaagcaaactcaagtccctttcagtcaaggaaatggctcaagagctagacctcggtccagaaacccttaaagatatcattgcagatcttctcaaaccaggtcgagatttccgtgattcctttgacgcacctgtgcttcgccaagatgtcctagatatcaaagacctagtggtaggtcagaagctagaaggtgttgtgcgtaacgttgttgacttcggtgccttcgttgatatcgggattcacgaggacggcttgattcatatttctcatatgagtcgcaagtttatcaaacaccctagtcaagtggtgtcagttggagatttggtgagcgtttgggttaagcaaattgatactgaacgtgaaaaagttaatctgtctctcctagctccaaatgaaactgactga

SEQ ID NO: 2342 - DNA (genomic), 207 bp, Streptococcus pneumoniae; double-stranded, circular
  misc_feature (B) LOCATION 1...207
  hypothetical: NO
  anti-sense: NO
ccgcaagctgtacttgagtacggtaagacgacgctgacgtggtttgaagagattttcgaagagtataagtctctacggaccaaccattatcctgtagtaacaaaaaagaagttgagacagactgaactcaacttcttttttagtgtcgtatcagcaatgttagtcctgcatctgacgttttacctgataaggcaaatacaagactag

SEQ ID NO: 2343 - DNA (genomic), 195 bp, Streptococcus pneumoniae; double-stranded, circular
  misc_feature (B) LOCATION 1...195
  hypothetical: NO
  anti-sense: NO
cagagagctgtgtttttgataaacagttgcttgggcctattcactgcggctgactttaagtcagcaccccttctcccgaagttacggggtcattttgccgagttccttaacgagagttctctcgctcacctgaggctactcgcctcgactacctgtgtctgtttgcggtacgggtacagtatgtttaaacgctag

SEQ ID NO: 2344 - DNA (genomic), 198 bp, Streptococcus pneumoniae; double-stranded, circular
  misc_feature (B) LOCATION 1...198
  hypothetical: NO
  anti-sense: NO
cagagagctgtgtttttgataaacagttgcttgggcctattcactgcggctgactttaagtcagcaccccttctcccgaagttacggggtcattttgccgatgttccttacatcgagagttctctcgctcacctgagctactcgcctcgactacctgtgtcggtttgcggtacgggtagagtatgtttaatacgctag

SEQ ID NO: 2345 - DNA (genomic), 222 bp, Streptococcus pneumoniae; double-stranded, circular
  misc_feature (B) LOCATION 1...222
  hypothetical: NO
  anti-sense: NO
aacttttatgtgaagagtttgggcataaacttttacctcttcttccctactcacctgagtacaatcctattgagaaaacatgggctcatatcaaaaagaacctcaaaaaggtattaccacgttgccataccttttacgaggctcttttgtcctgctcttgtttcaattgactatattagaggcgagacatttttcggttctttgtcaactgtagtgggttga

SEQ ID NO: 2346 - DNA (genomic), 990 bp, Streptococcus pneumoniae; double-stranded, circular
  misc_feature (B) LOCATION 1...990
  hypothetical: NO
  anti-sense: NO
attgaagacttaaaaaatcaaacctatcctaaagagaatattgaaattctatttataaatgctatgtccacagatgggaccacagctatcattcagcaatttataaaggaagatacagagtttaactcaattagattgtataacaatcctaagaaaaatcaagctagtggttttaacctgggagttaaacattctgtaggggaccttattttaaaaattgatgctcattcaaaagttactgagagttttgtaatgaacaatgtggctattattcaacaaggtgaatttgtctgtggggggcctagaccgacgattgtcgaaggaaaaggaaaatgggcagagaccttgcatcttgttgaggaaaatatgtttggaagtagtattgccaattatcgaaatagttccgaggatagatatgtttcttctatttttcatgggatgtataaacgagaggttttccagaaggttggtttagtaaatgagcaacttggccgaactgaagataatgatattcattatagaattcgagaacatggttataaaatccgctatagcccaagtattctatcttatcagtatattcgaccaacattcaagaaaatgctgcatcaaaagtattcaaatggtttgtggattggcttgacaagtcatgttcagtttaagtgtttatcattatttcactatgttccttgtttatttgttttgagtcttgtgtttagtctagcattgttaccgatcacattcgtattcataactttactattaggtgcctattttctacttttgtcattactcactttgctgactttattaaaacataaaaatggatttctaattgtgatgccctttcttttattttccattcactttgcttatggccttgggacgattgtaggtttaattagaggatttaaatggaagaaggagtacaagagaacaataatttatttggataaaataagccaaataaatcaaaatatgctacaataa

SEQ ID NO: 2347 - DNA (genomic), 678 bp, Streptococcus pneumoniae; double-stranded, circular
  misc_feature (B) LOCATION 1...678
  hypothetical: NO
  anti-sense: NO
gagtattatgttatgctaagtaaagaggattatactgaagaaatcgggctaataaagaaacaaaattatgtagaggctgaattgtatcctatagttgctgatataattaagccaactttaaaagatagtttatcaaaaagatatgtcttcggaagacaaagaaggggtttgggacaaatttattatggtctaagtaattttcctgatatagttattttagataagacttatgaaaacaaatctaggaaaagtataaaaattgaagaatggaagaaacttcgaggatgcgtggaagttaagaatttaaattatagtttaattacagaggaaaaaatcaaatcaaccatatcgaacagttttgaacatataactggagagatggaacaactaactggagagatgggacaacttattggagaccttttatggtataaaaaagtaatttatacaaatggaattgaatggagatttctaagtttagatgacaaggaagagatagataatacaattgttgaagtagttaacaaaagaatagaaacagaagaagcgggaaattcttttgattggtggaagaatattaaagatttatcgttcaattatacggatatatgcctatctaaagattgtagacaagagtggaatgaatttgtaaaaagggtaaaggaaatagaatggtag

SEQ ID NO: 2348 - DNA (genomic), 1131 bp, Streptococcus pneumoniae; double-stranded, circular
  misc_feature (B) LOCATION 1...1131
  hypothetical: NO
  anti-sense: NO
ggaagagactttagagcattttttcattcaagagtgcggaatgatttgaaatatggtataataaaagggaatttctacagaaaagagaagattatgtcaaattttgccattattttagcagcgggtaaagggactcgcatgaaatctgatttgccaaaagttttgcacaaggttgcgggtatttctatgttggaacatgttttccgtagtgtgggagctatccaacctgaaaagacagtaacagttgtaggacacaaggcagaattggttgaggaggtcttggctggacagacagaatttgtgactcaatctgaacagttgggaactggtcatgcagttatgatgacagaacctatcttagaaggtgtgtcaggacacaccttggtcattgcaggagatactcctttaatcactggtgaaagcttgaaaaacttgattgatttccatatcaatcataaaaatgtggccactatcttgactgctgaaacggataatccttttggctatggacgaattgttcgtaatgacaatgctgaggttcttcggtcattgttgagcagaaggatgctacagattttgaaaagcaaatcaaggaaatcaacactggtaacatacgtctttgacaacgagcgtttgtttgaggctttgaaaaatatcaataccaataacgctcaaggcgaatactatattacagacgtcattggtattttccgtgaaactggtgaaaaagttggcgcttatactttgaaagattttgatgaaagtcttggggtaaatgaccgtgtggcgcttgcgacagctgagtcagttatgcgtcgtcgcatcaatcataaacacatggtcaacggtgttagctttgtcaatccagaagcaacttatatcgatattgatgttgagattgctccggaagttcaaatcgaagccaatgttatcttgaaagggcaaacgaaaattggtgctgagactgttttgacaaacggtacttatgtagtggacagcactatcggagcaggagcggtcattaccaattctatgattgaggaaagtagtgttgcagacggtgtgacagtcggtccttatgctcacattcgtccaaattcaagtctgggtgccccaagttcatattggtaa

SEQ ID NO: 2349 - DNA (genomic), 237 bp, Streptococcus pneumoniae; double-stranded, circular
  misc_feature (B) LOCATION 1...237
  hypothetical: NO
  anti-sense: NO
tattcatatgtatgtgtcgttctaattgtcactgccttcttgatgatagagagtattttagaatccagttctggggggtacaatttatttagaggaaacagtagtccagctattccgtgttggaatgataaattacttacgaaatttccaaattctgttgaagaagtgatccttccttcagaatttacagttttatctagtaaaaattgtagaacactattacattctgttttgtaa

SEQ ID NO: 2350 - DNA (genomic), 1488 bp, Streptococcus pneumoniae; double-stranded, circular
  misc_feature (B) LOCATION 1...1488
  hypothetical: NO
  anti-sense: NO
aaggagtatgttttgaaagagttagatcaaaaccaagccccaatttatgaagccttggtgaagttacgcaagaaaaggattgttccctttgatgttccaggtcacaagcgtggacggggaaatccagaacttgtcgaactcttaggagaaaaatgtgtaggcattgatgtcaattcgatgaaacccttggataatttaggccatcctatttcgattattcgtgatgcagaggagctggctgcagatgcttttggagctagccatgcctttctaatgattggtggaacaacttcatcggtgcagactatgattctggcaacctgcaaggcaggagataagattattctgccacgaaatgtccataaatctgctatcaatgcgttggttctatgtggtgccattcccatctatatcgagatgagtgtagatcctaagattggtatcgctttaggtcttgaaaatgaccgagtagcacaggccataaaggaccatccagatgctaaggctatcctaatcaacaatcctacttactacggcatctgttcagacctaaaggggttgacagaaatggctcatgaagctggcatgatggttttagtagatgaagcccatggagcgcatttgcatttcactggtaaacttccaatttctgctatggatgcaggagctgatatggcagcagtttccatgcataagtctggtgggagtttgacacaaagttcgcttcttttaatcggggagcagatgaatcccgagtacgttcgtcagattataaacctgacccagtctacatctgcctcttacttattgatggctagtttggatatttcacgtcgcaacttggcccttcgtggtaaagagtcgtttgaggaagtcattgagctatccgagtacgctcgtcatgaaatcaatgccattggcggttactatgcttactcaaaagagttaatagatggtgtgtcggtctgtgattttgatgtaaccaagttgtcagtttacactcagggaataggcttaacaggtatcgaggtttatgacctcttgcgagacgaatacgacattcagatcgagtttggtgatatcggcaatatcttggcctatatttccatcggcgaccgcatccaagacatcgagcgcttggttggtgctctggctgatattaagagactctattcacgagatgggaaggacttaatagctggagaatatattcagcccgagttggtgctgtctccacaagaagccttctattcagagagaaaaagtttgaccttagatgagtctgttggacaggtctgtggagaatttgtcatgtgctatcctccagggattcctatcttggctcctggtgaacgcattacacgagaaattgtagactatatccaattcgccaaggaacgtggttgctccctccaagggacggaagatccagaggtcaatcatatcaacgttattaagagaaagacaaactataagaaaagtcaatag

SEQ ID NO: 2351 - DNA (genomic), 309 bp, Streptococcus pneumoniae; double-stranded, circular
  misc_feature (B) LOCATION 1...309
  hypothetical: NO
  anti-sense: NO
aagacggactttgcgcgcattaaaatgaccctgtccaattatttttacaaggtcaaacagcagtatcctttgacagaaaaacagcaggagctctatgacattttaggagatgttaatcctgagtatgccctcaagtatatgacggcttttttgttgaaatttctcaaaaaagaccagcttatgcagaaatgccgtgatatctttgtggacagtttggttgtcttaggctatattgtgcaaaatgaagatagaaagtatgagttggctatcgattttgataaggagagattaactttctacttagcgtga

SEQ ID NO: 2352 - DNA (genomic), 267 bp, Streptococcus pneumoniae; double-stranded, circular
  misc_feature (B) LOCATION 1...267
  hypothetical: NO
  anti-sense: NO
ttgtataatgtaattacaccgtcggtaatagtgctagcagaccaaaataaagcagattggtcgtatgatgaaaatactgtaattaacatttatgatgatgctaattttgaagatggtaggttgcatatgacctttgaacaattcttcaaattggcacaaatagctagagaagaaggtcttgaaattcattctccgtttgagagagctggtgcgactaaatctgctcgttatatagcgaaatggattttgagaaataaaaaacattaa

SEQ ID NO: 2353 - DNA (genomic), 1026 bp, Streptococcus pneumoniae; double-stranded, circular
  misc_feature (B) LOCATION 1...1026
  hypothetical: NO
  anti-sense: NO
aaaaataatgttacatttatatccgcagatatctttcgataccaaatctacatgaaaggacggggtatgaaactttctcattatttaattggcttacttctactcctagtctttctctctattagcattgggaccagtgatttttcatggggaaagctatttgatttcgaccagcagacctggctcctctttcaagagtcccgtctcccaagaactatcagtattctcctgactgcctctagtatgagtatggcaggccttctcatgcagactattacccaaaatcagtttgctgcaccgagtacagttggaacgactgaagccgccaaactgggaatggtgctgagcctttttgtctttccatcggctagtctgacccaaaagatgctcttcgcttttgtttcatccatcgtattcaccctcttcttcctagcctttatgaccatttttactgtaaaggaaaggtggatgttgcctctgattgggatcatctatagcgggattatcggctcagtcacagaagttatcgcctatcgtttcaatctggttcagagtatgactgcctggacccagggctccttctccatgattcagacccatcagtatgagtggctcttcttaggcctcatcatcctgataaccgtttggaaattatcccaaaccttcaccatcatgaatctagggaaagaaaccagcgagagtttggggatttcctactccctacttgaaaaactggccctctttctggtggcgctaacgacaagcgtcaccatgattaccgtgggtggcctaccatttctcggagttatcgttcccaatcttgttcgcaagtgctatggagataatctaagtcaaaccaaactcatggtcgcactggttggtgccaatctagttctggcttgcgatatcctatcccgagttctgattaggccctatgagttgtctgtcagtctcttgctaggaatcatcggtagtctcgtctttatcctacttctctggagagggggacgaaaagatgcagactaa

SEQ ID NO: 2354 - DNA (genomic), 840 bp, Streptococcus pneumoniae; double-stranded, circular
  misc_feature (B) LOCATION 1...840
  hypothetical: NO
  anti-sense: NO
gttataaatgtaagtaagcattatggtcattcaatcattctcaaagatataaattttgcacttaacaagggtgaaattgttggtctagtagggagaaatggagttggtaagagtacgttgatgaaaattcttgttcagaataatcaaccgacttcaggtaatattataagcagtgataatattgggtatttaatcgaagaaccaaaattatttttatctaaaacaggtttagagaatttaaaatatttgtcaaatttatatggtgttgactacaatcaagaaagatttagaagtttgatccaagagttagatttgactcagtctattaataaaaaagtaaagacctattctttgggtacaaaacaaaaattagctttgcttctaactctcgttacgaaacctgatatattgattttagatgaaccgactaatggtttagatattgaatcatcacaaatagttttagcggttctaaaaaaattagctttaaatgaaaacgtgggaattttaatatcgagtcataaattagaagacattgaagaaatttgtgagagggttcttttcttggagagcgggcttttgacatttcaaaaagtaggaaaagatagtcataatttcttgtttgagatagctttttcatcagctacagatagagacattttcattaccaaacaagaatttggggatattgttcaggaagagggactgagaattactatgtctgggaatattcaaagtagtgagctttttaaattttttaacgaaaactctattaaagtagttgattttgaaactaaaaaagagacgcttaaagatatttacttaaatcgttcaaaataa

SEQ ID NO: 2355 - DNA (genomic), 426 bp, Streptococcus pneumoniae; double-stranded, circular
  misc_feature (B) LOCATION 1...426
  hypothetical: NO
  anti-sense: NO
ttgacaaatgtagattttggaggtatggtaatgcagatttcagatgcagaatggcaggtcatgaagattatttggatgcagggggagcagaccagtacagatttgattagggttttggcagagcggttcgactggtccaagtcaaccattcaaactcttttggctcgtttggttgagaaagagtgtctgactcggaaaaaagaaggcaagttctttgtttattcagcccttttaactctagaccaaagtcgggatttacttgtccaagatatcaaagacaaggtttgttcccgtaggattaggaatttgttggctgacttgattgtagaatgtgaatttactcagactgacttggaagacttggaagctgtgatttcagagaagaaatcaagtgctgtaacagaagtaagatgtaattgtatgtaa

SEQ ID NO: 2356 - DNA (genomic), 264 bp, Streptococcus pneumoniae; double-stranded, circular
  misc_feature (B) LOCATION 1...264
  hypothetical: NO
  anti-sense: NO
aaagaaaatgttatgtctgaacgtagaatctctgaaaagtctcttgaaaatctcagaaaatcaaaccaagaatccaatttattaaccagagaagccattgaaacagccctcttgcaactcttggaaaaaaaggaactgaccaagattagtatttctgaattggtcaaacgtgcaggtgtttcgcgtgcggccttttatcgcaattatgactccaaaggaggaattttagagaggtctttaaaagaactgtccacaatattatga

SEQ ID NO: 2357 - DNA (genomic), 267 bp, Streptococcus pneumoniae; double-stranded, circular
  misc_feature (B) LOCATION 1...267
  hypothetical: NO
  anti-sense: NO
atgaagaatgtagaattaaaggagaaaaacatgacatttgaagagatcctgcctgggttaaaggctaagagaaaatatgtacgaactggttggggaggtgcggaaaactatgtccaactctttgataccatcgagcaaaatgggcttgcacttgaaatgacaccttatttcctaatcaacgtttctggcgaaggagaaggtttttccatgtggagcccgacagtttgtgatgttttggcaacggattgggtagaagtgcatgactaa

SEQ ID NO: 2358 - DNA (genomic), 282 bp, Streptococcus pneumoniae; double-stranded, circular
  misc_feature (B) LOCATION 1...282
  hypothetical: NO
  anti-sense: NO
aaccgtgatgtgacgagcaccgatagccattcctttatcatcattgatagtacgaaagaaattcaagacattgttgtaattatcaaagggctcaccgattcccatgacaacgatatggctgacgcgttcatcctgaccacgctcagcaaagtatttctgaaccagcatgatttgcgctacgatttcaccgttattgaggtcacgttgcttcttaatcaaaccagaggcacagaaggtacaaccgatattacagccgacctgagtggtcacacagacagataa

SEQ ID NO: 2359 - DNA (genomic), 357 bp, Streptococcus pneumoniae; double-stranded, circular
  misc_feature (B) LOCATION 1...357
  hypothetical: NO
  anti-sense: NO
acaagagatgttgacttaatgaataccatagagcggactaggcggctggttaaaggctgtgcaacacactgttttgaggttgcagatagaactgacgaagtcagctcaaagcactgctttgaggttgtagatagaactgacgaagtcagctcaaagcactgctttgaggttgcagatgaaactgacgaagtcagctcaaaacatgtttttgaggttgtggatgaaactgacgaagtcagctcaaaacatgtttttgaggttgtggatgaaactgacgaagtcagctcaaaacatgtttttgaggttgtggatgaaactgacgaagtcagtaaccatacatacggtaaggcgacgtga

SEQ ID NO: 2360 - DNA (genomic), 516 bp, Streptococcus pneumoniae; double-stranded, circular
  misc_feature (B) LOCATION 1...516
  hypothetical: NO
  anti-sense: NO
aactcttgtgtgaagagtttgggtataaacttttacctcttcctccctactcacctgagtacaatcctattgagaaaacatgggctcatatcaaaaagcacctcaaaagggtattaccaagttgcaataccttttatgaggctcttttgtcttgttcttgtttcaattgactatataaattgtctaagcgaaacaaccgataagaattggcacaaaagcgaccgtgtttttgttaccaatacaggaaaaacagttcatagttctatcttgagcaagtctctccagcgagcaaacgaacgccttaaaaaaccaattcccaaacatctgtcccctcacatcttcagacacaccactattagcatcttatcagaaaataaaattcctttaaaaacaatcacggacagggttggtcattccgactctgaagtcactacttccatctacacccacgtcacaaagaacatgaaagatgaagcaatcaatgtactggataaagttatgaaaaagattttttaa

SEQ ID NO: 2361 - DNA (genomic), 303 bp, Streptococcus pneumoniae; double-stranded, circular
  misc_feature (B) LOCATION 1...303
  hypothetical: NO
  anti-sense: NO
ggaagncgtgtccttttctacaatcctgccaagtcaacagtcaatgaggaagactatttgactgttattcctcacctgcctaaaaaaggattttcccgtgattttttagcttattttgcgcttttccttaaagatactgctgaggttgggctagatgtcctcatggactttttggaagacccagaagcagaggaatttgtcatggaatggaaccaagaagtcttagaagaaggaaaagttggcttggaagagggagaatttacccttatccgagatactaggagttggttggaggtgttatga

SEQ ID NO: 2362 - DNA (genomic), 897 bp, Streptococcus pneumoniae; double-stranded, circular
  misc_feature (B) LOCATION 1...897
  hypothetical: NO
  anti-sense: NO
atggaaagtgtcggagatgtactcaaacgtcaaccaagtcgttttcactatcaagatttagttcagaaaatcatgaaggatcctgatgttgcggcctttgtccagcaagaatccctcaatcaggacgagttgaaccgtagtatttccaagtttaaccaatacatcactgagagagataaattcctccgaggagatacagattatattgccaaaggctacaagcctatattagtcatgaaccatggctatgcggatgtttcttatgaagaaactcctgaactaatcgcagctgaaaaagaagcggctatcaagaaacgtctcaacttaattaattttccatctagcctgaaaaatgtcagttttttagatgtttatcgtgatgatgttcagcgcttaactgttctaaaaagaatgatagaatttgttaacgattaccccaataatttgaaaggtctttacttgtatggagactttggtgtgggtaaaagtttcatggtggctgccctagctcatgatttatcagaaaaacgtggtgtatcatccactctcctccactatcctagctttgtcattgatgtcaaaaatgctatcagtgatggcaatgttaagaccttagtggatgagattaagctttctgaagtcctgattttagatgatattggtgccgagcaatccaccacttgggtgcgtgatgaaatcctgcaggtcattctccaatatcggatgcaggaaaatttaccgacctttttcacctctaacttcaactttgaagatttggagaagcatttcgctaaagggaaaaatggaaatgacgaaacctgggaagccagacgcgtcatggaacgcatccgttatttggctgaggagactcgtttagaaggagtaaaccgtcgatga

SEQ ID NO: 2363 - DNA (genomic), 609 bp, Streptococcus pneumoniae; double-stranded, circular
  misc_feature (B) LOCATION 1...609
  hypothetical: NO
  anti-sense: NO
gagcgaggtgtgttcttagctgttgacaatgaaatcaaaggcttgcttgctttgcaagatattcctaaggaaaatgctaagctagccatcagtcagctaaaaaaacgtggtctccgaacagtcatgctgacaggagacaatgctggtgtggcgtgtgctattgcagatcaaatcggaattgaagaggtcattgcaggcgtcttgccagaagaaaaagcccatgaaatccataaactgcaacagtcagggaaagtagcctttgttggggacggtatcaatgacgctcctgcccttagtgtagcagatgtggggattgctatgggagctggaacagatatcgccatcgagtcagcagatttggtgttgacaaccaataatcttttaggagtggttcgtgcctttgatatgagtaagaaaacctttcatcgaattctactcaatcttttctgggcttttatctacaatgttgtcggaattccgattgcagcaggagtcttttcaggtgttggactggctctcaacccagaattggcaggtctagccatggcctttagttctgtatctgttctgaccagttcccttctgttaaattttagtaaaatagactaa

SEQ ID NO: 2364 - DNA (genomic), 456 bp, Streptococcus pneumoniae; double-stranded, circular
  misc_feature (B) LOCATION 1...456
  hypothetical: NO
  anti-sense: NO
attggaggtgttatgaaagatagtcatttgctagcccatcatattcgtttgttgaatgggcggatttttcaaaagttactgagtcaagatcctgaggctctttataggggtgaacagggcaagattttagcggttttatggaatagtgaaactggctgcgcaactgcgacagatatcgcgcttgcgactgggcttgcgaataatacgctgacgactatgataaaaaagctagaggaacaaaagcttgtaattgttagtccgtgtggaaaagacaagcgtaagaagtatttagttttaacggagttaggcaagtcccagaaagaagtggggcatcgtgtcagtcagaaattggatactatcttttacaaaggattttcagaggaagaaattcaccaatttgaaggttttcaagaaagaattttggcgaatctgaaagagaagggaaatgaggtttag

SEQ ID NO: 2365 - DNA (genomic), 201 bp, Streptococcus pneumoniae; double-stranded, circular
  misc_feature (B) LOCATION 1...201
  hypothetical: NO
  anti-sense: NO
ttggatttcgtcaatcaagtcttgtgtttgttccctcatattgctataacttctgaggactcgtttggtcagtggactatgcttggagacttggttggcttgattttctgcctgatgttggtattggaaaataaattctcggtagccagtaaagccacactttttagcaaagcgggtcaaagcagcttgagaaatatgtaa

SEQ ID NO: 2366 - DNA (genomic), 228 bp, Streptococcus pneumoniae; double-stranded, circular
  misc_feature (B) LOCATION 1...228
  hypothetical: NO
  anti-sense: NO
gctgacttcgtcagttttatcgacaacctcaaacactgctttgagcaacctgcggctaacttcctagtttgctctttgattttcattgagtatgactttagcggttgtcaattttctctggataaacgtcgtgttggaaaacgcgttgttctgccaagncctcatacttatttccttgcttaccgtaattgtaataggggtcgattgacatgccaccgcgcggaataa

SEQ ID NO: 2367 - DNA (genomic), 786 bp, Streptococcus pneumoniae; double-stranded, circular
  misc_feature (B) LOCATION 1...786
  hypothetical: NO
  anti-sense: NO
aggagattcgttatgaagaataatcgtattttagcactttctggaaatgatatttttagtggtggtggactgtcagctgatttggctacctataccttgaacggcttgcatgggtttgtagcagtgacttgtttgacagccttgacagaaaaaggatttgaagtctttccaactgatgataccatttttcaacatgaattagatagcttgcgtgatgtggaatttgggggaattaagattggtcttctccctactgtcagtgtggctgagaaggccttggactttatcaaacaacgcccaggagtacctgtggtgttggatcctgtcttggtctgcaaggaaacgcatgatgtagctgtcagtgagctctgccaagagttgattcgcttcttcccttatgtcagtgtgattacgcctaatctcccagaagcagaattattatccggtcaggaaattaaaaccttggaagacatgaaaactgcagcgcagaaattgcatgatttaggagcgccagcagtcattatcaagggaggcaatcgtcttagtcaggacaaggctgtggatgtcttttatgatggacagacctttactatcctagaaaatccagttatccaaggccaaaatgctggtgcaggttgtacctttgcctctagcattgccagtcacctggttaaaggtgataaatttttgccagcagtagaaagctctaaggctttcgtttatcgtgctattgcacaagcagatcagtatggagtaagacaatatgaagcaaacaaaaacaactaa

SEQ ID NO: 2368 - DNA (genomic), 414 bp, Streptococcus pneumoniae; double-stranded, circular
  misc_feature (B) LOCATION 1...414
  hypothetical: NO
  anti-sense: NO
tttaagttcgtcctatttgtaaaacaaatgaaacaatttcaactaaggaggagaaaacaaatggaacttgtattaccaaataattatgttgtgattgatgaagaagaaatgatgtatcttgatgggggagcttatttaagcaagcgtgcttgtcaaggaatttgcgtagctttagctatgagttcaggaacttttatagcattagctggagctgcagttttaaccaaaaaactaataaactatattaaggttggaagctttggaggctggcttattggtgcagcagcaggtgtattggctggggcggcaggaagaatagcttactgtattggatatggtactcttaatagagattgtgatattagcgggaacccttatccttgggatggattcatatctgcgacagtaagatga

SEQ ID NO: 2369 - DNA (genomic), 555 bp, Streptococcus pneumoniae; double-stranded, circular
  misc_feature (B) LOCATION 1...555
  hypothetical: NO
  anti-sense: NO
atatttctcgtaaggaacaggtgttaccaatggtaccggctggtaagagtaatcatgagatgttgggggtgcagttccatgcgtagaatgttaacagcaaaactacaaaatcgttcaggagtcctcaatcgctttacaggtgtcctatctcgtcgtcaggttaatattgaaagcatctctgttggagcaacagaagatccgaatgtatcgcgtatcactattattattgatgttgcttctcatgatgaagtggagcaaatcatcaaacagctcaatcgtcagattgatgtgattcgcattcgagatattacagacaagcctcatttggagcgcgaggtgattttggttaagatgtcagcgccagctgagaagagagctgagattttagcgattattcaacctttccgtgcaacagtggtagacgtagcgccaagctcgattaccattcagatgacgggaaatgcagaaaagagcgaagccctattgcgagtcattcgcccatacggtattcgcaatattgctcgaacgggtgcaactggatttacccgcgattaa

SEQ ID NO: 2370 - DNA (genomic), 225 bp, Streptococcus pneumoniae; double-stranded, circular
  misc_feature (B) LOCATION 1...225
  hypothetical: NO
  anti-sense: NO
aatccactcgttgcccctgttactcctgcccaaagagccacaccaaatttagctcctatgtatccacatgctcccataaatggcgctccaacaccactcgcagcacaaatagctgtccctaacccccagccaccaaaagcagcaccaccaccttctaagacattagtttgccaattattcttgcctccttcaatactagataacatagttatatccatttcatga

SEQ ID NO: 2371 - DNA (genomic), 699 bp, Streptococcus pneumoniae; double-stranded, circular
  misc_feature (B) LOCATION 1...699
  hypothetical: NO
  anti-sense: NO
caaccactcgtctggttaaggagcaagggcattttgcagggcataatttgtttgcggatggagccattaccatccaagacgagtccagtcagctggttgctccgacgcttgatttacaaggtgatgagcgagtgcttgatcctgtgcggctccaggtggaaaacagcccatatagcctcttatcttacgacaggtcaggttactgctctggacttgtacgaccacaagttggatttaattcaagaaaatgcccaacgtctgggagttgcagatcgggttcaaactcaaaaattggatgccagaaaggtgcatgagttttttgaccaggattcctttgataagattttggtggatgctccttgttcaggaatcggtcttttgcgccgaaaaccagatatcaaatacaataaagaaacggcagatttcgcgtccttgcaggaaattcagttagaaatattaggtagtgtttgtcaaatactaggcaaaggtggtataataacttatagcacctgcactatcgtctcagaggagaattttcaagtcgttaaggcctttttagagagtcatcccgagttcgagcaggtaaaactagaacatgaatgtaaggatatcatgaaagacggctgtatcctcattacacctgaattgtatggaagtgatggattcttcatcagtcaatttcgcaagatatcggattag

SEQ ID NO: 2372 - DNA (genomic), 435 bp, Streptococcus pneumoniae; double-stranded, circular
  misc_feature (B) LOCATION 1...435
  hypothetical: NO
  anti-sense: NO
ggggcactcgtggtgacgaggcatggacattttgctacagggatttatagttctttacaattgattgcaggcaatcaagaaaatgtggaggcgattgactttgtggaaggaatgtcagcagatgaactcaagcaaaaaatcttacttgcaatttcaaatgaagaagaagttttaatcctaagtgatctcttgggaggatcgccattcaaggtttcttctaccataatgggagaaaatccagccaaaacaatgaatgttctctcgggtttgaacttagccatgttaatggaagcagtctttgctagaatggctcatagctttgatgaagttgttaataaatcagtagtggcggcccagggcggagtcgtaaatggtaaagaattgttttcaacggatgcagaggaagaggaagaagatttcgaatcgggtatttaa

SEQ ID NO: 2373 - DNA (genomic), 2013 bp, Streptococcus pneumoniae; double-stranded, circular
  misc_feature (B) LOCATION 1...2013
  hypothetical: NO
  anti-sense: NO
gcgcaactcgtggtgaagacgcgatggctaaaaagatcttctaatgcaattactaatgatttagataattcaccaactgttaatcagaatcgttctgctgaaatgattgcctctaattcaaccactaatggtttagataattcgttaagtgttaatagtatcagctctaatggtactattcgttccaattcacaattagacaacagaacagttgaatctacagtaacatctactaatgaaaataagagttataaggaagatgttataagtgacagaattatcaaaaaagaatttgaagatactgctttaagtgtaaaagattatggtgcggtaggtgatgggattcatgatgatcgacaagcaattcaagatgcaatagatgctgcagctcaagggctaggtggaggaaatgtatattttcctgaaggaacttatttagtaaaagaaattgtttttttaaaaagtcatacacacttagaattgaatgagaaagctacaattctaaatggtataaatattaagaatcacccttccattgtttttatgacaggtttatttacggatgatggtgcgcaagtagaatggggcccaacagaagatattagttattctggtggtacgattgatatgaacggtgctttgaatgaagaaggaactaaagcaaaaaatctaccacttataaattcttcaggtgcatttgctattgggaattcaaataacgtaactataaaaaatgtaacattcaaggatagttatcaagggcatgctattcaaattgcaggttcgaaaaatgtattagttgataattctcgttttcttgggcaagccttacccaaaacgatgaaggatgggcaaatcataagtaaggagagcattcagattgaaccattaactagaaaaggttttccttatgccttgaatgatgatgggaaaaaatctgaaaatgtgactattcaaaattcctattttggcaaaagtgataaatctggggaattagtaacagcaattggcacacactatcaaacattgtcgacacagaacccctctaatattaaaattttaaataatcattttgataacatgatgtatgcaggtgtacgttttacaggattcactgatgtattaatcaaaggaaatcgctttgataagaaagttaaaggagagagtgtacattatcgagaaagcggagcagctttagtaaatgcttatagctataaaaacactaaagacctattagatttaaataaacaggtggttatcgccgaaaatatatttaatattgccgatcctaaaacaaaagcgatacgagttgcaaaagatagtgcagaatatttaggaaaagtatcagatattactgtaacaaaaaatgtaattaataataattctaaggaaacagaacaaccaaatattgaattattacgagttagtgataatttagtagtctcagagaatagtatattcgggggtaaagaaggaattgttattgaggattcaaagggtaaaataaccgttttaaataaccaattttataatttatccggtaagtatatatcattcatcaaatctaatgcaaatgggaaagaacctgttatacgtgatagcgatggtaatttcaatattgtaacggagaatgggctttacaaaattgtaacaaataatttaagtgataaaaacgaaaaagaaaaaaacaaagaggaaaaacaatataattcaaataatgtaattgatagtaaccagaagaacggagagtttaactcaagtaaagataatagacaaatgaatgacaagatcgacaataaacaagataataagacagaagaagtaaactataaaatagttggagatggcagagaaactgaaaatcatattaataaatctaaagaaatagtagatgtaaaacaaaaattaccaaagagaggttcgtacaagattatggaactatttttaacagtgacaggaattggtttacttttgacactaaaagggttgaagtattatggtaaagataaataa

SEQ ID NO: 2374 - DNA (genomic), 375 bp, Streptococcus pneumoniae; double-stranded, circular
  misc_feature (B) LOCATION 1...375
  hypothetical: NO
  anti-sense: NO
atggaactcgtattaccaaataattatgttgttcttgagcaagaagagatgatgtatcttgatgggggattttctattccgagatggcctgttgcaacagccattaatatagcttttaatggtgttttaggtggaggagcaatcagtctagttagaaattatattcgtaattatggtttgcggcgagttacaagcgcaattgctggagcagctgcaagatatgttggggtacgagttgcaaatagagtggcaggatttgcactgtctgctattaatggatttgcagcttggatgtcaattggcgatgctattacaacaatctgggccaacaatgatgtaaataggagagacccaaatttaaacgccttgtggtaa

SEQ ID NO: 2375 - DNA (genomic), 495 bp, Streptococcus pneumoniae; double-stranded, circular
  misc_feature (B) LOCATION 1...495
  hypothetical: NO
  anti-sense: NO
agggaactcgtattaccaaataattatgttgctcttgagcaagaggagatgatgtatcttgatggggggggttatttaagcaagagtgcttgtcaaggaatttgcgcagctttagctatgagtccaggaacttttatagcattgactggagctgcagttttaacaaaaaaactaataaactatattaaggttggaggccttggaggttggcttattggtgcagcagcaggtgtattggctcttatctttttgataaaaatttgtgtagatactacgataaaggttctattaaacagaatctttaaggcaagtaaggtaatgaaaaggaggatattttctctttttgtactagatttgatggtctatatatttttaggttatgttttagtgatacaaaaagacgtatatctgttttcaattctgataattttttctaatttttcagttccctttatcagagaaaaagagtatgaattatttaaaaataagaaatga

SEQ ID NO: 2376 - DNA (genomic), 592 bp, Streptococcus pneumoniae; double-stranded, circular
  misc_feature (B) LOCATION 1...592
  hypothetical: NO
  anti-sense: NO
cgcgctcgtggtgaagctagtaaaagcctcnntggatggacagttggaagaaaaaggaaatttgacagataaaatcaagagtctgtcaaaaggaggtcagcagaagattcagctcattattactctgattcatgaaccagacctgattatcttggatgagccttttagtggattggacccagttaatacagaattgctcaaacaagtcatttttcaggaaaaagagcgcggagcaaccattatcttttctgaccatgtcatgaccaatgttgaggaactttgtgacgatattctgatgatccgagatggccgtgtggtcttgcacggaccagttcaggatgtccgcaatcaatacgggaaaacgcgtctctttgtttcaagtgaacgaagcaaggaagaattggaaaatcttcctcatgtcaaacaggtgagcttgaccaaacaaggtagttggaaattgattttggaggatgagagcgctggaagggaactcttcccaatcttgactcaaggtcaatatatcgcaacatttgaccaacaagcgccaactatcgatgaaatctttaaactagaatcaggagtggaagtatga

SEQ ID NO: 2377 - DNA (genomic), 750 bp, Streptococcus pneumoniae; double-stranded, circular
  misc_feature (B) LOCATION 1...750
  hypothetical: NO
  anti-sense: NO
tctacctgcttttctttttattgcttcaaaccagtctatttttataaaggagttattatggaatttacagatattgcgatggaattatccaagaaagcttggcaggcttcctttcatcatccctttattttacaattacaagaggggaatttagaacctgccattttccgctattacctgattcaggatgcctactatctgaaggccttctcagaaatctatcatcttttggctgataagacttcaaaccaagagatgaaaagactcttgaaacaaaatgctcagggtttagtggagggtgagttatttattcgccaacaatttttcaaggaaatggaaatcagcgaccaggaaatggagcaacatccaattgctccaacctgttatcattacatttctcatatttataggcaatttgcagaaccgaacttagccatcgcttttgcaagcttgcttccttgtccttggttataccatgatataggcaaatcacttaatcttaaaccatcaccaaatcctctctatcaacaatggattgaaacttatattacggatgagttagagcaacagatcagagaggagggagcactggtcaatcagctctatcgagaaagtgatgagacagataagcaaaaaatgctagatgccttccacatcagtgttcatatggaagccaagttttgggagatggcttaccaacaccagacatggaagagcgatttacagtctttagaaaaaggagaagaatag

SEQ ID NO: 2378 - DNA (genomic), 1128 bp, Streptococcus pneumoniae; double-stranded, circular
  misc_feature (B) LOCATION 1...1128
  hypothetical: NO
  anti-sense: NO
attctatgcttctatctatttattcggaaaagaaggcttttcttcagaagaaagctaatagcttatttgaaattttctcctctctgttggatagtcccgtctatctatgttataatgaaagaaggatttaaaatcggaaaaggagtatttatgctaaaattaggtgtcatcggaactggcgctatcagccatcatttcatagaagcagcccataccagtggagaataccaactggtcgcaatctattctagaaaactagaaactgcagcaacctttgcttctcgctatcagaatatccaactattcgatcaattagaagtcttcttcaaatcttcttttgatttagtctatatcgccagtccaaactccttacattttgctcaggcaaaagctgccttgtctgctggtaaacatgttattctcgaaaaaccagctgtcactcaaccacaagaatggtttgatttgattcaaacagctgaaaaaaataactgttttatctttgaagcagctcgtaattaccacgagaaagcctttactactatcaaaaactttttagcagataagcaagtgttaggagcagatttcaactatgccaaatactcttccaagatgcctgacttgttgactggacaaacaccaaatgtcttttcagaccgttttgctggtggagccctcatggatttggggatttatcccctctatgctgctgttcgtctttttggaaaagccaatgacgcgacttaccatgctcaacagcttgacaatagcattgacctaaatggagatggtatcctcttctacccagactatcaagttcacatcaaggctggaaaaaacatcacttccaatcttccttgcgagatttatacaacagatggaaccttgactctcaacacgattgagcatattcgctcagctatttttaccgaccaccaaggaaatcaagtccagcttcctatccaacagactcatcatacgatgactgaggaagtcgctgcatttgcacacatgatccagcaaccagatctgaatctctaccaaacttggctggatgatgcaggctctgttcatgagctactatataccatgcgccagactgctggtattagatttgaggcagaaaaatga

SEQ ID NO: 2379 - DNA (genomic), 1110 bp, Streptococcus pneumoniae; double-stranded, circular
  misc_feature (B) LOCATION 1...1110
  hypothetical: NO
  anti-sense: NO
ggagaatgcttaatgcttgaaagactgaaaagcatacattatatgttttggatcagtttaatttttatggttttccccatcctaactgtagtgactgggtggctttctgcctggcatttattgattgatattctatttgtagtggcgtatttgggtgttttaacaactaagagccagcgtctatcttggctatattggggcatcctgctgacttatgtagttgggaatactgcctttgtggctgttaattatatctggtttttctttttcctatccaatctcttaagctatcatttcagcgtaggtggtttaaagtctttacatgtctggacttttcttcttgctcaagtccttgttgtgggtcaactgttgatttttcagagaatcgaagttgagtttctattctatctacttgtaattcttgcttttgtcgatttaatgacttttggcttggttcggattcgaattgtggaggatttgaaagaagcacaggctaagcaaaatgcccagataaatctattgcttgctgaaaatgaacgcaatcgtatcggtcaagatttgcatgatagtctggggcatacctttgctatgcttagtgttaaaactgatctagccttgcagttatttcagatggaggcttatccacaggtggaaaaggaattaaaagaaattcaccagatcagcaaggattccatgaatgaagttcgaactatcgtggaaaatcttaagtctagaactttgacatccgaactagagactgtgaaaaagatgttagaaattgctggaattgaggtggaaacggataaccaactagatactgctagccttactcaagaattggagtcaatggcttctatgattttgcttgagttggtgaccaatatcatcaaacatgccaaagcgtctaaagcttacttaaaattagaacggacagagaaggaactcattttaacagtaagtgatgatggctgcggctttgcttttctaaaaggagatgagctccatacagtccgagatcgtgtttttccattttcaggagaagtaagtgtaatcagtcagaaacatccaacggaagtgcaagttcgactaccttataaggagagaaactaa

SEQ ID NO: 2380 - DNA (genomic), 1428 bp, Streptococcus pneumoniae; double-stranded, circular
  misc_feature (B) LOCATION 1...1428
  hypothetical: NO
  anti-sense: NO
gcccgatccgtggtgaagacagattgcctttttcgcgaaattattgaccaaggtcattaccactacaactacagcaaagttatttttgatagcatcagctacgacagccgaaaagtaacagaagacactcttttttttgcaaaaggcgctgcctttaaaaaagaataccttctttctgctataacacaaggtttagcttggtatgtagctgaaaaggactacgaagtcgatatccctgtcatcattgtgaacgatataaagaaagccatgagtttgattgccatggagttctatggtaatccacaagagaaactcaaactccttgcctttactggtactaagggtaagacaacagcaacctatttcgcctataacatcttatctcaggggcatagacctgctatgttgtcgaccatgaacacaactcttgatggcgagactttctttaagtcagcgttgacaacccctgagagtattgacctctttgacatgatgaatcaggctgtgctaaatgaccgtacccacctcatcatggaagtctccagtcaagcctatctagtccatcgagtctatggactgacctttgatgtaggagtctttcttaacatcactcctgaccatatcggcccgattgaacaccctagctttgaagactatttctaccacaagcgtctcttgatggaaaatagccgagcagtcatcattaacagtgacatggaccacttctcagtcttgaaagaacaggttgaagatcaagaccatgatttctatggtagccaatttgataaccaaatcgagaattccaaagcctttagcttttcagctacgggtaaactcgctggagattatgatatccaactcattggcaacttcaaccaagaaaatgcagttgctgctggacttgcttgtctccgtctcggagcaagtcttgaggacatcaaaaaaggcatcgctgcaacccgcgttcctggtcgtatggaagtcctcactcagaaaaatggagccaaggtcttcatcgactatgcccacaatggggatagtctgaaaaaactcatcaatgtggttgaaactcatcaaaccggaaagattgctctggttctgggatcaacaggaaacaagggagaaagtcgtcgtaaggactttggcctcctcctcaatcaacaccctgagattcaagtctttctgactgctgatgaccctaactatgaagacccaatggccattgcagatgaaattagtagctacatcaatcatcctgttgaaaagattgcggatcgccaagaagccatcaaggcggcaatggctatcacaaatcacgaattagatgcagttattattgcgggtaagggagccgattgttaccaaatcatccagggcaagaaagaatcctacccaggagatacagccgtcgcagaaaattatttataa

SEQ ID NO: 2381 - DNA (genomic), 243 bp, Streptococcus pneumoniae; double-stranded, circular
  misc_feature (B) LOCATION 1...243
  hypothetical: NO
  anti-sense: NO
gcgcagcccgtccaggtgctcgtagtgagtctcttgaaagctacatcaagcgtctccatgatttggaagaaattgctaacggctttgaaggagtgcaaactagctttgcccttcaagcaggacgtgaaattcgtatcatggtcaatccaggaaaaatcaaggacgacaaagtcacaatcttggctcacaaagttcgtaagaaaattgaaaacaatctcgattatccaggaaatatcaaggtaa

SEQ ID NO: 2382 - DNA (genomic), 1245 bp, Streptococcus pneumoniae; double-stranded, circular
  misc_feature (B) LOCATION 1...1245
  hypothetical: NO
  anti-sense: NO
aattctaccgttagtaacaattacatacacaatcaagtgcacacctgtgaagttggatggaaccgtggccctgccactccaacgttttgtcaggtgtgcttttttcataaaggagttcttatgttagatatcaaacgtattcgtacagattttgaagctgtcgcagaaaaattagctacacgtggtgtagatgctgctgtcttgaatgaaatgaaagaaatcgatgctaaacgtcgtaacatcttggtcaaggttgaaactctcaaagcagaacgtaacacagtttctgctgagattgcccaagctaagcgcaacaaggaaaatacagatgacaagattgctgccatgcaaaatctatctgctgaggttaaagccttggatgctgaattggcagaaatcgatgctaaattgacagaatttacaacgactcttccaaatatcccagctgacagcgttcctgttggggctgacgaagacgacaatgtggaagttcgccgttggggtactccacgcgagtttgacttcgaacctaaagctcactgggatctcggtgaagaccttggtatccttgactgggaacgcggtggtaaggtaacaggcgctcgcttcctcttctataaaggcctcggtgctcgtttggaacgtgctatctacaactttatgttggatgaacatggaaaagaaggctatactgaagtcatcacaccttacatagtcaaccatgattctatgtttggtactggtcagtatccaaaatttaaggaagatacttttgaactcagcgataccaactttgtcttgattccaactgctgaagttcctctggcaaactactaccgtgatgaaatcttagacggcaaagatcttccaatctacttcactgctatgagtccgtcattccgttctgaggctggttctgccggtcgtgatacgcgtggcttgatccgtttgcaccaattccacaaggttgaaatggtcaaatttgccaaaccagaagaatcttacgaagaattggaaaaaatgacagccaacgctgaaaacattcttcaaaaactcaaccttccataccgtgtcgttgctctctctactggagatatgggcttctcagctgcgaagacttacgacttggaagtgtggattccagcacaaaacaattacgtgaaatctcaagctgttcaaacacagaagatttccaagccgttcgtgcccaaatccgttaccgtgatgaagcagatggcaaggtga

SEQ ID NO: 2383 - DNA (genomic), 1224 bp, Streptococcus pneumoniae; double-stranded, circular
  misc_feature (B) LOCATION 1...1224
  hypothetical: NO
  anti-sense: NO
atcaggtgctttcggacgtggtatggttccatcaaggagctttctactggtgaacacgaagcagttgaacttcgcgacggtgacaaatctcgttacggtggtcttggtacacaaaaagctgttgacaacgtaaacaacatcattgctgaagctatcattggctacgatgtacgtgatcaacaagctattgaccgtgctatgatcgcacttgacggtactcctaacaaaggtaaatggggtgcgaatgcaatcctcggtgtgtctatcgctgtagctcgtgctgctgctgactaccttgaaatcccactttacagctaccttggtggattcaacactaaagttcttccaactccaatgatgaacatcatcaacggtggttctcactctgacgctccaatcgctttccaagagttcatgatcttgccagttggtgcgccaacatttaaagaagcccttcgttacggtgctgaaatcttccacgcccttaagaaaatccttaaatcacgtggtttggaaactgccgtaggtgacgaaggtggattcgctcctcgtttcgaaggaactgaagatggtgttgaaactatccttgctgcgattgaagctgctggatatgtaccaggtaaagacgtatttattggatttgactgtgcttcatcagaattctacgataaagaacgtaaagtttacgactacactaaatttgaaggtgaaggtgctgctgttcgtacatctgcagaacaaatcgactaccttgaagaattggttaacaaatacccaatcatcactattgaagatggtatggatgaaaacgactgggatggttggaaagctcttactgaacgtcttggtaagaaagtacaacttgttggtgacgacttcttcgtaacaaacactgactaccttgcacgtggtatccaagaaggtgctgctaactcaatccttatcaaagttaaccaaatcggtactcttactgaaacttttgaagctatcgaaatggctaaagaagctggttacactgctgttgtatcacaccgttcaggtgaaactgaagattcaacaatcgctgatattgcagttgcaactaacgcaggacaaatcaagactggttcactttcacgtacagaccgcatcgctaaatacaaccaattgcttcgtatcgaagaccaacttggtgaagtagctgaatatcgtggattgaaatcattctacaaccttaaaaaataa

SEQ ID NO: 2384 - DNA (genomic), 2736 bp, Streptococcus pneumoniae; double-stranded, circular
  misc_feature (B) LOCATION 1...2736
  hypothetical: NO
  anti-sense: NO
ggggctcgctttagctcaaccgattcttatcagaatcacaagtttacatttaaaacgttaaaatttaaatttagaatgaggttttacttcatggaaaatgttgttgtacatattatctcacatagtcactgggaccgtgagtggtacttgccttttgaaagccatcgtatgcagttggtggaattgtttgacaatctctttgatctctttgaaaatgaccctgagttcaagagtttccacttggatggacaaactattgtccttgatgactacttacaaattcgccctgaaaatcgtgacaaggtccaacgctacattgacgagggcaaacttaaaattggtcccttttacatcttgcaggatgactacttgatctccagtgaagccaatgtccgcaataccttgattggtcaacaagaagctgccaaatggggtaaatcaacccagattggctactttccagatacctttggaaatatgggacaagctcctcaaatccttcaaaaatcaggtattcacgtggcagcctttggtcgtggtgtgaagccgattggatttgacaaccaagtccttgaagatgagcggtttacatcccagttttcagaaatgtactggcagggtgtggatggtagtcgtgttttaggtattctctttgccaactggtacagtaatgggaatgaaatcccagttgacaaagatgaggccttgatcttctggaaacaaaaattgtcagatgtgcgtgcctacgcttcgaccaaccaatggttgatgatgaacggctgtgaccaccagcctgtccagaaaaatctgagcgaagccattcgtgtggcaaatgaactcttcccggatgtaatctttgttcatagttcttttgatgaatatgttcaagctgtagaaggtgcgcttcctgaacacttatcaactgttacaggtgagttgaccagtcaggaaacagatggctggtacacacttgccaacacttcttcatcccgcatttacctaaaacaagccttccaagaaaatagcaacctcctagagcaagtggtagaacccttgactattatcactggtggacacaaccacaaggaccagttgacctatgcttggaaaacacttttgcagaatgcgccacatgatagtatctgtggctgtagcgtggacgaagttcaccgcgagatggaaacgcgttttgccaaggtcaaccaagtaggaaactttgttaaaagtaatttgctcaacgagtggaagggtaaaattgctacggataaggctcaaagtgactatctctttactgtcattaacacaggcttgcatgataaggtcgatactgtcagcacagtgattgatgtggcgacttgtgatttcaaggaattgcacccaacagaaggctacaaaaagatggctgctcttatcttgccaagttaccgtgtggaggacttggatggtcgtcctgtagaggctacaatcgaagacctcggagctaattttgagtatgatttaccaaaagacaagttccgccaagctcgtattgctcgtcaagtgcgcgtgaccattccagttcacctagcgccgctttcttggacaaccttccaattgctggaaggaaaacaagaacaccgtgagggtatttaccaaaacggagtgattgatacaccattcgtaacggtgagtgtggatgacaacatcacagtctatgacaagacaactcacgaagcctatgaagactttatccgctttgaagaccgtggggacatcggaaacgagtatatctatttccaaccaaaaggaacagagccaatctttgcagagcttaagggccacgaggtcttggaaaacacagcttgctatgctaaaatcttgctcaaacatgaattgaccgtgcctgtcagtgcggatgaaaagctagaagaagagcaacaaggtatcatcgagtttatgaagcgtgaggctggacggtcagaagaattgacaaacattcctctggaaactgagttgactgtcttcgttgacaatccacaaatccgcttcaagactcgctttactaacactgccaaggatcaccgtatccgtctcttggtcaagactcataacacgcgtccaagcaatgattctgaaagtatctatgaggtggtgacacgaccaaacaaaccagctgcttcatgggaaaatcctgaaaatcctcaacaccaacaagcttttgtcagtctgtatgacgatgaaaaaggggtgactgtatccaataagggattgaatgaatacgaaatccttggggataacaccattgccgtgaccattttgcgtgcatcaggtgagctaggtgactggggctacttcccaacgccagaagcacaatgcttgcgtgagtttgaagtcgagtttgcacttgaatgccaccaagcccaagaacgcttctcagcctatcgtcgtgccaaagccttgcagacaccgtttaccagccttcagcttgctagacaggaaggaagcgtggttgcgactggtagcctcttgagccattctgttctcagcataccgcaagtttgtccaacagcctttaaagtggcggaaaatgaagaaggctatgtcctccgttactataatatgagtcaagaaaatgtgcgcatatcagaacatcaacaaaccattcttgacttacttgagcgaccatatccagttcattcaggactattggctccacaagagattcgtacagaattcatcaaaaaagaagaaatttaa

SEQ ID NO: 2385 - DNA (genomic), 711 bp, Streptococcus pneumoniae; double-stranded, circular
  misc_feature (B) LOCATION 1...711
  hypothetical: NO
  anti-sense: NO
ttttggtacgtggagttttggtatttatttttagctcaaatccttgcaaatatgattggtttgactacgatttattggttattcaatcaaattattacttatggggttattgcggcggttgttatcttctctccagagattcggactggtttggaacgtttgggaagagcgacagatttcttttccaatgcccctattagtgctgaggaacagatgattcgtgcctttgttaagtctgttgaatacatgagtcctcgtaaaatcggggccttggttgctattcagcgtgtacgtaccttgcaggagtatatttcgacaggaatccccttggatgctaagatttctgcagaacttctcattaacatttttattcccaacactcccctacatgacggtgcggtgattatcaaagaagaacgtatcgctgtgacgtctgcctatctgcccttgacaaaaaacacaggtatttccaaggaatttgggaccagacaccgggcggctatcggtttatcagaagtctcagatgccttgacttttgtcgtatcagaggaaacgggaggaatttcgataacctataatggaaggtttaagcacaacctaacacttgatgaatttgaaacagaattacgtgaaatcttacttccaaaagaggaagtgggtcttagttttaaagaacgatggctaggaggatggaaacatgaaaaaaaatag

SEQ ID NO: 2386 - DNA (genomic), 279 bp, Streptococcus pneumoniae; double-stranded, circular
  misc_feature (B) LOCATION 1...279
  hypothetical: NO
  anti-sense: NO
aatagccacgttggtgcatgtgcagttttggcaggtgtgattgagccagctagtgctgaaccagtccgtgtcggagacaatgttcttatcggtgctaatgcagtggttatcgaaggagtccaaatcggtagtggttcagttgtcgcagcaggagctattgttacccaagatgtcccagaaaacgtggtagtagcaggtgttccagctcgtattatcaaagaaattgatgcccaaactcaacaaaaaacagcgctagaggatgcgcttcgtaccttgtaa

SEQ ID NO: 2387 - DNA (genomic), 480 bp, Streptococcus pneumoniae; double-stranded, circular
  misc_feature (B) LOCATION 1...480
  hypothetical: NO
  anti-sense: NO
atactatttttaacgaaaaaattaagaaattggagaactaatatgaaacttgaaaaacatttgattaagcttaataaacaattttctaacaaggaggaagctatttgttattgtgggcaagttctttatgagggtggatatgttaatgaagactatattgaagccatgattgagcgagataaagagctatctgtttacatgggtaactttatcgccataccgcatggaacagatgcagcaaaaaaggatgtcctcaagtctggtattacagtcgttcaagtccctagaggggttgattttgggaatgtatctaaccctcaagtggcaacggttctttttggtattgctggtattggtaatgaacacttagaaattattcagaaaatttctatcttctgtgcagatgtagataatgttcttaaactagcagatgctcagtcaaaagaggaagtattgcgcttatttgatgctgttgaataa

SEQ ID NO: 2388 - DNA (genomic), 396 bp, Streptococcus pneumoniae; double-stranded, circular
  misc_feature (B) LOCATION 1...396
  hypothetical: NO
  anti-sense: NO
ggtggacacgtgattgatgtcaatctcattaacgggattgcgctagcctttgagggggatgcggtgtattctatgtatattcgccgtcacctcatcctcaaaggtatgaccaaacccaataaactccatcaagaagcaactaagtacgtgtcagccaaggctcaggctcgcctgattgctctcatgttggaggagcaggtcctaacggaaaaagaagaagaaatctacaaacgtggccgcaataccaatagccacacaaaggctaaaaatgcagatgtcgtgacttatcgtatgtccacgggatttgaagcggttatgggctatctccatatgactgagaatctggaacgtcttgagagtttggtttcatggtgcatccaaaaagtggagggctag

SEQ ID NO: 2389 - DNA (genomic), 2037 bp, Streptococcus pneumoniae; double-stranded, circular
  misc_feature (B) LOCATION 1...2037
  hypothetical: NO
  anti-sense: NO
cctttgcacgttcacagggacgctacaccacagatgatggttatatcttcaatgcatctgatatcatcgaagatacggggcgatgcctatatcgttcctcatggagatcattaccattacattcctaagaatgagttatcagctagcgagttggctgctgcagaagccttcctatctggtcgggaaaatctgtcaaatttaagaacctatcgccgacaaaatagcgataacactccaagaacaaactgggtaccttctgtaagcaatccaggaactacaaatactaacacaagcaacaacagcaacactaacagtcaagcaagtcaaagtaatgacattgatagtctcttgaaacagctctacaaactgcctttgagtcaacgccatgtagaatctgatggccttattttcgacccagcgcaaatcacaagtcgaaccgccagaggtgtagctgtccctcatggtaaccattaccactttatcccttatgaacaaatgtctgaattggaaaaacgaattgctcgtattattccccttcgttatcgttcaaaccattgggtaccagattcaagaccagaagaaccaagtccacaaccgactccagaacctagtccaagtccgcaacctgcaccaaatcctcaaccagctccaagcaatccaattgatgagaaattggtcaaagaagctgttcgaaaagtaggcgatggttatgtctttgaggagaatggagtttctcgttatatcccagccaagaatctttcagcagaaacagcagcaggcattgatagcaaactggccaagcaggaaagtttatctcataagctaggagctaagaaaactgacctcccatctagtgatcgagaattttacaataaggcttatgacttactagcaagaattcaccaagatttacttgataataaaggtcgacaagttgattttgaggctttggataacctgttggaacgactcaaggatgtctcaagtgataaagtcaagttagtggatgatattcttgccttcttagctccgattcgtcatccagaacgtttaggaaaaccaaatgcgcaaattacctacactgatgatgagattcaagtagccaagttggcaggcaagtacacaacagaagacggttatatctttgatcctcgtgatataaccagtgatgagggggatgcctatgtaactccacatatgacccatagccactggattaaaaaagatagtttgtctgaagctgagagagcggcagcccaggcttatgctaaagagaaaggtttgacccctccttcgacagaccatcaggattcaggaaatactgaggcaaaaggagcagaagctatctacaaccgcgtgaaagcagctaagaaggtgccacttgatcgtatgccttacaatcttcaatatactgtagaagtcaaaaacggtagtttaatcatacctcattatgaccattaccataacatcaaatttgagtggtttgacgaaggcctttatgaggcacctaaggggtatagtcttgaggatcttttggcgactgtcaagtactatgtcgaacatccaaacgaacgtccgcattcagataatggttttggtaacgctagtgaccatgttcgtaaaaataaggcagaccaagatagtaaacctgatgaagataaggaacatgatgaagtaagtgagccaactcaccctgaatctgatgaaaaagagaatcacgctggtttaaatccttcagcagataatctttataaaccaagcactgatacggaagagacagaggaagaagctgaagataccacagatgaggctgaaattcctcaagtagagaattctgttattaacgctaagatagcagatgcggaggccttgctagaaaaagtaacagatcctagtattagacaaaatgctatggagacattgactggtctaaaaagtagtcttcttctcggaacgaaagataataacactatttcagcagaagtagatagtctcttggctttgttaaaagaaagtcaaccggctcctatacagtag

SEQ ID NO: 2390 - DNA (genomic), 1515 bp, Streptococcus pneumoniae; double-stranded, circular
  misc_feature (B) LOCATION 1...1515
  hypothetical: NO
  anti-sense: NO
gagacgaacgtgaaaaaaattagcttattactagccagtctatgtgccttgtttttagtggcttgttccaatcaaaaacaggtagatggtaaactcaatatcgtgacaaccttttaccctgtctatgaatttaccaagcaagttgcaggagatacggctaatgtagaactcctaatcggtgctgggacagaacctcatgaatacgaaccatctgccaaggcagttgccaaaatccaagatgcagataccttcgtttatgaaaatgaaaacatggaaacatgggtacctaaattgctagataccttggataagaaaaaagtgaaaaccatcaaggcgacaggcgatatgttgctcttgccaggtggcgaggaagaagagggagaccatgaccatggagaagaaggtcatcaccatgagtttgacccccatgtttggttatcaccagttcgtgccattaaactagtagagcacatccgcgacagcttgtcagcagattatcctgataaaaaagagacctttgagaagaatgcagctgcctatatcgaaaaattgcaatccttggataaggcttacgcagaaggcttgtctcaagcaaaacaaaagagctttgtgactcaacacgcagcctttaactatcttgccttggactatggactcaaacaagtcgcaatctcaggcctttctccagatgcagagccatcagctgctcgcttggcagaattgacagagtatgtcaagaaaaataaaatcgcctatatctattttgaagaaaatgcctcacaagcccttgctaacacactttcaaaagaagcaggtgtcaaaactgatgtcctcaatcctttagaaagtctgacagaagaggacaccaaggatggagaaaactacatttccgtgatggagaaaaacctcaaggctttgaaacaaacaacagaccaagaagtcccagcaatcgaacctgaaaaggcagaggataccaagacagtccaaaatggttacttcgaggatgcagctgtcaaggaccgcaccttgagtgactatgcaggtaactggcaatcagtttatcctttccttgaagacggcacgtttgaccaagtctttgactacaaggctaagttgactggtaagatgacccaggctgagtacaaggcttactatacaaaaggctatcagacagatgtgactaagattaacattactgataatactatggaatttgttcaaggtggacaaagcaagaaatacacttacaagtatgtcggtaagaaaattttgacttacaagaaaggcaatcgtggcgtgcgtttcctctttgaagccacagatgctgacgctggacaattcaaatatgttcagtttagtgaccacaatgttgccccagttaaggcagaacatttccatatcttttttggaggtacaagccaagaagctctatttgaagaaatggataattggccaacctactacccagataacctatctggccaagaaatcgcccaagaaatgttggcgcattga

SEQ ID NO: 2391 - DNA (genomic), 261 bp, Streptococcus pneumoniae; double-stranded, circular
  misc_feature (B) LOCATION 1...261
  hypothetical: NO
  anti-sense: NO
ggcagacgcttatccacagagtctgtcgggtgggcaacaacaacggattgcatcgcgcgtgggttggctatggtaccagatgttttgctctttgacgaaccaacttcagccttggatcctgaaatggtaggtgaggtattggctgttatgcaagaccttgccaagtcagggatgactatggttatcgtaacacatgagatgggatttgcccgtgaggtggcagatcgtgttatctttatggcagagcggtgtggttgttga

SEQ ID NO: 2392 - DNA (genomic), 1359 bp, Streptococcus pneumoniae; double-stranded, circular
  misc_feature (B) LOCATION 1...1359
  hypothetical: NO
  anti-sense: NO
gaggctagcgtcatgatgaagttcatattggatattgttagtacaccagctattttagtagctttaattgcaatcttaggattagttcttcagaagaagaaattacctgatattattaaaggtggaattaagacctttgttggtttcttagttgtatctggtggtgcaggaattgtacaaaattctttaaatccatttggtaccatgtttgagcatgcttttcatttatctggcgttgtgccgaataatgaagcaattgtagctgtagctttaacaacatatggctcagctactgcaatgattatgtttgcaggcatggtgttcaatatcttaatcgctcgttttactcgatttaaatatatctttttaacagggcaccacactctatatatggcatgtatgattgcggtcattttatcagttgctggctttactagcttgcctctcatcttactaggaggattagcactcggtattattatgagtatttccccagcatttgtgcaaaaatatatggttcaattaactggaaatgacaaggtggctttaggtcatttcagttctttgggatattggttgagtggttttactggtagccttatcggtgacaaatcaaaatcaacagaggacattaaatttccaaagagtttagcttttttacgtgatagtactgttagtatcactttatctatggcagttatttacattattgtagctatctttgcagggtcagaatatatagaaaaagaaatcagtagtggtacaagtggtctagtttatgctttacaattagcaggtcaatttgcagcaggggtatttgttattttagcaggtgttcgccttattttgggcgaaattgttccagcctttaaaggtatttcagagcgtcttgtacctaattcaaaacctgctttggattgtccgattgtttatacttatgcacccaatgcagttctaattggatttatctctagttttattggtggtttagtaagtatggcaattatgattgcttcaggaacggttgttatcttaccaggcgttgtgcctcatttcttctgtggagcgactgcaggtgtcattgggaatgcatctggtggtgttcgtggagccactattggagcatttttacaaggtattttaatcagttttcttccagtctttttaatgccagttttgggaggactcggtttccaaggatcaactttctcagatgcagattttggtctatcaggaattattttaggaatgttaaatcaatttggctcacaagcaggcattgtgattggtcttgttcttattttagcagttatgtttggagtatcctttattaaaaagccatctgcaaaggaggaataa

SEQ ID NO: 2393 - DNA (genomic), 201 bp, Streptococcus pneumoniae; double-stranded, circular
  misc_feature (B) LOCATION 1...201
  hypothetical: NO
  anti-sense: NO
atggaaagcgttcttgaaagcttgaaacaagaaaaagaccacctcgaaaaaatcattaaggtagttacctctggtggtaaatttctgagattgccgtatcaaaaaaagtcacgctcgattagtgagaatctgaaattgatttctcaaaatcttgataaattgagcgagcaagttcaacaaaccacgaatcagcattcatga

SEQ ID NO: 2394 - DNA (genomic), 426 bp, Streptococcus pneumoniae; double-stranded, circular
  misc_feature (B) LOCATION 1...426
  hypothetical: NO
  anti-sense: NO
cgactgagcgtattgttgatgcttatcttaagagcgaggcggtatcatagaatgtgcttaatctgtcagagaatcgaactcattaaagctgggcaaaatccctactttgtcaaagagttggaaacaggctatcttgtgattggagaccaccagtattttgcaggatatagtctttttctagctaaggaacacgttaccgaattgcaccatttgaaaaaggaaacaagactccgttttctcgaagaaatgagtctagtccaagaggcagttgccaaggcatttgctgctgagaaaatgaatatcgaactgctagaaaatggcgatgcccatcttcattggcatctgtttcctagacgaagaggtgatatgaatggtcacggtctcaagggacgtgggccagtttggtgggtccctttgaagaaatga

SEQ ID NO: 2395 - DNA (genomic), 276 bp, Streptococcus pneumoniae; double-stranded, circular
  misc_feature (B) LOCATION 1...276
  hypothetical: NO
  anti-sense: NO
caagctggcgtggtagtagtagataatacatcttatttccgtcaaaatccagatgttcctttggttgttccagaggtcaatgctcatgcacttgatgctcacaacggaatcattgcctgccctaattgttcaacaatccaaatgatggtggctcttgagcggtttcgccaaaaatggggcttggagcgtatcattgttttaacttatcaagccagtattcaggagctggtatgggagcaattcttgagacacaacgtgaacttcgtgaagtcttga

SEQ ID NO: 2396 - DNA (genomic), 219 bp, Streptococcus pneumoniae; double-stranded, circular
  misc_feature (B) LOCATION 1...219
  hypothetical: NO
  anti-sense: NO
cttcctagcttagatggctcgcagcaccgccatttctctggactaagacaagtgaaaattaattctcaactttcttattataacgtttttttaagcttgcgtcaactggaaatgatctccgttgaattagaccaattccctacatctctgattactttttcaggatatattttttcttactgccgtttttctttttatcccaaattttcatattactaa

SEQ ID NO: 2397 - DNA (genomic), 306 bp, Streptococcus pneumoniae; double-stranded, circular
  misc_feature (B) LOCATION 1...306
  hypothetical: NO
  anti-sense: NO
gattatagcttaatggatacaacattgttttatggaatagtgattgtcttggcagtgagtccccttttactgtcaagctttcattctattcgtcagcaaaagttgcttcgcaaacagatggagcaacgacaagagtatttagcttctttaacatctggtgatgaagtgttgttattgtctggaattcatggaaaaatcatttctatccaagatgacttggtctccttgcagattgcaaaaggtgtggtcatctatgtagaaaaggaaagtgtaatgggaaagacaaaagaactgctttttaagtag

SEQ ID NO: 2398 - DNA (genomic), 1383 bp, Streptococcus pneumoniae; double-stranded, circular
  misc_feature (B) LOCATION 1...1383
  hypothetical: NO
  anti-sense: NO
tataatagctttatgaataaaaaacgaacggtggacctgatacatggtccgattcttccctcgctcttaagcttcacctttccaattttgctatcaaatatttttcaacagctctataacactgctgatgtcttgattgttggacgatttcttggtcaagaatccttggctgcagtaggagcgacgacagcgatttttgacctgattgtaggttttacacttggtgttggcaatggcatggggattgtcattgctcgttattatggggctcggaatttcactaaaatcaaggaagcagtagcagctacttggattttaggtgctcttttgagcattctagttatgttgctgggctttcttggcttgtatcctctcttgcaatacttagatactcctgcagaaattcttcctcaatcttatcaatatatttctatgattgtgacctgtgtaggtgtcagctttgcttataatctttttgcaggcttgttgcggtctattggtgacagtctagcagccctgggatttctgattttctctgccttggttaatgtggttctggatctctattttattacgcaattgcatctgggagttcaatccgcaggacttgctaccattatttcgcaaggtttatcagcggttctctgcttttattatattcgtaaaagtgtgccagaactcttgccacagtttaaacatttcaaatgggacaaaagcttgtacgcagatctcttggagcaaggtttggctatgggcttgatgagttcaattgtatctatcggcagtgtgattttacagtcttctgttaatacatttggtgcagtgattattagtgcccagacggcagctcgacgcattatgacctttgcccttcttcctatgaccgctatttctgcatcaatgacgacctttgcttctcagaatctaggagctaagcaacctgaccgcattgttcaaggtcttcgaatcggcagtcgtttaagtatatcctgggcagtttttgtttgtattttcctcttttttgccagtccagctttggtttccttcttggctagttcgacagatggttacttgatagaaaatggaagtctctatctgcaaatcagttcaaccttttatcccattttgagcctcttgttgatttatcgcaattgcttgcagggcttggggcaaaagatccttcctctagtttctagctttattgaactaatcggaaaaatcgtttttgtggttttgattattccttgggcaggatataagggtgttatcctttgtgaacctcttatctgggttgccatgacagttcaactgtacttctcactattccgtcatcccttgataaaagaaggaaaggcaattttggcaaccaaagtgcaatcctag

SEQ ID NO: 2399 - DNA (genomic), 888 bp, Streptococcus pneumoniae; double-stranded, circular
  misc_feature (B) LOCATION 1...888
  hypothetical: NO
  anti-sense: NO
attaacagcttcagagctacgaaaggaaaaaactcaatggctactattcaatggtttcctggtcacatgtctaaagctcgtcgacaggtgcaggagaatttaaaatttgttgattttgtgacgattttagtagatgcacgcttgcctctatctagtcaaaatcctatgttgaccaagattgttggtgataaaccaaaactcttgattttaaacaaggccgacttggctgatccagcaatgaccaaggaatggcgtcagtattttgaatcacaaggaatccagacgctagctatcaactccaaagagcaagtgactgtaaaagttgtaacagatgcggccaagaagctcatggctgataagattgctcgccagaaagaacgtgggattcagattgaaaccttgcgtactatgattatcgggattccaaacgctggtaaatcaactctgatgaaccgtttggctggtaaaaagattgctgttgttggaaacaagccaggggtcacaaaaggtcaacaatggcttaaaaccaataaagacctggaaatcttggatacaccggggattctctggcctaagtttgaggatgaaactgttgcacttaagttggcattgactggagctatcaaggatcagttgcttcctatggatgaggttaccatttttggtatcaattatttcaaagaacattatccagaaaagctggctgaacgcttcaaacaaatgaaaattgaagaagaaccgtctgtgattattatggatatgacccgcgccctcggtttccgtgatgactatgaccgtttttacagtctcttcgtgaaggaagttcgtgatggcaaactcggtaactataccttagatacattggaagacctcgatggcaacgattaa

SEQ ID NO: 2400 - DNA (genomic), 1959 bp, Streptococcus pneumoniae; double-stranded, circular
  misc_feature (B) LOCATION 1...1959
  hypothetical: NO
  anti-sense: NO
acatcattagtaaaaggagttagattgatgaataaaagaaaagttagtttagaagatttttataaatggtatagtctaaataaagaagagttattaaataaggcaactgttggtgaaaagtttaatgataaattaaaagaagagtttctccaggaatggcctttggataggattttaacaatgtcaatcgatgaatatgtaataggaaagggacagcaaaataagtctttatgctacgctcttgagaagggaaaatacaaaaatctatttcttggaatttctggtggctcagcttcaaaatttggtatttattggaataaaaaaacaaacaaatataaagatcaagctaataatgagatttcagagttggatcagcgattttcaaaattaaaatcagatttgtatgaaattatcaaagaaggtattcgttttaactttgaaaatcctatttttgatatgaaaagatcaacaaatgaatttattggtcgttctgctatggtgacaaaattactttgtatctatactgagggagatcctttctttggtgtaaatattaatagtcagaaagaattttggaaccactttgtttctcagacaaatcaaggtggaccttatctgcaaaatcataaaataattgaactggtgtccaaaacttatcctgagttggagccatcgaaattaggaactatgctttttgagtattctaagctttttatggaaaataaggaagacaatagtacaatggattcatcaaacaattttagtcatcaattaactcaatctctattaaagtctccaaaccttatccttcgtggtgctcctggcacaggaaagacttatcttgctaaagaaattgccaaagaattaacggatggcaacgaagatcaaatcggatttgtacaatttcacccatcatatgattatacggattttgtagaaggtttaagaccagtatcaaatggggatggagctattgagtttaggctacaggacggtatttttaaagatttttgtcagaaatcaaaagaaacccaattgattggaggacaagataattttgatgaggcttgggattcttacttagaatatataaatgttgctgaagaaaaagaatatataacaaaaacatcttacttatctgttaatagtagacaaaatttgtcagtaaattatgatagtggtgttccaggatggtcactacctagcaaatatgtttacgagttgtataaagataaaaattataataagcaagaatactacaaaagtggtggaaaaactgtcctagaaacattgagaaagagatttggtttgaaagactatgtttccccaacagaaattgatactgataagaaattcgttttcatcatcgatgaaatcaatcgtggggagatttctaagatttttggcgaactctttttctctatcgaccctggctatcgtggtgaaaaaggaagtgtttctacccaatatgcaaatctacacgaaactgatgaaaagttctatatccccgaaaatgtttacatcatcggaactatgaatgatattgatcgttcagtggatacctttgattttgctatgcgtcgtcgttttcgttttgttgaagttactgccgagggtcaagttggcatgttggataaagagctgaatatccatgcagaagaagcaaaaattcgtctaagaaacttgaacgctgctatcgaaaatgttcaggaattaaacagtcattatcatattggaccaagttattttcttaagttgaaggatgtagattttgactatgaattactctggtccgattatattaagcctctcctagaagactacttgcgaggttcttatgatgaggttgaaactttggaaactttgaaaaaagcatttgaactgacaaataatgagcaaaaagatcaggcagtagctgatgacaatgaaagcgatgaaaacgatgatgcggattactga

SEQ ID NO: 2401 - DNA (genomic), 891 bp, Streptococcus pneumoniae; double-stranded, circular
  misc_feature (B) LOCATION 1...891
  hypothetical: NO
  anti-sense: NO
aatcaattagtctcaagctttctatcaatttcttctccaaaatatgctataataatagcaaaagataaagaaggaagacctatgattaaactactagccttggatatggatggaaccctcctcaatgaagccaaggaaatcccacaggctcacatcgctgctattcaccaagccattgaaaaaggtgtcaaactggttctctgtacgggtcgcccccttttcggtgtcctcccctactacaaaaaactgggactcgacctccagaatgagtatgtgattgttaacaacggttgttcaactcaccagactagcgactggggcttggttgactggcaagaacttagtccagctgacatcgaatacctctatgaccttgctgaaaagagtgatgttcagttgacactttttgacgagtcacattattttgttctcggtggcaaacccaatcaagttattgaaaatgatgctaaactagtattttcagacctgactgaaatttctcttgaagaagcgactagtggaaagttacggatgttccaaggtatgtttttaggaacaaaagaacaaacagacgattttgagcagcgttttgctgaagagctttgccaacgattcagtggagttcgttcgcagcctgtcatttatgaagcaatgccgcttggaacgacaaaggctactgctctttcacgactagctgagattttgaagattgattcctcagagattatggccatgggcgatgctaataacgatatcgaaatgctccagtttgcagggcttgggattgcaatgggaaatgccagcgattatgtcaaatctcttgcggatgccgttacctcaagcaacgaagaagacggcgttgcgcgtgctattgagaaatatattctataa

SEQ ID NO: 2402 - DNA (genomic), 864 bp, Streptococcus pneumoniae; double-stranded, circular
  misc_feature (B) LOCATION 1...864
  hypothetical: NO
  anti-sense: NO
cacatgttagttttttcagaataccagactggaacaatcgaccttgccctaagcttttatggatatgaggaatgcacacctaattactcttttggtccagccattcgtgatacatacgttctacattacattactaaaggacaaggaaaattttattacaagggtaaaattgttgatttaaaagaaggagatttctttctattaaaaccagaggaactaaccttttatcaagcagatagtaaagaaccttgggcctactactggttaggaatcactggagggaaatcccctgattattttgctctttctcaaatttctgatcaatcctatctcatccaatctgaaacttgtcatacccagactactgcaaaactcatctcagacattgtccgcttcgctcagattacaaaatcaagtgaattagctcaactccatatcatgggacaacttcatgaactgatgtttcatctgggaactattgctcccaatcagaaaaaaaagaatatttcatcaacccaccaactctatcttgaatgcaaacgattaattgatagccactatcctcaatcacttacaattcaagatttagcaaaagaactatccgttcacagaagctacttatcaagcgtattcaaagaatttaataccttatcacccaaagaatacctactctacgttcgaatgcaccgagctagacaacttctcgaaaatacccaagagtccatcaaggtaattgcatactcggtaggtttttcagatccactccatttttcgaaagcttataaacaatactttaatcagactccaagtcatacaagaaaagaatactctcaataccaactagtaagaaaggcaacattatga

SEQ ID NO: 2403 - DNA (genomic), 417 bp, Streptococcus pneumoniae; double-stranded, circular
  misc_feature (B) LOCATION 1...417
  hypothetical: NO
  anti-sense: NO
ccaatgttagtacctaaacgtgttaaacaccgtcgtgagttccgtggaaaaatgcgcggtgaagcaaaaggtggaaaagaagtagcattcggtgaatacggtcttcaagctacaactagccactggatcactaaccgccaaatcgaagctgctcgtatcgccatgactcgttacatgaaacgtggtggtaaagtttggattaaaatcttcccacacaaatcatacactgctaaagctatcggtgtgcgtatgggatctggtaaaggggcacctgaaggttgggtancaccagttaaacgtggtaaaatgatgttcgaaatcgctggtgtatctgaagagattgcacgtgaagcgcttcgacttgctagccacaaattgccagttaaatgtaaattcgtaaaacgtgaagcaaaataa

SEQ ID NO: 2404 - DNA (genomic), 261 bp, Streptococcus pneumoniae; double-stranded, circular
  misc_feature (B) LOCATION 1...261
  hypothetical: NO
  anti-sense: NO
tcaactatagtgaagttcaatatcaagaagatgttgaaacaatccgaaaagaggctgaaatcatcgaaggagagtaatatgggactcataaaaactctagctaaaatttatggtaattactttttgaccgtgcaaggtgtaaaagtgatgaaaacgataaagaaagctgaccatgtcgttgttggtctgggcaaactttttattgcagataagctaatggatacggctcggtggctcattaagccagaggagagagaatga

SEQ ID NO: 2405 - DNA (genomic), 276 bp, Streptococcus pneumoniae; double-stranded, circular
  misc_feature (B) LOCATION 1...276
  hypothetical: NO
  anti-sense: NO
cacatcatagtttctaaagcattgttagagattactttaaaatcctcttatcaatttgttcatattctatttcaatctactatatatatcccatcaactatgcatcataatttaggtaactcatactcaataaaaatcaaaaagcaaactagaaagctaggcacagactgctcaaaacaccgttttaaggttgtggatagaactgacgaagtcagctcaaaacactgttttgaggttgtagatacgactcacatatatacgacaaggcaacgctga

SEQ ID NO: 2406 - DNA (genomic), 207 bp, Streptococcus pneumoniae; double-stranded, circular
  misc_feature (B) LOCATION 1...207
  hypothetical: NO
  anti-sense: NO
tctacaatagttcaagtattaagtgaggtggataatctaaatttagtgtggtatactatttttgtcatcggttaccgattacgttcctatgggttcgtgagaggaggtgaaactaatgagccttataccagagctcgctcttactattatagcagatgttatagctggaattatcttgtatttcgtctgcaaatggctagatggtaa

SEQ ID NO: 2407 - DNA (genomic), 255 bp, Streptococcus pneumoniae; double-stranded, circular
  misc_feature (B) LOCATION 1...255
  hypothetical: NO
  anti-sense: NO
cagtggatagttggctgcaccaccataacttctgtagtccccaacccaagcatctttttggtggttacggataaagcgggtgatggcactgttgatacctttattggtgtagccaccgtaggtcaagtcagctgcccagtgatggaaggtagagtcgtactcaccaccatggccccactcgatcgcaaagcgccagccttgtttgttaatttctttagcaagaacgtgggtagcccaggcaccgttatcacctga

SEQ ID NO: 2408 - DNA (genomic), 396 bp, Streptococcus pneumoniae; double-stranded, circular
  misc_feature (B) LOCATION 1...396
  hypothetical: NO
  anti-sense: NO
agaagagtagtcatggataggaatatagatcaagaattagtaagtattataataccaacacataataggtatgaatctctgattagagctgtgaaaagttgtttacatcaaagttataaaaatatcgaagttataattattgatgataattatagtaatgtaaatttaagaaataaaattatccatcaatttggctataccaatcatagaattaagttaattttaagtaatgaagatttaggtgcaactaatgccagaaacataggtataaaaaattctagaggtaagtatatatcatttttagacgatgatgatgaatatatgccagatcgaattttaaagttgatggcntgtttaaaaanaccgtggaatgaagaatgtagctctagtttatag

SEQ ID NO: 2409 - DNA (genomic), 459 bp, Streptococcus pneumoniae; double-stranded, circular
  misc_feature (B) LOCATION 1...459
  hypothetical: NO
  anti-sense: NO
gcggaantagtgggggtgggggtgggtagggcactgccaacgttgnntggtatgaaccaagttctcaaagtcttatctgaagttggcattcaaaaaatcatgttctttttgantgttcttttttatggaaataactgtattgacaagccggtgattgaagataccntgtttgaccctgtcaacccttatgcagagacaaaactgatgggcgaacgaatgatttactggatggccaatcgctacgactggaaatatgttattttccgttactttaatgttgctggggctgaaatggatgcttcaaacggtctgcgtgtgaaaaatccaactcacatcattccaaatatcaacaagaccgcattgggacaaaatgatagcttaaaaatatttggagatgactacgatacacgtgacggttcatgtattcgagattacatttatgtcttggaccttgcatag

SEQ ID NO: 2410 - DNA (genomic), 786 bp, Streptococcus pneumoniae; double-stranded, circular
  misc_feature (B) LOCATION 1...786
  hypothetical: NO
  anti-sense: NO
catggttcagtttgtgggggttcagcgtccacgctacaaggtagggacttcctatccagttatctgggtggacgtaccgctcatggatatctcgtccagcatggtgcgtgccttccttgcccaaggtcggaaacccaactttctcctacctcagccagtgctagactacatcgagaaggaggggctctactgatgtcctatcaagactatatcaactgctcccgtgaggctttgttggaaaaaatggcagagcttctacctgagaaacgtctaacccattgtctaggtgtggagcgtgccgctatggaattagctcagcgctttggtgtagatgttgagaaagcaagtctagcaggtcttcttcatgactatgctaaaaagttgtcagatcaggaatttctagacttgattgaccgttaccagctagaccctgacctcaaaaactggggcaataatgtctggcatggtatggtcggaatttacaaaattcaggaagatttggatttgcatgattcagaaatcctgcgagccattgaagtccatacagtcggtgctggtcaaatgacagacctagataaggtcatctacgtcgcagactatatcgagcacaatcgagcctttcctggagtagatgtggcgcgtgagattgcaagtctatcgctcaataaggcggtggcctacgaaacagctcgtaccgtggagtatctagctcatcagggattccccatctatccccaaacccttgaaacctataacgcctttgtgcactatttgaaagaggactaa

SEQ ID NO: 2411 - DNA (genomic), 1074 bp, Streptococcus pneumoniae; double-stranded, circular
  misc_feature (B) LOCATION 1...1074
  hypothetical: NO
  anti-sense: NO
attcttccagttcgccttcctcgctgcgttcgcgcagcccctggcgctcggcgtcgacgtggcgctccagttcggcgaacttctccagttgccgctggcgttccagcagttctcgccggcactgccgcaggcgctcgcgctccccttcgaggcgctgcgcggtctcggcgcagtcctgttccaggccggcttccttttcccgcagcagtcctacctgctgctgccaggcttccaggcgccggcggtcgagcatggccgcctggcaggcgagaaacagccgttgctcttcggccagtcgccagtcgcggtagtcccgttgcgccgcctggcgctcggtgtgttcctgcgccgcggcgcgaacccgtagcaattggcggccctgggcgcgctcggcccggtccaggcgcaggcgtcggacgcgcaacagcagcgccaggctcatgcgcagaggctccgcaactgcgcgcaggcctgtgcgtaatcgctggtttcgtgggtaccctggcgcagccactggcggatcgccgcgatcttctcgatggcctggtcggcttcgctgtcctggcctttctggtattcgccgatcttcagcagcaactcgacttcctcgtacttcgccagccattcgcgcaagcgtccggccgcatggcgctgatcgtcgtcgacgatctggttcatgacccggctcaccgagtgcagcacgtcgatggccggatagtggttggcggcggccagcttgcgcgacagcacgatgtgcccgtcgagaatcgagcgggtctcgtcggccaccggctcgctcatgtcgtcgccttccaccagcacggtgtagagcgcggtgatcgagccccgctcggattgcccggcacgctccatcaagcgtggcagcgcggcgaacaccgatggcggatagccgcggcgggtgggcggttcaccggccgccaggccgatttcgcgctgggccctggcgaagcgggtcagcgagtccatcagcagcaggacgcggcgtccctggtcgcggatatactcggcgatgctggtggcgacgaaatcggaattgagctttacaccacgtga

SEQ ID NO: 2412 - DNA (genomic), 1578 bp, Streptococcus pneumoniae; double-stranded, circular
  misc_feature (B) LOCATION 1...1578
  hypothetical: NO
  anti-sense: NO
tattttgcagttgttggaggacaaataatgacaccagaacaacttaaagcaagtattctccaaagagcgatggaagggaaattagtgccgcaaaatcccaatgacgaacctgcaagtgaattattaaagagaattaaagctgaaaaagaaaaacttatcagtgaaggaaaaatcaaacgagataaaaaggaaactgagatatttcgtggtgatgatgggaaacattatgggaagtttgctgatggaagtactcaagaaattgatgttccttatgatattcctgatacttgggagtgggtgaggataaaatcaatttattggaattttgggcaaaataagccagagaaatcctttaggtatatagatacgtctagtattgatagaaaaaagaacataatcaactacaaaaatctacaatatctttcacctgaacaagcgccttcccgtgccagaaaattagtttcgcagaatagtgtcttattttcaacagttagaccatatctaaaaaatattgctgtagttagagaacttaaagagtatttgatagctagtacagcatttattgttttggatactttacttaacgaaacatatttgaaatattatttattatcagataattttatcaatcgtgttaataataaatctactggaacaagttatcctgcaatcaatgattataattttaatctattattaattgctctccccccactatccgaacaacaacgaatagtagaagcaatcgaatcagctttagaaaaagtagatgaatatgctgaaagttataatagactagaacagctagataaagaatttccagataaactaaaaaaatctattcttcaatatgctatgcaaggaaaattagttgaacaagacccaaatgatgaatcagtcgaagttttacttgaaaaaatacgagcagaaaaacaaaaactctttgaagaaggcaagattaaaaagaaagatttggacatttctattgtttcccaaggagatgataactcttattatgaggaagtaccttgtgaaataccagaaagttgggaatgggtgaggttaaacgatataacctcctacattcaaagagggaagtctccaaaatattcaaatattcctatataccctgtgattgctcagaaatgtaatcaatggtctggcttttctattgacttagcaagatttattgatcccgaaacagttcatagttaccagaaagaaagattactaagagatggtgatttaatgtggaattcaacaggtctaggtacgttaggacgattagctatttaccatgaaaataaaaatccttatggctgggctgttgcagatagccatgttacagttataagagtcttatcgggagttattaattgccatttcatctataattttctttcctctcctattgttcagtcagttattgaagaaaaagcgtcgggtagtacaaaacaaaaagaattattaacgaaaactataaaagaatatttaatccccctcccaccccttcctgaacaatccagaatcgttgataaaatcgaacaatttttcgcccatattgacgcactaatttag

SEQ ID NO: 2413 - DNA (genomic), 1596 bp, Streptococcus pneumoniae; double-stranded, circular
  misc_feature (B) LOCATION 1...1596
  hypothetical: NO
  anti-sense: NO
tattttgcagttgttggaggacaaataatgacaccagaacaacttaaagcaagtattctccaaagagcgatggaagggaaattagtgccgcaaaatcccaatgacgaacctgcaagtgaattattaaagagaattaaagctgaaaaagaaaaacttatcagtgaaggaaaaatcaaacgagataaaaaggaaactgagatatttcgtggtgatgatgggaaacattatgggaagtttgctgatggaagcactcaagaaattgatgttccttatgatattcctgatacttgggagtgggtgaggttttctacattggttgaaattgtcagaggtggctctccacgaccaatcaaagattatcttacttctgaagtagatggaataaattggataaaaataggtgatactgaaaagggtgaaaagtatataaataatgttaaagaaaaaatcaaaaaatcagggcttaacaaaactagatttgtaaaaaaaggtacatttttgttaactaattctatgagttttggtagaccttatattttgaatgttgatggtgcaatacacgatggatggttggctatttcgaactatgaaaactcattaaataaagattacctattctatattctttcatcaaatgtagtttattctcaatttctatctctaattagtggagctgttgtgaaaaacttgaatagtgataaagttgcttctattcttatccctctccccccactatccgaacaacaacgcataatagaagcaatcgaatcagctttagaaaaagtagatgaatatgctgaaagttataatagactagaacagctagataaagaatttccagataaactaaaaaaatctattcttcaatatgctatgcgaggaaaattagttgaacaagacccaaatgatgaatcagtcgaagttttacttgaaaaaatacgagcagaaaaacaaaaactctttgaagaaggcaagattaaaaagaaagatttggacatttctattgtttcccaaggagatgataactcttattatgggaacaaagacgaaacaacctcttatcctatatataaaatcccagaagcatggagatatattaaatttgctagcctagttaacttcagaataggaaaaactcctccacgcagtgaagctactttttggggaactgaaataccttgggtatctatatcagatatgcctatatctggttatgtaactaatacgagagaatctatttctaaattagcattaaaatcaaagaaaatagacatttcacctaaaggaactttattaatgagttttaaattatctattggaaaagttgccatattggatattcctgccactcataatgaagccattatatcgatattcccctatgctaataaagaaaatattatcagagattacttaatgatatttttgccacttatctctactttaggtgattcaaaagatgctatcaaagggaaaacattaaatagtaccagtatctccgaattattaatccctatttctaatcatgaagagatgaaaagaatcattttcaaagttgatttactttttcaaaaagtttctcaactttttgagtaa

SEQ ID NO: 2414 - DNA (genomic), 225 bp, Streptococcus pneumoniae; double-stranded, circular
  misc_feature (B) LOCATION 1...225
  hypothetical: NO
  anti-sense: NO
aatatggcagtaaagatttcaggagtcctgaaagacggcacaggaaaaccggtacagaactgcaccattcagctgaaagccagacgtaacagcaccacggtggtggtgaacacggtgggctcagagaatccggatgaagcctgcttttttatactaagttggcattataaaaaagcattgcttatcaatttgttgcaacgaacaggtcactatcagtcaaaataa

SEQ ID NO: 2415 - DNA (genomic), 189 bp, Streptococcus pneumoniae; double-stranded, circular
  misc_feature (B) LOCATION 1...189
  hypothetical: NO
  anti-sense: NO
tttttaggcttatgtattgcctgtatgggcgtatctgtcggtgaaggtttattgatgactggactgtttaaatcagtagcacgccaaccagataatgcttctgagtttcgtagtttgatgtttttaggtgttgcctttattgaaggaactttctttgtaactcttgtcttctcatttattatcaaataa

SEQ ID NO: 2416 - DNA (genomic), 1035 bp, Streptococcus pneumoniae; double-stranded, circular
  misc_feature (B) LOCATION 1...1035
  hypothetical: NO
  anti-sense: NO
aggcaaggcttcggagcagatattgatgtaacaggcgaaatcgtctttaatacagggatgaccggctaccaagaatccattacagaccagtcttataatggacaaatcttgacctttacttatcctttggtaggaaattatggtattaatcgtgatgattatgaatccattattccaacttgtaagggagtcgttgtttttgaagaagcgcgtagagctagcaactggcgcaaccaaatgaccttggatgaatttttgaaagccaagaaaattccagggatttcaggaattgatacgcgtgctcttaccaagattatccgtaagcatggtactatgcgtgcaaccttgacccatgttggggacagtatggaccatgtgacggaccagctccaagcaacagttttaccgacagacaatatcaaacaggtttctactaaaacgtcttatccagctccaggagttggtttgagcgtggtgctagtggactttggtctcaagcactcaatcctacgtgaactttctaaacgcaactgtaacgtgacagttgttccttattcgacaacggctgaagaaattctccatctcaatcctgatggagttatgttgtcaaatggtccaggtaacccagaagacgttccacaagcactcgacatgattcgcggtgtacaaggaaaaattccaatctttggtatttgtatgggacaccaactctttgcaatggcaaacggggctaagacctataagatgaagtttggccaccgtggattcaaccatgcggtacgtgaaatcgcaacaggacgagtagacttcaccagccagaaccatggttatgcagtcagccgcgaggatttgccagagcacttgattattacccacgaagaaatcaatgacaagtcagtggaaggtgtgcgccacagataccaacctgctttctctgttcaataccacccagatgcagctcctggaccacacgacgctagctacctatttgacgagtttatcgagatgatggaaatttttaaacaatcaaactaa

SEQ ID NO: 2417 - DNA (genomic), 285 bp, Streptococcus pneumoniae; double-stranded, circular
  misc_feature (B) LOCATION 1...285
  hypothetical: NO
  anti-sense: NO
acttgtcaagtttgtaacaagacaaatattaaaaataaaaaagaggtattcgttatgaatacaaaaaagatgtcacaatttgaaattatggatactgagatgcttgcttgcgttgaaggtggcggatgcaattggggagattttgccaaagcaggtgttggaggaggagtagcacgaggtcttcagctaggaattaaaacaagaacatggcaaggtgcagcaactggtgctgcgggaggagctatacttggaggtgtggcctatgcagcgacatgttggtggtaa

SEQ ID NO: 2418 - DNA (genomic), 315 bp, Streptococcus pneumoniae; double-stranded, circular
  misc_feature (B) LOCATION 1...315
  hypothetical: NO
  anti-sense: NO
tcattccaagtattgatgaaggtaaagattgcaagggctgcaaaccctggtttcacaatcgggaaggctacactccagaaggtacgaatctcaccacaaccgtcgattttagctgattcaagcaactctgtaggaatattttcactaaattgtttcatgaggaagacaccgaatggccatccaatcaaaggcaagataactgcccagagagtatcgtggattcccatgaagttgacgatacgtaccaatggtacaaggacaacttgttttggaagcgccatagcagcgataaagatagcaaatagaatgcgttga

SEQ ID NO: 2419 - DNA (genomic), 1908 bp, Streptococcus pneumoniae; double-stranded, circular
  misc_feature (B) LOCATION 1...1908
  hypothetical: NO
  anti-sense: NO
aagaaacaagtatatactgtttttgctgattctataaaagatgaattagactataccaattttaaggagaaagcacagcttgcctgtgtcgtatatactatgtgtggaattgttggtgttgttggaaacacaaatgcaactgatattttgattcaagggcttgaaaagcttgaataccgtggctatgattctgcgggaatttttgtcctagatggtgctgataaccatttggtgaaggcggttggtcgtattgcagaattgtctgccaagacagctggtgttgagggaacaactggtatcggacatactcgttgggctactcacggaaaaccaactgaggacaatgctcacccacaccgctctgagacagaacgttttgtcttggtgcataatggggtgattgagaactatcttgaaatcaaggaagaataccttgcaggtcaccacttcaaggggcagacagatactgaaatagccgttcatttgattggaaaatttgcggaagaagaagggctctcagttcttgaagcctttaaaaaagctcttcatattatccgtggttcatatgcctttgccttgattgactctgaaaatccagatgtcatctatgtagcgaaaaacaaatctccacttttgattggtcttggggaaggctacaatatggtctgctcagatgctatggctatgattcgtgaaaccaaccaatacatggaaattcatgaccaagagttggtaatcgtcaaggctgatagcgtggaagttcaagactatgatggtaacagtcgtgaacgtgctagctatactgcggaacttgacttgtcagatatcggtaagggaacttatccttactacatgcttaaggaaattgatgagcaaccaactgttatgcgtaaactcattcaagcctacacggatgatgctggtcaagtagtggttgctcctgctatcattaaggctgttcaagacgcagaccgcatctacatccttgcagctggaacatcttaccatgcaggatttgcttctaagaaaatgttggaagaattgacagatacaccagttgaacttggaatctcatctgagtggggctacggtatgccacttctcagcaagaaaccactcttcatctttatcagccaatctggtgaaacagcggatagtcgtcaagttttggtcaaggctaatgaaatgggaattccaagcttaacagtgacaaatgttccaggttcaaccctctcacgtgaagccaactataccatgctccttcacgcaggacctgaaattgccgtggcatcaactaaagcctatacagcgcaaatcgcagcccttgccttccttgcaaaagcagtcggagaagcaaatggtaatgctaaagcgcaagcctttgacctggttcatgaattgtcaatcgtagctcagtctattgaatcaactctttcagagaaagaaaccattgaagccaaggttcgtgaacttcttgaaacaactcgtaacgccttttacatcggacgtggtcaagattactacgtagccatggaagcaagtctcaaactcaaagagatttcttatatccagtgtgaaggttttgcggcaggagaactcaagcacggaaccattgccttgattgaagaaggaacgcctgttttggctctcttgtcagatccagttcttgccaaccatactcgtggaaatatccaagaggtcgcagcccgtggtgccaaagtcctcactatcgcagaagagaatgtagccaaagataccgacgatatcgtccttacgaccgtacatccatacctctcaccaatttcaatggtcgtaccaacgcaattagtcgcttactttgcaaccctccaccgtggcctcgatgtggacaaaccacgtaaccttgccaagtcagtaacggtagaataa

SEQ ID NO: 2420 - DNA (genomic), 502 bp, Streptococcus pneumoniae; double-stranded, circular
  misc_feature (B) LOCATION 1...502
  hypothetical: NO
  anti-sense: NO
aacgggctttactcgtgaaatttcgaattatttagtcaagactctagaaggttttggttaccagccagttcgcacagctaagggtggtgtcaatgtgaccatcaaaggtcaaaatgatgagcaacatcgctatgtgactgctcatgtggatacgctgggtgctattgttcgtgctgtcaaaccagatggtcgtcttaaattggaccgtatcggtggttttccttggaacatgattgaaggtgaaaactgtaccgttcatgtggctagcacaggtcaaaaggtatcaggaaccatcctcatccaccaaacttcttgccatgtctacaaggatgcaggaactgcagagcgcacgcaggacaatatggaagtgcgtttggatgtaaaagtaagcaatgaaaaagaaactcgtgctcttgggattgaggtcggtgattttatcagcttcgatccacgaactgttgtgactgatacaggtttttatcaagtctcgtcatttggatga

SEQ ID NO: 2421 - DNA (genomic), 435 bp, Streptococcus pneumoniae; double-stranded, circular
  misc_feature (B) LOCATION 1...435
  hypothetical: NO
  anti-sense: NO
gaggtaaaagtcttggctaaaccaacacgtaaacgtcgtgtgaaaaagaatatcgaatctggtattgctcatattcacgctacatttaataacactattgttatgattactgatgtgcatggtaatgcaattgcttggtcatcagctggtgctcttggtttcaaaggttctcgtaaatctacaccattcgctgctcaaatggcttctgaagctgctgctaaatctgcacaagaacacggtcttaaatcagttgaagttactgtaaaaggtccaggttctggtcgtgagtcagctattcgtgcgcttgctgccgctggtcttgaagtaacagcaattcgtgatgtgactccagtgcccacacaatggtgctcgtcctccaaaacgtcgccgtgtataatcatcgcattacactgcttttcgtttaagagggagtaa

SEQ ID NO: 2422 - DNA (genomic), 582 bp, Streptococcus pneumoniae; double-stranded, circular
  misc_feature (B) LOCATION 1...582
  hypothetical: NO
  anti-sense: NO
agactgaaagtattttctatcacttctgtgaaaccaggagaaggaaaaacaacgacttccaccaatatcgctcgggcttttgcgcgtgcaggttacaaaacgttgctgattgatgcagacatgcgtaactccgtgatgtcaggtgtctttaaatcaagggaaaggattaccgggctaacagaatttctatcagggactacagacctgtcacagggactttgtgataccaatattgagaatctctttgtgattcaggctggctctgtgtcaccaaatccgacagcccttcttcaaagtaggaatttcagtacaatgcttgaaaccgtgcgtaaatattttgactatatcgtcgtagacactgctcctgtcggtgtcgtgattgatgcggctatcattacgcagaaatgtgatgcttctattttagtgacgaaggcaggcgaaacaaagcgacgggatattcaaaaagcgaaagaacagatagaacaaactgggaagccgtgtttaggagttgtgttgaataaattcgatacttcagtagacgaatacggttcttatggaagttatgggaaaaagaaaaaatag

SEQ ID NO: 2423 - DNA (genomic), 474 bp, Streptococcus pneumoniae; double-stranded, circular
  misc_feature (B) LOCATION 1...474
  hypothetical: NO
  anti-sense: NO
aagaagaaagtaaaaaattacaaaggagtacccatgataccgcaagaaatgtggaataaatacaagcaaatcaatcctttgatcggagatgaaatcgatgcttgggcttttggagttgaaccagaccttttagcggatttggtgtttaaaggagaaaagacagcaacagcatcagcctatgacctctatgtactagaagacgaaccacttccccaagtagggaccttcgatatcattttagatagtcaaaatcagtctgtctgcattgtcgaaattacaaaggtttctgttgaactcttcaatcaagtttctgcgcaacatgcctttaaggaaggtgagggagacaaatcacttgcctattggcgccaggttcatgaggactttttcacagactgtttgggtgaagtagggctgacttttacatctgaaagcaaggttgttttagaagaatttcgcaaggtctacccactgtag

SEQ ID NO: 2424 - DNA (genomic), 768 bp, Streptococcus pneumoniae; double-stranded, circular
  misc_feature (B) LOCATION 1...768
  hypothetical: NO
  anti-sense: NO
aaggagaaagtaagtatgtcaaaagaaattaaattttcatcagatgcccgttcagccatggttcgtggtgtcgatattcttgcagacactgttaaagtaaccttgggaccaaaaggtcgcaatgtcgttcttgaaaagtcattcggttcacccttgattaccaatgacggtgtgaccattgccaaagaaatcgaattggaagaccattttgaaaatatgggtgctaagttagtatcagaagtagcttctaaaaccaatgatatcgcaggtgacggaactacgactgcaacagtcttgacccaagctatcgtccgtgaaggaatcaaaaacgtcacagcaggtgcaaatccaatcggtattcgtcgtgggattgaaacagcagttgccgcagcagttgaagctttgaaaaacaacgccatccctgttgccaataaagaagctatcgctcaagttgcagcagtatcttctcgttctgaaaaagttggtgagtacatctctgaagcaatggaaaaagttggcaaagaaggtgtcatcaccatcgaagagtcacgtggtatggaaacagagcttgaagtcgtagaaggaatgcagtttgaccgtggttacctttcacagtacatggtgacagatagcgaaaaaatggtggctgaccttgaaaatccgtacattttgattacagacaagaaaatttccaacatccaagaaatcttgccacttttggaaagcattctccaagagcattgttccatttgggattatgccggatga

SEQ ID NO: 2425 - DNA (genomic), 1428 bp, Streptococcus pneumoniae; double-stranded, circular
  misc_feature (B) LOCATION 1...1428
  hypothetical: NO
  anti-sense: NO
tggaggaaagttatgaccatttttccagatgattttctttggggtggagctgttgcagctaatcaagtagagggagcatataatgaagatggtaagggcttatcagttcaggatgtgttacccaaaggtggattaggagaagcaacagaaaatcctacagaagataacttaaaattgataggtattgatttttatcataaatataaggaagatatatccttgttttctgaaatgggctttaatgtttttcgtacttctattgcatggagtagaatttttccaaaaggagatgaagaagaacctaacgaagctggtttgaaatattatgatgaattgtttgatgaactacatgctcacgggatagagccacttgtaactctttcacactatgagactccattatatttagcaagaaaatatcatggatgggttgataggagaatgattcatttttatgaaaaatttgctcgaacagttttagaaaggtataaagataaagttaaatattggcttacatttaacgaagtaaactctgttttggaattaccatttactagtggaggaatagatatacctaaggagaatctttcgaaacaagaattatatcaagctatacatcatgaattagtcgcctcaagtttggttacaaaaattgctcgtgagattaattcagagtttaaggtgggatgtatggtattagctatgccagcttatccaatgactccaaatccaaaagatgtatgggcgactcatgagtatgagaatctaaattatctattttcagatgtgcatgttagaggttattatccgaattatgcaaaaagatattttaaggaaaatgacattaacatagagtttgcagctgaagatgcagagttattaaaaaattatactgtagattttttatcctttagctattacatgagtgtgactcaatctgctattccaacacagtataattcaggagaagggaatattattggtggtttagtaaatccttatttagagtcttcagagtggggatggcaaattgatccaattggactacgtataattttaaatagatattatgaccgttatcaaatcccattatttatagtagaaaatggattaggtgctaaagatcaactaataaaagatgaacttaataacttaaccgtccaagatgattatagaattcagtatatgaaagaacatttattgcaagttgctgaagctctacaggatggtgttgaaattatgggctatacgtcttggggatgtattgactgtgtttctatgtccactgcacaactttctaaaaggtacggtctcatttatgttgatcgaaatgatgatggaaatggcacattcaatcgatataagaaaatgtcctttacttggtataaaggagtgattgaatcaaatggagactccttattcaaatag

SEQ ID NO: 2426 - DNA (genomic), 711 bp, Streptococcus pneumoniae; double-stranded, circular
  misc_feature (B) LOCATION 1...711
  hypothetical: NO
  anti-sense: NO
aaagttgaagtagctggagatggcacagcaacaatcacattcccagatggttcagtagtgacgattctaggaaaagatacagttcaacaatctgcgaaaggtgaatctgtaactcaagaagctacaccagagtataagccagaaactacaccaggtggagataagggaggcaatactggaaactcagatgctaatgcgaatgcaggcggtggtagccaggcgggtggatcagctcacacaggttcacaaaactcagctcaatcacaagcttctaagcaattagctactgaaaaagaatcagctaaaaatgccattgaaaaagcagccaaggacaagcaggatgaaatcaaaggcgcaccgctttctgataaagaaaaagcagaacttttagcaagagtggaagcagaaaaacaagcagctctcaaagagattgaaaatgcgaaaactatggaagatgtgaaggaagcagaaacgattggagtgcaagccattgccatggttacagttcctaagagaccagtggctcctaagacaacaagtgcaccgcaagcaactgcaggaacaatgcaagatgttacctaccagtcacctgctggcaaacaattacctaacacaggttcagcatcaagtgcagcacttgctagtcttggtctagtggtggcaacaagtggttttgctttgctaggaagaaagactagacgtagaaaatag

SEQ ID NO: 2427 - DNA (genomic), 225 bp, Streptococcus pneumoniae; double-stranded, circular
  misc_feature (B) LOCATION 1...225
  hypothetical: NO
  anti-sense: NO
tgggttgaagtaactcttgttcaaagtggtgttacgatttcaagaactcctctcagctctgaggccacggtaatgattgatgcgacggaagtaaaaatcaatcgccctaaaaaagaattagcgaattattcttgtaaaaaaatgccacgctatgaaggctcaagcgattgtcacaagtcaagggagaattgtttctttggatatcactgtgaactattgtcatga

SEQ ID NO: 2428 - DNA (genomic), 987 bp, Streptococcus pneumoniae; double-stranded, circular
  misc_feature (B) LOCATION 1...987
  hypothetical: NO
  anti-sense: NO
tataatgaagtgttagaaaaacaggtttcatttgcctggaaaggaaaaattatgtctgaaaaaaatttttatattacaacgccgatttactatccatctgggaaacttcatatcggttctgcctacacaactatcgcatgtgatgtcctagcacgttacaaacgcctgatgggctacgatgtattttatctgacaggtcttgatgaacatggtcagaaaatccagcagaaagcggaagaagctggtattacacctcaagcctatgttgatggaatggcggttggagttaaagaactctggcaattactagatatctcatacgataaatttatccgtacaactgatgactaccatgaaaaagttgtcgcacaggtctttgaacgcttacttgctcaagatgatatttacttgggtgaatactctggttggtattcagtatcagacgaagaattctttacagaaagccagctggcagaagttttccgtgatgaagctggaaatgtgactggtggtattgctccatcaggtcatgaggttgaatgggtttctgaagaatcatactttcttcgccttagcaaataccaagaccgtttggtcgaatttttcaaagctcatcctgaatttatcacgccagatggtcgccttaatgaaatgctacgcaacttcatcgagccaggtttggaagatttggcggtatctcgtacaacctttacatggggagtgcctgtcccatcaaatccaaaacacgttgtctacgtttggattgatgcccttcttaactatgcgacagctcttggctacgctcaagacgaacatggtaactttgacaagttctggaatggaacagtcttccatatggtaggaaaagatatccttcgcttccactctatctactggccaatccttcttatgatgttggatgttaaattacctgatcgtttgattgccccatggttgtttgttcatgaaagacggaaaaatgtctaa

SEQ ID NO: 2429 - DNA (genomic), 342 bp, Streptococcus pneumoniae; double-stranded, circular
  misc_feature (B) LOCATION 1...342
  hypothetical: NO
  anti-sense: NO
actttcgaagtatgctataataaagaaaataaaaacaagaggtttatcatgacaaaattatatggaagcttggaagcgggcggtacaaagtttgtctgtgctgtcggtgatgaaaactttaacgttgtagaaaaaacacaatttccaacaacaactccaatcgaaacaatcgataaaaccattgagtcttctcaaaattcgataacctttctggtcttgcagttggttcatttgggccgattgatattgacaaaaactcaaaaacttatggctttatcacgacgactccaaaaccaaactgggcaaatgtggacttgcttggtgcctttcgtcgcgccctaa

SEQ ID NO: 2430 - DNA (genomic), 429 bp, Streptococcus pneumoniae; double-stranded, circular
  misc_feature (B) LOCATION 1...429
  hypothetical: NO
  anti-sense: NO
tggaccgaagtcatcgagttcaacgctcggttcggagatccagaaactcagcttatcttgcctcgcttaacctctgactttgctcaaaatatcacagatatcctggatagcaaggagccaaatatcacgtggacggacaagggtgtgactctgggtgtggttgtcgcatccaagggctacccgctagattattcaaagggtgttgagttgccagtcaaaaccgatggcgacatcattacctactatgcaggggctaagtttgcggaaaatagcagagcactgctctcaaacggcggacgagtttatatgctcgttaccacagcagataccgtcaaagaagcccaagccagcatctaccaagaactatcccaacaaaaaatagaaggactcttctaccgaacagatatcggaagcaaggcaattaagtaa

SEQ ID NO: 2431 - DNA (genomic), 1815 bp, Streptococcus pneumoniae; double-stranded, circular
  misc_feature (B) LOCATION 1...1815
  hypothetical: NO
  anti-sense: NO
gctcgagaagtggtgttgggttatgacttgtctgaagaagaagaacaaatcctcagccgccagatgaatctggtactctcttatgaaaaagaaagctttgaagaccttcatttattggatttgcgattggcaacggtggagcaaacggcatctagtaagctgctccagtatgttcatcggactcagatgagggaattgaaccacctcaaacctgttatccgctacgaaattaaggatttcttgcagatggattatgcgaccaaggctagtctggatttggttgagaatgctcgctcaggtaagaaacaaggcagtcttttctggcttttggatgaaaccaaaacggctatggggatgcgtctcttgcgttcttggattcatcgccccttgattgataaggaacgaatcgtccaacgtcaagaagtagtgcaggtctttctcgaccatttctttgagcgtagtgacttgacagacagtctcaagggtgtttatgacattgagcgcttggctagtcgtgtttcttttggcaaaaccaatccaaaggatctcttgcagttggcgactaccttgtctagtgtgccacggattcgtgcgattttagaagggatggagcaacctactctagcctatctcatcgcacaactggatgcaatccctgagttggagagtttgattagcgcagcgattgctcctgaagctcctcatgtgattacagatgggggaattatccgaactggatttgatgagactttagacaagtatcgttgcgttctcagagaagggactagctggattgctgagattgaggctaaggagcgagaaaactctggtatcagcacgctcaagattgactacaataaaaaggatggctactattttcatgtgaccaattcgcaactaggaaatgtgccagcccactttttccgcaaggcgacgctgaaaaactcagaacgctttggaaccgaagaattagcccgtatcgagggagatatgcttgaggcgcgtgagaagtcagccaacctcgaatacgaaatatttatgcgcattcgtgaagaggtcggcaagtacatccagcgtttacaagctctagcccaaggaattgcgacggttgatgtcttacagagtctggcggttgtggctgaaacccagcatttgattcgacctgagtttggtgacgattcacaaattgatatccggaaagggcgccatgctgtcgttgaaaaggttatgggggctcagacctatattccaaatacgattcagatggcagaagataccagtattcaactggttacagggccaaacatgagtgggaagtctacctatatgcgtcagttagccatgacggcggttatggcccagctgggttcctatgttcctgctgaaagcgcccatttaccgatttttgatgcgatttttacccgtatcggagcagcagatgacttggtttcgggtcagtcaacctttatggtggagatgatggaggccaataatgccatttcgcatgcgaccaagaactctctcattctctttgatgaattgggacgtggaactgcaacttatgacgggatggctcttgctcagtccatcatcgaatatatccatgagcacatcggagctaagaccctctttgcgacccactaccatgagttgactagtctggagtctagtttacaacacttggtcaatgtccacgtggcaactttggagcaggatgggcaggtcaccttccttcacaagattgaaccgggaccagctgataaatctacggtatccatgttgccaagattgctggcttgccagcagaccttttag

SEQ ID NO: 2432 - DNA (genomic), 372 bp, Streptococcus pneumoniae; double-stranded, circular
  misc_feature (B) LOCATION 1...372
  hypothetical: NO
  anti-sense: NO
ctaggagaagttatgcgtcttatctatctgataattggttttttatcactggccttggctattgttggggttgttttacccttgttgccgacaacgcctttccttttgttgtctattgcttgtttctccagaagttccaagcgtttcgaagactggctttatcataccaagctctatcaaacatatgtagctgattttcgcgagaccaagtctattacgcgtgaacgaaagaaaaaaatcatcgtctctatctacgtcttgatgggaatttctatttattttgcacctcttttaccagtcaaaatcggtttgggtgctttgaccatctttatcacttattatctcttcaaggtcattccagacaaagaatag

SEQ ID NO: 2433 - DNA (genomic), 255 bp, Streptococcus pneumoniae; double-stranded, circular
  misc_feature (B) LOCATION 1...255
  hypothetical: NO
  anti-sense: NO
aagctgcgagttgtgaggctcgctattatgttgcgtgatttagatctctataaggtgattttcgagggaaattatcgggcgacagcgggtagagaagagatgaaagaggctattttggaatatcaagcaaatcctgctgccttaaaagatctcaaagaaaaggctaagaatatttccagagagtattctgaagagcatctgttacaaatctggttggacttttatgagaaacaagccgctttagggagaaagtaa

SEQ ID NO: 2434 - DNA (genomic), 258 bp, Streptococcus pneumoniae; double-stranded, circular
  misc_feature (B) LOCATION 1...258
  hypothetical: NO
  anti-sense: NO
aataggcgagtgatggggatcgaacccacgcatgccagagccacaatctggtgtgttaaccacttcaccacacccgccataattctattaacacgggcagtaggaattgaacccacactgaaggttttggagaccttagttctacctttaaactatgcccgtaaaatggaaggggagggattcgaacccccgaacccgaaggagcggatttacagtccgccgcgtttagcctcttcgctacccttccaaaatatataa

SEQ ID NO: 2435 - DNA (genomic), 366 bp, Streptococcus pneumoniae; double-stranded, circular
  misc_feature (B) LOCATION 1...366
  hypothetical: NO
  anti-sense: NO
atatttagagtccattacaggttctggtgggaacttaggcccaggatttggtgtgataattccatgatgcgaaatgagtttcgagaaagggtggagcaacttcttcaacaaaaagaaataaatgaaaatagtgagttgagtcacctgtttcgtcttgctatacaaaatttagacagaaatgaaaaataccaatcggtcatggccaatttgagtcaagggttgtcactttacctcatgacgcatcattaccaggcacctaagtctgtcattgattttggtttatggattgccaaagctcctagccaggaaagagggagactggctttcttgcagatgcttgctcaaaccctacagggctttcgttaa

SEQ ID NO: 2436 - DNA (genomic), 1338 bp, Streptococcus pneumoniae; double-stranded, circular
  misc_feature (B) LOCATION 1...1338
  hypothetical: NO
  anti-sense: NO
ggggaaagagtaatggatttatttggatttgggacggttattgttcattttttaattattagtcacagttaccattttatttgtaaaggtcaaataaatagaaaagaattattcgtttttggtgcttatacattactaacagaaatagtatttgattttcccttatatattctatatttagatgggttagggattgaaagatttttatttcctttgggattatattcctattttcgatggatgaaacagtatgagagggatagaggactattcctaagtttactactatctcttttatatgagagcactcataactttctgtccgtaactttctcctctataacaggagataattttgttttacaatatcatttcccattctttttcgttgtgacggtgttaacctattttgttacattaaaaatcatttactatttccatttggaactagcctattttgacgaggactacctttatcctttcttgaaaaaagtattttttgctttactattgctacatattgtatctttcgtttcagatatggtaagtacgattaaacatttgaatagttttggaagtattttgtcatctattgtctttatctctctccttttgaccttctttgcaatgaattctcataaagttcaaatggagaaagagattgctttgaagcagaagaaatttgaacagaaacatttacagaattacacagatgaaattgttggtctgtataatgaaatccgtggttttcgacatgattatgctggaatgcttgtcagcatgcagatggcaattgacagtggtaatttacaggaaattgacagaatttacaatgaagttttagtcaaagcaaatcataaattgcgttcagataagtacacttactttgatttgaacaacatagaagactcagctttacgaagtttggttgctcagtcaattgtctatgctcgaaataatggtgtagagtttacactggaagtaaaagatacgattaccaagcttccaattgaactattggatttggttcgtatcatgagcgttttattgaataatgctgtcgaaggatcggctgatagctataaaaagcagatggaagtagcagttattaagatggaaactgaaacagttattgtgattcagaattcatgtaaaatgacgatgactccttcaggagatctatttgccttaggattctccactaagggaagaaatcgcggagtcggattaaataatgtgaaagaactactagataagtacaacaatattattttagaaacagagatggaaggcagtacatttagacaaatcattagatttaagagggaatttgaatga

SEQ ID NO: 2437 - DNA (genomic), 477 bp, Streptococcus pneumoniae; double-stranded, circular
  misc_feature (B) LOCATION 1...477
  hypothetical: NO
  anti-sense: NO
aagagaagagtacgattaagtgctcttttttatggttgtaaaaaagttcatttgaacaatttaagcagtgtagatagtgaggagctgtttcaattctatcgtgaacgagggaatgctgaaaactttatcaaagaaaggaaagcaggattctttggggataagacagatagttcgaccatgattaagaatgaagtacgtatgatgatgggctgtctggcttataatctctacctctttttaaagcagctagctggtgatgaagtaaaggccttgactatcaagcgttttcgacgtctcttccttcatattgccggaaaatatgtctctactgctagacgacatattctcaaattctcaagtctatacgcctattcaaaacagtttcaagccttatttgatacaatctgccagataaatctgatactccctgttccatatagagctagagggcaggggaaaacatgcctaacagaataa

SEQ ID NO: 2438 - DNA (genomic), 264 bp, Streptococcus pneumoniae; double-stranded, circular
  misc_feature (B) LOCATION 1...264
  hypothetical: NO
  anti-sense: NO
atgggaagagttgacagggcttcagttgaaagagttgaccgacctgaccttgtgttatcaattgattttaggttctttgtcaactatagttggtttgtaaagaagttaatatttggagaagaggattgctatcttctccatttttatgtgcagagttatagtggcttgatgctgggaaagtacactgtgactgctaaaacattcctagaagttgctttgatttacctaatctatttatgcaaattttatgttattttactataa

SEQ ID NO: 2439 - DNA (genomic), 1890 bp, Streptococcus pneumoniae; double-stranded, circular
  misc_feature (B) LOCATION 1...1890
  hypothetical: NO
  anti-sense: NO
gttgagagagtagtttatatgaaaattgaaaataaaaatgtaagacgtaatttcttttggggagatggtcgattttatactactgatatcgtaaacaaacgggcaggagtaatgatagaaaatgtttcgaaagaagaatttaccattacattggagaatggtataagactttcttcaaatcatttttcagcaatcgttagggaagagggagatacgcgaattcaggtttcttttgtttgtccttccattcgtttacgtttaatctttgaatcgagggatgatgttctttcgaagcaattagttttagaatcatctactgaggttattaaatctgtagaggtagagagttttgagtttgaaacagaagacaatattttctatccgaaaagacaagattgtattaaggaaatggcgaatttttccggtcattatgtagaattgggacaacctgtttatgcgaattctttattcttaggaatggaatttccaatgtctgaaaacaaggtagatggtagacactatgtatcaagatattacttgggaactgttgtaaatcaagaaaagagtttgtggtcttgtattattgggggagcatgttcttataaaaaagaagagattcaagaggcattttttgaatatgttgaaggaatagctcaacctagttatttccgtaaacagtataattcctggtatgaccatatgaccgatattacagaggaaggtattttaaaaagtttttctgagattcgagatggatttgaaaatcatggagttcatttagatgcttatgttgttgatgatggttggacaaactatcaatcagtttgggaattcaatcataaattcccaaatggtttgagaaatattaaacatcttgtaaatggatttggttcaagcctaggattgtggattggtccccgaggtggttataatgggacagaaatcattatgagtgattggttagaagcacatccagagttaaatattggatctaaaaatttgatttcaaatgatgtaaacgtggctgattttaactatctcaatcaaatgaagaaaaagatgttggaatatcaaaaagaattcgatatcagctattggaaaattgatggttggttacttcaacctgacaaacctgataagagtggaccgcacggtatgtataccatgacagcggtttatgagttcttaattcaactgttgatagatctaagaaaggagagaggaggaaaagattgttggttaaacttgacttcttatgtaaatcctagtccatggtttttacagtgggtcaatagtttatggattcaaatatctcaagatgtaggctttacagagaatgcaggtaatgatatcaatcgtatgattacttaccgagatagtcagtatcaagaatttttggaaaaacgtgagatacagttacctatgtggtcgctttataatcatgaaccaatctatgctgtcagtgcaaatacctggtacatggatcatcaaatgtttgcatcaataccagattttgaagcttatctattatttatttcaacaagagggaatgctttttgggagtttcactattcttttgatatgtttgatgaagaacgctggaaagccaatgctcgtgccgtcaaatggatagaggagaattatcaaacactaaaatatagtaaaaaaataggaggaagtcctgaaaaatttgaaatttatggttataagtgtcacaatcagaagacttctactgaaattctctctctgagaaatcctgctcagattaaacaaaaaataaaaatagagaatctttcgatagagaattttaccagagtaattggagattttactattcaagaagatgagatagaattggcaccgtactctatcgtgatactgaagaagtaa

SEQ ID NO: 2440 - DNA (genomic), 888 bp, Streptococcus pneumoniae; double-stranded, circular
  misc_feature (B) LOCATION 1...888
  hypothetical: NO
  anti-sense: NO
atagagagagtgaatcttatgctccaacaactcgtaaatggtttgattctaggtagtgtttacgcgctgttagccctaggatataccatggtttacggaattatcaagctcatcaacttcgcccatggtgatatttatatgatgggagcctttatcggttatttcttgatcaattctttccaaatgaatttctttgtagcgcttattgtagctatgctagtgacagctattcttggtgtcgtgattgagtttcttgcttaccgacctttgcgccactctactcgtattgctgttttgattacggctattggggtttctttcctattggagaatggaatggtctatctggttggtgccaatacccgtgccttccctcaagcgattcaaacagttcgatatgatttgggaccaattagcttaacaaatgtgcagttaatgattttggccatttccttgattttgatgattttgttacaagtcattgtccaaaagactaagatggggaaagccatgcgtgcagtatcagtagatagcgacgcggcacaattgatggggatcaatgtaaaccgtacgattagctttaccttcgctttgggttctgctcttgcgggtgcggctggtgttctgattgctctttattataactctcttgagcctttgatgggggttactccaggtcttaaatctttcgttgccgcagtacttggtggtatcggaattattcctggtgcggctcttggtggctttgtgattggtctattggaaacctttgcgacagcctttgggatgtcagatttccgtgatgccattgtttatggaatcttgttgttgatcttgattgtccgcccagctggtatccttggtaagaatgtgaaagagaaggtgtaa

SEQ ID NO: 2441 - DNA (genomic), 240 bp, Streptococcus pneumoniae; double-stranded, circular
  misc_feature (B) LOCATION 1...240
  hypothetical: NO
  anti-sense: NO
tcaggtggagtggttaatgttaaagagtatccactatatttcttctcatactcaatggaaatcaaagagcaaactaggaagctagccgcaggctgctcaaaacactgttttgaggttgtggatagaactgacgaagtcagtaaccatatatacggtaatgtgacgctgacgtggtttgaagagattttcgaagagtattatatttcaaaaggccgaagtaagtttactccgacctgttag

SEQ ID NO: 2442 - DNA (genomic), 942 bp, Streptococcus pneumoniae; double-stranded, circular
  misc_feature (B) LOCATION 1...942
  hypothetical: NO
  anti-sense: NO
gagaaaggagttggtagcttgactcttcgttcacattctgaacggctaatggggactactatcactatttcattagtggatgagcaagccgatatctttctccaaaaatcctttgacttgctcaaagagcttgaataccgcttcaacgccaatagtcaagaatctgagttgatggaaatcaattatcaagcaggagtatcccccgtcacggttcatccagacctgtttgagctgatttcacttgggttagagcatagcctagcgctctctagccacctcaatatcagcattggtcccttaattcaaacctggcgtatcggtttttcagatgccaaggtcgcccagcctcaagaaattgaatcggtgctgcctctaatcaatcctcatggtatcgagttagattcttctacttctactgtgtttttaaaacagaaaggaatgaagatcgatctaggttgtttagccaaaggatacagtgcggataaggttgcccaatttcttaggaaagagggggtgacttctgccttgatcaatctgggagggaatatcctgaccattggaaaaaatcaggcaagaggggataacccatggcaaatcgggattcaagacccagccaatcctaggggaaatcatttaatgaccatccctgttgtcaataaatctgtcgtgacttcaggcatttatgaacgtcacctgaccgtcgatggacaagattaccatcacatttttgacagtcaaacaggatatcctgttgaaacggaactagcgagtctaacaatcatctctgataaatcagtcgatggcgaaatctggacgactcgactctttggagaaagacctgcttctatcctctggcaagtcgaaagtttggagggcatcgaagtcatcctcatcgataaagaaggccacctaagctgttcttcaggaattcctactctatag

SEQ ID NO: 2443 - DNA (genomic), 207 bp, Streptococcus pneumoniae; double-stranded, circular
  misc_feature (B) LOCATION 1...207
  hypothetical: NO
  anti-sense: NO
aaaggaggagtttttatgaaatcctttaaagattttcgagaatctttaacagctgaagatatgcaagctatctctgctaaagctaatgaagctactaaacagattgaccatacagacggattgcaactggggaaggtcagtggtttgacttctgtaataactactattgagttacttgagaagtatcatgaatggcttcatagctaa

SEQ ID NO: 2444 - DNA (genomic), 375 bp, Streptococcus pneumoniae; double-stranded, circular
  misc_feature (B) LOCATION 1...375
  hypothetical: NO
  anti-sense: NO
cattcgggagtgaaacagtctgggagactgtttcagcctgagcctagaaatttgaaagcgaagctgtttagccaagtcatagtaagggctaaacatatccatagtaatgattttgacgcgacatcggacggctctatcatatttaagaaagtgatctcggatgacagcttgtgttctaccttcaagaacagtgatgatatcgagcttttcaaaatcttgcgcaataaagctcatctccatctcccgattgaaacagtcactccccggactgtttcaacgtcccaagacataatcttaggcagatttctaaaattacactcaaagtggaagtcattgagctttcgaatgacagttgaagttgagatggaaagctga

SEQ ID NO: 2445 - DNA (genomic), 327 bp, Streptococcus pneumoniae; double-stranded, circular
  misc_feature (B) LOCATION 1...327
  hypothetical: NO
  anti-sense: NO
cattcgggagtgaaacagtctgggagactgtttcagcctgagcctagaaatttgaaagcgaagctgtttagccaagccatagtaagggctaaacatatccatagtaatgattttgacgcgacatcggacggctctatcgtagcgaagaaagtgatttcgaatgatagcttgtgttcttccctcaagaacagtgatgatattgagcttgtcaaaatcttgcgcaataaagctcatctccatctcccgattgaaacagtcactacccggactgtttcaacgtcccaagacataatctcaggaagacaagaaaaatcatgtttaaagtga

SEQ ID NO: 2446 - DNA (genomic), 327 bp, Streptococcus pneumoniae; double-stranded, circular
  misc_feature (B) LOCATION 1...327
  hypothetical: NO
  anti-sense: NO
cattcgggagtgaaacagtctgggagactgtttcagcctgagcctagaaatttgaaagcgaagctgtttagccaagtcatagtaagggctaaacatatccatagtaataattttgacgcgacatcggacagctctatcgtagcgaagaaagtgatttcgaatgatagcttgtgttcttccctcaagaacagtgatgatattgagattgttaaaatcttgcgcaatgaagctcatctccatctcccgattgaaacagtcactccccggactgtttcaacgtcccaggacataatctcaggaagacgcgaaaaatcatgctcaaagtga

SEQ ID NO: 2447 - DNA (genomic), 327 bp, Streptococcus pneumoniae; double-stranded, circular
  misc_feature (B) LOCATION 1...327
  hypothetical: NO
  anti-sense: NO
cattcgggagtgaaacagtctgggagactgtttcagcctgagcctagaaatttgaaagcgaagctgtttagccaagccatagtaagggctaaacatatccatagtaatgattttgacgcgacatcggacggctctatcgtagcgaagaaagtgatttcgaatgatagcttgtgttcttccctcaagaacagtgatgatattgagattgttaaaatcttgcgcaatgaagctcatctccatctcccgattgaaacagtcactccccggactgtttcaacgtcccaggacataatctcaggaagacaagaaaaatcatgtttaaagtga

SEQ ID NO: 2448 - DNA (genomic), 327 bp, Streptococcus pneumoniae; double-stranded, circular
  misc_feature (B) LOCATION 1...327
  hypothetical: NO
  anti-sense: NO
cattcgggagtgaaacagtctaggagactgtttcagcctgagcctagaaatttgaaagcgaagctgtttagccaagtcatagtaagggctaaacatatccatagtaatgattttgacgcgacatcggacggctctatcatatttaagaaagtgatctcggatgacagcttgtgttctaccttcaagaacagtgatgatatcgagcttttcaaaattttgcgcaataaagctcatctccatctcccgattgaaacagtcactccccggactgtttcaacgtcccaagacataatcttaggcagatttctaaaattacactcaaagtga

SEQ ID NO: 2449 - DNA (genomic), 336 bp, Streptococcus pneumoniae; double-stranded, circular
  misc_feature (B) LOCATION 1...336
  hypothetical: NO
  anti-sense: NO
cattcgggagtgaaacagtctgggagactgtttcagcctgagcctagaaatttgaaagcgaagctgtttagccaagtcatagtaaggactaaacatatccatagtaataattttgacgcgacatcggacaactctatcgtagcgaagaaagtgatttcgaatgatagcttgtgttctaccctcaagaacagtgatgatattgagcttgttaaaatcttgcgcaatgaagctcatctttccctttgtaaaagcatactcatcccaagacataatctcagaaagacaagaaaaatcatgtttaaagtgaaaatcattgagcttacgaatgacagttga

SEQ ID NO: 2450 - DNA (genomic), 966 bp, Streptococcus pneumoniae; double-stranded, circular
  misc_feature (B) LOCATION 1...966
  hypothetical: NO
  anti-sense: NO
aatgggggagtttttttgaagccatttaaaacaatcgaggaacaaatcgcaacactaaaaatcagagggttatccattacagatgaatctaaagcagctaagtacctgctaagtaacaattactacaatattatcaatggatacagtaagttttttcaacaccctggtactgacacttatattgacggcgtcacatttgacgaagtttcaagtctctatacatttgacaaagatgtaaaacgagccattttgcaagctattcttgaagctgaacaccatatcaagtcaatcactgctcacagattcgccgaagcttaccccagtcaaaaatacgcttatttaaacaccaattcttatgcagataataaaatattagacgtgggatttattgtatcaaaactatccaaaatcataaacacaaacaagcgatacagaggaaattcaattcaccactacgcacatactcattcagatgtcccaatctgggtactaactgattatctagagtttggagatttacgcacgattattgaaaacctgcctaattcactccaaaatgaaatcgcacgggatttagtaagttttataagcacaaacatacctgactttaacgatgttttcccaccagaaaccttgatatcttttctaaaaaatattaacgaggtacgaaacaaatgcgctcacaataatcgcttattaaacttcagatgccgttctaatagtacgttttgggaaacgattcataacaaagagatcttgatgggagatgacagtagaaaaactgtatattcaacaattattagccttcaatgctttattagtaaagcagcattcaacattttgtggaatactcttagaaaaaaagttatcaaactagagaaaaagctgccttctatagacatcaatgtaatcaaccagtctttaggttttcctaatgattggcaccgtaatgaaccaaaagtataa

SEQ ID NO: 2451 - DNA (genomic), 342 bp, Streptococcus pneumoniae; double-stranded, circular
  misc_feature (B) LOCATION 1...342
  hypothetical: NO
  anti-sense: NO
gtctttttggtctatctgatcattactgtacacaagcttggtcgtgtcatcgatgaaacagaaaagacgattaaaaccttgacttcagatgtggatgtgaccttgcatcacaccaatgagttgttggctaaggtcaatgtcttggcagatgatatcaatgtcaaggtggctacgattgatccactcttcagtgctgttgcagatttatctctatctgtttcagacctcaatgaccatgcgcgtgtcttgagcaagaaagcttcatcagctggttcaaaaacactcaagactggtgcaagtctgtcagctcttcgtcttgcaagtaaatttttcaaaaaataa

SEQ ID NO: 2452 - DNA (genomic), 279 bp, Streptococcus pneumoniae; double-stranded, circular
  misc_feature (B) LOCATION 1...279
  hypothetical: NO
  anti-sense: NO
ctgttcttggtaaggaagtacctgtatcatcaaccaagtcttttacaggacatttgctgggggctgcggcgtgcagtagaagctatcgtcaccatcgaagctatgcgtcataactttgtaccaatgacagctgggacaagtgaagtatcagattatatcgaagctaatgtcgtttatggacaaggcttggagaaagaaattccatacgctatttcaaatacttttggttttggaggccacaatgcagttcttgctttcaaacgttgggagaatagataa

SEQ ID NO: 2453 - DNA (genomic), 195 bp, Streptococcus pneumoniae; double-stranded, circular
  misc_feature (B) LOCATION 1...195
  hypothetical: NO
  anti-sense: NO
ctcagcttggtagagtacttggtttgggaccaaggtgtcgcaggttcgaatcctgtcttcccgattcatggcggtgtagctcagctggctagagcgtccggttcatacccgggaggtcgggggttcgatccccttcgccgctataatgatcttgtcggacctttagctcagctggttagagctctcggctcataa

SEQ ID NO: 2454 - DNA (genomic), 255 bp, Streptococcus pneumoniae; double-stranded, circular
  misc_feature (B) LOCATION 1...255
  hypothetical: NO
  anti-sense: NO
ttaagattggtaatcaaaaatatagggaggaatgttttgaataagaaatataacatagttctatttttgttgtttatagtttatttatttggatatttttcaatttcaaaaacgttaattcctataatgtgtgtgttccaagtattcttgatagaacatatatttagaattcgaaatagaatgatgcagataggtgaaattataattattgttgcttctataatattatttattgatagtatattgagtttgtaa

SEQ ID NO: 2455 - DNA (genomic), 246 bp, Streptococcus pneumoniae; double-stranded, circular
  misc_feature (B) LOCATION 1...246
  hypothetical: NO
  anti-sense: NO
aagagattggtgttgagtgtccaagctgtcatcagggacaaattattgagcgaaaaaccaagcgtaatcgcctattctatggttgcaatcgctatccagaatgtgaatttacctcttgggacaagcctgttggtcgtgactgtccaaaatgtggcaacttcctcatggagaaaaaagtccgtggtggtggcaagcaggttgtttgtagcaaaggagatgactcttcaccacgagtgcngngcacaa

SEQ ID NO: 2456 - DNA (genomic), 2448 bp, Streptococcus pneumoniae; double-stranded, circular
  misc_feature (B) LOCATION 1...2448
  hypothetical: NO
  anti-sense: NO
ccatcactggtcaagcacaagagtgaccgcatctccctccaccaaaaagacttggaaatcacctctgtagaagttgcaggtcaagctcgtccatttacagttgaccatgacaatgaagcccttcatatcgaattggctgaggctggtcaagttgaattggttcttgccttttctggtaaaattacagacaacatgacagggatttacccttcttattatacagttgatggagtcaagaaggaggtcttgtctactcagttcgagagccattttgcgcgcgaagctttcccatgtgtggatgagcctgaagccaaagcaacttttgacctctctcttcgctttgaccaagcagaaggtgaattggccttgtcaaacatgccagaaatcgatgttgaaaaccgtaaggaaacaggtatctggaagtttgagacaacacctcgcatgtcttcttacttgttggcctttgttgctggtgatttgcaaggggtgaccgctaaaactaaaaatggtaccctggtaggtgtctactcaaccaaagcacatccactttcaaatcttgatttctcactggatatcgctgttcgctctatcgagttttacgaagattactatggagttaagtatccaattcctcaatctctccacatcgcccttcctgacttctcagctggtgctatggaaaactggggtcttgtgacctaccgtgaagtttacttggttgtcgatgagaactctacatttgctagccgtcaacaagttgcccttgttgtggcccatgaattggctcaccaatggtttgggaacctcgtgactatgaaatggtgggatgacctttggctcaatgaaagtttcgctaatatgatggaatacgtctgtgtggataccatcgaaccaagctggaatatctttgaagatttccaaacaggtggagtacctcttgctcttgaacgtgacgctactgatggcgttcagtctgtccacgtcgaagttaaacatccagatgaaatcaatacactctttgacggcgctatcgtctatgccaaaggaagccgtctcatgcacatgcttcgccgttggctaggagatgctgattttgctaaaggtttgcatgcctactttgaaaaacaccaatacagcaacaccattggtagtgacctttgggatgcccttggtcaagcgtcaggacgtgatgtcgcagccttcatggattcttggttggaacagcctggttacccagttcttactgtcaaagttgaaaatgatgtcttgaagatttcacaaaaacaattcttcatcggtgagaacgaagacaagaaccgtctctgggtggtgcccctcaatagcaactggaaaggcttgcctgatacactcgaaactgaaagtatcgaaatccctggctacgcagctcttcttgctgaaaatgaaggagctcttcgtctcaacactgaaaatactgcccactatattaccgactatcaaggagacttgttagaagctgttcttgctgagctagagacacttgataacacaagcaaactgcaaattgttcaagaacgtcgtttgttggctgaggcagggcacatttcttatgcagacttgcttccagttcttgataaacttgctaaggaagagtcttatctggtggtttcagctgtttctcaagtgatttcagcccttgagcgctttattgatgaaggaacggatgctgaaacagccttcaaaggactggttgctaaattggctcgtcataactatgaccgtcttggttttgaagctaaagacggagaatcagatgaggatgaattggttcgtcagctggctgtttcgatgatgattcgctcaaatgatgcagaagctcgtcaagtcgctagccaaatcttcgcaacacacaaggagaatcttgcagaactcccagcagctattcgttcacaagttctgattaatgagatgaaacatcatgagactaaagacttgttagcactttatcttgatacttatactcacgcaacagatgctgtctttaaacgccagttgacagcagctcttgcatacagtacagatgcggataatatccaaaacttgattacttcttggaaggacaaatttgtggtcaaaccacaggacttgtctgcttggtattaccaattcctagctcatcaagcaactcagaaaacagcttggtcttgggcgcgtgaaaactgggcttggattaaggcagcccttggaggagatatgagctttgatagctttgttatccttcctgctcatgtatttaagactcagcaacgcttggcggaatacaaggagttctttgaaccgcaactttctgaccttgctcttagccgtaacatcggtatgggaatcaaggaaattgcagcgcgtgttgacttgattagccgtgaaaaagctgcagtcgaagcagttgttcttcaatacggaaatgcataa

SEQ ID NO: 2457 - DNA (genomic), 945 bp, Streptococcus pneumoniae; double-stranded, circular
  misc_feature (B) LOCATION 1...945
  hypothetical: NO
  anti-sense: NO
ccaggactggtatgttgggttcttatagtatttttggtggctgttaacagtttgagtgattataagacagattttcgtctgtttgaattctccaaaatatttggagatgaagagtatggtttccagctttcagttactgttttacgttatggttatacataccgtttgttctcttttgtggtagacatgcttaatcaagatatgggacgaaacttggaagttattcaacgtcatggggccctgctcttggttgaaaatgggcaactcttgtatgtagaattgcctaaagaaggggtcaatgttcatgatttctttgagacaagcaaggtcagagaaaccttgttgattgcgactcgtaacgaaggtaaaaccaaggaattccgagctatctttgataagttaggctacgatgtggaaaatcttaatgactaccctgacctgcctgaagtagcagaaacaggtatgacctttgaagaaaatgcccgccttaaggcagaaaccatttctcaattaacgggcaagatggttttggcagatgattctggtctcaaagtcgatgtccttggtggcttaccaggcgtctggtcagctcgtttcgcaggtgtgggagcaactgaccgtgaaaataatgccaaactcttgcacgaattggccatggtctttgaactcaaggaccgctcggctcagttccacacaaccctagtcgtagccagcccaaataaggaaagtttagtgttgaacaccagacctggtcaggttatattaactttgaaacctaagggtgaaaatggctttggctatgatcccctcttccttgtaggagagacaggtgagtcatcagctgaattaaccctggaagaaaaaaatagtcaatctcaccgtgccttagccgttaagaaacttttggaggtatttccatcatggcaaagcaaaccatcattgtaa

SEQ ID NO: 2458 - DNA (genomic), 207 bp, Streptococcus pneumoniae; double-stranded, circular
  misc_feature (B) LOCATION 1...207
  hypothetical: NO
  anti-sense: NO
ttcttgctggtgggcaaggaactcgtctcggtaaactcactcaaagcatcgcaaaaccagctgtgcaatttggggggcgctaccgtatcattgactttgccctatcaaactgtgccaactcagggattcataatgttggggtcgttacacagtatcaaccacttgctctcaacaaccatattgggaatggttcaagctggggactag

SEQ ID NO: 2459 - DNA (genomic), 657 bp, Streptococcus pneumoniae; double-stranded, circular
  misc_feature (B) LOCATION 1...657
  hypothetical: NO
  anti-sense: NO
gatagtatggtcaaagtagcaacccagacaccgattatcagtctcttcttgctgattttatccttggaaacatctttcattccttcgattgctctgaatctttcggtagtcgcattttgtattctctttatgctctattaccgtcgatttaaaatgttagcttggatgatcatacttgccattttaccatcttttgccaactactgggcagttcagttacacggagatgcttcacaggcagtcatgcttggaacgagggcctttgtgacagtttgtatcggccttgtctttgtttcctctatttcactaaaagagcttctcttgtacttggctcaaaaggggctatcacgctcttggtcctatgccttgattgtggtattcaattcctttcctctcattcagcaagaaatcaagtccctcaaagaagcttgcctattacgtggtcaagaactgtatttttggtcgcccttgatttacagtaaggttctgatgacagtctttaggtggcgccatctttacctgagagctctgtctgctcatggatatgacgaacatgcacagttgaagaatagctatcggactttttatattcctaaaaaaacaaaattaatctacctgcttttctttttattgcttcaaaccagtctatttttataa

SEQ ID NO: 2460 - DNA (genomic), 660 bp, Streptococcus pneumoniae; double-stranded, circular
  misc_feature (B) LOCATION 1...660
  hypothetical: NO
  anti-sense: NO
agcaccatggttggcgaaatattatgccacgtccagaacatcctaggaaagcagacgctcaaaccattgtcgcgtctaaaaataaaatctcaattcaagaaggcaagaaagcgctttaaatatagtagacgttttcgtaaggttcgcttgatgtaccaagatgaggctggtttcagtagaatcagtaaactgggatcttgttggtctccaataggagtagatccacatgtccatagtcactatatacgagaatttcgctattgttatggagctgttgatgcctatacaggcgaatcatttttcttaatagctggtagatgtaatactgagtggatgaacgcctttttagaagagctttcacaagcttatccagatgattatcttttactcgttatggacaatgctatatggcataaatcaagtatcttaaagattccgactaatattggttttgcatttattcctccatacacaccagagatgaaccccattgaacaagtgtggaaagagattcgtaaacgtggatttaagaataaagcctttcgaattttggaagatgtcatgaatcaactccaagatgtcatacaaggattggagaaggaggtgataaagtccatcgttaatcggagatggactagaatgctttttgaaagcagatga

SEQ ID NO: 2461 - DNA (genomic), 297 bp, Streptococcus pneumoniae; double-stranded, circular
  misc_feature (B) LOCATION 1...297
  hypothetical: NO
  anti-sense: NO
agcgccatggttggcgaaatattatgccacgtccagaacatcctaggaaaacagacgctcaaaccattgtcgcgtctaaaaataaaatctcaattcaagaagaaaagaaagcgctttaaaaccagtagacgttttcataaggttcgcttgatgtaccaagatgaggctggtttcggtagaatcagtaaactgggatcttgttggtctccaataggagtaggtccacatgtccatagtcactatatacgagaatttcgctattgttatggacccatacaggcgaatcatttttcttaa

SEQ ID NO: 2462 - DNA (genomic), 660 bp, Streptococcus pneumoniae; double-stranded, circular
  misc_feature (B) LOCATION 1...660
  hypothetical: NO
  anti-sense: NO
agcgccatggttggcgaaatattatgccacgtccagaacatcctaagaaagcagacgctcaaaccattgtcgcgtctaaaaataaaatctcaattcaagaagaaaagaaagcgctttaaaaccagtagacgttttcataaggttcgctcgatgtaccaagatgaggctggtttcggtagaatcagtaaactgggatcttgttggtctccaataggagtaggtccacatgtccatagtcactatatacgagaatttcgctattgttatggagctgttgatgcccatacaggcgaatcatttttcttaagagctggtggatgtaatactgagtggatgaacgcctttttagaagagctttcacaagcttatccagatgattatcttttactcgttatggacaatgctatatggcataaatcaagtaccttaaaaattccgactaatattggctttgcatttattcctccatacacaccagagataaaccccgttgaacaagtgtggaaagagattcgtaaacgtggatttaagaataaagcctttcgaactttggaagatgtcatgaatcaacttcaagatatcatacaaggactggagaaggaggtgataaagcccatcgttaatcggagatggactagaatgctttttgaaagcagatga

SEQ ID NO: 2463 - DNA (genomic), 189 bp, Streptococcus pneumoniae; double-stranded, circular
  misc_feature (B) LOCATION 1...189
  hypothetical: NO
  anti-sense: NO
gctttaatggtgcccctgcaaagtttgatattcgtgcttggagtccagaccatactaaaatgggcaaagggattactctctcaaatgaagaatttcaaacgatggtggatgcctttaaaggcaactaatactcttcgaaaatctcttcaaaccgcatcagctttgccttgccgtatgtatggttactga

SEQ ID NO: 2464 - DNA (genomic), 3789 bp, Streptococcus pneumoniae; double-stranded, circular
  misc_feature (B) LOCATION 1...3789
  hypothetical: NO
  anti-sense: NO
gaaaaaatggtctacagcatccgttccctcaaaaatggaactggttctgtccttatcggtgcaagccttgtcttgcttgccatggctacaccaactatctcatccgacgaaagtacaccaaccactaacgaacccaacaacagaaatacaaccatccttgcccaacctcttactgatacagcagctggctctggtaagaacgaaagtgatatttcttcacctagaaatgcaaacgcttccctagagaaaacagaagaaaaacctgctgcaagcccagccgatccagcaccacaaactggacaagatcgttcaagtgagccaactacttctactagtccagtaacaactgaaactaaggcagaagagcccatcgaagataactacttccgtatccatgtcaaaaaacttcctgaagaaaacaaggatgctcaaggactatggacttgggacgatgttgaaaaaccatctgaaaactggccaaacggagctttgtccttcaaggatgccaagaaagatgactacggctattacctagatgtcaaattaaagggagaacaagccaagaaaattagcttcctcatcaacaatacagctggaaaaaatctaaccggcgataaatctgtagaaaaactagttccaaaaatgaacgaagcttggttagaccaagattacaaggttttctcttacgagccacagcctgcaggaactgttcgcgtcaactactaccgcacagatggcaactatgacaagaaatctctctggtactggggagatgtaaaaaatccaagtagcgctcaatggcctgacggaacagactttacggctacaggcaaatatggccgctatatcgacattcctcttaatgaagccgcaagagaatttggatttttattactagatgagagcaaacaaggagacgacgtgaaaatccgtaaagaaaattataagttcacagatttgaaaaatcatagccaaattttcctaaaagacgatgatgaatcgatttacacaaatccatactatgtccatgatatccgtatgacaggagcccaacacgtaggcacttctagcattgaaagtagcttttcaacacttgtcggtgctaaaaaagaagatatcctcaaacactccaacatcactaatcacctaggaaacaaggtaactattaccgatgttgcaatcgatgaagctggtaagaaagtgacctacagcggagatttctctgacacaaaacatccttatactgttagctacaattccgaccaattcactaccaaaacaagctggcgcctgaaagatgagacatacagctatgatggcaaactgggagctgacctaaaagaagaaggaaaacaagttgatttgaccctttggtcaccaagtgctgataaggtttctgttgttgtctacgacaagaatgaccctgacaaagtagttggaactgtcgctctcgaaaaaggggaaagaggaacttggaaacaaactctagacagcacaaacaaactcggaatcacagatttcactggctactattatcaataccaaatcgagcgtcaaggtaaaactgttcttgcactcgatccttacgctaaatctcttgctgcttggaatagcgacgatgccaagattgacgatgcccataaagtggctaaagccgcctttgtagatccagctaaactcggacctcaagacttgacttatggtaagattcacaatttcaagactcgtgaagacgccgttatctacgaagctcatgtgcgtgacttcacttcagatcctgccattgcaaaagacttgaccaaaccatttgggacttttgaagccttcattgaaaaactagactatctcaaagacttgggtgtaacccatatccagctccttccagtcttgtcttactactttgtcaatgaattgaaaaaccatgaacgcttgtctgactatgcttcaagcaacagcaactacaactggggatatgaccctcaaaactacttctccttgactggtatgtactcaagcgatcctaagaatccagaaaaacgaatcgcagaatttaaaaacctcatcaacgaaatccacaaacgtggtatgggagctatcctagatgtcgtttataaccacacagccaaagtcgatatctttgaagacctagagccaaactactaccactttatggatgccgatggcacacctcgaactagctttggtggtggacgcttggggacaacccaccatatgaccaaacggctcctagttgactctatcaaatacctagttgatacctacaaagtggatggcttccgcttcgatatgatgggagaccatgacgccgcttctatcgaagaagcttacaaggctgcacgcgccctcaatccaaatctaatcatgttaggcgaaggttggagaacctatgccggtgatgaaaacatgcctactaaagctgctgaccaagattggatgaaacataccgatactgtcgctgtcttttcagatgacatccgtaacaacctcaaatctggttatccaaacgaaggtcaacctgcctttatcacaggtggcaagcgtgatgtcaacaccatctttaaaaatctcattgctcaaccaactaactttgaagctgacagccctggagatgtcatccaatacatcgcagcccatgataacttgaccctctttgacatcattgcccagtctatcaaaaaagacccaagcaaggctgagaactatgctgaaatccaccgtcgtttacgacttggaaatctcatggtcttgacagctcaaggaactccatttatccactccggtcaggaatatggacgtactaaacaattccgtgacccagcctacaagactccagtagcagaggataaggttccaaacaaatctcacttgttgcgtgataaggacggcaacccatttgactatccttacttcatccatgattcttacgattctagcgacgcagtcaacaagtttgactggactaaggctacagatggtaaaacttatcctgaaaatgtcaagagccgtgactatatgaaaggtttgattgcccttcgtcaatctacagatgccttccgacttaagagtctccaagatatcaaagaccgtgtccacctcatcactgtcccaggccaaaatggtgtggaaaaagaggatgtagtgattggctaccaaatcactgctccaaacggcgatatctacgcagtctttgtcaatgcggatgaaaaagctcgcgaatttaatttgggaactgcctttgcacatctaagaaatgcggaagttttggcagatgaaaaccaagcaggatcagtcggaattgccaacccgaaaggacttgaatggactgaaaaaggcttgaaattgaatgcccttacagctactgttcttcgagtctctcaaaatggaactagccctgagtcaactgcagaagagaaaccagactcaaccccttccaagcctgaacatcaagacccagctccagaagctagacctgattctactaaaccagatgccaaagtagctgatgcggaaaataaacctagccaagctacagctgattcacaagctgaacaaccagcacaagaagcacaagcatcatctgtaaaagaagcggttcaaaacgaatcggtagaaaactctagcaagaaaaatatacctgcaaccccagatagacaagctgaacttccaaatacaggaatcaaaaacgaaaacaaactcctatttgcaggaatcagcctccttgcgctccttggtctcggtttcttactaaaaaataaaaaagagaactaa

SEQ ID NO: 2465 - DNA (genomic), 696 bp, Streptococcus pneumoniae; double-stranded, circular
  misc_feature (B) LOCATION 1...696
  hypothetical: NO
  anti-sense: NO
ggagaaatggttgaagccatgcgagcaggccaatttcttcatctgcgtgtaccagacgatgcccatctcttacgtcgtcctatttcaatttcgtctattgacaaggcaaacaagcagtgtcacctcatttatcggattgagggagctgggactgcaattttttcaaccttaagtcagggagacactcttgatgtgatggggcctcagggaaatggttttgacttgtctgaccttgatgagcagaatcaggttctccttgttggtggtgggattggtgttccacccttgcttgaggtggccaaggaattgcatgaacgtggagtgaaagtagtgacagtcctcggttttgctaataaggatgctgttattttgaaaacggaattggctcagtatggtcatgtctttgtaacgacagatgatggttcttatggcatcaagggaaatgtttccgttgttatcaatgatttaaacagtcagtttgatgctgtntactcgtgtggggctccattaatgatgaagtatatcaatcaaacctttgatgatcacccaagagcctatttatctctggaatctcgtatggcttgtgggatgggagcttgctatgcctgtgttctaaaagtaccagaaaacgagacggtcagccaacgcgtctgtgaagatggtcctgttttccgcacaggaacagttgtattataa

SEQ ID NO: 2466 - DNA (genomic), 1303 bp, Streptococcus pneumoniae; double-stranded, circular
  misc_feature (B) LOCATION 1...1303
  hypothetical: NO
  anti-sense: NO
ccagatggttatgtggtcgtactgcatagcaaggataggaggtaggatggaaagtttacttattctattattaattgccaacctagctggtctctttctgatttggcaaaggcaggataggcaggagaaacacttaagtaagagcttggaggatcaggcagatcatttgtcagaccagttggattaccgctttgaccaagccagacaagccagccagttagaccaaaaagatttggaagtggctgtcagcgaccgtttgcaagaagtgcggattgaattgcaccaaggcctgacccaagtccgtcaagaaatgacagataatctcctccaaactagagataagacagaccaacgtctccaagccttgcaggaatcaaatgagcaacgtttggaacaaatgcgccagacggtcgaggaaaaactagaaaagaccttgcagacacgcttacaggcttcctttgagacagtttctaaacaactggagtctgtcaatcgtggtcttggagaaatgcagacagttgcccgtgatgtcggagctcttaacaaggttctctctggaaccaagacgcgagggattctgggagaattgcaactggggcaaattattgaagacatcatgacacctgcccagtacgaacgagaatacgcaacggttgaaaactctagtgaacgagtggagtatgccatcaagttacccggacaaggcgaccaagaatacgtctatcttccaattgactctaagtttccactggcagattattaccgcttggaagaagcctatgagacaggtgacaaggatgagattgaacgctgtcgtaagtcactcctagcaagcgtcaagcgctttgccaaggatatcaagagcaagtacatagcaccgcctcggacaaccaactttggaatcttgtttgttccgacagaaggtctttattcagagattgtgcgcaatccggtcttctttgatgatttgagacgggaagaacagattattgttgcaggaccaagtaccctatcagcccttcttaactccctatcagttggtttcaagacccttaatatccaaaagagtgccgaccatatcagcaagactcttgccagtgtctacaccgagtttggcaagtttggtggtattctggttcaggcacaaaaacatctccaacatgcctctggcaatattgatgaattattaaaccgtcgtaccatagctatcgagcggacgctccgtcacattgagttgtcagaaggtgagcctgcgcttgatctactctattttcaagaaaatgaggaagaatatgaagattag

SEQ ID NO: 2467 - DNA (genomic), 264 bp, Streptococcus pneumoniae; double-stranded, circular
  misc_feature (B) LOCATION 1...264
  hypothetical: NO
  anti-sense: NO
aatcggatggtaaaatggctgtcaatgaatgggttgatggtggacgttattatgttggcgctgacggagtttggaaggaaggtcaagcaagtacagtttcttctagtaatgatagcaatagtgaatatttctgctgctttaggaaaggcaaaaagttataattcgttattccacatgtcaaaaaaacgtatgtatagacaattaacttctgattttgataaattttcaaatgatgcagctcaatatgccattgatcatttagat

SEQ ID NO: 2468 - DNA (genomic), 1134 bp, Streptococcus pneumoniae; double-stranded, circular
  misc_feature (B) LOCATION 1...1134
  hypothetical: NO
  anti-sense: NO
aaacggatggtaccgcgtgtcaacgctccgagtggagtttttggcatgtggttttctttttatctacgagagactgatggaggaaatatgtcaactattgaagaacaattaaaagcgcttcgcgaagaaacgctggctagcttgaagcagattactgctggaaatgaaaaagagatgcaagatttgcgtgtctctgtccttggtaaaaagggttcgctcactgaaatcctcaaagggatgaaagatgtttctgctgagatgcgtccaatcatcgggaaacacgtcaatgaagctcgtgatgtcttgactgctgcttttgaagaaacagctaagctcttggaagaaaagaaagtcgcggctcaactggctagcgagagtatcgatgtgacgcttccaggtcgtccagttgcgactggtcaccgtcacgttttgacacaaaccagtgaagaaatcgaagatatcttcatcggtatgggttatcaagtcgtggatggttttgaagtggagcaagactactataactttgaacgtatgaaccttccaaaagaccacccagctcgtgatatgcaggatactttctatatcactgaagaaatcttgctccgtacccacacgtctccagttcaggcgcgtgctatggatgcccatgatttttctaaaggtcctttgaagatgatctcgccagggcgtgtcttccgtcgcgatacggacgatgcgacccacagtcaccaattccaccaaatcgaaggcttggtagttgggaaaaatatctctatggctgatcttcaaggaacgcttcagttgattgtccaaaaaatgtttggtgaagagcgtcaaattcgtttgcgtccatcttacttcccattcacagagccatctgttgaggtggatgtttcttgcttcaagtgtggtggagaaggctgtaatatatgtaagaaaacaggttggatcgaaattatgggggccggtatggttcacccacgtgtccttgaaatgagtggtatcgatgcgactgtatactctggctttgcctttggtcttggacaagagcgtgtagctatgctccgttatggaatcaacgatatccgtggattctaccaaggagatgtccgcttctcagaacagtttaaataa

SEQ ID NO: 2469 - DNA (genomic), 354 bp, Streptococcus pneumoniae; double-stranded, circular
  misc_feature (B) LOCATION 1...354
  hypothetical: NO
  anti-sense: NO
accattgtggtgaacacgagccatttatcaaattgtccaaaatgtaactcagaatatgtctacgaagacggtgccctactggtttgcccagagtgtgctcatgagtggaatcctgctgaagttgcagaagtagaagaaggtcttgtcgctatcgatgccaacggaaataaattggctgatggtgatatagtaactctcatcaaggacttgaaagtaaaaggtgcgccaaaagatttgaaacaagggacgcgcgtgaaaaatatccgcatcgtagaaggcgaccacaatatcgactgtaagattgatggttttggtgccatgaaacttaaatcagagtttgtgaggaagatttaa

SEQ ID NO: 2470 - DNA (genomic), 402 bp, Streptococcus pneumoniae; double-stranded, circular
  misc_feature (B) LOCATION 1...402
  hypothetical: NO
  anti-sense: NO
cggttcgtggttaagaggcttggttatgancactcaatggctcggcacctcggtgcagtatataatttgccacatggtgtttgctgtgccatgttgctaccagttatagagcgtgaaaatgctaaacgtgtaccagaagctttccgcaatgttgccaaagccttgggacttcatgtagaaggtaaatcagatcaagaatgtgccgattatgcgattgttgagattgagaagctttctgagacagtaggtattcctaagaaactgactgaacttggtattgaagaaaaagatttcgactttgaatacctttctaagaatgccttgattgatgcctgcgcaccaggaaatccatttatgccaaccttagaagaaacgattgccttttataaagagttattttag

SEQ ID NO: 2471 - DNA (genomic), 894 bp, Streptococcus pneumoniae; double-stranded, circular
  misc_feature (B) LOCATION 1...894
  hypothetical: NO
  anti-sense: NO
aacgtcgtggtgcaagaaaaaataattgtgattgttggaccgactgctgttggaaagacggctctagctattgaagttgcaaagcgttttaatggcgaagtggttagtggagatagccagcaagtctatcgaggacttgatattgggacggccaaggctagtccagaagagcaggcagctgttcctcatcatttaatcgatgttagagagataaccgagtcttactcggcttttgattttgtttcagaagctaagatgactattgagggtattcacaaccgtggcaagctagccattatcgccggtgggactggactttatatccagagcttgctaaaaggttaccacctaggtggggagactcctcatgaggagattttagcttatcgagctagtttggagccatattcagatgaggaattagcccatttggtggagcaagcaggccttgagattccccagtttaatcgtcgtcgtgctatgcgtgccttagaaattgcccattttggtcaggatttggaaaatcaagagatcttgtatgaaccgctgattatctgcttggatgatgaacgtagtcaactttatgagcgtatcaaccaccgagtggatttgatgtttgaggctgggcttttggatgaggccaagtggctgtttgaccattcccctaatgtacaggctgctaaaggaattggctataaggaactctttccttatttccgtggagagcagacctttgaggaagctcgtgagagtcttaatcaggcgacccgtcgttttgccaagcgtcagctgacctggttccgtaatcgcatgctggtcaccttttatcatattggagaatctggtgtacaagaccgcattttaagccagatagaggagtctttagatgattga

SEQ ID NO: 2472 - DNA (genomic), 183 bp, Streptococcus pneumoniae; double-stranded, circular
  misc_feature (B) LOCATION 1...183
  hypothetical: NO
  anti-sense: NO
tttctagtggtaaagttgtttgatttgtgttatagtgaatatgcatgggatagcctttctaaatggtttattaagcaattctattttaccaagactatcgtaaccatgcaaaaaagcaacggcaaatccgttgccttttttggatataagagactattgtcccagactcttttctttgtataa

SEQ ID NO: 2473 - DNA (genomic), 1011 bp, Streptococcus pneumoniae; double-stranded, circular
  misc_feature (B) LOCATION 1...1011
  hypothetical: NO
  anti-sense: NO
gaatcatcggtagtctcgtctttatcctacttctctggagagggggacgaaaagatgcagactaaaagcaaacataccaagctcttctggattctcattattcttgccatcggagcttgtcttctctacttttggcccatcactcacttgtcagcctttgcttggaagttgcgttcccaaaagatcatcgtttatctcttggtagccatcgcgactgggatttcgaccattagttttcaaaccctgacggaaaatcgcttcctgacgcctagtattttgggaattgaatccttctacgtcctactacaaaccctactactggtttttgaaagcaagtttcttcaacttggcaaatcccctatcttagaattcctagtcttacttcttgtccagtccctcttctttctcgccttacaaggttacttgaagacactgatgaagcaagacctggtcttcatcctgctgatctgtctagcgctcagaagtctctttcgaaatatcagcaccttccttcaagtcctaatggatccaaacgaatacgataaactgcaaaatagtctttttgcctcctttcaacatctcaacacttccatcctagccatcggttctctgatcatcctcgctttgacaatctttttctttcgaaaagcagtcgttctagatgtcttgcacctgcaaagagaaacggctcagatattgggactcgatgttgaaaaagaacagaaagagctcctctggggaatcgtgcttttgacctcaacggccactgccttggtaggacctatggccttcttcggctttatgctggccaacctcacctacctgattgtcaaagactatcagcacaagttactctttatagtggccattctgattggatttattagcttaaccttggggcaagccttgattgaacgagtctttgcactggaaattcgtatcagtatgatcattgagagtgtgggtggcttcttattctttatcttactatataggagggctcgtcagtga

SEQ ID NO: 2474 - DNA (genomic), 186 bp, Streptococcus pneumoniae; double-stranded, circular
  misc_feature (B) LOCATION 1...186
  hypothetical: NO
  anti-sense: NO
tgtatcccggttaacgaaagttttggacttatactctccgaaaatgctcttcaaaccgacgtcaacgtcgccttgccgtgcgtatggttactgaatacgtcagttctatccacaacctcaaaacagtgttttgagcaatctgcggctagtttcctagtttgctctttgattttcattgagtactaa

SEQ ID NO: 2475 - DNA (genomic), 447 bp, Streptococcus pneumoniae; double-stranded, circular
  misc_feature (B) LOCATION 1...447
  hypothetical: NO
  anti-sense: NO
gtggaaacggtcaagcgtttgagaaagtatcccaagattgagattgtttcccatttgatcaatggtttgcctggtgaaacccatgagatgatggttgaaaatgtccgccgttgtgtcacgaataacgatattcaagggattaaactgcatttgctccatcttatgacaaatactcgtatgcaacgagattaccatgagggacgtttacaattgatgagtcaggacgaatatgtcagggtcatctgtgaccaactggaaattattcccaaacatatcgtcatccatcgaattacaggagatgcgcctagggatatgctgcttgggcctatgtggagcctcaataaatgggaagctctcaacagcattgagatggagatgcgacgtcgtggaagtgttcaaggatgcaaggctgtaaaacaggagtttgaaaatgaaaagaccacttga

SEQ ID NO: 2476 - DNA (genomic), 285 bp, Streptococcus pneumoniae; double-stranded, circular
  misc_feature (B) LOCATION 1...285
  hypothetical: NO
  anti-sense: NO
gagaagacggtatacgatcaaaccattcaccgtgtagccgaaatcgttcagaatgaagacttgtataagaaaggtttgaatgttgaacttgcgcaccaacaaattaagggattttttgaagcagagtttaaaaatcgtattaatggagttcttaatactaaaataaaaaatagtacattaaatcgtgtaaataaaaaaactatacaccagagcaacaaaaactccatgatcaatttgaagcagaagcaacggaagatgctaaaaaacaaggcgatattgtgttga

SEQ ID NO: 2477 - DNA (genomic), 885 bp, Streptococcus pneumoniae; double-stranded, circular
  misc_feature (B) LOCATION 1...885
  hypothetical: NO
  anti-sense: NO
aggtcacaggttcgactgttaccagctattgggctaataagtcaggagcgccagcgacaagttatcgctttgctattggtggaagtgatgcggattatcagaatgcttggtctagtattgtggggagtctaccaactccatccagctccagcagttcaagtagtagttctagcgatagcagtaactcaagtactacacgaccttcttcaagggcgagacgataattctctaaatgaagtggccaatcaatggattgccacttttttcctttcgtgttacaataagggtatgaatcagtatcagaaaaagattgttaacggaaaaatttattcgctcctatccggcttaatatggggaatctgtggaattttaggaaagtacttctttactcattatcaggtgtcttcgggctggattacctctatgcgtttgacactggcagggagtcttgtactcatttggtctgcaatacaattaaaatcgcaagtgctagatatttggcgagacaagaaaaattacctgccctttttagcctatgctattttggggattttttcagttcagtattttttctatctctgtgtagaatactcaaatgctacgacagcaactattttacagtttattagccctgtctttatcctcttttataatcgcttggtttatcaaaaacgagcgtcaaaaagcgctgttttctatgttttggttgccatgctgggtgtttgcttgatggcgacaaagggagatctctctcagttatccatgacgccgctagctcttataacaggtttgctgagtgccatgggtgttatgtttaatgttatcttgccccaaccttttgctaagcgttatggttttgttctaacgagttgggtggggggatga

SEQ ID NO: 2478 - DNA (genomic), 474 bp, Streptococcus pneumoniae; double-stranded, circular
  misc_feature (B) LOCATION 1...474
  hypothetical: NO
  anti-sense: NO
cctggtaaggtttgtatcaccaaggttaagactggttttggtacaggtggttggcagttggctgctctacgctggtgtgccaaggctgcgcgtaaaccgattatcgctgatggaggaattcgtactcacggtgatattgccaagtctatccgcttcggtgctagcatgatcatgattggttccctctttgcaggacacattgaaagtccagggaaaacgattgaagtcgatggtgaacagttcaaagaatattatggttcagcctcacaatatcaaaaaggtgcttacaaaaatgtggaaggcaaacgtatcttgcttcctgctaaaggtcatctgcaagacactttaactgagatggaacaagaccttcaaagtgctatttcttatgcaggtggacgtcaggttgctgaccttaaacacgttgattatgtgatcgtgaaaaactccatctggaatggggatgcttcccactaa

SEQ ID NO: 2479 - DNA (genomic), 219 bp, Streptococcus pneumoniae; double-stranded, circular
  misc_feature (B) LOCATION 1...219
  hypothetical: NO
  anti-sense: NO
gaaagcaaggtttggtattgtttcaccaaggcatttcttggctctttcaagatgcgaaccaagtcatcaacggtcaattgctcaagagccgcaaaaacaggcaagcgtccaatcaactcagggataataccaaattttgaacttctctcttaccanggcgngcgttggggnaggggtacaaatgtacaaggggtgcngttacgnatggggtccgcttga

SEQ ID NO: 2480 - DNA (genomic), 996 bp, Streptococcus pneumoniae; double-stranded, circular
  misc_feature (B) LOCATION 1...996
  hypothetical: NO
  anti-sense: NO
gcaaggaaggttggaggcactatgaaaacgcgtattacagaattattgaagattgattatcctattttccaaggagggatggcctgggttgctgatggtgatttggcaggggctgtttccaaggctggaggattaggaattatcggtgggggaaatgccccgaaagaagttgtcaaggccaatattgataaaatcaaatcattgactgataaaccctttggggtcaacatcatgctcttatctccctttgtggaagatatcgtggatctcgttattgaagaaggtgttaaagttgtcacaacaggagcaggaaatccaagcaagtatatggaacgtttccatgaagctgggataatcgttattcctgttgttcctagtgtcgctttagctaaacgcatggaaaaaatcggtgcagacgctgttattgcagaaggaatggaagctggggggcatatcggtaaattaacaaccatgaccttggtgcgacaggtagccacagctatatctattcctgttattgctgcaggaggaattgcggatggtgaaggtgctgcggctggctttatgctaggtgcagaggctgtacaggtggggacacggtttgtagttgcaaaagagtcgaatgcccatccaaactacaaggagaaaattttaaaagcaagggatattgacactacgatttcagctcagcactttggtcatgctgttcgtgctattaaaaatcagttgactagagattttgaactggctgaaaaagatgcctttaagcaggaagatcctgatttagaaatctttgaacaaatgggagcaggtgccctagccaaagcagttgttcacggtgatgtggagggtggctctgtcatggcaggtcaaatcgcagggcttgtttctaaagaagaaacagctgaagaaatcctaaaagatttgtattacggagccgctaagaaaattcaagaagaagcctctcgctggacaggagttgtaagaaatgactaa

SEQ ID NO: 2481 - DNA (genomic), 324 bp, Streptococcus pneumoniae; double-stranded, circular
  misc_feature (B) LOCATION 1...324
  hypothetical: NO
  anti-sense: NO
cggcttgaggttgctggatttacgtggagtttgtgcttgaggatatatcttcatgggcccttgataaccactgtcagccaagattttaccagcttgtccgatatttctgcgactcattttgaacaacttcatatcgtggcaatagttcaccgcaatattcaaagaaacaattctttcttggctggtgacaatcgcttgaggttccatagaatgacatttctattttaccagaataattggctagttgatttttttaggacgatttatttttacctctgttgcatccacaatcaccgtattctcagcactaagatgagtttttga

SEQ ID NO: 2482 - DNA (genomic), 321 bp, Streptococcus pneumoniae; double-stranded, circular
  misc_feature (B) LOCATION 1...321
  hypothetical: NO
  anti-sense: NO
tatcgtgaggtgaattttatggcaaatctaaatcgattcaaatttacattcgggaaaaaatcgttaaccttgacaagcgaacatgacaacctttttatggaggaaatcgctaaggttgcgacagaaaaataccaagcaattaaagaacaaatgcctagcgcagatgatgaaacaatcgctcttttgttggcagtcaactgtttatcaactcagctcagccgtgagattgaatttgacgataaggagcaagagctagaagaactccgtcacaagcttgtgacttgtaagcaagaacagagcaagattgaggattccttatga

SEQ ID NO: 2483 - DNA (genomic), 192 bp, Streptococcus pneumoniae; double-stranded, circular
  misc_feature (B) LOCATION 1...192
  hypothetical: NO
  anti-sense: NO
agaagcgaggtccaaactatttacaaaccaatgttttggaagacccaagatcgacacggaaaggctttggttggtaatcgcgttggtcaatggcgctatagaattggtaattatcgagttatcgtacaaattgtagatgatgaattagtcgttgctactctagaagttggtcatcggagagatatttattaa

SEQ ID NO: 2484 - DNA (genomic), 567 bp, Streptococcus pneumoniae; double-stranded, circular
  misc_feature (B) LOCATION 1...567
  hypothetical: NO
  anti-sense: NO
accgtagaggtgtttatgaatgtttggaccaaattagcaatgttttctttttttgaaacggatcgcttgtatttgcgtcctttcttttttagtgatagtcaggacttccgcgagatagcttcaaatccagaaaatcttcaatttattttcccaacgcaggcaagtctggaagaaagtcaatatgcactggccaattactttatgaagtcccctttgggagtgtgggcaatttgtgaccagaaaaatcaacaaatgattggttctattaaatttgagaagttagatgaaatcaaaaaagaagctgagcttggctattttttgagaaaagatgcttggtcgcaaggatttatgacagaggttgttagaaaaatttgtcagctttcttttgaggaatttggcttaaaacaattatctatcattacccaccttgaaaatgaagctagccaaagagttgctcttaagtctggatttagtttgttccgtcagtttaagggaagtgatcgttacacaagaaaaatgcgggattatcttgaatttcggtatgtaaaaggagagttcaatgagtaa

SEQ ID NO: 2485 - DNA (genomic), 687 bp, Streptococcus pneumoniae; double-stranded, circular
  misc_feature (B) LOCATION 1...687
  hypothetical: NO
  anti-sense: NO
aataaagaggttctttttatggaatttatgcttgacacattaaatttagatgagattaaaaagtggtctgaaattttgccgctagctggggtaacttcaaatcccactattgcaaaaagagagggttctattaatttttttgaacgaatcaaagatgtaagagaattgattggctctacaccctctattcatgttcaggtgatttctcaagattttgaaggcatcttaaaggatgctcatgaaattcgaagacaagcaggagatgatatatttatcaaagtacctgttactccagctggattacgtgcaataaaggtgctaaaaaaagagggctaccatatcactgcaacagctatttatacagttattcagggattattagctatcgaagtaggagcggattacctagctccatattataatagaatggaaaatctgaacattgattcaaattctgtcattcgtcaattagctcttgctattgatagacagaactctcctagtaagattttagctgcatcctttaaaaatgtagcacaagtaaataatgctttagctgcaggtgcgcatgctgttacagcaggagcagatgtttttgaatcagctttcgccatgccatctatccaaaaggcggttgatgatttttctgacgattggtttgttattcaaaatagtcgttccatttag

SEQ ID NO: 2486 - DNA (genomic), 915 bp, Streptococcus pneumoniae; double-stranded, circular
  misc_feature (B) LOCATION 1...915
  hypothetical: NO
  anti-sense: NO
ttattggaggttaggatgaaaaaactccccttagtattttcaggttgtttgctaggtttggcaggagctggaaatcttattttagatacgttgccggttctatcccatctttttagtctgactggtttggttttatggatttactttctaattctgcatctctttaattggaaagaaaccaagcaagaattgaccaagccccctcttttgtcaggaatggcaacctttcctatggctgggatgattttatcgacctatgtctttcgcgtattctcttatcttcctttggtagcacaagggatttggtggttttcatttctcttggatttgaccttgattgctggttttaccatcaagtttgcttgtccagggcggatggttcatgccactccaagttggactgttctctatgtggggatagcagtggctgccttgacctatcctctggtaggtattatcgaaattgcctatgcgaccttgagttttggttttctcttgaccttctatctctatccccttatttatagcgatttaaagaaacatccactcccactagccttgcttggacaagaaggaatctactgtgctcctttctctctactcttggcttctctagttcgagtaggaggaaccagcctgccgacttggggcttgattgtcatgattttggcttctcaatccttctttttctttgttttaactcgtatgcccaacattttaaaacaaggctttcaaccagccttctcagccctcaccttcccaaccattatcacagcgacctcgctcaagatggctcagggaattttgaaacttccatttctggattacctggtattggctgaaaccattatatgcctaactattttattctttgtactaggtgcttatctgatttggttacgaaaaaaggtctag

SEQ ID NO: 2487 - DNA (genomic), 642 bp, Streptococcus pneumoniae; double-stranded, circular
  misc_feature (B) LOCATION 1...642
  hypothetical: NO
  anti-sense: NO
ttagaggaggttaaactgatgttgaataagataagagactatctagacttttctggtttgcagtaccgtagtcctgataaagcgggagcagagcgagagaagatgctggcgttccgccacaaaggacaagaggcccgaaaggcttttacagaactggccaaagcctttcaagcaagccatccagaatggcaactccaacagactagtcagtggatgaatcaggcccagcgtttgagaccacatttttgggtttatctacagagagacggacaagtgacagaacctatgatggccttacgtttgtatgggacatctactgactttggaatttctttggaagtcagtttcatcgaacgtaagaaggatgagcaaacactgggcaagcaggccaaagttttagacattccaaccgttaaagggatttattatctaacctactctaatggtcaaagtcaacggtgggaggcgaatgaagaaaagcgtcgtactttacgcgagaaggtgagaagtcaagaagttcgaaaagttttagtgaaggtagatgttcctatgacagaaaattcgtctgaagaagaaatcgtagaaggcttattgaagtcttattctaaaattcttccctattatctagctacgagaaaataa

SEQ ID NO: 2488 - DNA (genomic), 561 bp, Streptococcus pneumoniae; double-stranded, circular
  misc_feature (B) LOCATION 1...561
  hypothetical: NO
  anti-sense: NO
aagttgtgggtggaggcgtcccnacgggttctcaaggggattgacttgggccttggggaactgcgtccagatgtcattgtcatggatattgtcatgcctgagatgaatgggattgacgcgaccttagcaatccttaaagaatggcctgaagccaagattttgattgtgacttcttatttggacaatgaaaaaatcatgccagtcttagatgctggtgccaaaggctatatgctcaagacttctagtgcagatgaattgcttcatgccgtcagtaaggtagctgctggcgagctggccattgagcaagaggttagcaagaaggttgaataccaccgcaatcatatggaacttcatgaagaattgactgcgcgtgagcgagatgttctccaactcatcgccaagggctacgaaaatcagcgcatcgcagatgacctctttatctcactcaagacggtcaagacccacgtgtccaacattcttgccaaacttgaagtcagcgatcgtacccaggcggctgtctatgcctttcagcaccatttggtggggcaagaggagttttag

SEQ ID NO: 2489 - DNA (genomic), 195 bp, Streptococcus pneumoniae; double-stranded, circular
  misc_feature (B) LOCATION 1...195
  hypothetical: NO
  anti-sense: NO
gcatcgtgggtcacaataatgactgttttcccttctcgattcatctctaagagaaacttcaagaccaaatctctattttcaggatccagcgaacctgtaggttcatcggctaaaatcagctggctgggttttaagatggctctagcaactgcaattcgttgttgttcgcccccagacaactcggagaccctttga

SEQ ID NO: 2490 - DNA (genomic), 288 bp, Streptococcus pneumoniae; double-stranded, circular
  misc_feature (B) LOCATION 1...288
  hypothetical: NO
  anti-sense: NO
ggtcttggggtaaaaaaacaaaaggcttgcttttcagccatagaggaggtcatcatgtataaacacttatttttcctagattccaaaactttagatcggttgacaccctatattctagtcttggcttctgacaccattgcttttaatgtttttgtgctaacctttgtatctgcggtggtttttaatttcctaaattccatgctagctttaatggctatattcataggggctggctatgtggtcggattttggttactaatactcaatgaaaatcaaagagcaaactag

SEQ ID NO: 2491 - DNA (genomic), 405 bp, Streptococcus pneumoniae; double-stranded, circular
  misc_feature (B) LOCATION 1...405
  hypothetical: NO
  anti-sense: NO
agattttctttagcacatgaactgtatcatctttattatgatgaggtgaagaagagttcagtcagtcttatcttgattggtgaaggagatgaaactgaaagaaaagcggatcagtttgcttcttattttttaattttcccatcttcactgtataggatggttgaggaaatcagagaaaatgccaatagaactcatcttgaagtagaagatattataaaattgggtcagttttatggtatcagtcataaagctatgttatatagattgaggaatgatggataccttgatgcagaagaaattaaaaatatggatattagtgttatagagacagcttcaagattaggctatgatacaagtttatatcgtcctttgtcagaaagtaaaaaagaaatggcattaggataa

SEQ ID NO: 2492 - DNA (genomic), 669 bp, Streptococcus pneumoniae; double-stranded, circular
  misc_feature (B) LOCATION 1...669
  hypothetical: NO
  anti-sense: NO
cagcctttattggtccaaatggtgctggaaaatcgactcttcctctccatcatgagcagactaaccaagaaagatcagggagttctcagtatcaaaggacgtgaaatcgagagctggaattcgcaagaactggcccaagaactaaccatcctaaaacagaaaatcaattaccaagccaaattgactgttgaagaactggtcagttttggacgttttccctacagccgaggtcgacttagatcagaagactgggaaaaaatccgagaaactctgaactatttggaactgaccaacttaaaagaccgctacatcaatagcctgtcaggggggcaactccagcgcgtctttatcgctatggtactggcccaggatacggactttatcttgctggacgaaccactcaataatctcgatatcaagcaaagcgtcagcatgatgcaaattcttcgacgactggtggaggaactcggcaagaccattatcatcgtcctccacgatatcaacatggccagtcagtatgcagatgaaattgtcgccttcaaggacggtcaggtctttagcaagggaagcaccgatcaaatcatgcaggctgacctgctcagccaactttatgagattcccatcacgctagctgatatcaatgacaaaaagatctgtatctatagctag

SEQ ID NO: 2493 - DNA (genomic), 1854 bp, Streptococcus pneumoniae; double-stranded, circular
  misc_feature (B) LOCATION 1...1854
  hypothetical: NO
  anti-sense: NO
agcgatttatttagaaagtgtgtaaatatggaattttcaaagaaaacacgtgaattgtcaattaaaaaaatgcaggaacgcaccctggacctcttgattatcggtggaggaatcacaggggctggtgtagccttgcaggcggcagctagcggtcttgagactggtttgattgaaatgcaagactttgcagaaggaacatctagtcgttcaacaaaattggttcacggaggacttcgttacctcaaacaatttgacgtagaggtggtctcagatacggtttctgaacgtgcagtggttcaacaaatcgctccacacattccaaaaccagacccaatgctcttaccagtttacgatgaagatggagcaacctttagccccttccgtcttaaagtagccatggacttgtacgaccttttagcaggtgtgagcaacacaccaactgcgaacaaggttttgagcaagaaagaagtcttggaacgccagccaaacttgaagaaggaaggcttggtaggaggtggagtgtatcttgacttccgtaacaacgatgcgcgtctcgtgattgaaaacatcaaacgtgccaaccaagacggtgccctcattgccaaccacgtgaaggcagaaggcttcctctttgacgaaagtggcaagattacaggtgttgtagctcgtgatctcttgacagaccaagtatttgaaatcaaggcccgtctggttattaatacaacaggtccttggagtgataaagtacgtaatttgtctaataagggaacgcaattctcacaaatgcgcccaactaagggagttcacttggtagtggattcaagcaaaatcaaggtttcacagccagtttactttgacacaggtttgggtgacggtcgtatggtctttgttctcccacgtgaaaacaagacttactttggtacaactgatacagactacacaggtgatttggagcatccaaaagtaactcaagaagatgtagattatctacttggcattgtcaacaaccgctttccagaatccaacatcaccattgatgatatcgaaagcagctgggcaggtcttcgtccattgattgcagggaacagtgcctctgactataatggtggaaataacggtaccatcagtgatgaaagctttgacaacttgattgcgactgttgaatcttatctctccaaagaaaaaacacgtgaagatgttgagtctgctgtcagcaagcttgaaagtagcacatctgagaaacatttggatccatctgcagtttctcgtgggtctagcttggaccgtgatgacaatggtcttttgactcttgctggcggtaaaatcacagactaccgtaagatggctgaaggagctatggagcgcgtggttgacatcctcaaagcagaatttgaccgtagctttaaattgatcaattctaaaacttaccctgtttcaggtggagaattgaacccagcaaatgtggattcagaaatcgaagcctttgcgcaacttggagtttcacgtggtttggatagcaaggaagctcattacctagcaaatctttacggttcaaatgcaccgaaggtctttgcacttgctcacagcttggaacaagcgccaggactcagcttggcagatactttgtcccttcactatgcaatgcgcaacgagttggctcttagcccagttgacttccttcttcgtcgtaccaaccatatgctctttatgcgtgatagcttggatagcatcgttgagccagttttggatgaaatgggacgattctatgactggacagaagaagaaaaagcaacttaccgtgctgatgtcgaagcagctctcgctaacaacgatttagcagaattaaaaaattaa

SEQ ID NO: 2494 - DNA (genomic), 882 bp, Streptococcus pneumoniae; double-stranded, circular
  misc_feature (B) LOCATION 1...882
  hypothetical: NO
  anti-sense: NO
gaaggtttattatctttaatgaatacactcgcagagaaattcagattgaaaagaaaagagttgagactctcccaacaaactcttgcagaaggaatttgtgaacaaagtcagattagtaaaattgagagagggcatttcattccctccgcagaccttttgttcaaactctctcaacgacttgaagtaccattagattatttttttaatgaacaaattgaaattaaatctaacctctctaatttcaagcaattgtctgctcgactattagacgatagaaattatgacgatttggaatatatttatagaatagagattgaacgaagtacttttctaacactagaagaccgaacttaccttgaatggattaaagctattattgacttctatcaatatgacagtaagtgtgaggcaatttcttcattggaaaatatattattaaaagtctcttcaaatactctgatttatttaaaggcgttgaatactctatctaatttctattccttagtgggtcgtgaacaagaatatgaggcaaactactctcatttaatagagttgtatcagacaaaaaatttggaccatcaagagtttttatttggctacatcagagttcgttacaactacgctcactacctagtatcaaaggaaaaatataatgaagccatccaagaagctcttgaaacgattgaactctgtaaacaaagacagacaagctaccaattggctcctctacttattcttgtaggaaatgctggagccaaatttctagacagagaacaagtcaaaaattattatatagaagcaagagagttatgtaagatttataacaatcctttaatgttgatgaagatagaaaattatttgaaggaactagatactgtttag

SEQ ID NO: 2495 - DNA (genomic), 195 bp, Streptococcus pneumoniae; double-stranded, circular
  misc_feature (B) LOCATION 1...195
  hypothetical: NO
  anti-sense: NO
ccaatattattggagggggtgagtggggaaacccggtggcattggcatttcccaaggaccaagcgcaaccccggaggggttcaaacaattttaggtgttagcaaaaaatttttagtgaatttnttcatagggttaaatacccttctttttttnnttcaaatattttaccaccaaatgaaaagtaaaataaaatga

SEQ ID NO: 2496 - DNA (genomic), 1512 bp, Streptococcus pneumoniae; double-stranded, circular
  misc_feature (B) LOCATION 1...1512
  hypothetical: NO
  anti-sense: NO
ccccaattattcacccctaatctaaaaaccatccagaatccttgccttagcttagatcctggatggtttcttttttcacccaatgggtgttttttactagacaaaaaagagtttcccctttatggtataagtgtagaaaaaaacacaaaaagaaaggaaactcacatgaacagtttaccaaatcatcacttccaaaacaagtctttttaccaactatctttcgatggaggtcatttaacccagtatggtggtcttatcttttttcaggaacttttttcccagttgaaactaaaagagcggatttctaagtatttagtaacgaatgaccaacgccgctactgtcgttattcggattcagatatccttgtccagttcctctttcaactgttaacaggctatggaacggactatgcttgtaaagaattgtcagctgatgcctactttccaaaattgttggaaggagggcagcttgcttcacagccaaccttatcccgttttctttccagaactgacgaggaaacagtccatagtttgcgatgcctcaaccttgaattggtcgaattctttttacagtttcaccagctaaaccaactcattgtagatatcgattctacccatttcacaacttatggcaagcaagaaggtgttgcttataacgctcactatcgtgctcatggctatcatcctctttatgctttcgaggggaagacaggttattgtttcaatgcccagcttcgtcctggtaatcgttattgttctgaagaggcagacagctttatcacacctgttttagaacggtttaatcaacttctctttcgaatggatagtggctttgcgaccccaaaattatacgatttaattgaaaaaacagggcaatactacctcataaaactcaagaaaaatactgttctgagccgtcttggagacctttccctcccttgcccacaggatgaggacttaaccatcttgccccactccgcctactcagaaactctctatcaagcaggatcttggtcgcacaagcgtcgtgtctgccagttctctgaacgaaaagaaggaaacttgttctacgatgttatttctctcgttacaaatatgacgagtggaacaagccaagaccagtttcagctttatcgtggacgtggtcaagccgagaatttcatcaaggagatgaaggagggattttttggcgataaaacggatagttcaaccttaatcaaaaacgaagttcgtatgatgatgagctgtatcgcctacaatctctatctttttttcaaacatctagctggaggtgacttccaaactttaacaatcaaacgcttccgccatctttttcttcacgtggtaggaaaatgtgttcgaacaggacgcaagcagctcctcaaattgtctagtctctatgcctattccgaattgttttcagcactttattctaggattagaaaagtcaacctgaatcttcctgttccttatgaaccacctagaagaaaagcgtcgttaatgatgcattaa

SEQ ID NO: 2497 - DNA (genomic), 864 bp, Streptococcus pneumoniae; double-stranded, circular
  misc_feature (B) LOCATION 1...864
  hypothetical: NO
  anti-sense: NO
aaaaaattattttcatgtgctttagcattttcaacgattggaacattgtcaacgattgataaatcaggagttcttcctttttcagcgcaaacggtgcaggctgacatacaaacgcttaccccaatggcaaaatattatattattcttccgaaggatgcagaaatatataaaacttggagaggtactgtcaatattcccattattgatgctacaaaaactactccagaattatcttatttcaaagaagatcatcgcaactatatagctaatgagaataagtctggtgccaattacatagagtggaagggaacagtagaagagtttaaagaggccattaagaagttgactgataaaaaatcaactactgcaacaccaaaaaaggatgaaaagccaacaccaaaaccggatgagaagccaaaaccaacacctacagttcagtctggttgggtaggttcatcctattatcaagatggtaaaaaagtcattagtaagtggatttttgataaaaaatataattcatacttctatctagatgcatcaggaaattatgttcaaaacgcttgggtaggtaactattatcttaaatcaggcggatacatggctaaaggtgaatgggtttatgatgccacctatcaagcttggtattatttgacatcagatggttcttatgcttacagtacatggcaaggaaattactatctaaaatcggatggtaaaatggctgtcaatgaatgggttgatggtggacgttattatgttggcgctgacggagtttggaaggaaggtcaagcaagtacagtttcttctagtaatgatagcaatagtgaatatttctgctgctttaggaaaggcaaaaagttataa

SEQ ID NO: 2498 - DNA (genomic), 303 bp, Streptococcus pneumoniae; double-stranded, circular
  misc_feature (B) LOCATION 1...303
  hypothetical: NO
  anti-sense: NO
ttagaattatttggaggaatcattaacatggcaaacaaacaagatttgatcgctaaagtagcagaagctacagaattaactaagaaagactcagcagcagcagttgaagctgtatttgcagcagtagctgactatcttgcagctggtgaaaaagttcagttgatcggttttagtaactttgaagttcgtgagcgcgcagaacgtaaaggtcgcaacccacaaactggtaaagaaatgacaattgcagcttctaaagtaccagcattcaaagctggtaaagctcttaaagacgctgttaaataa

SEQ ID NO: 2499 - DNA (genomic), 288 bp, Streptococcus pneumoniae; double-stranded, circular
  misc_feature (B) LOCATION 1...288
  hypothetical: NO
  anti-sense: NO
tgcccttttttgtttcaatatactatggctccgatgacctataaagatacgatgacgagtgactttttcgaagcttgcttccaaaaattcttactacctactttagatacaccatcccttatcattatggacaatgcaaggtttcacagaatgaacatgtgtaaggagcagggcatagactgttaccacttcctacctattcacctgagtataatcccattgagaaaatatgggcttacatcaaaaacatctcagaataatattgtcaaattacgatgcttttcttga

SEQ ID NO: 2500 - DNA (genomic), 882 bp, Streptococcus pneumoniae; double-stranded, circular
  misc_feature (B) LOCATION 1...882
  hypothetical: NO
  anti-sense: NO
aaaaggttattacatatgtcacgccaaacaccgtcactctcatttgaagtgttccctccaaacccagccgtgggtaatggtaacattatttcagccttgcaggatatgcaggagttggctccccattttatcagtgtaactgccagcaataataaatttaatatcaaggaaacgacggttcgtttggctgactttatccaaaatgatttggcgattccgaccattgcccacttgccagctatttatctaactaaggacaaggttgctgaaactattgctgacttggacaaagttggggtgcagaaaatcttggctcttcgtggggatattattccagacgtggaaccacaaaaggatttccgctatgcaaccgacttgattgagtttatcaaggaacaaacccctcactttgatattattggagcttgctatccagaagggcatccagattcgccaaatcagatttcagatattcaaaatcttaagaagaaagtggatgcaggctgttcgagcctcgtaactcagctcttctttgacaatgagcgcttctatgattttcaggacaagtgcatcttggctgggattgatgttcccattcatgcaggaattatgccaattctgaatcgaaatcaggctctccgactcttgaagacttgtgagaatatccatcttccacgcaaatttaaagccatcttagacaagtatgagcatgaccctgaatcgctcagagcagcaggacttgcctatgcagtggaccaaatcgtggacttggtaactcaggatgttgccggtgtgcatctctatacgatgaataatgctgatacagcaaaatacatccatcaagcaacccatgccttgtttaatcaccagtctctaggataa

SEQ ID NO: 2501 - DNA (genomic), 585 bp, Streptococcus pneumoniae; double-stranded, circular
  misc_feature (B) LOCATION 1...585
  hypothetical: NO
  anti-sense: NO
ctggaatttttgaataaaggaggacaaatgaaaaaagtaatgtttgctggcttaagtctcttgtcattagttgtattgatggcctgtggtgaggaagaaactaaaaagactcaagcagcacaacagccaaaacaacaaacgactgtacaacaaattgctgttggaaaagatgctccagacttcacattgcaatccatggatggcaaagaagttaagttatctgattttaagggtaaaaaggtttacttgaagttttgggcttcatggtgtggtccatgcaagaaaagtatgccagagttgatggaactagcggcgaaaccagatcgtgatttcgaaattcttactgtcattgcaccaggaattcaaggtgaaaaaactgttgagcaattcccacaatggttccaggaacaaggatataaggatatcccagttctttatgataccaaagcaaccaccttccaagcttatcaaattcgaagcattcctacagaatatttaattgatagccaaggaaagattggaaagattcaatttggtgctatcagtaatgcggatgcagaagcagcatttaaagaaatgaactag

SEQ ID NO: 2502 - DNA (genomic), 1359 bp, Streptococcus pneumoniae; double-stranded, circular
  misc_feature (B) LOCATION 1...1359
  hypothetical: NO
  anti-sense: NO
ggaggtctatttatggatcaacaaaacgggttgtttggttttcttgaaaaccatgttatgggaccaatgggcaaacttgctcagtttaaagtagtacgtgctatcacggctgcaggtatggctgctgtaccatttactattgtaggatcaatgtttttggtattcagtattttgccacaagctttctcattttggccaattgtggcagatattttctctgcttcatttgataaattcagatcactttacatggttgcaaactatgcgactatgggttctctatctctttatttcgttctatcacttgcatatgaattgacaaaaatttatgcagaggaagaagaactcaatatgaatcctcttaatggtgccttgcttgccttgatggcttttgtcatgacagtaccgcaaatcatttttgatggtggaatgatgaagactgtgacaagtctaaaagaaggtgcagtaattgcagatggatgggcaatgggaaatggagtcgcacgttttgggacaacagggatttttaccgcaatcattatggcaattgtgactgttcttatttatcgtatgtgtgttaaacataattgggttattaaaatgcctgaagctgttccagaaggagtttctcgtggatttaccgctttggttccgggatttgttgttgcatttgttgttatctttatcaacggtcttcttgtagcaatgggaacagatatttttaaagtcattgcaattccatttggttttgtatccaatctgactaattcgtggattggtttaatgattatttatctattgactcaactactttggattgtaggtatccacggtgcgaacattgtttttgcatttgttagtccaattgctcttgccaacatggctgaaaatgctgctggcgggcacttcgctgttgcaggtgaattttctaatatgtttgtaattgcaggtggttctggtgcaactttaggactatgtttatatattgcttttgcctctaaatctgaacagcttaaagcaataggacgagcatctgtagttccagccttatttaatattaatgaaccattaatttttggattacctattatctataatccagccttggctataccatttattttagcaccaatggttactgctactatttattacgtagcgaattctctaaactttattaagccaattatcgcacaggttccatggccaactccagtagggattggagctttcttagggacagcagatcttcgagctgtattagttgctctagtatgtgcatttgcagcattcctagtctatcttccattcatccgtgtatatgatcaaaaattggtgaaagaagagcaaggtatctaa

SEQ ID NO: 2503 - DNA (genomic), 363 bp, Streptococcus pneumoniae; double-stranded, circular
  misc_feature (B) LOCATION 1...363
  hypothetical: NO
  anti-sense: NO
attaggctattttttggtataataaaagttatggaaatcgaaaaaaccaatcgtatgaatgcgctctttgaattttatgcggcgcttttgacagataagcaaatgaattatatagagctttactacgctgatgattacagtcttgctgagatagctgaggagtttggtgttagtcgtcaggctgtctatgacaatatcaagcgaacagaaaagattctggaagattatgagatgaaattgcacatgtactcggactacattgtccgtagtcagatttttgaccaaatcttggagcgctatcccaaggatgattttctgcaggagcagatagaaattttaacaagcattgataatagagaataa

SEQ ID NO: 2504 - DNA (genomic), 510 bp, Streptococcus pneumoniae; double-stranded, circular
  misc_feature (B) LOCATION 1...510
  hypothetical: NO
  anti-sense: NO
agaaggctattcgctcattgggacctgtcaacttggaagctattgaccagtacgaagaagttcacaaccggtctggactttctaaatagtcagcgagatgatattttgtcagcgaaaaatctgctccttgaaaccattacagagatgaatgatgaggtcaaggaacgctttaaatcaacctttgaagctattcgtgagtcctttaaagtgaccttcaagcagatgtttggcggaggtcaggcagacttgatattgactgagggcgaccttttaacagctggtgtggagatttctgttcacctccgagataagaaaatccagtcgcttaacctcatgagtggtggtgaaaaagctcttcggctcttgccttgcttttctccattattcgtgtcaagaccattccttttgtcatcttggatgaggtggaagctgcgctggatgaagccaatgttaaacgttttggggattacttcaaccgctttgacaaggacagccagtttatcgtcgtaa

SEQ ID NO: 2505 - DNA (genomic), 228 bp, Streptococcus pneumoniae; double-stranded, circular
  misc_feature (B) LOCATION 1...228
  hypothetical: NO
  anti-sense: NO
atggttatatttttgcttaaaatgaaacatttttttgcaggaattggtgaaataaactttgtaagttatttattgtatatatgtgtaggaatagcccctttttttcacgtatatataataggttctgaaatgaattttgtgaaaatagtgttatctattttgggaattatatttgtttgtattttaactattgctcgaatttataggacttttttctataaagaatag

SEQ ID NO: 2506 - DNA (genomic), 708 bp, Streptococcus pneumoniae; double-stranded, circular
  misc_feature (B) LOCATION 1...708
  hypothetical: NO
  anti-sense: NO
tactatatattgaaaggaggtgataatatggtagaacaaagaaaatcaattaccatgaaagatgttgctttagaagcaggagttagtgttggaactgtttcacgtgtaattaataaagaaaaaggcattaaagaagtaactttgaaaaaagtggaacaagcgattaaaactttgaattacattccagattactacgctagaggaatgaaaaaaaatcgaacagaaacgattgcaatcattgtaccaagtatctggcatcccttcttttcagaatttgctatgcatgtggaaaatgaagtctataagagaaataacaaattactcttatgttctatcaatggtacaaatagagagcaagactatctggagatgttgcgtcataataaagttgatggagtggttgccattacctatagtccaattgaacattacttgacgtcaggaattccctttgttagtattgaccgcacatactcagatattgccattccttgtgtttcatcagataatgatgcaggttggagagaagcagctaaacaattaattagtaaaggatgtcagcatttagcctttgtgggcggacataatacaaccattaatgaaaccaaacgtcgtagaattcatttgaaaagtatgtccaagagcataaaatacttcttagtatttttgatttggatgagacagttactgactattatggaaagctag

SEQ ID NO: 2507 - DNA (genomic), 210 bp, Streptococcus pneumoniae; double-stranded, circular
  misc_feature (B) LOCATION 1...210
  hypothetical: NO
  anti-sense: NO
cctgtctctttagagcctttaagcgttatcttaaataccgtggaaaagtcagagaaagtatggcggcagattgccctgaacgctttgactgggagtttatcagatggattctttgggatggacgtagcaaaactcaaaaagaaaattaccaaaaactttgccaagaatattcacataaagtcactattcttcgaaatcagagagagctag

SEQ ID NO: 2508 - DNA (genomic), 456 bp, Streptococcus pneumoniae; double-stranded, circular
  misc_feature (B) LOCATION 1...456
  hypothetical: NO
  anti-sense: NO
aaagaaatatttattaccgaaaaaaaggggaaatcgagtcaagtaccaacaggctcatctattccaaaaagatatttactcgatggaaaaactcctagaattagtgctacaaatattgacaatggtatcttaggttactacgaagatatagatgataaaaattatagagtttttgaaaattttatatctgtttcatgtttaggagcagtcttttatcataaatataaagcaagcctagatatgaaaattcattgtttaaaattaaaaaataaagaattgaataaagaagtagcattctatttaacttcaattattaggcaagctttaaaaaatactgaatataaagatcaaatatctagcacagtattgccagatatcaaaattaaattaccgatagacagtagaggtactccagattggaattacatggaaagatatagagagagggagagatag

SEQ ID NO: 2509 - DNA (genomic), 333 bp, Streptococcus pneumoniae; double-stranded, circular
  misc_feature (B) LOCATION 1...333
  hypothetical: NO
  anti-sense: NO
aatagaatatttgataataattgtttgatacaagtatacaaatttatttctttttatgatatttgtgaaatggtgtttgcctttcatttacctcctgatgagttgataacaaatgttatctttaaagaaaaaattaactctatgttaaaatgttacattgacaggctattatatgtttttataaatcctacacattttactgaaaaagttaatctacaattttatggtagttttttctcatatgaatttatttgtcgtgaagttggaaacattcttaaaaataaaggtgtgaaatgcaatttaaacttttttgaaggggaagaatatttgtaa

SEQ ID NO: 2510 - DNA (genomic), 702 bp, Streptococcus pneumoniae; double-stranded, circular
  misc_feature (B) LOCATION 1...702
  hypothetical: NO
  anti-sense: NO
aagcagatattagtattggttaagaaaggaaagagcatgtcagatcgtacgattggaattttgggcttgggaatttttgggagcagtgtcctagctgccctagccaagcaggatatgaatattatcgctattgatgaccacgcagagcgcatcaatcagtttgagccagttttggcgcgtggagtgattggtgacatcacagatgaagaattattgagatcagcagggattgatacctgcgataccgttgtagtcgcgacaggtgaaaatctggagtcgagtgtgcttgcggttatgcactgtaagagtttgggggtaccgactgttattgctaaggtcaaaagtcagaccgctaagaaagtgctagaaaagattggagctgactcggttatctcgccagagtacgaaatggggcagtctctagcacagaccattcttttccataatagtgttgatgtctttcagttggataaaaatgtgtctatcgtggagatgaaaattcctcagtcttgggcaggtcaaagtctgagtaaattagacctccgtggcaagtacaatctgaatattttgggtttccgagagcaggaaaattccccattggatgttgaatttggaccagatgacctcttgaaagcagatacctatattttggcagtcatcaacaaccagtatttggataccctagtagcattgaattcgtaa

SEQ ID NO: 2511 - DNA (genomic), 246 bp, Streptococcus pneumoniae; double-stranded, circular
  misc_feature (B) LOCATION 1...246
  hypothetical: NO
  anti-sense: NO
ataaagatattagacaagaggaaacgaatgaccccaaacaaagaagactatctaaaatgtatttatgaaattggcatagacctgcataaaattaccaacaaggaaattgcggctcgcatgcaagtctctccccctgccgtaactgaaatgatcaaacgaatgaaaagtgaaaatctcatcctaaaggacaaggaatgtggctttctacggactgacctcggtctcaaactggtctctgagctctaa

SEQ ID NO: 2512 - DNA (genomic), 453 bp, Streptococcus pneumoniae; double-stranded, circular
  misc_feature (B) LOCATION 1...453
  hypothetical: NO
  anti-sense: NO
ccatttgtatttgcgacagagaatgattcactaaatggtgtgtctatgctctttaatcatctattaacaaatactccacaaatctttgctgatgtgcgtacttattggagtccagaggctgttgaacgtgtaacaggatatactttagagggtcgtgctgcagctggattcttacatctaatcaactctggatcttgtacattggatggtacaggtcaagctactcgagatggcaaacctgttatgaaaccattctgggagttggatgaaagtgaagtacaggctatgcttgaaaatacagacgttcccaccagcaaaccgcgaatacttccgtggaggaggattctcaactcgtttcttgacgaagggggatatgccagtaacaatggtacgtctcaatcttttaaaaggggttggtccagtgctacaaattgcagaaggttacacacttga

SEQ ID NO: 2513 - DNA (genomic), 888 bp, Streptococcus pneumoniae; double-stranded, circular
  misc_feature (B) LOCATION 1...888
  hypothetical: NO
  anti-sense: NO
acccacgtattcgttattaggaaggaggtcaatgttatgaaacctatgcctttatggaaaagaaatttgaaaaaattctataataacaaattggcctttatcggctttatatgcttcatgctaattctattagcatgtattctagcacctttattgacaacctattctccagatgttgttgatttaggatctatgaaccgtcctccttcagcaaaacacattctgggaacagataaactaggtcgtgacgtatttgctcgaatcctatatggtggtcgagtttcaattcaagtagggatgtatggagcgatttgtggagcggttattggtactgtacttggtggtattgctggatattttggtgggaaaattgatgctcttctagttcgtctagcagaattattcttaacattcccgaatatgattgtcattctcttgctttcaagtatttttggacaaggtgtattcaatcttatcttcgtattctcagtaatgggttggatgacaacgttccgaatggttcgtaatgagttcatgtctttgaaacaagaaacatatgtggatgtatgtagagcttttggtttttctgacagtcgaattatctttaataatattttaagaaatgctatctcaccagtaattgtatcgttgtctttaaacgttgctggtttcattctcagtgaggcaggtcttagtttcttaggagtaggtgttccttctgatattcctacttggggaaatatcataaatgctgccaaaacagccgatgttattaaaaatagttggtggttgtggttagttccagggtcaatcattactcttttcgttctttctatcaactttattggtgatggattacgagatataatggatccgaaacaacagtag

SEQ ID NO: 2514 - DNA (genomic), 228 bp, Streptococcus pneumoniae; double-stranded, circular
  misc_feature (B) LOCATION 1...228
  hypothetical: NO
  anti-sense: NO
gtgacagtatttgcatattcagaacctaacgggctaccgatggcaatagcagtttctcctacagttaacttactagaatcaccaaactcagctactgttgtcactttttctgaagagattttgacgacagcaatatcagagaaagtgtcagctccgacaatttctccaggtactttagtcccatctgacaatcgaatatctactttgctggcgccatttataacgtga

SEQ ID NO: 2515 - DNA (genomic), 567 bp, Streptococcus pneumoniae; double-stranded, circular
  misc_feature (B) LOCATION 1...567
  hypothetical: NO
  anti-sense: NO
aataaagtattaagtaatcgtgaaaaaaggatatctatgcgaaaagaaattgcacctgaattatacaactataacaagtttcctggtccggagttccatttacacggggacaaggtcgaaacggaagggatagctttttccttggttgaaaatatcaaggatgcctttgatgtgacaacttttaatcagcgtttttcagaagtattaaccaagtttgattatatcgtgggggactggagcaacgaacagcttcgcctacgaggtttttacaaggatgaccgaacagaagaaaaacttgaaaaaatcagtcgtttacaagactaccttttagagtattgtagttatggttgtgcctattttgtcttagaaaatgaagcccctaagcgagcatcatttgacaagaaaatgcgtaagacggaagaagaaacaccttctagaaaaggaaagaaaccgactcaaactaaacgaaagtcgaatgcagataagaaaaatagacgtcgtcagaaagaccagcattctcagaaagaggacaagggacaacgtcattttgtcattcgtcagaagtga

SEQ ID NO: 2516 - DNA (genomic), 270 bp, Streptococcus pneumoniae; double-stranded, circular
  misc_feature (B) LOCATION 1...270
  hypothetical: NO
  anti-sense: NO
aaaagagtatttgtcatggatacaaaaattatggaacaatttcatgaaatggatataactatgttatctagtattgaaggaggcaagaataattggcaaactaatgtcttagaaggtggtggtgctgcttttggtggctgggggttagggacagctatttgtgctgcgagtggtgttggagcgccatttatgggagcatgtggatacataggagctaaatttggtgtggctctttgggcaggagtaacaggggcaacgagtggattttaa

SEQ ID NO: 2517 - DNA (genomic), 1035 bp, Streptococcus pneumoniae; double-stranded, circular
  misc_feature (B) LOCATION 1...1035
  hypothetical: NO
  anti-sense: NO
gttatggtatttacagcaaaaagctctaaaataaatatagaagaagttcgtgccttgtcaaaattagaaggtcaggctttggagaggaaatcacagcgagatcaagagctagaagccattatacgtggagaagaccagcgaattctcttggtaatcgggccatgctcatctgacaatgaagaagctgtccttgaatacgctaagcgtttggcagtcctacaagaagaagtggcagatcgtatctttatggttatgcgtgtttatactgccaaaccccgtaccaacggagatggctataagggcttgattcaccagcctaacgcgacagaagcgcctagtcttatcaatggaatcaaagccgttcgccatcttcactatcgtgtcatcacagaaacagggatgacaactgctgatgaaatgctttatcctgaaaaccttccgcttgtagatgatttgatttcttacatggcagttggtgcccgttcagttgaagaccagcaacaccgctttgtggcaagtggggcaggattttctactggttttaaaaatccaacctctggaaatctcaatgtcatgtttaatgggatttatgctgctcaaaacaaacaaagtttccttttcttaggaaaagaagtagaaacaactgggaacccgctttcacacgctattcttcgtggtgctcttaatgagtatggaaaaaatattcccaactactattatgacaatttaattgataccattgcccagtatgagaaaatgggcttggaaaatccttttatcatcattgataccaatcatgacaattctggtaagcagtatattgaacagatccgaattgtccgccagaccttgattaaccgtgcttggaatgaaaaaattaagcagttcgttcgtggttttatgattgagtcttatctggaagatggtcgacaaaatgagccagaagtatttggtaagtctatcacagacccttgcctgggttgggataacacagaagctcttgtcagagaaatttacaaaacgttaggagaataa

SEQ ID NO: 2518 - DNA (genomic), 897 bp, Streptococcus pneumoniae; double-stranded, circular
  misc_feature (B) LOCATION 1...897
  hypothetical: NO
  anti-sense: NO
aaggaggtatttatgacatactacgttgcaattgatatcggtggaaccaacatcaagtatggtttggttgatcaagaggggcaacttcttgaatcgcatgaaatgccaactgaggcgcataagggtggacctcatatcttacaaaagaccaaagatatcgtagctagttatttagaaaaaggcccagtagcaggtgttgccatatcttctgctgggatggtggatccggataagggtgagattttctatgctgggcctcaaatccctaactacgcaggcacccagttcaaaaaggaaatcgaagaaagctttactattccttgtgagattgaaaatgatgtcaactgtgcaggtcttgctgaggcagtatctggttcaggcaagggagcaagtgtgacactttgcttgaccattggaaccggtatcggtggttgcttgattatggataggaaagtcttccatggttttagtaattcagcctgtgaagtcgggtatatgcatatgcaggatggagcttttcaggatctcgcttctacaacagctttagtgaaatatgtagctgaagcccatggagaagatgttgatcagtggaatggccgacgtatctttaaggaagctactgaaggaaacaaaatctgcatggaaggtattgaccgtatggttgactatctaggaaaaggtctggcaaatatttgttatgtggccaatccagaagtggttattcttggtggtggtatcatggggcaagaggctatcctcaaacctaagatccgcacagccttgaaagaggcattggtaccaagtttagcagaaaaaacacgattagaatttgcccatcaccaaaatacagcagggatgttgggtgcatattatcattttaagacaaaacaatcctag

SEQ ID NO: 2519 - DNA (genomic), 1539 bp, Streptococcus pneumoniae; double-stranded, circular
  misc_feature (B) LOCATION 1...1539
  hypothetical: NO
  anti-sense: NO
aggagatttttgatgaaatcaaaaatagttttgggagcttcgctagcgatcgcaacacttagcttagtatctcttgtcgagattgaaggactctcaccgtttttaatagagaatgttagcgcaaatactcattctgcaaataaagttattaatcataaagtaagtatttacttagaaaatgctgatgaaggtaaaggtctaactgtaaacttttcaacagacagtgttagtccaaatttatttgatgagttcgaaaaaaagagtggaattacaataactactatgttagtgaatgctaagacaggtgaagttgtagaaaaaagattaacaccaagcgtttttttacgttccaatgatttaaccagtgggaccatatcttcgtttatttttagtgaatatcctgatggagaatataaatatgttgtgtctaaaggagactttatcgatcctaagactcagtttaaacatcagtatagaggagaatctccagtttttagaatacgtaatcgaaaatatgtggagttgggaacaactgataaaaaattagatgaaagacgtgataatagcgtttataaagatggggttgttgaacacaaggtaaatttaagtttaacaagttatcaaggaggtaatggagttactgcaattttttcaactgatagtgttaactctaacttacttaattcttttggtgaaaaggctaaaaaagttttgattaggtctaagttaattaatgttaagactggcgaggttattgatgaaacgttttctccaaaagtaagtttaacctctaaaattttgaaaagtggttctacagcagtattttattttatagatttaactgatggcgaatataaatatgttgcgtatgaaagccagcaatatactgatcctcaaacaacattgactcatcagtatagaggagaatctcctatttttagtatcaaagatggaaaattttctggtttagtatctgcctcaaaaccagacgaaaacccgaagccaacgccaaaaccggatgagaaaccaaaaccttcagcaccacaacaggagaaaccaaaacctacagttcagtctggttgggtaggttcatcttattatcaaaatggtaaaaaagtcactagtaagtggatttttgataaaaaatataattcatacttctatctagatgcatcaggaaattatgttcaaaacgcttgggtaggtaactattatctcaaatcaggcggatacatggctaaaagtgagtggatttatgataagaactatggttcatactactatctaacatcagaaggcagctacgctcgtaacacttggtcaggcaattattatttgaagtcaaatggtaagatggctaaaagtgagtgggtatacgatagtaactacaaatcatattactacttgacatcagaaggaagttatgctcgtaacacttgggtaggcaattactatcttaaatcaaacggtaaaatggctgttaatgaacgtacaccagatggttatcgtgtagatggttcaggtaaatgggttaaataa

SEQ ID NO: 2520 - DNA (genomic), 777 bp, Streptococcus pneumoniae; double-stranded, circular
  misc_feature (B) LOCATION 1...777
  hypothetical: NO
  anti-sense: NO
atacaatctttgaagagacgcagaagggagataactaagatgaaacgatggatagcacttagtaagatagattttttattgaccaaacgacaattaatttattatctattgtcggtagggatgccgacggctttctatttatttttttctggtatctatcaggacacaccaggtgaactcgcgaattttatgcgtgattatcttatctccatgactgcattttccatgatgtcaacagctatcttctcattcccagttgttttacataccgacaagatcaacaactggcagaaaacattgcgtcatagccctgtaaatatggtagaatattatctatcaaagataacaagtatgctggttgattatttggtttcaatcttggtggttttctcagttgggcattttgtaagaggtgtggacatgtctcttggaaattggattggggctgcacttttgctgatagtaggaagtattgccttcgtagcgcttggtttgaccttgactctcttaccaactagtcagttgatgtctgtcgtgggcaatcttctttatctagggttggctgttttaggtggactctggatgcctatctctttatttccagactggatgcaagtagtaggtaagtgtctcccgacctatcagttgatggagttgctcaagaccttcttaaatgagggtggcatcaatctatcagccacagtttatttacttgttttttcagtagttttgtttggtttgaccatttaccttcaaggtcataaggagaatgcttaa

SEQ ID NO: 2521 - DNA (genomic), 240 bp, Streptococcus pneumoniae; double-stranded, circular
  misc_feature (B) LOCATION 1...240
  hypothetical: NO
  anti-sense: NO
gtacattcattcagggggataagagagattttgttccaattatggtcagagaaaganggtagagccgagaaattggggacgggtctcattttctcagacattttgttgcgtcacaacgccaagcaaagtttgattgnttcggacaaaatggtaccaattcaaagttttttgcgatcatccgttgactcacattggcaatatttgtcgataatccaaccaaanatagantacgagacataa

SEQ ID NO: 2522 - DNA (genomic), 480 bp, Streptococcus pneumoniae; double-stranded, circular
  misc_feature (B) LOCATION 1...480
  hypothetical: NO
  anti-sense: NO
acaaactcattgaggatgcctttaaagcgtccattgaaaaatagaaagaaggaaaagaacatgagtaaagaaaaagtaattttggcctattctggcggtttagacacatcagttgctattacctggctgaagaaagactatgatgttgttgcagtttgtatggatgtgggtgaagggaaagacttagatttcatccatgataaggctcttaaggttggggcagtcgaatcttatgtcattgatgttaaggacgaatttgctacagattatgtgctagtggctcatcagtcacatgcctattatgaacaaaagtatcccttggtatctgccttgagccgccctctgatttctaaaaaattggttgaaatagcgcatcagataggagcgactacaattgctcatggttgtaccggtaaggggaatgaccaagtcgaataccagattgcagtcgctaagaaagcgaatgaagctaaaaagtga

SEQ ID NO: 2523 - DNA (genomic), 606 bp, Streptococcus pneumoniae; double-stranded, circular
  misc_feature (B) LOCATION 1...606
  hypothetical: NO
  anti-sense: NO
aaaacgtcattctcatgtgagctggcgttttttctatgcccacatttccggtcaaatcattggaaaattctgactgtttcagatacaatggaagaaaaaagattggagtatcctatggtaacttttctcggaaatcctgtgagctttacaggtaaacaactacaagtcggcgacaaggcgcttgatttttctcttactacaacagatctttctaaaaaatctctggctgattttgatggcaagaaaaaagtcttgagtgtcgttccttctatcgatacaggcatctgctcaactcaaacacgtcgttttaatgaagaattggctggactggacaacacggtcgtattgactgtttcaatggacctaccttttgctcaaaaacgttggtgcggtgctgaaggccttgacaatgccattatgctttcagactactttgaccattctttcgggcgcgattatgccctcttgatcaacgaatggcacctattagcacgcgcagtctttgtcctcgatactgacaatacgattcactacgttgaatacgtggataatatcaattctgagccaaacttcgaagccgcaattgcagctgctaaagccctatag

SEQ ID NO: 2524 - DNA (genomic), 702 bp, Streptococcus pneumoniae; double-stranded, circular
  misc_feature (B) LOCATION 1...702
  hypothetical: NO
  anti-sense: NO
ggactgtctttatttcatagtataggagaaaatagaatgaaaaagataatctcacaccgctactttattatagtttttctactagttattgctgaccagaagttcagtgttttagttttacgcagtgaccttgttgctgggctatctgactttgcctattatctgtcggatatgatgttgaattttcttgtggttttatttgctcttattgctatgatttggtcggggaaatggcagaaaatcaatagtagaaagtttaaaggatcctatcttttctattccttcctagctctgcttgcttttgttgcttggaattttgtcaccttttttcttttcccacctactcgaaatgaaatttcttatcaacatgctgctcctacttttacaggagctacggcatttttgatgtattttttttatcctgtgattgcaggtcccatttttgaagacatgatttatcgtggattagtgatgactgctctggaaaaaggaaagaaatgggggctagatgtacttggttccgctgttttatttggggtctcgcacattagtaatcacggttgggtcttgacagactttgtcttctatatgggtggaggtcttatatttgcagtcttatttagaatgacaaagtcaatttattggcctattggactgcatatagtctacaatggcattggtcagcttttgatgttactgtaa

SEQ ID NO: 2525 - DNA (genomic), 492 bp, Streptococcus pneumoniae; double-stranded, circular
  misc_feature (B) LOCATION 1...492
  hypothetical: NO
  anti-sense: NO
ctcacaccattgttatcagcataccatttaatcaagagacctgtgatagacaagtgccagatatcaaagatatcgacatcaagtgtatcggttttcttcatagcaagcatcactacgttgacaatcaacatgatgagcaagaagtatagtgtccaagcagaaccccaagtgattgttgcgagtggtgcccaaccaacgtcggtaatactcaattgtataccagtgttttcaacgaattttgcaagtgatgctgagaaagcaccatttagcataccgatgatagcaccgatacctgtaagagcgatggcaagtttgataccaccttcaagcgctttggagaatttcactccaaaaagtaaagccaatactgtcaaaatgattaacatgatgacaggtccacccatttctaagatgggattgaaaacctttccgattaggtcaaagattgcatccataacagttcctcccttttttatgttatatgaatgttaa

SEQ ID NO: 2526 - DNA (genomic), 363 bp, Streptococcus pneumoniae; double-stranded, circular
  misc_feature (B) LOCATION 1...363
  hypothetical: NO
  anti-sense: NO
tttgagccattttatcccctttcttatgccaaatcagaaactgaaataccacgaagggcagcaatttcttcagcgcgtttcaattgtttcaaaccttcaacagttgcacgaacaatgttgattggagtgttagaaccaagtgatttagatgtaatatctgccacacctgccaattccacaacggcacgaactgcaccaccagcggcaactccagaaccttctacagcaggtttcaacaatactttagctccaccgaattctgaaagaacttcgtgtgggattgttgttccaaccataggaacttcgatcaagtttttcttagcatcatctactgctttacggattgcttctggaacttcttga

SEQ ID NO: 2527 - DNA (genomic), 468 bp, Streptococcus pneumoniae; double-stranded, circular
  misc_feature (B) LOCATION 1...468
  hypothetical: NO
  anti-sense: NO
ttcgaaacatttgcttgtaatttgcggaggaacatcaatatggatggaataacaaaagattttataaaaacggctaaactaatgaaacaattatggccccaattgaccgataaagaagctattgatgaagtaaaaaaatatacgaatggcaaaaatactgcaatctttactgaagttgaaggtgacacaattgtaggtctagcactatgttcactcagatttgattatgttgaaggttgtaaatatagtcctgttggattcttagaagggattattgttgacgaggaatatcgtttaaaggatattgctaaaaatctctgtacaaaatgtgaggaatgggcgaaaaataaaggatgtaaggaatttgcaagtgactgtactttaacgaatacggattctataagatttcatctcaatattggatttcaggaggcaaatagaattattcattttaagaaaaaattataa

SEQ ID NO: 2528 - DNA (genomic), 261 bp, Streptococcus pneumoniae; double-stranded, circular
  misc_feature (B) LOCATION 1...261
  hypothetical: NO
  anti-sense: NO
ctcttgacattgcccttggctcaggtggttatcctaagggacgtatcatcgaaatctatggcccagagtcatctggtaagacaacggttgcccttcatgcagttgcacaagcgcaaaaagaaggtgggattgctgcctttatcgatgcggaacatgcccttgatccagcttatgctgcggcccttggtgtcaatattgacgaattgctcttgtctcaaccagactcaggagagcaaggtcttgagattgcgggaaaattga

SEQ ID NO: 2529 - DNA (genomic), 1263 bp, Streptococcus pneumoniae; double-stranded, circular
  misc_feature (B) LOCATION 1...1263
  hypothetical: NO
  anti-sense: NO
attatgacattttcatttgatacagctgctgctcaaggggcagtgattaaagtaattggtgtcggtggaggtggtggcaatgccatcaaccgtatggtcgacgaaggtgttacaggcgtagaatttatcgcagcaaacacagatgtacaagcattgagtagtacaaaagctgagactgttattcagttgggacctaaattgactcgtggtttgggtgcaggaggtcaacctgaggttggtcgtaaagccgctgaagaaagcgaagaaacactgacggaagctattagtggtgccgatatggtcttcatcactgctggtatgggaggaggctctggaactggagctgctcctgttattgctcgtatcgccaaagatttaggtgcgcttacagttggtgttgtaacacgtccctttggttttgaaggaagtaagcgtggacaatttgctgtagaaggaatcaatcaacttcgtgagcatgtagacactctattgattatctcaaacaacaatttgcttgaaattgttgataagaaaacaccgcttttggaggctcttagcgaagcggataacgttcttcgtcaaggtgttcaagggattaccgatttgattaccaatccaggattgattaaccttgactttgccgatgtgaaaacggtaatggcaaacaaagggaatgctcttatgggtattggtatcggtagtggagaagaacgtgtggtagaagcggcacgtaaggcaatctattcaccacttcttgaaacaactattgacggtgctgaggatgttatcgtcaacgttactggtggtcttgacttaaccttgattgaggcagaagaggcttcacaaattgtgaaccaggcagcaggtcaaggagtgaacatctggctcggtacttcaattgatgaaagtatgcgtgatgaaattcgtgtaacagttgtcgcaacgggtgttcgtcaagaccgcgtagaaaaggttgtggctccacaagctagatctgctactaactaccgtgagacagtgaaaccagctcattcacatggctttgatcgtcattttgatatggcagaaacagctgaattgccaaaacaaaatccacgtcgtttggaaccaactcaggcatctgcttttggtgattgggatcttcgccgtgaatcgattgttcgtacaacagattcagtcgtttctccagtcgagcgctttgaagccccaatttcacaagatgaagatgaattggatacacctccatttttcaaaaatcgttaa

SEQ ID NO: 2530 - DNA (genomic), 498 bp, Streptococcus pneumoniae; double-stranded, circular
  misc_feature (B) LOCATION 1...498
  hypothetical: NO
  anti-sense: NO
aaaatggcatttaaagacaatgcagttgaattagaagaacgcgtagttgctgtcaaccgtgttacaaaagttgttaaaggtggacgtcgtcttcgtttcgcagctcttgttgttgttggtgaccacaatggtcgcgtaggatttggtactggtaaagctcaagaagttccagaagcaatccgtaaagcagtagatgatgctaagaaaaacttgatcgaagttcctatggttggaacaacaatcccacacgaagttctttcagaattcggtggagctaaagtattgttgaaacctgctgtagaaggttctggagttgccgctggtggtgcagttcgtgccgttgtggaattggcaggtgtggcagatattacatctaaatcacttggttctaacactccaatcaacattgttcgtgcaactgttgaaggtttgaaacaattgaaacgcgctgaagaaattgctgcccttcgtggtatttcagtttctgatttggcataa

SEQ ID NO: 2531 - DNA (genomic), 201 bp, Streptococcus pneumoniae; double-stranded, circular
  misc_feature (B) LOCATION 1...201
  hypothetical: NO
  anti-sense: NO
agaaaggcatttaacatcactttgcaaaaggcaaatactaaactagagaaaccgataaaccagccccttagttcccatattttcaggcacacactccttagtacactagctgagaagaatgctataatggttagagtggaacacaaaaacgctaaaacagtaaataacatctacactcacgtaagtaaaagaatggagtaa

SEQ ID NO: 2532 - DNA (genomic), 1233 bp, Streptococcus pneumoniae; double-stranded, circular
  misc_feature (B) LOCATION 1...1233
  hypothetical: NO
  anti-sense: NO
aaagctcctttcggttttgatacaatagtttcaaaatttgagaggagctttaatatgaatcgctatgcagtgcagttgattagccgtggggctatcaataaaatgggaaatatgctctatgattatggaaatagtgtctggttggcttctatggggactataggacagacagttttaggaatgtatcagatttctgagctcgtcacatctattctcgtcaatccctttggcggagttatttcagaccgtttttctcgtcgtaagattttaatgacggcagatcttgtttgtgggattctttgtctggctatttctttcataaggaatgatagctggatgattggcgctttgattgttgctaacattgtgcaggctattgcttttgccttttctcgcacagccaataaagctatcataactgaagtggtggagaaagatgagattgtgatctataattctcgcctagagctggttttgcaggttgtaggtgttagctctcctgttctttccttccttgttttacagtttgcaagtctccatatgacgctactgctagactcgctgacttttttcattgcttttgttctagtggctttccttccaaaagaggaagcagaagttcaagagaaaaaggcttttactgggagagatatttttgtagatatcaaggatgggttacactatatctggcatcagcaagaaattttcttccttttgctggtagcttccagcgttaatttcttttttgcagcttttgaatttctacttcccttttcgaatcagctttacgggtcagaaggagcctatgcaagtattttaactatgggggctattggttccatcattggggctcttctagctagtaaaattaaagctaatatttataatcttttgattttactggctttgacaggtgtcggagtttttatgatgggattaccacttccaacttttctttccttttctggaaatttagtttgtgaattgtttatgacgatttttaatattcacttttttactcaagtacaaaccaaggttgagagcgaatttcttggaagagtactgagtacaatttttaccttagctattctatttatgcctattgcaaaaggatttatgacagtcttgccaagtgtacatctctcttctttcctgataattggaagtggtgttatcatcttgtcttgtatatcgtttatttatgttcgaactcattttgaaaaattgatataa

SEQ ID NO: 2533 - DNA (genomic), 228 bp, Streptococcus pneumoniae; double-stranded, circular
  misc_feature (B) LOCATION 1...228
  hypothetical: NO
  anti-sense: NO
atatatcctttaggatttagcgttccaataataagggtcaagacggcgataccaacgcctgaaaagacaaaacctgcgatggcaggaagaaaatgttctccagatagagcacctagagaaggcggaaaaatcaagttccccgcaccaaaaaatattccaaacaggagcaaacctgttagggtaccttttttagccataaaaatttccttcatatttataaaatactga

SEQ ID NO: 2534 - DNA (genomic), 246 bp, Streptococcus pneumoniae; double-stranded, circular
  misc_feature (B) LOCATION 1...246
  hypothetical: NO
  anti-sense: NO
tgtcttcaattgatcaaaatttgttttttcagagtagtcataagtgaatgtaatatatttccaatctgccgaacctttatacataccaagcgtagcataatctggaccactctgtactccggtctcactattttttctaaaaagataatgtttgaagcaattaaatacattccaaaaatttcgaccttggactacattttcgtacttgatccaagcgctaaaagtaactttttggtacaaccttga

SEQ ID NO: 2535 - DNA (genomic), 230 bp, Streptococcus pneumoniae; double-stranded, circular
  misc_feature (B) LOCATION 1...230
  hypothetical: NO
  anti-sense: NO
tggttcaattattattcactctaagtagtcatatgctctttatttatgtgagtttttaccttttaaaggatcttgttagatgggagaaggttttaaaagtgacagatgagaatacaagaaaagttcgtttattagtagccttttttagcattgtcataggctacatcctgagttctttctttattagcctgtatcatttgtggcaagaagcgcttagaggattattatga

SEQ ID NO: 2536 - DNA (genomic), 351 bp, Streptococcus pneumoniae; double-stranded, circular
  misc_feature (B) LOCATION 1...351
  hypothetical: NO
  anti-sense: NO
atggcacaattgacaatcaatggggtggctgtgaagcctcccaaatcttttcaagtcggtattcaagatatcgatggagagacagggcgtaatgccaatggcgacatggtgcgtgaccgtatcacgaccaaacgcaaactagactgtgaatggggtatgatgactcagggagaaataagtcagcttttacatgctgtatcatctaaattttttgaggtatcttatccagaccccatggatggccaagtcacaaagactttctatgtcggtgataggacagctcctagctatacctttactgagaagcttaaaccttggtctggcgctaaatttaatctggtagagaggtaa

SEQ ID NO: 2537 - DNA (genomic), 201 bp, Streptococcus pneumoniae; double-stranded, circular
  misc_feature (B) LOCATION 1...201
  hypothetical: NO
  anti-sense: NO
aaaaaacaattaatgagaagcggtcgtgataaaaagattgcgggtgtttgtgctggggtggcccattatctggatatggatccgactatcgttcaagtcatttggggtgttcttacttgctgttacggatctggaattgtagcttacattattttatggattatcgcaccagtagcaactgtcttcaccacgggatttcat

SEQ ID NO: 2538 - DNA (genomic), 1749 bp, Streptococcus pneumoniae; double-stranded, circular
  misc_feature (B) LOCATION 1...1749
  hypothetical: NO
  anti-sense: NO
cttttgcaattcgtggtgaagacgacagctcggataagaaataacttgagccgatgggttggacgtcgtcgtgaccttggtggtttgatctttatcgatcttcgtgaccgtgaaggaatcatgcagttggttatcaaccctgaaaaagtatctgcagaggttatggcaacagctgaaagccttcgtagcgaatttgttattgaggtgactggtcaggtcgctgcgcgtgagcaagccaatgataagttgccaactggtgcggttgagttaaacgtgacagctcttattgtgcttaatacagctaagacaacaccatttgagattaaggatggcattgaggcaaatgacgatacacgtttgcgttaccgttaccttgaccttcgtcgtccagaaatgttggaaaatcttaaacttcgtgccaaggtgacccactctatccgcaactacttggatgagttggagtttatcgacgtggagacaccattcctttctaagtcaacgcctgaaggggcgcgtgattatttagtgccgtctcgtgttaataaggggcatttttacgctcttcctcaaagtccacaaatcacgaaacagctcttgatgaatgctggttttgaccgttactaccaaatcgttaaatgtttccgtgacgaggacttgcgtggagaccgccagcctgaatttactcaggtcgacttggaaacgtccttccttactgagcaagaaatccaagatattacagaaggcttgatcgcgcgcgtgatgaaggaaacaaaaggcatcgaagtaacgctaccattccctcgtatgaaatacgatgatgctatggctctttacggttctgacaagccagatactcgttttgacatgttgcttcaggacttgacagaagtggtcaaaggtgtagactttaaagtcttttcagaagcacctgctgtaaaagcgattgtggtcaaagaagctgcggacaactattcacgtaaagacatcgacaagatgacggaagtagccaaacagtatggtgccaaaggtcttgcttgggtcaaggtggttgatggagaattaaacggaccagttgccaagttcttgactggtatccaagaagaattgacaacagcgcttgctcttgaagataaggacttggttctctttgtggcggatacgcttgaagtggctaatgcaacactgggtgcccttcgtggacgtattgctaaagagcttggcttgattgataatgataagttcaacttcctttgggtggttgactggccgatgtttgaatggtctgaagaagaaggccgctacatgagcgcccaccatcctttcacccttccacaggaagagactgttcacgaattagaaggtgatttggctaaggttcgtgccattgcttacgatatcgtcttgaacggttatgagcttggtggtggtagccttcgtatcaaccaaaaagaccttcaagaacgcatgttcaaggctcttggtttctcaactgaagaagccaatgaccagtttggtttccttcttgaagccatggactatggtttcccaccacacggtggtttggctatcgggcttgaccgttttgtcatgttgcttgctggagaagaaaatatccgtgaagtcattgcctttcctaagaacaacaaggcaactgacccaatgacacaagctccatcaacagtcgctctcaaacaactagaggaactcagcttacaagtagaagaagatgaaacaaacaaaacgaattaa

SEQ ID NO: 2539 - DNA (genomic), 1314 bp, Streptococcus pneumoniae; double-stranded, circular
  misc_feature (B) LOCATION 1...1314
  hypothetical: NO
  anti-sense: NO
cctatgttttttaaattattaagagaagctcttaaagtcaagcaggttcgatcaaaaattttatttacaatttttatcgttttggtctttcgtatcggaactagcattacagttcctggtgtgaatgccaatagcttgaatgctttaagtggattatccttcttaaacatgttgagcttggtgtcggggaatgccctaaaaaacttttcgatttttgccctaggagttagtccctatatcaccgcttctattgttgtccaactcttgcaaatggatattttacccaagtttgtagagtggggtaaacaaggggaagtaggtcgaagaaaattgaatcaagctactcgttatattgctctagttctcgcttttgtgcaatctatcgggattacagctggttttaataccttggctggagctcaattgattaaaactgctttaactccacaagtttttctgacgattggtatcatcttaacagctggtagtatgattgtcacttggttgggtgagcaaattacagataagggatacggaaacggtgtttccatgattatctttgccgggattgtttcctcaattccagagatgattcagggcatctatgtggactactttgtgaacgtcccaagtagccgtatcacttcatctatcattttcgtaatcattttgattattactgtattgttgattatttactttacaacttatgttcaacaagcagaatacaaaattccaatccaatatactaaggttgcacaaggtgctccatctagctcttaccttccgttaaaggtaaaccctgctggagttatccctgttatctttgccagttcgattactgcagcgcctgcggctattcttcagtttttgagtgccacaggtcatgattgggcttgggtaagggtagcacaagagatgttggcaactacttctccaactggtattgccatgtatgctttgttgattattctctttacattcttctatacgtttgtacagattaatcctgaaaaagcagcagagagcctacaaaagagtggtgcctatatccatggagttcgtcctggtaaaggtacagaagaatatatgtctaaacttcttcgtcgtcttgcaactgttggttccctcttccttggtgtgatttccattttaccgattgcagctaaagatgtatttggtctttctgatgttgttgcctttggtggaacaagtctcttgatcattatctctacaggtatcgaaggaatcaagcaattggaaggttacctattgaaacgtaagtatgttggtttcatggacagaacagaataa

SEQ ID NO: 2540 - DNA (genomic), 2337 bp, Streptococcus pneumoniae; double-stranded, circular
  misc_feature (B) LOCATION 1...2337
  hypothetical: NO
  anti-sense: NO
caattccctttctgctttttttttgatataataaccttaactgtcattctatatggaggttctatgcgttttaatcaatatagttatatcaattttccaaaagaaaatgtcttatctgaactaaaaaaatgtggctttgatttacaaaatacagccaatcacaaagactcacttgaaacctttttacgtcgtttctttttcacttatcaagacaccaactacccactttctatcctagcagctgataaaaaaacagacctgctgacattttttcaatcagaagatgaactgacagcagatattttttatactgttgcttttcaacttttaggcttttcttatttggttgacttcgaagatagtgacgtttttcgtaaagaaactggatttcccattatatatggtgacttgattgaaaatctctatcagttactcaatactcgcaccaaaaaaggaaatactcttatcgaccaacttgttagtgatggtcttattccggaggataatgactaccactactttaacggcaagagtttggctactttttctaaccaggatgtcattcgtgaagtcgtttacgttgagtctcgtgtcgatactgaccaaaaagggctatcagacctagtaaaggttagcattattcgccctcgttttgatggaaaaatccctgccatcatgacagccagcccttatcatcagggaaccaatgacaaggctagtgacaaggctctctacaagatggagggcgagcttgaggttaaacttcctcacaagattgagctagagaaacctcaactaaatctcgtccaaccccaaggtaaagctgagcttatagcagaggctgaggaaaagctaactcacatcaactctagctatacactaaacgactacttccttccgagaggctttgccaatctctatgtctcaggtgttggtaccaaagactcgacaggtttcatgactaatggagactaccagcaaatcgaggcttataaaaatgtcatcgattggcttaacggccgttgccgtgcctttactgatcacacgcgccagcgtcaagtcaaggctgattggtcaaacggaaaagttgctacaacaggactttcctatctaggtaccatgtccaatggtcttgcgactacaggagtcgatggtttagaagttatcattgccgaggcaggaatttcatcatggtacaactactaccgtgaaaacggtctggtgactagcccaggtggttatccaggtgaggactttgactcccttgctgagttaacctattctcgtaatctcttagctggcgactatatccgtggcaatgaagctcaccaagctgacttagaaaaagtgaaagctcagctagaccgaaaaactggggactacaatcaattttggcatgaccgcaattatctgctcaatgcccataaagtaaaggcagaggttgtctttactcatggttctcaggattggaatgtcaaaccacttcatgtttaccagatgttccatgctcttcctactcatatacacaagcatctctttttccataatggtgcccatgtttacatgaacaattggcaatcaattgacttccgtgagtccataaatgccttattgaccaagaaattactaggacaggaaacagactttcaacttcctactgttatctggcaggacaatacagctccacagacttggttatcacttgataacttcggtgggcaagaaaactgtgaaaccttctcacttggtcaagaagagcaagctattcaaaaccagtacccagataaggattttgagcgctatggtaagacataccaaaccttcaatacagagctctatcaagggaaagccaatcagattactattaaccttcctgtgactaaagatctccacctaaacggtcgcgctcagctcaatcttcgtatcaaatccagtacaaacaaggggctcttatctgcccaactgctagaatttgggccaaagaaatacctacaaccttatccagctattttaagtgctagaaccattgacaacggtcgctatcacatgttggaaaatctctgtgaattgccatttagaccagaggcacaacgagtcgtgacaaaaggttaccttaatttacaaaatagaaatgatttactgttagtagaggatattactgcagatgaatggatggacgttcaatttgaactgcagccaactatttacaagctaaaagaaggagacactctccgtttagtcctctatactactgactttgaaatcaccatccgtgacaatacagactaccacttgactgtcgacctcgctcagtccatgcttaccttaccttgctaa

SEQ ID NO: 2541 - DNA (genomic), 741 bp, Streptococcus pneumoniae; double-stranded, circular
  misc_feature (B) LOCATION 1...741
  hypothetical: NO
  anti-sense: NO
gaccctaaattccagattttagacatcatcaataaggatacacaacaaggaatctttggcaaactggactatgaagctccatcttgtcctgagtgcggaagtcaaatgaagaaatattactttcaaaaaccttctaaaattccttatcttgaaacaactggtatgcctactagaattctccttagaaagcgtcgtttcaagtgctatcattgttctaaaattatggttgctgaaacttctatcgtcaagaagaatcatcaaatccctcgtatcatcaaccaaaagattgctcaaaagttaattgaaaagatttctatgactgatattgcccatcagctttccatctcaacttcaactgtcattcgtaagctcaatgattttcactttaaacatgatttttcttgtctttctgagattatgtcttgggatgagtatgcttttacaaagggaaagatgagcttcattgcgcaagattttaacaagctcaatatcatcactgttcttgagggtagaacacaagctatcattcgaaatcactttcttcgctacgatagagttgtccgatgtcgcgtcaaaattattactatggatatgtttagtccttactatgacttggctaaacagcttcgctttcaaatttctaggctcaggctgaaacagtctcccagactgtttcactcccgaatgctaaaatcgtgttggatcgctttcacattgtacaacatcttagccgtgctatga

SEQ ID NO: 2542 - DNA (genomic), 612 bp, Streptococcus pneumoniae; double-stranded, circular
  misc_feature (B) LOCATION 1...612
  hypothetical: NO
  anti-sense: NO
tatactaaattactagaggcaaatccccagtatgtggtcctcaatcccttggaagccaaggcaaaatggcgggacttgtttggcaatgataatcccattcatgtggaagttggaagtggaaagggtgcctttgtttcaggtatggccaagcaaaaccctgacatcaactatatcgggattgatattcaaaagtctgttttgagctacgctttggacaaggtgcttgaagttggagtgcctaacatcaagctcttgtgggtagatggttctgacttgactgactactttgaagacggtgagattgatcgcttgtatctgaacttttcagatccatggccgaaaaaacgccatgaaaagcgtcgtttgacctacaagacctttttggacaccttcaaacgtatcttgcctgaaaatggagaaattcatttcaaaacggataaccgtggcttgtttgagtacagtttagtgagcttttctcaatatggcatgaaactcaatggtgtctggctagatttgcatgccagtgattttgaaggcaatgtcatgacagaatacgagcaaaaattctcaaacaaggggcaagttatctaccgagttgaggcagaattttaa

SEQ ID NO: 2543 - DNA (genomic), 336 bp, Streptococcus pneumoniae; double-stranded, circular
  misc_feature (B) LOCATION 1...336
  hypothetical: NO
  anti-sense: NO
tataataaatttgaagtaatattcaaggagaatcaaatgatttacgaattttgtgctgaaaatgtgactttacttgaaaaagcgatgcaggctggagctcgtcggattgaactctgtgataatctagcagttggtgggacaacacctagctatggagtgactaaggcagcggttgaactggcagctaactacgatacaaccatcatgaccatgattcggccacgtggtggtgactttgtctataatgacctagaaattgctatcatgctagaagacatttgtttgactgctcaggcctggaagtcaaggggttgtatttggagctttaactgctga

SEQ ID NO: 2544 - DNA (genomic), 570 bp, Streptococcus pneumoniae; double-stranded, circular
  misc_feature (B) LOCATION 1...570
  hypothetical: NO
  anti-sense: NO
atgaccaaattacttgtaggcttgggaaatccaggggataaatattttgaaacaaaacacaatgttggttttatgttgattgatcaactagcgaagaaacagaatgtcacttttacacacgataagatatttcaagctgacctagcatcctttttcctaaatggagaaaaaatttatctggttaaaccaacgacctttatgaatgaaagtggaaaagcagttcatgctttattaacttactatggtttggatattgacgatttacttatcatttacgatgatcttgacatggaagttgggaaaattcgtttaagagcaaaaggctcagcaggtggtcataatggtatcaagtctattattcaacatataggaactcaggtctttaaccgtgttaagattggaattggaagacctaaaaatggtatgtcagttgttcatcatgttttgagtaagtttgacagggatgagtatatcggtattttacagtctgttgacaaagttgacgattctgtaaactactatttacaagagaaaaattttgagaaaacaatgcagaggtataacggataa

SEQ ID NO: 2545 - DNA (genomic), 399 bp, Streptococcus pneumoniae; double-stranded, circular
  misc_feature (B) LOCATION 1...399
  hypothetical: NO
  anti-sense: NO
atttttttttcactttcccccacacccacccccattcccntttcttcctttctttccccctcccaacctccccccnnccccnccttttccttccccctttttccccanacctcccncaacaccctttttttccttcttttcccccccccnnccntcaccccnccttcttcctcctttccctccctccccnttttctccccccccttcnnntttccctcttttttttnntttcccttttnnnnnnnntnnntttttttttttttnnnnnnnnnttnnnnntattnnnttncccccannnnnnnnnnnnnnnnnnnnnnnnnnnnnnnnnnnnnntattcaatgaaaatcaaagagcaaactagaaagctagccgcaggttgttcaaaacactgtttttag

SEQ ID NO: 2546 - DNA (genomic), 1974 bp, Streptococcus pneumoniae; double-stranded, circular
  misc_feature (B) LOCATION 1...1974
  hypothetical: NO
  anti-sense: NO
atgaaaaaattttatgtaagtccaatttttcctattctagtaggattgattgcgtttggagtcttatccactttcattatttttgttaataataatctgttgacggttttaattttgtttctttttgtaggaggctatgtttttttatttaagaaactgagagtgcattatacaaggagtgatgtagaacagatacagtatgtaaaccaccaagcggaagaaagtttgacatctctattggaacagatgcctgtaggtgttatgaaattgaatttatcttctggagaggttgagtggtttaatccctatgctgaattgattttgaccaaggaagatggtgattttgatttggaagctgttcaaacgattatcaaggcttcagtaggaaatccgtctacttatgccaagcttggtgagaagcgttatgctgttcatatggatgcttcttcaggtgttttgtattttgtagatgtatccagggaacaagccataacagatgaattggtaacaagtcgaccagtgattgggattgtctctgtggataattatgatgatttggaggatgcaacttctgagtcagatattagtcaaatcaatagttttgtagctaattttatatcagagttttcagaaaaatacatgatgttttctcgtcgggtaagtatggatcgattttatctatttactgactacacggtgcttgagggcttgatgaatgataaattttctgttattgatgctttcagagaagagtcgaaacagagacagttgcccttgaccttaagtatgggattttcttatggcgatggaaatcatgatgagatagggaaagttgctttgctcaatttgaacttggctgaagtacgtggtggcgaccaggtggttgttaaggaaaacgacgaaacgaaaaatccagtttattttggtggtgggtctgctgcttcaatcaagcgtacacggactcgtacgcgcgctatgatgacagctatttcagataagattcggagtgtagatcaggtttttgtagtcggtcacaaaaatttagacatggatgctttgggctctgctgtaggtatgcagttgttcgccagcaatgtgattgaaaatagctatgctctttatgatgaagaacaaatgtctccagatattgaacgagctgtttcattcatagaaaaagaaggagttacgaagttgttgtctgttaaggatgcaatggggatggtgaccaatcgttctttgttgattcttgtagaccattcaaagacagccttaacattatcaaaagaattttatgatttatttacccaaaccattgttattgaccaccatagaagggatcaggattttccagataatgcggtcattacttatatcgaaagtggtgcaagtagtgccagtgagttggtaacggaattgattcagttccagaattctaagaaaaatcgtttgagtcgtatgcaagcaagtgttttgatggctggtatgatgttggatactaaaaatttcacctcgcgagtaactagtcggacatttgatgttgctagctatctcagaacgcgcggaagtgatagtattgctatccaggaaatcgctgcgacagattttgaagaatatcgtgaggtcaatgaacttattttacaggggcgtaaattaggttcagatgtactaatagcagaggctaaggacacgaaatgctatgatacagttgttattagtaaggcagcagatgccatgttagccatgtcaggtattgaagcgagttttgttcttgcgaagaatatacaaggatttatctctatctcagctcgaagtcgtagtaaactgaatgtacaacggattatggaagagttaggcggtggaggccactttaatttggcagcagctcaaattaaagatgtaaccttgtcagaagcaggtgaaaaactgacagaaattgtattaaatgaaataaaggaaaaggagaaagaagaatga

SEQ ID NO: 2547 - DNA (genomic), 1332 bp, Streptococcus pneumoniae; double-stranded, circular
  misc_feature (B) LOCATION 1...1332
  hypothetical: NO
  anti-sense: NO
gcgtgtttttcttgcttgattataaacccaaaagatttgtttcctatactgtggttgtctcattttttgctgttgcagctttatctctttatcagttggttgacttacctcttaatccaaaaaatgacaatcagctctctgctgaaaggtttttcatctttcaaatttggtcttatcttcaattatgtgatgaaaatagggacaactattttactgacggccttactgattggggtgggcagaagtttagaacaagaaaacaaagaacttgcttatcagcaacagtgggtaagtcaaggtaattacctgaccttagaaaccttcaaactcaatgataatctgtggcaagaagagctagcagggtcagggaaatctacagattatttctatcgattttatcaggatttggtagaaaaaacgcaggcgggctatgtgcagagtagcagtcttcctgtaaaaaattttgtccaatcagaacagattcagcaatatcagttaacagatacggtggatgtttactatgccaatcgcaattttctaaagagcaagggattcaagctaccagataccggtattaaaaaagttattttgatgccagcaagtacgaaaggtgaagaagataaaaatcagctcttggggaagttaattgcctttcattcgatgaagtatgaagagcagcaaaaacgaacgatagaggagatggatgtcgagattgcctattatgaaggagattggtcatttttcccatatagtgataagcgaaaggaaaatctctccaatccaattattagcttggtcaatgattctgatatgatgtgggatgagaaagcctccctgtcaacaactggcttaaataatccgattaaaattgaaaatacggttcaacatcaaaaagagattacagagttagttgagaaattgtcagatggaaattatttaaaattttcatctattcaagccattcaacaagagaaagtggattcttatcgagatgctgttcggaattttaacctactctttgctttgtttggtctccttagcatgatgatttcctacttcttactagtaacaactttcttattgaagcgcagggatatcattaccaagaagtttatggggtggaaactggtcgatcgctaccgtcctctcctcgttctgctcttgctgggctatagtttccctcttctagtcttgattttctttgcccatgcgttcttaccacttctactgtttgcaggttttacatgtctggatatactatttgtgctaggcttagcttctaggatggagaaaagaagtctagtagagttattgaaagggggcatcttatga

SEQ ID NO: 2548 - DNA (genomic), 387 bp, Streptococcus pneumoniae; double-stranded, circular
  misc_feature (B) LOCATION 1...387
  hypothetical: NO
  anti-sense: NO
ttaagtttttctatcacagacataaaagatatatattggtttatcaggaaagtttctgataaactagcaagtactttacatttgaatggagacagtatgaaaaaatttagcctattactagctatcctaccatttttggttgcctgtgagaatcaagctacacccaaagagactagcgctcaaaagacaatcgtccttgctacagctggcgacagtgcaccatttgactacgaagacaagggcaatctgacaggctttgatatcgaagttttaaaggcagtagatgaaaaactcagcgactacgagattcaattccaaagaaccgcctgggagagcatcttcccaggacttgattctggtcactatcaggctgcggcaataacttga

SEQ ID NO: 2549 - DNA (genomic), 549 bp, Streptococcus pneumoniae; double-stranded, circular
  misc_feature (B) LOCATION 1...549
  hypothetical: NO
  anti-sense: NO
ggagacttttctttttggaggtttgtcatgaaaacaaaagaagttgtagacgaattgaccgtcaaacgagcgattacgcgtattacttatgagattatcgaacgcaacaaagatttgaataagattgtcttggctggtattaaaactcgtggtgtctttattgcccaccgaatccaagaacgtttgaagcagttagaaaatctttcagttcctgttgtggaattggatactaaacctttccgtgatgatgttaaaagtggagaagatacttctttggtttctgtcgatgtgacagaccgcgaagttatcttggtggatgatgtgctctatacaggtcgtaccatccgtgctgctattgataatattgtcggtcatggtcgtcctgcgcgtgtgagtttagcagttctagtcgatcgtggacatagagaattgccaatccgtccagattacgttggaaaaaatatcccaaccagtcgttctgaagaaatcatcgtagagatgacagaacttgatgaccaagacagagttctgattactgaagaagcttag

SEQ ID NO: 2550 - DNA (genomic), 1215 bp, Streptococcus pneumoniae; double-stranded, circular
  misc_feature (B) LOCATION 1...1215
  hypothetical: NO
  anti-sense: NO
aggctgttttccacagatttcacagactctattattactattatctttctaatactaaaaataaataaaggagaatccatgattcatttttcaattaataaaaatttatttctacaagcattaaatactactaagagagctattagttctaaaaatgccattcctattttatcaacagtaaaaattgacgtgaccaatgaaggtattactttaattggttcaaatggtcaaatttcaattgaaaattttatttctcaaaaaaatgaagatgctggtttgttaattacttctttaggttcgatccttcttgaagcttctttctttatcaatgtagtatctagtttacctgatgtaactcttgattttaaagaaattgaacaaaatcaaattgttttaaccagtggcaaatcagaaattaccctaaaaggaaaagatagcgaacaatatccacgaatccaagaaatttcagcaagcactcctttaatacttgaaacaaaattactcaagaaaattattaatgaaacagcctttgctgcaagtacacaagagagtcgtccgattttaacaggtgtccacttcgtattgagtcaacacaaagagttaaaaacagttgcaacagactctcatcgcctaagccagaaaaaattgactcttgaaaaaaatagtgatgattttgatgtcgtaattcctagccgttctctacgcgaattttcagcggtatttacagatgatatcgaaactgtagagattttctttgccaataaccaaatcctctttagaagcgaaaatattagcttctatactcgtctcctagaaggaaactatcctgatacagatcgcttgattccaacagactttaacactactattacttttaatgtggtaaacttacgccagtcaatggagcgtgcccgtcttttatcaagtgcgactcaaaatggtactgtgaaacttgaaattaaggatggggttgttagcgcccatgttcactctccagaagttggtaaagtaaacgaagaaatcgatactgatcaggttactggtgaagatttgaccattagtttcaacccaacttacttgattgattctcttaaagctttaaatagcgaaaaggtgaccattagctttatctcagctgttcgtccatttactcttgtgccagcagatactgacgaagacttcatgcagctcattacaccagttcgtacaaattaa

SEQ ID NO: 2551 - DNA (genomic), 186 bp, Streptococcus pneumoniae; double-stranded, circular
  misc_feature (B) LOCATION 1...186
  hypothetical: NO
  anti-sense: NO
tgctggttttcaagtacggtctatgaatttgtcaagtcgggtcgctatccgagaaatggctggttccgtcgtttgaatgctcatgatgaggagcatatcacggctagtctggactcagttggcatgtgggacatcgagacaaacgcttgggttctctatctgggggacaaaagcagcgagcggtga

SEQ ID NO: 2552 - DNA (genomic), 192 bp, Streptococcus pneumoniae; double-stranded, circular
  misc_feature (B) LOCATION 1...192
  hypothetical: NO
  anti-sense: NO
aaagtgaaatttaaaatcaaacaagatttctatgattgggaatcaaatgtgaaacgactggcaggagaggaacttgagattactgaggagcgctatgctgagctggctgacaatattgccagcaacggtgtcactatctcagacgttcttgagaaaatcctccctgaacctgagttcttagaagaggattga

SEQ ID NO: 2553 - DNA (genomic), 408 bp, Streptococcus pneumoniae; double-stranded, circular
  misc_feature (B) LOCATION 1...408
  hypothetical: NO
  anti-sense: NO
tgtcagctttcaaaatgccatggaatatctggtcttgaaagaaatataaactcaaaaatgaatgataaagacaggaaaggggcttgttttatggacacaaaagaattatttgacgcgctggatgatttttcccaacaattattggtaaccttagccgatgtggaagccatcaagaaaaatctcaagagcttggtagaagaaaatacagctcttcgcttggaaaatagtaagttgcgagaacgcttgggtgaggtggaagcagacgctcccgtcaaggccaagcatgttcgcgaaagtgtccgtcgtatttaccgtgatggatttcacgtatgtaatgatttttatggacaacgtcgagagcaggacgaagaatgtatgttctgtgatgagttgttatacagggagtaa

SEQ ID NO: 2554 - DNA (genomic), 885 bp, Streptococcus pneumoniae; double-stranded, circular
  misc_feature (B) LOCATION 1...885
  hypothetical: NO
  anti-sense: NO
aaggagctttcaaaaggagaagggctagggaataaattcttggccaatattcgtgaagtagatgcgattgttcacgtagttcgtgcttttgatgatgaaaatgtgatgcgcgagcaaggacgtgaagacgcctttgtagatccacttgcagatattgatacaattaatctggaattaattcttgctgacttagaatcagtgaacaaacgatatgcgcgtgtagaaaagatggcacgtacgcaaaaagataaagaatcagtagcagaattcaatgttcttcaaaagattaaaccagtcctagaagacgggaaatcagctcgtaccattgaatttacagatgaggaacaaaaggttgtcaaaggtcttttccttttgacgactaaaccagttctttatgtagctaatgtggacgaggatgtggtttcagaacctgactctatcgactatgtcaaacaaattcgtgaatttgcagcgacagaaaatgctgaagtagtcgttatttctgcgcgtgctgaggaagaaatttctgaattggatgatgaagataaaaaagagtttcttgaagccattggtttgacagaatcaggtgtagataagttgacgcgtgcagcttaccacttgcttggattgggaacttacttcacagctggtgaaaaagaagttcgcgcttggactttcaaacgtggtatgaaggctcctcaagcagctggtattatccactcagactttgaaaaaggctttattcgtgcagtaaccatgtcatatgaagatctagtgaaatacggatctgaaaaggccgtaaaagaagctggacgcttgcgtgaagaaggaaaagaatatatcgttcaagatggcgatatcatggaattccgctttaatgtctaa

SEQ ID NO: 2555 - DNA (genomic), 1101 bp, Streptococcus pneumoniae; double-stranded, circular
  misc_feature (B) LOCATION 1...1101
  hypothetical: NO
  anti-sense: NO
caggctatttcggagattcctggggtcttgcgtttgaccttgggggaacctgattttacaacgccagaccatgtcaaggaggcggccaagcgagcgattgatcagaaccaatcctactatacagggatgagtggtctgctgactctacgtcaggcagccagtgactttgttaaggaaaagtaccaactggactatgctcctgaaaatgaaatcttggttacaattggggcgacagaggctttatctgcgactttgacggctattttggaagagggcgacaaggtacttttgccagctcctgcttatccaggctatgaaccgattgttaacttagttggggcagaaattgttgagattgatacgactgaaaatggttttgtcttgactcctgagatgttggagaaggccattttggagcagggtgataagctcaaggcggttattctcaactatccagccaatccgacaggaattacctacagtcgagagcagttagaggccttggcagctgttttacgcaagtacgaaatttttgttgtctgtgatgaggtttactcagaattgacctacacaggcgaagcccatgtgtctctaggaacgatgttgagagaccaggctattattatcaatggtttgtctaaatcgcatgccatgacaggttggcgtttggggctgattttcgctcctgcggccttcacagcccagttaatcaagagtcaccaatacttggtcactgccgcaaataccatggcgcaacatgctgcggtagaagccttgacggctggtaaaaatgatgcggagcccatgaagaaggaatatatccagcgtcgggactatatcatcgaaaaaatgactgctcttggttttgagattatcaaaccagacggtgccttctatatttttgctaaaattccagcgggctacaatcaagactcctttgcttttctgaaggattttgctcagaagaaggccgttgcctttatccctggtgcagcctttggacgttacggggaaggctacgtccgcctatcttatgcagccagcatggagactatcaaagaagccatgaaacgacttgaggagtacatgagagaagcatga

SEQ ID NO: 2556 - DNA (genomic), 816 bp, Streptococcus pneumoniae; double-stranded, circular
  misc_feature (B) LOCATION 1...816
  hypothetical: NO
  anti-sense: NO
aaggatatttctatgcaaccaacttacaacattgacaatccaaacttgtcttatgaagcgaagcgtgatttatggcggataggttttggtctgcagaaagttgacaatctagtgccatcagcgtatatggaatctttggctgagaaacagtcccggggagaactgacttatgagcaggtttatgaggatgcaacggcttatcaccatactattgatgcaagtacggaagaggcagacttggtttctctacgtattgtagaactattgtctcgaagaggctttagctttagtcctgcgaccttacttgctattcataaggagttgtttcaagatatatttgaaccctctattccggtggggcaatttcgtcagaccaatatcacaaagaatgaacctgttttgaatggtgaaagtgttgtgtactctgattactccatgattcaaatgaccttagattatgattttaatcaggaaaaacaagttgcatatgcgacactaactcaggcggatgtggttaaacaaatccagcattttatttcaggaatctggcagattcatccatttcgcgaaggaaacactcggacagtaacggtctttttgattcagtatcttcgtgagtttggttttgatattgataatacaccatttcagcaacattccaaatattttcgtgatgccttggtattagataatgcaaagattttacagcgacgttctgagtttttaacagctttttttgaaaatctcttgctcggtggtcaaaatgatttgtcttcagaaaaaatgtatctagatttagacctcgatttttcataa

SEQ ID NO: 2557 - DNA (genomic), 378 bp, Streptococcus pneumoniae; double-stranded, circular
  misc_feature (B) LOCATION 1...378
  hypothetical: NO
  anti-sense: NO
atcaggaaattcgccgcattcaaaacttacgtgaggacgagctttatgttgctgccaaggattttgcaagtccctgtagaattggtccaatatgttcatgaacatggaaaattgccagttgtaaatttcgctgctggaggtgttgcaacgccagcagatgctgcgttaatgatgcaattaggggcagagggggtctttgtcggttcaggtattttcaagtcaggagatcctgttaaacgagcgagtgccattgttaaggctgtgactaacttccgtaatcctcaaatcctagctcaaatctctgaagatttaggagaagccatggttggtattaatgaaaatgaaatccaaattctcatggctgaacgaggaaaatag

SEQ ID NO: 2558 - DNA (genomic), 672 bp, Streptococcus pneumoniae; double-stranded, circular
  misc_feature (B) LOCATION 1...672
  hypothetical: NO
  anti-sense: NO
aggaggaaattccctatgagaaagaaactctttctgactagtgctgcggtcttgtgggcagtaacagctatgaatagcgtccatgcagcaacagatgttcaaaaagttatcgatgaaacctatgtccaacctgaatatgtcctaggttcctccctatctgaagaccaaaaaaatcaaactcttaaaaaactgggctacaatgcctcaacagataccaaagaactcaagaccatgacacctgatgtttattctaaaatcatgaatgtggccaatgactctagcttacagttgtattcatcagccaagattcaaaagctaggtgacaaatcgccacttgaggtcaagattgaaacaccagaaaatatcactaaggtgactcaggatatgtaccgaaacgcagcagtaacgctgggtatggaacatgccaaaatcactgtagcagcccctattccagttacaggagaaagtgctttagcagggatttactattcgctagaggctaatggagccaaggtgccacaagctaataaagatttggctcaagaagagctaaaagctttgtcagatatcaatgctgaaaacaaggacaaatcaggctatgatgctaataaattaaacgttgccctagctgatatcaagtcaggactcgccaaagctaaagaaagcaaggga

SEQ ID NO: 2559 - DNA (genomic), 255 bp, Streptococcus pneumoniae; double-stranded, circular
  misc_feature (B) LOCATION 1...255
  hypothetical: NO
  anti-sense: NO
cgtgaaatttctttttaccaaaatcattcgctaattgtttttttagggcgattgatttttacttccgtcgcatcaatcattatcgtgtcctcagagctgagaggagttcttgaaatcgtaacaccacctttgaacaagagttacttcaacccattggctccgacggataaagaagacttgataagaactctagagttagctccccatgttgaaggtggctattttagacaaacaaaaaaacttcagacactataa

SEQ ID NO: 2560 - DNA (genomic), 1224 bp, Streptococcus pneumoniae; double-stranded, circular
  misc_feature (B) LOCATION 1...1224
  hypothetical: NO
  anti-sense: NO
aaggagatttctggtactatatttgcagttgtgactcttaatcactatcattggtcattgactgtaaccaccttgttttcattaatgattatgctacttgtaccaaaaatctttgcattgaaaatgcgagaagttagtctaaatttaactaaccaaaatgaagcttttttaaaatttagtgagactatattgaatggatttgatgtgttagcgtccttgaattttttatatgtattgcctaagaaaattacagaagcaggaattttattaaagttggttatacaaagcaagaccactgtagtaacgttagcaggcgatattagcttctttctcaatattttttttcagatatctttcgtttttttaacaggctatcttgcaataaaaggaatagtgaaaattggtactattgaagcaataggagcactaacaggtgttatttttacagcgctaggtgaattaggaggtcaattatcctttattattggtacgaagcctatttttttaaaattgtattcaattaatccaattgagtcaaataaaatgaatgatatcgaaccaaatgaggtgaatagagattttccgttatatgaagcaaaaaatatttgctataagtatggagataaagaaatattaaaaaacttaaatttttgttttcaacgtaatgaaaagtatttaattttaggtgaaagtggaagcgggaaatctacattattaaaattattgaatggctttttgagagattatagtggagaattgcgattctgcggggatgatataaaaaaaacctcctatttaaatatggtttcgaatgttctatatgtagatcaaaaagcttatttgtttgaaggtacgattagagataatattttattggaagaaaattatactgatgaagaaatactacagtctttagagcaagttggtttgagtgtaaaagattttcctaataacattttagattattatgttggtgatgatgggagattactgtcaggagggcagaaacaaaaaattactttagctagagggctaattagaaataagaaaatagtattaattgacgagggaacttctgctatcgataggagaacttcgttagcgattgaacgtaagatattagatagagaggatttgactgtcattattgttacccatgctccgcatccggaacttaaacaatattttactaagatatatcaatttccaaaggattttatttaa

SEQ ID NO: 2561 - DNA (genomic), 201 bp, Streptococcus pneumoniae; double-stranded, circular
  misc_feature (B) LOCATION 1...201
  hypothetical: NO
  anti-sense: NO
ttgtggatttctgtgctgggaatggagcagtggggctttttgctagcactcgtactcaagcacagatattgtctgttgagatttcaggagcgtttggcggatatggctgaacgctctgtccgtttgaatggattagaggagcaaatgcaggtcatctgcgatgatttgaaaaatatgcctgctcacattcaggggaagtaa

SEQ ID NO: 2562 - DNA (genomic), 702 bp, Streptococcus pneumoniae; double-stranded, circular
  misc_feature (B) LOCATION 1...702
  hypothetical: NO
  anti-sense: NO
gggaggatttctatgaaaaagtatcaacttctattcaaaataagtgcagtcttctcttacttatttttcgtatttggtctttctcagctgacgcttatcgtccaaaattattggcaattttcttcccagattggcaatttcgtctggattcaaaatatcttgagtttactatttagcggagtcatgatttggattctggttaagacaggccatggctatctctttcgcattccaagaaaaaaatggctttggtattctattttgacagtattagtggtagtgctccatatctcttttaacgttcagacagctaaacatgttcagtcaactgctgagggttggaacgtattgattggttatagtgggaccaactttgctgagctaggtatctatgtaaccctgtttttcctgactccactaatggaagagttgatttataggggattacttcaacacgccttctttaagcattcgcgatttgggcttgatttgcttcttccttccattttgtttgctcttcctcattttttgagtctgcctagtctgttagatatcttcgtctttgcaacatttggaatcatctttgccggtttgacccgctataccaagagtatttatccatcctatgcggtgcatgtgatcaataatattgtagcgaccttcccgtttttgctcacttttctacatagggtcttggggtaa

SEQ ID NO: 2563 - DNA (genomic), 279 bp, Streptococcus pneumoniae; double-stranded, circular
  misc_feature (B) LOCATION 1...279
  hypothetical: NO
  anti-sense: NO
tcttccgtttccttgtgttggggatcaaggaacatctgcttggtatcattaaattcaatcaaatctccatctaggaaaaatcctgtcttatcagagatacgtgaagcttgctgcatggaacgggttaccagaagcatggtgtacttgtcttttagaccatacaaggtttcctcaattttaccagctgaaatcggatccaaagccgaagttggctcatccaagaggatgattttaggactagttgccaagacacgggccacgcagacacgctgctgttga

SEQ ID NO: 2564 - DNA (genomic), 591 bp, Streptococcus pneumoniae; double-stranded, circular
  misc_feature (B) LOCATION 1...591
  hypothetical: NO
  anti-sense: NO
agggcagtttcatcaaaaaagcgaggaagaaggatggcaagaactgagctgtcagataaaatcgaaacagaacgtctcgttttacgagtccgtactgtggcggatgctgaggatatccatgcctacgctagtttgccagaggtcgcctatccagcaggttttcctccagtcaagaccttggaagatgagatttattatctggagcacattcttccggagcgtaatcaaaaggaaaatctcccagcaggctacgggattgtcatcaaaggaacggataagatcgctggctctgtcgatttcaaccatcgctatggggacgatgtgctagagcttggctataccttacactcagactactggggtcgaggttatgttccagaagctgcgcgtgccttgattgacttagcctttaaagatttgggtcttcacaagattgaactaacttgctttggatataaccttcaaagtaaacgagtcgcggaaaagcttggctttaccctcgaagctcgcataagagaccgcaaagatgctcaaggcaactgctgtgatgatttaagatatgccttgctgaagagtgaatgggaggaataa

SEQ ID NO: 2565 - DNA (genomic), 1035 bp, Streptococcus pneumoniae; double-stranded, circular
  misc_feature (B) LOCATION 1...1035
  hypothetical: NO
  anti-sense: NO
gatatggtttctactattggtattgttagtttatctagtggcattatcggagaagattttgtcaaacacgaagtggacttgggtatccaacgtctcaaggttctgggactcaatcccatctttttgccccattcgttaaaaggattagactttatcaaggaccatcctgaagctcgtgcagaggatttgattcatgccttttctgatgatagcatcgacatgatcctatgtgccataggtggagacgatacctatcgcttgctaccttatctttttgaaaatgaccaactccaaaaggctatcaaacaaaaaatttttcttggcttctcggatacaaccatgaaccacctcatgttgcataaattaggaatcaagactttttatggtcaatcctttttagcagacatttgtgaattagacaaagaaatgctagcctatagccttcactactttaaagaattgattgagacgggaagaatttcagaaatccgccctagtgacgtttggtatgaggaacgaactgattttagtcccacggccctgggaacacctcgtgtcagtcatacaaatacaggttttgacttgttgcaaggaagtgctcagttcgaggggaaaatcctcggtggttgcctcgaatccctctacgatatctttgacaactctcgatacgcagatagcacggaactctgccaaaaatacaaacttttccctgacttgtcagactgggaagggaaaatcctcttgctcgaaacaagcgaagaagagcctaagccagaagacttcaaaaagatgttgctaactttaaaggacactggcatattcgcggtcatcaatggactcttggtcggaaaacctatggatgaaactttccatgacgactataaagaggcactattggatatcattgacaacaatatcccgattgtctataatctgaatgtcggccacgcaactccaagagcaattgtaccctttggggtccatgctcatgtagatgcacaggaacaagtcattcgctttgactataacaaataa

SEQ ID NO: 2566 - DNA (genomic), 1593 bp, Streptococcus pneumoniae; double-stranded, circular
  misc_feature (B) LOCATION 1...1593
  hypothetical: NO
  anti-sense: NO
tcctcggtttccgtaatgtcttggaaggtgtccattggtcgatgttggatggcaagaccatcacagaatcctctcagttttgggcaggggttaatcacttcctctggttgcctggtgaagctatcttccagttcttaccagttagggattacttggtctgtttctcgtaagatgggaaccaaccaaattttgggaattgttctcggaatctgtttggtatcgcctcagttgctcaatgcctatgcggttgcttcaacgccagcagctgatatcgcagcaaactgggtttggaattttggttattttactgttaatcgtattggttaccaagcccaagttatcccagccttgcttgcaggtttgagtctgtcttatcttgaaattttttggcgcaaacatatcccagaagtcatttccatgatttttgtaccttttttgtcattgattccagccttgattttggctcatactgtcttggggccaatcggttggacaattggacaaggactttcatcagttgtattggcaggtttaacgggtcctgtaaaatggctcttcggtgcaatttttggtgccctctacgctccatttgtcatcacaggtctgcaccacatgaccaatgccattgatacacaattgattgcggatgctggtggcactgccctctggcctatgattgctctttctaatattgctcaaggctcagccgtgtttgcctattatttcatgcatcgccatgatgagtgtgaggctcaggtttcacttcctgcaaccatttcagcctatctcggtgttacagaaccagctctttttggggttaacgtaaaatatatttatccatttgttgctgggatgactggttcagcccttgcaggcatgttatccgttacttttaatgtaactgcggcttctattggtatcggtggtttgccaggtattctctctattcaacctcaatacatgctgccatttgcaggaactatgctagttgcgattgttgttccaatgctcttgactttcttctttcgcaaggctggtctcttcacaaaaatagagggcgatacgaacttgcaggcagaattcgttgctcaagaagaagcagaatttgtgagccatgaaccagtagaacttacttcggtagaaattatcagcccactaactggccaagtgaaagaattgagtcaagcgacggatcctgtttttgcatcaggtgtcatggggcaaggtctggtcattgaaccaagccaaggtgagttgacctctccagttaatggaacagtgacggttcttttccctaccaagcatgccatcggcattgtctctgacgagggagttgaattgctcatccacatcggtatggatacagtaggtcttgatggcaaaggttttgaaagtcttgtagtccaaggagatcacgttatagttggccagcaactgattcgttttgatatggatgtcattaaggctgcaggtctggtgacagaaactcctgttatcatcaccaaccaagatgcttatacagcgactattactggaacttatccgacaacgatccaagctggagcatctctcatggtcgctacacgaatctaa

SEQ ID NO: 2567 - DNA (genomic), 363 bp, Streptococcus pneumoniae; double-stranded, circular
  misc_feature (B) LOCATION 1...363
  hypothetical: NO
  anti-sense: NO
actagggtttccaccttctttgtaggcttcgataattttctgtggatacttgcttgtagggagtttagaagaggtatctgtagagttttggttgatgaagaactggctgccattggtgtttggttgaccagtattagccatagcaagagcaccgcggatgttatacaaataaggagtaatctcgttcttgaaaccagttcctttgtctttagtcttatccttgtcatgccagatggactgaccacctgtaccgtccccttttggatctccagtttggaccataaagccatcgatgacacggtggaaggtaataccgttatagtagccttctttggcgtgagtgaggaaattttcaaccgctag

SEQ ID NO: 2568 - DNA (genomic), 1041 bp, Streptococcus pneumoniae; double-stranded, circular
  misc_feature (B) LOCATION 1...1041
  hypothetical: NO
  anti-sense: NO
ctcgcttcttcggtctactcattgttcgtctggtacaatttgttcttaaaaaaggaaagagaggtaatcagcatgcgtaaatggacaaaaggatttctcatctttggtgtggtgactaccgttatcggctttatcctgctttttgtaggtatccaatctgacgggattaagagcctactttccatgtccaaagaacctgtctatgatagccgtacggaaaagctaacctttggcaaggaagtcgaaaacctagaaattactctccaccaacacgcgctcaccatcacagactctttcgatgatcaaatccacatttcttaccatccatctctttctgctcaccatgatcttatcaccaatcaaaacgatagaactctgagtctcactgataagaaactgtctgaaactccgtttctctcttctggaattggtgggattcttcatatcgcaagtagctactctagtcgttttgaagaagttattctccagctaccaaaagggagaactctaaaagggatcaacatctcagccaatcgcggacaaaccaccatcataaatgctagccttgaaaatgcgaccctcaatacaaacagctatatcctccgaattgaaggaagtcgtatcaaaaacagtaaactcacaacacccaatatcgttaatatctttgatacagttcttacagatagtcagctagagtcaacagagaatcacttccacgctgaaaatatccaagtccatggtaaggttgaactgactgccaaagattatctcagaatcatcctagaccagaaagaaagccaacgaattaactgggacatctcaagcaactatggttctatcttccaattcacaagagaaaagcctgaatcaagaggtacggaattaagcaacccttacaaaactgaaaaaaccgatgtcaaggatcaactcattgcgagatctgatgataatattgatctaatatccacactcagagacgngnccntnnnnnnttntacaaagggcnttacttcgaaggccgnannnacacgccgaaaaaag

SEQ ID NO: 2569 - DNA (genomic), 273 bp, Streptococcus pneumoniae; double-stranded, circular
  misc_feature (B) LOCATION 1...273
  hypothetical: NO
  anti-sense: NO
aaacattcttcaaaaactcaaccttccataccgtgtcgttgctctctctactggagatatgggcttctcagctgcgaagacttacgacttggaagtgtggattccagcacaaaacaattacgtgaaatctcaagctgttcaaacacagaagatttccaagccgttcgtgcccaaatccgttaccgtgatgaagcagatggcaaggtgaaactcccttcataccttgaacggttctggacttgcagttggacgtacagtggctgcaattcttga

SEQ ID NO: 2570 - DNA (genomic), 243 bp, Streptococcus pneumoniae; double-stranded, circular
  misc_feature (B) LOCATION 1...243
  hypothetical: NO
  anti-sense: NO
cggcttgaatttgctggatttacgtggagtttgtgcttgaggatatatcttcatgagcccttgataaccactgtcagccaagattttaccagcttgtccgatatttctgcgactcattttgaacaacttcatatcatgacaatagttcacagtgatatccaaagaaacaattctcccttgacttgtgacaatcgcttgagccttcatagcgtagcatttctttttaccagaataattcgctaa

SEQ ID NO: 2571 - DNA (genomic), 282 bp, Streptococcus pneumoniae; double-stranded, circular
  misc_feature (B) LOCATION 1...282
  hypothetical: NO
  anti-sense: NO
aaaagctcttcggctcttgccttgcttttctccattattcgtgtcaagaccattccttttgtcatcttggatgaggtggaagctgcgctggatgaagccaatgttaaacgttttggggattacttcaaccgctttgacaaggacagccagtttatcgtcgtaacccaccgtaagggaaccatggcagcggctgattccatctatggagtgaccatgcaagaatcaggtgtctcaaaaattgtttcggttaagttaaaagatttagaaagtattgaaggatga

SEQ ID NO: 2572 - DNA (genomic), 255 bp, Streptococcus pneumoniae; double-stranded, circular
  misc_feature (B) LOCATION 1...255
  hypothetical: NO
  anti-sense: NO
gctgttccttcttcagcgattttcccttggtcgaggaagataatccggtcagtaatggcttgggcaaactgcatttcgtgggttactaaaatcatggtacggccttcttgggtcaaatcattgataagttccagcacctcacgcaccatttctggatccagcgaagcagtcacctcgtcaaaaaggatgatttctggatgcattaggagggcacggacaattgcaacacgttgcttctgtccaccagataattga

SEQ ID NO: 2573 - DNA (genomic), 1011 bp, Streptococcus pneumoniae; double-stranded, circular
  misc_feature (B) LOCATION 1...1011
  hypothetical: NO
  anti-sense: NO
cagatgccttcccattatacgaggaataaaacttttatggacatttatattaagaaagccattattcaccagttcagtccggatgataccgagctgttcttagcagataagtttctcaatattactccaaaaatcgaagaatacctacgtaaaaaaattgaacatgtgtattcagatgaagccaagactgggattttcgaagaagaaaatcccttcttcaatcatattacagacgatttgttggagacatcagtaacgctggctaatctctggaaagaggagtttagcatttctgaaaatctcaagaccaatgacttgatttttgttcaattttctaaagaaggtgtagaacatttcgctttcttgcgaattgccctgcgggagaccttgacccacctcggaggagaagttgataatccaatcaagctgactcagaataacctgcctggatttggaacgggtgctgacgaggccttggtggtcaatcttcagagtcgcaagtatcacctgattgaaaaacgaatcaagtacaacgggacttttttgaactatttttcagataatcttcttgctgtcgctcctaagatttctcctaaaaaatctatcaaggaactggaaaaaacagcccagagaattgctgaatcttttaacacagatgattttcaatttcaatccaaggtcaaatcagcgattttcaacaacctagaagaaagcaatgaattgtcacctgagaaattggctaatgacctttttgacaacaatctgacggctcgtttgagctttattgaccaagtcaaagaagccgtaccagaacctgttcaatttgatgaaattgatgcaagtcgccaattaaagaaatttgaaaaccaaaaactctccttatcaaatggaattgagctcatcgttcccaataacgtctatcaagacgccgagtctgttgagtttatccaaaacgaaaatggaacctactctatcttaatcaaaaatatcgaggatatccaaagtaaataa

SEQ ID NO: 2574 - DNA (genomic), 528 bp, Streptococcus pneumoniae; double-stranded, circular
  misc_feature (B) LOCATION 1...528
  hypothetical: NO
  anti-sense: NO
caaacgccttccaaggtatttcaaacaaattgttgccaggttcattcccagcggttgacgttgcagcttcttatggatttggttctccaaatgctgtcttgtcaggatttacctttggttttgattggtcaattgattacaattgttttgctcatcgtctttaaaaatccgattcttattattacaggatttgtaccagtgttctttgacaatgcagccattgcggtctacgctgataaacgcggcggatggaaagcggctgttatcctttcctttatatcaggtgtccttcaagttgctctaggagctctttgtgtggcccttctcgatttggcatcttatggtggctaccatggaaatatcgactttgaattcccatggcttggatttggatatatcttcaaataccttggtattgttggttatgtacttgtgtgtctcttcttgcttgttattcctcaacttcaatttgccaaagcaaaagataaagagaaatattacaacggtgaagttcaagaagaagcttag

SEQ ID NO: 2575 - DNA (genomic), 1083 bp, Streptococcus pneumoniae; double-stranded, circular
  misc_feature (B) LOCATION 1...1083
  hypothetical: NO
  anti-sense: NO
ggtggtacttcttctcgaacaaatgaggatggaagtttatcacgtagtaaggtaaaggatattacccagcagttggctatgctgcacgaggctggtcatgagttgattttgggttcttcaggtgccattgcggctggttttggagccttaggatttaaaaagcgtccgactaaaattgctgataaacaggcttcagcagcggtagggcaggggcttttgttggaagaatatacaaccaatcttctcttgcgtcaaatcgtttctgcacaaatcttgctgacccaagatgactttgtggataagcgtcgttataaaaatgcccatcaggctttgtcggttttgctcaaccgtggggcaattcctatcatcaatgagaatgatagtgtcgttattgatgaggtcaaggttggggacaatgacactctaagtgcccaagtagcggcgatggtccaagcagaccttttggttctcttgacagatgtggacggtctctatactggaaatcctaattcagatccaagagccaaacgcttggagagaatcgagaccatcaatcgtgagattattgatatggctggtggagctggttcgtcaaacggaactgggggtatgttaaccaaaatcaaggctgcaactatcgcgacggaatcaggagttcctgtttatatctgctcatccttgaaatcagattccatgattgaggcggcagaggagaccgaggatggttcttactttgttgctcaagagaaagggcttcgtacccagaaacaatggcttgccttctatgctcagagtcaaggttctatttgggttgataaaggggctgcggaagctctctctcaacatggaaagagtcttctcttatctggtatcgttgaagcagaaggagccttttcttacggtgatatcgtgacagtatttgataaggaaagtggaaaatcacttggaaaaggacgcgtgcaatttggagcatctgctttggaggatatgttgcgttctcaaaaagccaagggtgtcttgatttaccgtgacgactggatttccattactcctgaaatccaactactttttacagaattttag

SEQ ID NO: 2576 - DNA (genomic), 588 bp, Streptococcus pneumoniae; double-stranded, circular
  misc_feature (B) LOCATION 1...588
  hypothetical: NO
  anti-sense: NO
atcttaacttcacactcccaaagaggtattagtgtcgtgtctcaatcttatatcaatgttatcggtgctggtttggcaggttctgaagcagcttaccaaatcgcagagcgtggtattccagttaaactttatgaaatgcgtggtgtcaagtctacaccccagcataaaacagacaattttgctgagttggtttgttccaattctttgcgtggggatgctttgacaaatgcagttggtcttctcaaggaagaaatgcgtcgcttgggttctgttatcttggaatctgctgaggctacacgtgttcctgccggtggagcccttgcggtggatcgtgatggtttctctcaaatggtgaccgaaaaagtggtcaaccaccccttgattgaagtggtgcgtgatgaaattacagaattgccaacagatgttattacagttgtggcgactggtcccttgactagcgatgccctggctgaaaagattcatgcccttaataatggcgatggcttctatttctacgatgcagcagcgcctattatcgatgtcaacactatcgatatgagtaaggtctatctcaataatctccgttag

SEQ ID NO: 2577 - DNA (genomic), 234 bp, Streptococcus pneumoniae; double-stranded, circular
  misc_feature (B) LOCATION 1...234
  hypothetical: NO
  anti-sense: NO
tacttaacttccttctcagttccgaagatagcttcttcaaaggtcaaattgacacgatactggagatcatctccttggcgaggagcgtttggattgcgcgaagaaccgcctccgccgaagaaacttgagaaaatatcctcaaaaccaccgaagccacctgccccattgaaaccgccgaaaccaccagctccaccaaaaccaccattggcgcctgcagcaccatactggtcatag

SEQ ID NO: 2578 - DNA (genomic), 261 bp, Streptococcus pneumoniae; double-stranded, circular
  misc_feature (B) LOCATION 1...261
  hypothetical: NO
  anti-sense: NO
ctaccaacttcaatgattttcccctggtcaagaacaatgacacggttagttcgttcggctatactgagacgatgggctacaaagagaatggttttatcagttagggatataagattatctataacctttttctcagtcaagacatcaagaccgctagtagcttcatctagtattaaaacaggagctttagttaaaagagcacgagcgagagcgattcgttgcttttgtcctcctgatagaccagctccatcagagagctga

SEQ ID NO: 2579 - DNA (genomic), 762 bp, Streptococcus pneumoniae; double-stranded, circular
  misc_feature (B) LOCATION 1...762
  hypothetical: NO
  anti-sense: NO
attcgaacttcatttttagaaaggagtgagtttatgtctcaagatgaaaaattaattcgtgaacagatttgtgatgtttgtcataagatgtggcaacttggttgggttgctgctaacgatgggaatgtatctgttcgattagatgaggataccattcttgcaacacctactggtatcagcaaaagttttattacaccagaaaagctggtgaagttaaatcttaaaggagagattttagaagcagaaggtgattactgtccttctagtgaaattaaaatgcacattcggtgctacgaagaacgtgaggatgttcgttcagttgttcacgcgcatccaccgattgcaacaggatttgctcttgcacacattcctttagatacttattcactaattgagagcgcgattgtggttggggcaattcctattaccccatttggagtaccgtctacaatggaagtgccagaagcaattacaccttatctgcccgatcatgatgtcatgctattagaaaatcatggagctctgactgtcggaagcgatgtcattacagcatactaccgtatggaaactttagaattagtcgcaaagacaaccttccacggaagaatgttactttctacaaagggcattgaggagcaagaaattgctcgtccgactttagaacgtctattctcaatgcgagaaaattataaggttacaggtcgtcacccaggctaccgtaaatataatggcgatggtagtataaaagaaacaaaaaaataa

SEQ ID NO: 2580 - DNA (genomic), 432 bp, Streptococcus pneumoniae; double-stranded, circular
  misc_feature (B) LOCATION 1...432
  hypothetical: NO
  anti-sense: NO
ttactgacttcgtcagtttcatctacaacctcaaaaccatgttttgagctgacttcgtcagtcttatctacaacctcaaaactgtgttttgagcaacctgcggctagcttcctagtttgctctttgattttcattgagtttatattttataggagcgcattattttgcttttgctgcgtactcttcgttacgtttgatcatttgttttctgtaccaagcaaagataccgatatagaatacaaggaaggctactgcaccaaggattgctttgatatcaccagttgtagtgttaccaattgtccaaccaagaagtttttcgattggtccttcaagagtagagtgagtaatcaattgagtttggctcacaccttctgggaaggcacctacacctttagcaagttctgttgcaaatggtgcaataagtgtacctga

SEQ ID NO: 2581 - DNA (genomic), 1308 bp, Streptococcus pneumoniae; double-stranded, circular
  misc_feature (B) LOCATION 1...1308
  hypothetical: NO
  anti-sense: NO
caggtgacttctccatccaaattttgttcaaatggtgcaatcaggaatcctcttagtttatttggtgcacctgtgacaccagctagttatggttcgtcagtcgttccaattcttattatggtttggttgatgaaatatattgaaaaaatgattgctaaattaacaccagctgttactaagagttttttgcaacctacgctagtattattagtatcaagctgtattgccttagttgtagtcggacctattggagtaattgttggtgaaggattatcaaatctagttgggcaaatgtatggtgtagctggatggcttacattagctattcttggtgctattatgccatttattgttatgactggaatgcattgggcttttgcacctatttttttggcggcatctattgctactccagacgtattaattcttccagcaatgttagggtcaaacttagctcaaggggctgcttcgatggctgttgcattaaagagtaaaaataataatacaaaacaaattgcttttgcagcaggtttctcagccttacttgcagggattaccgaacctgcattatatggtgtgactttaaaatataaaaaaccgctttatgcagctatgattggtggtggattagcgggattatttgcaggtcttactagtgttaaagcatatctatttgctgtcccatctttgatagcgttgcctcaatttatttattctgatgtgccatcaaatattgtaaatgctttaattgtggcggtcatttcggttgttattacctttgtattagcttatatatttggaatcgatgaagaagagagttctagcaatttagaagttaaagctggagtttcaaataaaaaaatgatattttctcctatatcaggagaaatcattccgttaagcgatgtccaggataaaacattttcagataaactaattggagacggagtagcgattatcccaagtgaaggtaaggtttatgcaccatttgatgggaaaattacaaatatttttccgactaagcacgcaattggattgaagagtgatgagggtgttgagttactaattcatattggattagatactgttgagctaaaaggtcaaggttttattagtcatgtagaagaaggagacagagttttcaaaaatcagttgatttttgaaatggacttgaatttaatcaagactaaaggctacgaaacagttacaccagtaattgtaacgaataccaatgattttctagatgtattagtattacctaataatcagacaatcgagcattctaaggaattactggtaatattataa

SEQ ID NO: 2582 - DNA (genomic), 1184 bp, Streptococcus pneumoniae; double-stranded, circular
  misc_feature (B) LOCATION 1...1184
  hypothetical: NO
  anti-sense: NO
ttggtgcttcgattttcaatctggtctttatcgtctatgcatcgaccttgtcacaagcatcttttgctgttgctatggcgaatattgtcatgcttctctccgatctctttacagtttttgcagggattcgggcagattacacgagggccaaggtcaaatggatggtctatagcggtttgtttcaggcggttttattttttctggcagccctagttgttcagcaagctagtttatttgccttttctagcctgtgttttatcaatgtcattagtgatatcatcagtgattttgcaggtggcctgcgtatcgctcttattaaggaaaaagtagctgaagatgatttgatggaggcttattctttttcacagttcatcacctatatttcagctattggtggtcaagctttcggagtctggctcttagctctatcggtcaacaatttttctctcgttgcgggaatcaatgcctgctttttcctagtatcagccactatcctctttttaggaaaaagcaaattgagcctgtcaatgtcatctgctgatggtgaaaaactaaaaaatgagaagctttctatcaaagaccagttcctaacaatttatcgaaatttacgtctcgtttttcttaaaagtggacagaaaaactttggttttatgctctgtgctgtcttgcttgtcaatgccttgggtggcgctttgggtggaatttataatatcttctttttgagccattctctcttgaatttttcttacacagaggcactatttatcaatcaagtctgtgttttgttagcaatcatcattagtagccttacgggcaatgattattttgggaagcagtccttgcctagattgatgatgtgggagaccgtaggacttagtctagttggtttggctaatttattcaatcaagtcgtgcttggtttgctatttctcttctttactctgtatgtgtctggtaaagttcaaccaaagattagtgccatgctcatgaaaaatctagctccagaggttctagctcgtactagtaattttttaggtctattgtttaccttatccatacctgtgggaacagcttgtttttcactagtagccgtatggaatatacagttgacttggatgctatttgttggtctttccttgctagctatttttttgacaattcttaatctcaaaaatgatatctaa

SEQ ID NO: 2583 - DNA (genomic), 624 bp, Streptococcus pneumoniae; double-stranded, circular
  misc_feature (B) LOCATION 1...624
  hypothetical: NO
  anti-sense: NO
gcgatagcttctttattggcaacagggatggcgttgtttttcaaagcttcaactgctgcggcaactgctgtttcaatcccacgacgaataccgattggatttgcacctgctgtgacgtttttgattccttcacggacgatagcttgggtcaagactgttgcagtcgtagttccgtcacctgcgatatcattggttttagaagctacttctgatactaacttagcacccatattttcaaaatggtcttccaattcgatttctttggcaatggtcacaccgtcattggtaatcaagggtgaaccgaatgacttttcaagaacgacattgcgaccttttggtcccaaggttactttaacagtgtctgcaagaatatcgacaccacgaaccatggctgaacgggcatctgatgaaaatttaatttcttttgacatacttactttctccttctattcctcaatgattgccaaaatgttagcttcgcctacgatgatgtacttttcatcgccatctttgacatcaagacctgcgtgggcttcaactaagacacgatctccagttttaacacttggagcaaccaagtcaccgttcaaggtacgaacaccttgtccagtagccacaacttga

SEQ ID NO: 2584 - DNA (genomic), 1476 bp, Streptococcus pneumoniae; double-stranded, circular
  misc_feature (B) LOCATION 1...1476
  hypothetical: NO
  anti-sense: NO
gacttggcttcaattagaaaaaggagagtaatgatgccaattcaaaataaaaccatgttgattacctattctgatagccttggaaataatcttaaagacttatatgataatttggaagagcattttcgagatgctattggaggagttcaccttttaccatttttcccatcaacaggtgatcgtggatttgcgccagttgactacgacgaagtggactcagcttttggtgattgggaggatgttaagcgtttaggtgagagatattatcttatgtttgattttatgattaatcatatttctcgtcaatccaagtattataaggactatcaagaaaaacatgaagccagtgaatttaaagctctctttttaaactgggataagttttggccagaaaaccgtccgacacagtctgatgtagatttaatttacaagcgtaaggatcgtgcaccaaagcaagagattgtgtttgaagatggttcagtggaacatttgtggaatacctttggtgaggagcagattgatcttgatgtgaccaaagaagtaactatggaatttatccgtaagaccattcagcacttggcaagtaatgggtgtgatttgattcgtctagatgcctttgcttatgcagtgaagaaattggatactaatgatttctttgtggaaccagatatttgggatttattggacaaagttcgagatatcgctactgagtatgggacagagtttttacctgagattcatgaacactattcgattcagtttaaaatagcagaccatgattactatgtttatgattttgctcttccaatggtgacactttatactctttacagttccagaacagagcgtttggctaagtggttaaagatgagcccgatgaagcaatttacgacgctagatacccatgatgggattggagtagtagatgtcaaggatatcctgaccgatgaggagattgactatgcttcaaatgaactctataaggttggagccaatgtcaaacgtaagtactctagtgccgagtataacaacttagatatctaccaaatcaattcaacctactattcagcgcttggagatgatgaagtcaagtattttctcgctcgtctaattcaagcttttgccccaggtattcctcaggtttactatgtgggtctattagcaggcaagaatgacttgaaattattagaagaaactaaagaaggtcgaaatattaatcgtcattactatagcaacgaggaaatagcaaaagaagtgcaacgacctgttgtgaaggcccttctcaatctattttctttccgtaaccgttcagaagcctttgatctagaagggactactgagatagagacaccaacagctcacagcattgtaatcaaacgtcaaaataaagataagtccgtaacagcagtagcagaaattgatttgcaaaatcagacttatcgggtaattgagaatggagttgaagtaacattttga

SEQ ID NO: 2585 - DNA (genomic), 303 bp, Streptococcus pneumoniae; double-stranded, circular
  misc_feature (B) LOCATION 1...303
  hypothetical: NO
  anti-sense: NO
actgcttattcttgttcagcagcttcttctgttgcttccgcttttgttgctttctcagcttcttcagcttcaaaggctgctttagcctcttgggctgctttttcgcgggctttttcaaggtcatctacgtggatgacatcttcgtccattccttcatccaagtcgcgaagttccacttcttggtcatcttcgtctaggacacgcatgtcaagaccaagagattgcaattctttgacaagaactcggaaggattctggaacacctggttttggaattggtttgccttttgtaatagcttcatag

SEQ ID NO: 2586 - DNA (genomic), 429 bp, Streptococcus pneumoniae; double-stranded, circular
  misc_feature (B) LOCATION 1...429
  hypothetical: NO
  anti-sense: NO
aatggagaattaaacatgttagcaaatggaattacgctttcttatggcgaaacaaaagatagctatactaaacttgttggattgaaagaagtaccagagtttggtattgaactcgaaaaagtagaaaatactactcttgaagatacggtgaagaagtacgagtttggtattggggacataggagaacttgagtacaagttctcttataataattcaagcgcaactgctccttatcgtgtattgcgtaaggcagcagacgacaagaagaaactctactttgaacaagcttatccagacggtactaaggtcatttttgaaggccaagtatctgttaagcttggcggtggcggtgtcaatgccgttatcgatttcacacttaagattgccttgcagtctaatcttacatttactgatggtattggaggttaa

SEQ ID NO: 2587 - DNA (genomic), 351 bp, Streptococcus pneumoniae; double-stranded, circular
  misc_feature (B) LOCATION 1...351
  hypothetical: NO
  anti-sense: NO
ttcgcatattcagcaacatcatccatcaaatgcgttaccaagacgatggtcatccctgactggtggagttttttgaacagggtcatcaactcttttctccctagaggatctagaccagctgttggctcatctaagactaatatagctggctccatggcaagtatgcctgcaatggcaacacgtctcatttgtccccctgacagctcaaacggactacgatcaaaaagtgattcatcaattccaaccagagccagtttctcacgcgcagtcttcacagcatcttcttcagaaactccaaaattttgcggtccaaaagcaacgtccttcaaaaccgtttcttcaaaaatctga

SEQ ID NO: 2588 - DNA (genomic), 402 bp, Streptococcus pneumoniae; double-stranded, circular
  misc_feature (B) LOCATION 1...402
  hypothetical: NO
  anti-sense: NO
aaatgtcattctatggaacctcaagcgattgtcaccagccaagaaagaattgtttctttgaatattgcggtgaactattgccacgatatgaagttgttcaaaatgagtcgcagaaatatcggacaagctggtaaaatcttggctgacagtggttatcaagggcccatgaagatatatcctcaagcacaaactccacgtaaatccagcaacctcaagccgctaatagctgaagataaagcctataaccatgcgctatctaaggagagaagcaaagttgagaacatctttgccaaagtaaaaacgtttaaaatgttttcaacaacctatcgaaatcatcgtaaacgcttcggattacgaatgaatttgattgttggtattatcaatcatgaactaggattctag

SEQ ID NO: 2589 - DNA (genomic), 639 bp, Streptococcus pneumoniae; double-stranded, circular
  misc_feature (B) LOCATION 1...639
  hypothetical: NO
  anti-sense: NO
atcatggaatttaggacaattaaagaggacggccaagtccaagaagaaatcaaaaaatctcgctttatctgccatgccaagcgtgtttatagcgaagaagaggctcgtgacttcattactgccatcaaaaaagaacactacaaagcgacacataactgctctgcctttattattggagaacgtagtgaaattaaacgtacaagtgatgatggtgagcctagtggtactgctggtgttcccatgcttggggtactagaaaatcacaatctcaccaatgtctgtgtggtcgtgacacgctactttggtggtattaaactaggcgctggaggactaattcgtgcttacgccggcagtgtcgccttagctgtcaaagaaattggtattattgaaataaaagaacaggctggcattgctattcaaatgtcttatgctcagtaccaagagtacagtaacttccttaaagaacatgatctcatggagctggatacaaactttacagatcaagtcgatacgatgatttatgttgataaggaagaaaaagaaactattaaagctgcacttgtggagttttttaatggaaaagtcactttaactgaccaaggtttacgagaggttgaagttcctgtaaacttagtgtaa

SEQ ID NO: 2590 - DNA (genomic), 363 bp, Streptococcus pneumoniae; double-stranded, circular
  misc_feature (B) LOCATION 1...363
  hypothetical: NO
  anti-sense: NO
gtaatggaattgatgaataaaacacgagtaacagattcactagcagttgtgattggaccagaatcgattgaagtacttgttactgaaggttttctatttgatgttgcgattcgttttgtaaaagtagacgaaacaaatcttgatcaaggaaatgaaaagccagtattcactccggaatacaagctggtcacagttgctaaatacaaggaaaaacctatctttgaatcggaggaagatattcgaaaatttgagaagcaagcaaaagaagttaaatcgctatttgcctttgcaaaggtaaataaacaaaattggtttaacactgccctttatccaggagtgctgactgagaaagttggtgtttga

SEQ ID NO: 2591 - DNA (genomic), 813 bp, Streptococcus pneumoniae; double-stranded, circular
  misc_feature (B) LOCATION 1...813
  hypothetical: NO
  anti-sense: NO
cagatggaattgactaaatacgcttcatctatgcttcttgaccctgagtatggacttccagcaactaaagctcttgatgaaaaagctggtcttctccttgcttatgaaaaaacaggttatgacacaacaagcacaaaacgcttgccagactgcttggatgtttggtctgcaaaacgtattaaagaagaaggtgcagatgcagttaaattcttgctttactatgatgtagatagctcagacgaactcaatcaagaaaaacaagcctacatcgaacgcatcggttctgagtgtgtggctgaagatatcccattcttccttgaaatccttgcttacgatgaaaaaattgcggatgcaggttctgtagaatacgcgaaagtaaaaccacacaaagttatcggcgctatgaaagtcttttcagacccacgctttaacattgatgtcttgaaagttgaagttcctgttaacattaaatatgttgaaggcttcgctgaaggtgaagtagtttatacacgtgaagaagcagcagccttcttcaaagcgcaagatgaagcaacgaacttgccatacatctacttgagtgctggtgtatcagctaaactcttccaagatactcttgtatttgctcatgaatcaggtgcaaactttaacggagttctttgtggccgtgctacatgggcagggtcagttgaagcttacatcaaagatggtgaagcagcagctcgcgaatggcttcgcacaactggatttgaaaacattgatgagctcaataaagttcttcaaacaacagcgacttcatggaaagaacgtgtgtaa

SEQ ID NO: 2592 - DNA (genomic), 204 bp, Streptococcus pneumoniae; double-stranded, circular
  misc_feature (B) LOCATION 1...204
  hypothetical: NO
  anti-sense: NO
acctgccattcatgtaataaaggctctactcttaaaggaaaacccgtagcacagaccacatacgaagccgtttctaaagctcttgtgactgcagaagatacgattatttcagctgacgagagtaaaggatttttgctcaatttctggacttgctgccgtcccatctcagacaagggtgccaaatctatcccaaatcctatataa

SEQ ID NO: 2593 - DNA (genomic), 228 bp, Streptococcus pneumoniae; double-stranded, circular
  misc_feature (B) LOCATION 1...228
  hypothetical: NO
  anti-sense: NO
ggaggccattcttttatcaagcacaagacaggttggtttgatggcatgatgacgacaggttgctctatgggagcctatcatgcactcaatttcttcctccagcatccagatgtctttaccaaagtgattgctctcagtggtgtttacgacgcacgtttctttgtcggtgattactacaacgatgatgctatttaccaaaactcgccagtagattatatttggaactaa

SEQ ID NO: 2594 - DNA (genomic), 1137 bp, Streptococcus pneumoniae; double-stranded, circular
  misc_feature (B) LOCATION 1...1137
  hypothetical: NO
  anti-sense: NO
atgaaacattctgttcattttggtgccggtaatatcggtcgtggttttataggtgaaattctatttaaaaatggtttccatattgattttgtggatgtcaataatcagataatttatgctctaaatgaaaagggcaagtatgaaattgaaattgcacagaaaggacagtctcgtatagaagtaactaatgtggctggcattaatagcaaagaacatcctgagcaagtcattgaagcgattcaaaagacggatattattactactgcaatcggacctaatatactcccttttatcgctgaacttctagccaaaggaatcgaagctcgccgagttgcaggaaatacacaggcattggatgttatggcctgtgaaaatatgattggcgggtctcaatttctttatcaagaagtcaagaaatatttaagtccggaaggtttgacatttgctgataactacataggttttccaaatgctgcagtagacaggattgttccaacacaaagtcacgaagattccctttttgttatggtcgagccctttaatgaatgggtcgtggaaaccaagcgtcttaaaaatccagatttacgtctaaaagatgtgcattatgaagaagatttagaaccctttattgagcgaaaacttttttcagtcaattctggacatgcaacttcagcttacattggtgcgcattatggtgccaagacaattttggaagctcttcaaaatcctaatatcaaatctcggattgaatctgtattagctgaaattcggagtctcttgattgccaaatggaactttgataaaaaagaattggagaattatcacaaagtcattatagaacggtttgaaaatcctttcatagtggacgaggttagtcgcgtagctcgtactccaatccgaaaattaggctataatgaacgattcatccggccgatacgtgaattgaaagaactcagtttgtcatataaaaacctacttaaaacagttggctatgcctttgactatcgcgatgtaaatgatgaagaaagtattcgattaggtgaattgttggctaaacaatcagtcaaagatgttgttatacaagttacaggtttagacgaccaagaattgattgagcaaattgtagagtatatttaa

SEQ ID NO: 2595 - DNA (genomic), 876 bp, Streptococcus pneumoniae; double-stranded, circular
  misc_feature (B) LOCATION 1...876
  hypothetical: NO
  anti-sense: NO
aaagaggaattgaaaatggaaaaattagttgcctataaacgcatgcctttgtggaataaacaaacaatgcctgaagctgttcagcaaaagcacaatacaaaagttgggacttgggggaaaattactgtcttgaagggagctctcaagtttattgaattgacagaagaaggggaagttctagctgaacacctctttgaagcaggggcagacaatccaatggcccaacctcaagcctggcaccgagtggaagctgccacagatgatgtggaatggtacttggaattttattgtaaacctgaggattattttgctaaaaaatacaataccaatcctgttcattcagaggtcctagaggccatgcagacagtgaaacaagggaaagctttggatttgggttgtggtcaggggcgtaattctctttttctagcccagcaagattttgatgtgacggctgtagatcaaaatggactagctcttgaaatcttgcaaagcattgtggagcaggaagatttggacatgcctgttgacctttacgatatcaattcagctagcattgaacaagaatatgattttatcgtttcaacagttgttctcatgtttctacaagcggaccgcattccagctattattcaaaatatgcaggagaaaaccagtgttggtggttacaaccttatcgtttgtgccatggacacggaggattatccttgctcggttaacttcccattcacctttaaagaaggagaactggcagactattacaaggattgggaattggttaagtacaatgaaaatccaggccatttgcaccgtcgcgatgagaatggcaatcgtattcaactacgctttgcgaccttactagctaagaaaatcaagtaa

SEQ ID NO: 2596 - DNA (genomic), 486 bp, Streptococcus pneumoniae; double-stranded, circular
  misc_feature (B) LOCATION 1...486
  hypothetical: NO
  anti-sense: NO
ggtggtaattctaggcaagacccctatcacggaccaggtcaagcgcagggcttgagtttttctgtacctgactctatcccagctccaccatccttgcaaaatatcttgaaagaattgtcagatgatatcggagttaagaaatctcatgatttgacagcttgggctgagcaaggagtcttgcttcttaatgcttgtttgactgttcctgctggacaggccaatggtcatgctggtcaaatctgggagccttttactgatgctgtgattcaggtggtcaatcatctagatagaccagtcgtttttgtactctggggagcttatgcacgtaagaagaaggccttagttaccaatcctcatcacttgattatcgaatcagcccatccaagtcctttgtcggtttatagaggattttggggttccaagcccttttccaaggccaatgcattcttaaaagagacaggacaagagccaatcgcattggcttag

SEQ ID NO: 2597 - DNA (genomic), 300 bp, Streptococcus pneumoniae; double-stranded, circular
  misc_feature (B) LOCATION 1...300
  hypothetical: NO
  anti-sense: NO
catttcaattcttttttcaacctcatacaaggtatgtcgaataacatacaggcccaaaaaggcaatgacaaaagtcagagtgttgataagggaaatagtttgaatacttataacattgataaggaatgcgccagccagattggcgacaatacggacaaccctcatcagagactgcctgaaccccatggcatcatgcaggtcgtccttaattacactgatgtagagggcgttcatcatgtaggcagacaggtagctcaaggtgtcagagatgaggttgatgatgacaatcataatgactga

SEQ ID NO: 2598 - DNA (genomic), 1323 bp, Streptococcus pneumoniae; double-stranded, circular
  misc_feature (B) LOCATION 1...1323
  hypothetical: NO
  anti-sense: NO
aaggacaattcaatgattcatttaataatgattagcgccattgctctagccattggaattggttaccgcaccaaaatcaatattggcctgctggctattgctttttcttacctcatcgcaaccactctcatgggattaagccccaaagaacttcttcatttttggccaacctcactcttttttaccatttttagcgtctctctcttttataacgttgcaacaactaacggtactcttgatgttttggctcaacacattctctaccgcacacgcacccaccctaacgccctctacatgattttatacctgatggcaacccttttgtctgctttaggtgctggatttttcactactatggccgtttgctgtcctctagcgattaccctctgtcaaaaagcggacaaacaccctttgattggagctcaagccgtcaattggggagcttcaggaggggctaatttgataaccagtagctcaggcattgtctttcaaggcctgtttaagcaaatgggatgggaagagcaagctttttcacttggcaatcatatctttatcgtcagcattatctacccactcatcgtcttgcttttattatcctgttacagtcactatagtaagggaagaacaaactcatccttgactattgaccaaccaccactcctcagcaaggttcaaagacaaaccaccttgctcatgatcagcagcatggttttggtttggctttttcccttgttgcatctcattttcccaaacatcgcctggatagctacttatcaaaaaacatttgatattggctttgtctcaatactcatggtctgcctcgccttaaggctcaaattagggaagcaagaagccattttagctaaggttccctgggctacaattatcatgctctgcggcatgagcttactaatgtctctagcggtcaagtcaggtttagtcacactgatagggcacctcatgacaacaaccattcctcatttctggttacctctgttcttttgtgtgatagccggagtgatgtcactctttagttccaccctatccgttgtagctccagccctctttcccatcattgctatcatcagtgctcaaaatcctcagattgatattcacttactcacaacagccaccgttattggcgctctatctactaatatctcacccttttcatcagctggttctctcattcaactctcacttcccaatatagaggaacgtggccttgccttcaaaaagcaaattattctgggtgtccccatcagcttaagtttgggactcttgaccacctggattctcatccttctagcttccttaagttag

SEQ ID NO: 2599 - DNA (genomic), 1275 bp, Streptococcus pneumoniae; double-stranded, circular
  misc_feature (B) LOCATION 1...1275
  hypothetical: NO
  anti-sense: NO
ataataaattcccattcgatgtgcagacataaggagaaaagtatgaaattattttggacaaacaacatatatagacagttgctgctaaacagctgtttttcatcattcggcgacagtattttctacctcgccattatcaattatgtggctcagtacaatttcgctccgctagcgattttactgatttccatttcagagatggttcccctactatcgcaactctttctcgggattctaggagattttcaagaaaatagagtcaaacacgcactctggattgccaaaatcaaaatcctgctctacgctattttgacagtatttctcgtcttgtcgcccttttcattagtttcagtcattatgattgtcatcatcaacctcatctctgacaccttgagctacctgtctgcctacatgatgaacgccctctacatcagtgtaattaaggacgacctgcatgatgccatggggttcaggcagtctctgatgagggttgtccgtattgtcgccaatctggctggcgcattccttatcaatgttataagtattcaaactatttcccttatcaacactctgacttttgtcattgcctttttgggcctgtatgttattcgacataccttgtatgaggttgaaaaaagaattgaaatgtcacatacagcactgagttttaagaaatattttcaacatcttaaacagtcgctggctgtgctcctgaggttaaaagataccgtcatactactgtttctgacgaccagtatgattgccatcttggatgtgtcccctcggctgattgccctccgcttcatccaacagacactagcacaactgagcattgggcaactcctcgccctgctctccatcatcatgtcttgtggagctatccttggcaatatgaccagcagtaatctatttaaaaatatccgtttcacgcacctcttggttttctgtgagatttccctattgactctaataactagtatcctttgtcaagcctatatcgtaattttcatgaccagtttcatcagttctacgattatcggcattctcagccctcgcctacaagcagctgtctttgcccatatccccagtgacaagatggggacggtgggctctgctctgagcacagtggacattctcgccccgtccctgctctccctattagccctatccatagcatcgggcgtttcggtgcagttagcattgatatttttgtatcttattttaattgctcttatcttttgtcaatggttagtcaagttcaacactcataactaa

SEQ ID NO: 2600 - DNA (genomic), 618 bp, Streptococcus pneumoniae; double-stranded, circular
  misc_feature (B) LOCATION 1...618
  hypothetical: NO
  anti-sense: NO
gttatgaattcatttaaaaatttcttaaaagagtggggactgttcctcctaattctgtcattactagctttaagtcgtatctttttttggagcaatgttcgcgtagaaggacattccatggatccgaccctagcggatggcgaaattctcttcgttgtaaaacaccttcctattgaccgttttgatatcgtggtggcccatgaggaagatggcaataaggacatcgtcaagcgcgtgattggaatgcctggcgacaccattcgttacgaaaatgataaactctacatcaatgacaaagaaacggacgagccttatctagcagactatatcaaacgcttcaaggatgacaaactccaaagcacttactcaggcaagggctttgaaggaaataaaggaactttctttagaagtatcgctcaaaaagcccaagccttcacagttgatgtcaactacaacaccaactttagctttactgttccagaaggagaataccttctcctcggagatgaccgcttggtttcgagcgacagccgccacgtaggtaccttcaaagcaaaagatatcacaggggaagctaaattccgcttctggccaatcacccgtatcggaacattttaa

SEQ ID NO: 2601 - DNA (genomic), 417 bp, Streptococcus pneumoniae; double-stranded, circular
  misc_feature (B) LOCATION 1...417
  hypothetical: NO
  anti-sense: NO
gtatcgaattcccttgaggagaaagaaatgaaagtcaatatagcagatcttcatccgactcaactatatttatcagaaaagaagttgcaagatattcagatgctttaccagtcggcagaaacaatccaagtcgatccaatcagtattcttgcctttggagattgtttgctgattacagatgggcatcacagggcttatcaggctttattggcaggtcgggatacgatttctgctgagtgggatagagatggtggtgatgaactatatcatctctatgcgcaagcttgcgaggaaagaaagatttactctgtttttgatttagaagatcgtatcctagctcaagatgggtatgaagcaaaatggtataactggtgtgatggttttaatcaagcagcaactcttttgttgaaaaggtag

SEQ ID NO: 2602 - DNA (genomic), 1086 bp, Streptococcus pneumoniae; double-stranded, circular
  misc_feature (B) LOCATION 1...1086
  hypothetical: NO
  anti-sense: NO
gagaatgattcgcttgcagtgctagaaataggcattttgaatagtgaatatgttataataagtattagtaggaggtgttttagattggagaagaaactgaccataaaagacattgcggaaatggctcagacctcgaaaacaaccgtgtcattttacctaaacgggaaatatgaaaaaatgtcccaagagacacgtgaaaagattgaaaaagttattcatgaaacaaattacaaaccgagcattgttgcgcgtagcttaaactccaaacgaacaaaattaatcggtgttttgatcggtgatattaccaacagtttctcaaaccaaattgttaagggaattgaggatatcgccagccagaatggctaccaggtaatgataggaaatagtaattacagccaagagagtgaggaccggtatattgaaagcatgcttctcttgggagtagacggctttattattcagccgacctctaatttccgaaaatattctcgtatcatcgatgagaaaaagaagaaaatggtcttttttgatagtcagctctatgaacaccggactagctgggttaaaaccaataactatgatgccgtttatgacatgacccagtcctgtatcgaaaaaggttatgagcattttctcttgattacagcggatacgagtcgtttgagtactcggattgagcgggcaagtggttttgtggatgctttaacagatgctaatatgcgtcacgccagtctaaccattgaagataagcatacgaatttggaacaaattaaagaatttttacaaaaagaaatcgatcccgatgaaaaaactctggtatttatccctaactgttgggccctacctctagtctttaccgttatcaaagagttgaattataacttgccgcaagttgggttgattggttttgacaatacggagtggacttgcttttcttctccaagtgtttcgacgctggttcagccctcctttgaggaaggacaacaggctacaaagattttgattgaccagattgaaggccgcaatcaagaagaaaggcaacaagtcttggattgtagtgtgaattggaaagagtcgactttctaa

SEQ ID NO: 2603 - DNA (genomic), 1059 bp, Streptococcus pneumoniae; double-stranded, circular
  misc_feature (B) LOCATION 1...1059
  hypothetical: NO
  anti-sense: NO
gcgacagattctccattaaagaaaaggaaaaaacaaatgacaaataaaaatgcatatgcccagtcgggtgtggatgttgaagcgggttatgaagttgttgaacggattaaaaagcacgtggcccgtacggagcgtgcaggtgtcatgggagctcttggtggctttggtggtatgtttgacctttccaagactggggttaaagaacccgtcttgatttcagggactgacggtgtcggaaccaagctcatgttggctatcaagtacgacaagcacgataccatcgggcaggactgtgtggccatgtgtgtcaacgacatcattgctgcaggtgcggaacccctctattttctcgactacgtagcgacagggaagaatgaaccagctaagctagaacaagtggttgctggtgtggcagaaggttgtgtgcaggctggtgctgccctcatcggtggggaaacggctgaaatgccgggcatgtacggcgaagacgactatgacttggctggttttgcggtcggtgtggctgaaaaatctcaaatcattgacggttcaaaggtggtagagggagatgttcttctcggacttgcttcaagtgggattcactcaaatggttactctttggttcgtcgtgtctttgcggattacacaggtgaggaagtcctaccagaattggaaggcaagaaacttaaggaagttctacttgagccgactcgtatctatgtcaaggctgtcttgccgctcatcaaagaagagttggtcaacggcattgcccacatcacaggtggtggctttatcgaaaatgtccctcgtatgtttgcagatgacctagctgctgaaattgatgaaagcaaagttccagtgcttccaattttcaaagcccttgaaaaatatggtcagattaaacacgaagaaatgtttgaaatcttcaatatgggtgtgggacttatgttggcggtcagccctgaaaatgtagagcgtgtaaaagaattgttggatgaagcagtctatgaaattggtcgcatcgtcaagaaagaaaacgaaagtgtcattatcaaatga

SEQ ID NO: 2604 - protein, 86 aa, Streptococcus pneumoniae
  misc_feature (B) LOCATION 1...86
  hypothetical: YES
TPCSLSLSTKTQRKDRSKTSALFSSEQFASSVHMTNIDRRISKTKKAIYQAFIQLLNAKGYEATTVQDIIDLADVGRSTFYCHYER

SEQ ID NO: 2605 - protein, 102 aa, Streptococcus pneumoniae
  misc_feature (B) LOCATION 1...102
  hypothetical: YES
WSCSSQHYGLYLKEEIVMSINVFQAILIGLWTAFCFSGMLLGIYTNRCIVLSFGVGIILGDLPTALAMGAIGELAYMGFGVGAGGTVPPNPIGLIMRGIHXS

SEQ ID NO: 2606 - protein, 63 aa, Streptococcus pneumoniae
  misc_feature (B) LOCATION 1...63
  hypothetical: YES
LIRSHSITIYYNKMMRVITNYRFEKSLISFSSILTNASSLVSRNKVIPLSIKSELCCSIPKRT

SEQ ID NO: 2607 - protein, 300 aa, Streptococcus pneumoniae
  misc_feature (B) LOCATION 1...300
  hypothetical: YES
FSSSFVVIFCTHIPLKYKRRLYMYRILNPMNHNVSFVRNDKGEEVIVIGKGIAFGKKKGDLIAENQVEKIFRMKTEESRENFMALLKDVPLDFITVTYEIIDKLSKKYHYPIQEYLYVTLTDHIYCSYQALTQGRYKDSNLPDISAKYPVAFQIANEAFEIYRQKLADHFPEDEIIRIAYHFINAEGENEVELVESIDKRKEILRNVEEVLTDYAIQRTKKNNHFYDRFMIHLNYFLDYLDRSRDDNQSLLDMEDHIKQSYPKAFEIGSKIYDVITQHTGLDLYKSERVYLVLHIQRLLS

SEQ ID NO: 2608 - protein, 231 aa, Streptococcus pneumoniae
  misc_feature (B) LOCATION 1...231
  hypothetical: YES
YNSSMRLDKFLVACAVGSRTEVKNLLKAGRVTVNGKKEKSAKLQIDEKIDEIRFDGQVLEYEEFVYYMMNKPKGVISATEDPKHRTVLDLLDDLARSKEIFPVGRLDIDTHGLLLLTNDGQLAHVLLSPKRHVDKTYLAQVKGIMTQEDVEIFAEGIPLKDFTCQPAILELVSIDTEKNQSQIRVTIAEGKFHQIKRMVGYCGKEVVDLQRLTMGTLVLDENLERGGSGVA

SEQ ID NO: 2609 - protein, 169 aa, Streptococcus pneumoniae
  misc_feature (B) LOCATION 1...169
  hypothetical: YES
YNSSMLKSEKQSRYQMLNEELSFLLEGETNVLANLSNASALIKSRFPNTVFAGFYLFDGKELVLGPFQGGVSCIRIALGKGVCGEAAHFQETVIVGDVTTYLNYISCDSLAKSEIVVPMMKNGQLLGVLDLDSSEIEDYDAMDRDYLEQFVAILLEKTAWDFTMFEEKS

SEQ ID NO: 2610 - protein, 91 aa, Streptococcus pneumoniae
  misc_feature (B) LOCATION 1...91
  hypothetical: YES
KTSSQSVTPVLQTNYYIDTPDFELREKKVAMRIRTFEDWAELTLKVPQSVGNMEYNQKLQLKDAENYLSKEELTQGLVLDDLATHGIQSKN

SEQ ID NO: 2611 - protein, 122 aa, Streptococcus pneumoniae
  misc_feature (B) LOCATION 1...122
  hypothetical: YES
ERSSKFGIIPELIGRLPVFAALEQLTVDDLVRILKEPRNALVKQYQTLLSYDDVELEFDDEALQEIANKAIERKTGARGLRSIIEETMLDVMFEVPSQENVKLVRITKETVDGTDKPILETA

SEQ ID NO: 2612 - protein, 307 aa, Streptococcus pneumoniae
  misc_feature (B) LOCATION 1...307
  hypothetical: YES
KESSMSKHQEILSYLEELPVGKRVSVRSISNHLGVSDGTAYRAIKEAENRGIVETRPRSGTIRVKSQKVAIERLTFAEIAEVTSSEVLAGQEGLEREFSKFSIGAMTEQNILSYLHDGGLLIVGDRTRIQLLALENENAVLVTGGFQVHDDVLKLANQKGIPVLRSKHDTFTVATMINKALSNVQIKTDILTVEKLYRPSHEYGFLRETDTVKDYLDLVRKNRXSRFPVINQHQVVVGVVTMRDAGDKSPSTTIDKVMSRXLXLVGLSTNIANVSQRMIAKNFELVPFCPXQSNFAWRCDATKCLRK

SEQ ID NO: 2613 - protein, 143 aa, Streptococcus pneumoniae
  misc_feature (B) LOCATION 1...143
  hypothetical: YES
KGSSSIVWKKKKVKAGVLLYAVTIAAIFSLLLQFYLNRQIAHYQDYALNKEKLVAFAMAKRTKDKVEQESGEQFFNLGQVSYQNKKTGLVTRVRTDKSQYEFLFPSVKIKEEKRDKKEEVATDSSEKVEKKKSEEKPEKKENS

SEQ ID NO: 2614 - protein, 109 aa, Streptococcus pneumoniae
  misc_feature (B) LOCATION 1...109
  hypothetical: YES
SGGSVWKGHRSTDKSYPGDNRLISPKSSHRRGGLAPRCRLVASWGCSRSQGLGCSPIKAARELGSERRETVRSLSVAGVGNLRGSAPSTRGPEWTYRWCTSCLAKGIAG

SEQ ID NO: 2615 - protein, 109 aa, Streptococcus pneumoniae; identical to SEQ ID NO: 2614
  misc_feature (B) LOCATION 1...109
  hypothetical: YES

SEQ ID NO: 2616 - protein, 109 aa, Streptococcus pneumoniae; identical to SEQ ID NO: 2614
  misc_feature (B) LOCATION 1...109
  hypothetical: YES

SEQ ID NO: 2617 - protein, 109 aa, Streptococcus pneumoniae; identical to SEQ ID NO: 2614
  misc_feature (B) LOCATION 1...109
  hypothetical: YES

SEQ ID NO: 2618 - protein, 510 aa, Streptococcus pneumoniae
  misc_feature (B) LOCATION 1...510
  hypothetical: YES
GEGSFGIFKGNNMKKYIFMRVLRSLVSIFLVTTLTYTIIYTLVPRKLIFKQDPNYNKIATTADKRDNYENTVFERMGYIEYYDTRELQEKASSMDSSVTVEANATNKAIYEKYINQLGHGWTLGEFTESGQFYATREIPIFERVFHFYANLIDIDHTNKIQDPENPDLKRYLRFENDPAIGWSLVGSGTKHKYLLYFNSQFPFVHQNFVNLNLGDSYPTYANTPVLQVITQGQGQTKTAQVQFPTGKKTSSVNIYSRTYKSPSQADSREVASYGKDDPYTATESNYQYPSMIVSSAITGLIGLVLAYALAVPLGSAMARFKNTWIDSLSTGTLTFLLALPTIALVYIVRLIGSSIALPDSFPILGAGDWRSYVLPAVILGLLGAPVTAIWIRRYMIDLQSQDFVRFARAKGLSEKEISNKHIFKNAMVPLVSGIPGAIIGVIGGATLTETVFAFPGMGKMLIDSVKASNNSMVVGLVFIFTCISIFSRLLGDIWMTIIDPRIKLTEKGGK

SEQ ID NO: 2619 - protein, 359 aa, Streptococcus pneumoniae
  misc_feature (B) LOCATION 1...359
  hypothetical: YES
KGGSTMKQEWFESNDFVKTTSKNKPEEQAQEVADKAEETIADLDTPIGKNTQVEEEVSQAEVELESQQEEKIETPEVGEARTEIEEKKASNSTEEEPDLSKETEKVTIAEESQEALPQQKATTKEPLLISKSLESPYIPDQAPKSRDKWKEQVLDFWSWLVEAIKSPTSKLETSITHSYTAFLLLILFSASSFFFSIYHIKHAYYGHIASINSRFPEQLAPLTLFSIISILVATTLFFFSFLLGSFVVRRFIHQEKYWTLDKVLQQYSQLLAIPIFLTAIASFFAFFDSLRFTALLCVISIGIILLASLHIITRPSQASETDSFYQLFLSVLVNGVIILLFFVAEVALIGDYLRILAFL

SEQ ID NO: 2620 - protein, 87 aa, Streptococcus pneumoniae
  misc_feature (B) LOCATION 1...87
  hypothetical: YES
IFFSLLTSRLAVISSKINIGASFKKALAIDNLCLSPPDSSAPFSPITVSKPLSIFSIKSVQFASFAALLTSSSLASCLPILIFSITL

SEQ ID NO: 2621 - protein, 70 aa, Streptococcus pneumoniae
  misc_feature (B) LOCATION 1...70
  hypothetical: YES
NILSTTSTKGISQYEIKKRLEITARIAHQLDEEMGEIRDDIQEAQALFDPLSRKLNDGVGNSDDTDEEYR

SEQ ID NO: 2622 - protein, 124 aa, Streptococcus pneumoniae
  misc_feature (B) LOCATION 1...124
  hypothetical: YES
TLISFAIAIVIGIIFGMFSVSPYKSLRVISEIFVDVIRGIPLMILAAFIFWGIPNFIESITGQQSPINDFVAGTIALSLNAAAYIAEIVRGGIQAVPVGQMEASRSLGISYGKTMRKIILPQSN

SEQ ID NO: 2623 - protein, 331 aa, Streptococcus pneumoniae
  misc_feature (B) LOCATION 1...331
  hypothetical: YES
LQISMIRSVKKWDLPIWLTRRKEMSEKLVEIKDLEISFGEGSKKFVAVKNANFFINKGETFSLVGESGSGKTTIGRAIIGLNDTSNGDIIFDGQKINGKKSREQAAELIRRIQMIFQDPAASLNERATVDYIISEGLYNHRLFKDEEERKEKVQNIIREVGLLAEHLTRYPHEFSGGQRQRIGIARALVMQPDFVIADEPISALDVSVRAQVLNLLKKFQKELGLTYLFIAHDLSVVRFISDRIAVIYKGVIVEVAETEELFNNPIHPYTQALLSAVPIPDPILERKKVLKVYDPSQHDYETDKPSMVEIRPGHYVWANQTELARYQKGLN

SEQ ID NO: 2624 - protein, 102 aa, Streptococcus pneumoniae
  misc_feature (B) LOCATION 1...102
  hypothetical: YES
LSSSRASIRVKKGDVFDSNEAMSTKIKQGGTTYDIAIPSEYMINKMKDEDLLVPLDYSKIEGIENIGPEFLNQSFDPGNKFSIPYFWGDSLCGETFRHGTTQ

SEQ ID NO: 2625 - protein, 66 aa, Streptococcus pneumoniae
  misc_feature (B) LOCATION 1...66
  hypothetical: YES
FNSSKISCLRSVFNTESPPVIVYTIHSIILSFEVKHFLSFSFKIYHFFLFLEFLLQDKSLYGRLFE

SEQ ID NO: 2626 - protein, 129 aa, Streptococcus pneumoniae
  misc_feature (B) LOCATION 1...129
  hypothetical: YES
ENTSVLYLLFTTNTRKGTEMQEHYTPKGKHLTIDNRRLIERWKNENKSNREIAGLLGKAPQTIHNEVKRGTTLQQVRKGLYKKVYSADYAQTVYQFNRKRSVKKLILTKEIREKILHYHKHISKNFRLK

SEQ ID NO: 2627 - protein, 368 aa, Streptococcus pneumoniae
  misc_feature (B) LOCATION 1...368
  hypothetical: YES
ENTSVLYLLFNHKHKKGTEMQDNYTTKGKHLTIDSRRLIERWKKEGKSNREIASLLGKAPQTIHTKIKRRTVRKCLGKGRFKEVYSADYAQQSYENNRKRSVKKSSLTKELKEKILHYHNQKFSPEMMVMAKGVNVGISTIYYWIHHGKLGLSKQDLLYPRKGKVLKKQASTNFKPAGQSIAQRPEAINLRLENGHYEIDTVLLTRSKNYCLLVLTDRKSRHQIIRLIPNKSAEVVNQALKLILKQHKILSITADNGTEFNRLSDVFSEEHIYYAHPYASWERGTNENHNRLIHRWLPKGTKKMTPKEVAFIEKWINNYPKKCLNYKSPREDFLMANLNLKFSVRNKSRNRFKFCRSFKYPARRCSWC

SEQ ID NO: 2628 - protein, 129 aa, Streptococcus pneumoniae; identical to SEQ ID NO: 2626
  misc_feature (B) LOCATION 1...129
  hypothetical: YES

SEQ ID NO: 2629 - protein, 151 aa, Streptococcus pneumoniae
  misc_feature (B) LOCATION 1...151
  hypothetical: YES
ENTSVLYLLFNHKHKKGTEMQDNYTTKGKHLTIDSRRLIERWKKEGKSNREIASLLGKAPQTIHTKIKRRTVRKCLGKGRFKEVYSADYAQQSYENNRKHSVKRSSVTKELKEKILHYHNQKFLPEMMVMAKGVNVGISTIYYWIHHGKLG

SEQ ID NO: 2630 - protein, 175 aa, Streptococcus pneumoniae
  misc_feature (B) LOCATION 1...175
  hypothetical: YES
LSTSLSPCLPYLAKRSYIIMNKSEHRHQLIRALITKNKIHTQAELQALLAENDIQVTQATLSRDIKNMNLSKVREEDSAYYVLNNGSISKWEKRLELYMEDALVWMRPVQHQVLLKTLPGLAQSFGSIIDTLSFPDAIATLCGNDVCLIICEDADTAQKCFEELKKFAPPFFFEE

SEQ ID NO: 2631 - protein, 77 aa, Streptococcus pneumoniae
  misc_feature (B) LOCATION 1...77
  hypothetical: YES
ASASSGCQLTSLEQFINQGMIARQLMVFFSTNQADTRITNMSIDSLIINNSKDFQSSSHASVSFILTKLVNLLIFNF

SEQ ID NO: 2632 - protein, 595 aa, Streptococcus pneumoniae
  misc_feature (B) LOCATION 1...595
  hypothetical: YES
VLASGFHLQSERDFMSIIQKLWWFFKLEKRRYLVGIVALVLVSVLNLIPPMVMGRVIDAITSGQLTQQDLLLSLFYLLLAAFGMYYLRYVWRMYILGTSYCLGQIMRSRLFKHFTKMSSAFYQTYRTGDLMAHATNDINALTRLAGGGVMSAVDASITALVTLLTMLFSISWQMTLVAILPLPFMAYATSRLGRKTHKAFGESQAAFSELNNKVQESVSGIKVTKSFGYQADELKSFQAVNELTFQKNLQTMKYDSLFDPMVLLFVGSSYVLTLLVGSLVVQEGQITVGNLVTFISYLDMLVWPLMAIGFLFNTTQRGKVSYQRIENLLSQESPVQDPEFPLDGIENGRLEYAIDSFAFENEETLTDIHFSLAKGQTLGLVGQTGSGKTSLIKLLLREYDVDKGAIYLNGHDIRDYRLTDLRSLMGYVPQDQFLFATSILDNIRFGNPNLPLSAVEEATKLARVYQDIVDMPQGFDTLIGEKGVSLSGGQKQRLAMSRAMILDPDILILDDSLSAVDAKTEYAIIDNLKETRKDKTTIITAHRLSAVVHADLILVLQNGQIIERGRHEDLLALDGWYAQTYQSQQLEMKGEEDAE

SEQ ID NO: 2633 - protein, 102 aa, Streptococcus pneumoniae
  misc_feature (B) LOCATION 1...102
  hypothetical: YES
LFRFTTTNPEFPSMIELFSILPEYPLKKDGREIPLHFDQDASLSALLLDEDYYNILVHEKETIQGYSVLSNCGLYSSKISSNHVSFHLQPQNSVLSSLQLAS

SEQ ID NO: 2634 - protein, 112 aa, Streptococcus pneumoniae
  misc_feature (B) LOCATION 1...112
  hypothetical: YES
FLYSSKISSNHVSVALPYVWLLTSSVSSTISKPCFELTSSVSSTTSKPCFELTSSVSSTTSEPCFELTSSVSSTTSKPCFELTSSVSSTTSKLCFEQPAASFLVCSLIFIEY

SEQ ID NO: 2635 - protein, 157 aa, Streptococcus pneumoniae
  misc_feature (B) LOCATION 1...157
  hypothetical: YES
RAHSRFMPLSFRYQVSALDYIDKALSAEEFESRIETALLYANGQDSKSLAEDCFYFKSKFAQFQYPFKEVYYLETSTRPHRVILYTKTDRLEFTASLEEVLKQEPRFLQCHRSFLINPANVVHLDKKEKLLFFPNGGSCLIARYKVREVSEAINNLH

SEQ ID NO: 2636 - protein, 256 aa, Streptococcus pneumoniae
  misc_feature (B) LOCATION 1...256
  hypothetical: YES
LLPLSIQKGKGFLRIIPFLFAIIGGYLFALTLGLVDFTPVLKANWFESPGFYLPFSTGGAFKEYNLYFGPEAIAILPIAIVTISEHIGDHTVLGQICGRQFLKEPGLHRTLIGDGIATSVSAFLGGPANTTYGENTGVIGMTRIASVSVIRNAAFIAIALSFLGKFTALISTIPNAVLGGMSILLYGVIASNGLKVLIKERVDFAQMRNLIIASAMLVLGLGGAILKLGPVTLSGTALSAMTGIILNLILPYENKD

SEQ ID NO: 2637 - protein, 67 aa, Streptococcus pneumoniae
  misc_feature (B) LOCATION 1...67
  hypothetical: YES
NINSMKIKEQTRKLAAGCSKHSFEVVDKTDEVSSKHGFEVVDETDEVSNHIYGKATLTKFELDFRRV

SEQ ID NO: 2638 - protein, 154 aa, Streptococcus pneumoniae
  misc_feature (B) LOCATION 1...154
  hypothetical: YES
LPNSRKNTERREQKPSLKACSLRNKASIRVTDLSRKEEIQALLEANDSLLATTRLVKEQGHFAGHNLFADGAITIQDESSQLVAPTLDLQGDERVLDPVRLQVENSPYSLLSYDRSGYCSGLVRPQVGFNSRKCPTSGSCRSGSNSKIGCQKGA

SEQ ID NO: 2639 - protein, 255 aa, Streptococcus pneumoniae
  misc_feature (B) LOCATION 1...255
  hypothetical: YES
KENSAISCKMQRVEFFLRQIWYNSFNKEEFLMIKILLVEDDLGLSNSVFDFLDDFADVMQVFDGEEGLYEAESGVYDLILLDLMLPEKNGFQVLKELREKGITTPVLIMTAKESLDDKGHGFELGADDYLTKPFYLEELKMRIQALLKRSGKFNENTLTYGNIVVNLSTNTVKVEDTPVELLGKEFDLLVYFLQNQNVILPKTQIFDRLWGFDSDTTISVVEVYVSKVRKKLKGTTFAENLQTLRSVGYLLKDVQ

SEQ ID NO: 2640 - protein, 317 aa, Streptococcus pneumoniae
  misc_feature (B) LOCATION 1...317
  hypothetical: YES
IMNSIRKTLNKNQNKKKKDASISLHKPIRGNSHLSNNIFIKIKRIMKSLKEDFSVRAEKYENYQETFQGPNSFSKTDPDATFMRMKEDHMKNGQLKAAYNLQIATENQFVLHYDVFSNPTDTKTLLPFLETYPHDLKTVVADAGYGSEENLLRLDEKEVNHLIKYAMFDKEQKRGYKQSARNLANWHYNDKEDSYTHPDGWYYRFHHTKHQKTQTDFQQEIKVYYADEPESAPQKGLYMNEGYQNLKAKECQALLSPQGRQIFAQRKIDVEPVFGQIKACLGYKRCNLRGKRQVRIDMGLVLMANNLLKYNKRTTQN

SEQ ID NO: 2641 - protein, 65 aa, Streptococcus pneumoniae
  misc_feature (B) LOCATION 1...65
  hypothetical: YES
FQNSLLLSSILLYNVKTRTMTVAIYTEVLRGNYGVAAALSTILTVLTVGSLLLFMKISKSNSITL

SEQ ID NO: 2642 - protein, 587 aa, Streptococcus pneumoniae
  misc_feature (B) LOCATION 1...587
  hypothetical: YES
SLRLFQVKKEFDMSNGQLIYLMVAIAVILVLAYVVAIFLRKRNEGRLEALEERKEELYNLPVNDEVEAVKNMHLIGQSQVAFREWNQKWVDLSLNSFADIENNLFEAEGYNHSFRFLKASHQIDQIESQITLIEEDIAAIRNALADLEKQESKNSGRVLHALDLFEELQHRVAENSEQYGQALDEIEKQLENIQSEFSQFVTLNSSGDPVEAAVILDNTENHILALSHIVDRVPALVTTLSTELPDQLQDLEAGYRKLIDANYHFVETDIEARFHLLYEAFKKNQENIRQLELDNAEYENGQAQEEINALYDIFTREIAAQKVVENLLATLPTYLQHMKENNTLLGEDIARLNKTYLLPETAASHVRRIQTELESFEAAIVEVTSNQEEPTQAYSVLEENLEDLQTQLKDIEDEQISVSERLTQIEKDDINARQKANVYVNRLHTIKRYMEKRNLPGIPQTFLKLFFTASNNTEDLMVELEQKMINIESVTRVLEIATNDMEALETETYNIVQYATLTEQLLQYSNRYRSFDERIQEAFNEALDIFEKEFDYHASFDKISQALEVAEPGVTNRFVTSYEKTRETIRF

SEQ ID NO: 2643 - protein, 90 aa, Streptococcus pneumoniae
  misc_feature (B) LOCATION 1...90
  hypothetical: YES
LPCSMIFPSFMTKIKSAFRMIDKRWAMTKDVRPSIKRSMAFWINSSVRVSTEEVASSKIKSDASLRRAQAIVNSCFCPTDKVTVSSKMVS

SEQ ID NO: 2644 - protein, 76 aa, Streptococcus pneumoniae
  misc_feature (B) LOCATION 1...76
  hypothetical: YES
STCSQIRGLWVAIIMVRFGFFRDSRMESNSSEFLGSSEAVGSSARIKGGSFKIIFANATRCASPPDNSNIGCFKSK

SEQ ID NO: 2645 - protein, 74 aa, Streptococcus pneumoniae
  misc_feature (B) LOCATION 1...74
  hypothetical: YES
QKCSEMTSNHFRARKKHKYTFIFFHPDYTVGFGISPNHAFRLVGYTTGRELHPALKIVIQLQMIIVLNFEYVNR

SEQ ID NO: 2646 - protein, 359 aa, Streptococcus pneumoniae
  misc_feature (B) LOCATION 1...359
  hypothetical: YES
PWCSGCQDERWWARRLYHSLGNQFDTRTRTSRKIRRERSCSDMDREPVTVRSYANIAIIKYWGKKKEKEMVPATSSISLTLENMYTETTLSPLPANVTADEFYINGQLQNEVEHAKMSKIIDRYRPAGEGFVRIDTQNNMPTAAGLSSSSSGLSALVKACNAYFKLGLDRSQLAQEAKFASGSSSRSFYGPLGAWDKDSGEIYPVETDLKLAMIMLVLEDKKKPISSRDGMKLCVETSTTFDDWVRQSEKDYQDMLIYLKENDFAKIGELTEKNALAMHATTKTASPAFSYLTDASYEAMDFVRQLREKGEACYFTMDAGPNVKVFCQEKDLEHLSEIFGQRYRLIVSKTKDLSQDDCC

SEQ ID NO: 2647 - protein, 133 aa, Streptococcus pneumoniae
  misc_feature (B) LOCATION 1...133
  hypothetical: YES
LKSSMENPLRKVFAPLDNSTFLRKSLHLRKMEMFPVETEEITYKRKKSKGKRQALLAQFDSEEVHHQVEERICPDCQGDLKEIGGSLQGQELVFIPAQLKRIDHIQHAYKCQACSDKNPSDKIVKAPIPKAPL

SEQ ID NO: 2648 - protein, 107 aa, Streptococcus pneumoniae
  misc_feature (B) LOCATION 1...107
  hypothetical: YES
SKSSHIILYVSDMYGATILVPLILGMPVSVALFASGVGTLIYMIATGFKVPVYLGSSFAFITAMSLAMKEMGGDVSAAQTGVILTGMVYVLVATSIRYVRTKWIDKL

SEQ ID NO: 2649 - protein, 305 aa, Streptococcus pneumoniae
  misc_feature (B) LOCATION 1...305
  hypothetical: YES
THGSPFGHFYAKIVAMDKIIKTISESGAFRAFVLDSTETVRTAQEKHQTQASSTVALGRTLIASQILAANEKGNTKLTVKVLGSSSLGAIITVADTKGNVKGYVQNPGVDIKKTATGEVLVGPFVGNGQFLVITDYGTGNPYNSITPLISGEIGEDLAFYLTESQQTPSAVGLNVLLDEEDKVKVAGGFLVQVLPGAKKEEIARFEKRIQEMPAISTLLESDDHIEALLKTIYGDEAYKRLSEEEIRFQCDCSHERFMNALASLPSSDLQEMKEEDHGVEITCQFCQTTYNFDEKDLEELIRDKS

SEQ ID NO: 2650 - protein, 201 aa, Streptococcus pneumoniae
  misc_feature (B) LOCATION 1...201
  hypothetical: YES
FLGSVFKRFFLGMIATAFFWLLTLAGGIILGLAPASATLMSLYAEHGYSFREYSLKEAWSLYKQNFVSSNLIFYSFLGVGLVLTYGLYLLVQLPHQTIVHLIATLLNVLVVALIFLAYTVSLKLQVYFALSYRNSLKLSLIGIFMSLAAVAKVLLGTVLLVAIGYYMPALLFFVGIGMWHFFISDMLEPVYEIIHEKLATK

SEQ ID NO: 2651 - protein, 307 aa, Streptococcus pneumoniae
  misc_feature (B) LOCATION 1...307
  hypothetical: YES
TQPLKQCLSGKYKSWRLIVEKIIKEKISSLLSQEEEVLSVEQLGGMTNQNYLAKTTNKQYIVKFFGKGTEKLINRQDEKYNLELLKDLGLDVKNYLFDIEAGIKVNEYIESAITLDSTSIKTKFDKIAPILQTIHTSAKELRGEFAPFEEIKKYESLIEEQIPYANYESVRNAVFSLEKRLADLGVDRKSCHIDLVPENFIESPQGRLYLIDWEYSSMNDPMWDLAALFLESEFTSQEEETFLSHYESDQTPVSHEKIAIYKILQDTIWSLWTVYKEEQGADFGYYGVNRYQRAVKGLASYGGSDEK

SEQ ID NO: 2652 - protein, 105 aa, Streptococcus pneumoniae
  misc_feature (B) LOCATION 1...105
  hypothetical: YES
NDRFLNRNKIMFGFFKKDKAVEVEVPTQVPAHIGIIMDGNGRWAKKRMQPRVFGHKAGMEALQTVTKAANKLGVKVITVYAFSYGKLDPSRSGSQVYHELASRVL

SEQ ID NO: 2653 - protein, 77 aa, Streptococcus pneumoniae
  misc_feature (B) LOCATION 1...77
  hypothetical: YES
HTRLWLWHAWVRSPSLAYFILGYSQAVRQGTLTPSCVGSNPATPVTICRRGGIGRRAGLKIQCPQGRAGSTPAAGIV

SEQ ID NO: 2654 - protein, 74 aa, Streptococcus pneumoniae
  misc_feature (B) LOCATION 1...74
  hypothetical: YES
VLRFSGLRQAMKMNKKSSYVINRLLLVIIVLILGTLALGIGLMVGYGILGKGQDPWAILSPAKWQELIHKFTGN

SEQ ID NO: 2655 - protein, 215 aa, Streptococcus pneumoniae
  misc_feature (B) LOCATION 1...215
  hypothetical: YES
SDLSMFTGIIEEIGKVERIQKDSRNCKLSIKASKILTDIHLGDSIAVNGICLTVTHFNHQSFTVDVMNETWSRTALTLLKHGSEVNLERALSVNGRLGGHVVTGHIDGTGKISSIKKDDNAVWYQINTQKEILDLIVEKGSITIDGISLTVAKVSKVNFSVSVIPHTLEQTILKSKQVGSTVNLENDILGKYVQKLMDNSPKSEISKELLYQNGF

SEQ ID NO: 2656 - protein, 131 aa, Streptococcus pneumoniae
  misc_feature (B) LOCATION 1...131
  hypothetical: YES
TSLSSSTYPTFIVIKIYLKLYKENSIMNREEVTLLGFEIVAYAGDARSKLLEALKAAEAGDFEKADALVEEAGSCIAEAHHAQTSLLTKEASGEDLAYSVTMMHGQDHLMTTILLKDLMHHLIELYKRGVK

SEQ ID NO: 2657 - protein, 181 aa, Streptococcus pneumoniae
  misc_feature (B) LOCATION 1...181
  hypothetical: YES
KPLSVSTKTGTYIGRRRNMTMPNIIMTRIDERLIHGQGQLWVKYLGCNTVIVANDEVSTDKMQQTLMKTVVPDSVAMRFFPLQKVIDIIHKANPAQTIFIVVKNVKDALTLVEGGVPIKEINIGNIHNATGKEQVTRSIFLGEEDKVALKELSQTHQVTFNTKTTPTGNDGAVQVNIMDYI

SEQ ID NO: 2658 - protein, 470 aa, Streptococcus pneumoniae
  misc_feature (B) LOCATION 1...470
  hypothetical: YES
DSLSAQCWYPVFWDWGFSGIKVPCLWQRCNWSSLLFYFMDCTLAGISTLLSVVYLLGLQENSLVDLLKGKLPLKRMMTLMMVGQLLAVLVVGSSATRLLPHYREMQEMERASNKWSQSSDRYRLSFGWSSAFADEEGTRKDNREWQTFTEERLANTDSFYIMSNVDNFSDGAEVDLDGNRLSDYTPSGNVIYVSPRYLIEEKITVSSEFMDKMQNLSEGEFGLILPESLREQSIYYQGLFTDYLQNFSSESVEVTSQKHYLPQVRLAFTEIGQERFLYNDGYKTTRQYLKDPIIVVLTPQATGTRPVAGMLWGTTANSALKLDRYGDSITALKEQGLYHKVSYLVKSQLFFAKVLNDKRVEFYSLLIGTILTLSTAILLFDSMNLLYFEQFRRDLMIKRLAGMTIYELHGKYLLAQGGVLLLGLVLSSILTRDGLISALVVALFTLNALLILVRQDKKEEAGSMAVLKGK

SEQ ID NO: 2659 - protein, 102 aa, Streptococcus pneumoniae
  misc_feature (B) LOCATION 1...102
  hypothetical: YES
QKLSVPVLDTIKPDPFPEQYFLEITSPGLERPLKTKDAVAGAVGKYIHVGLYQAIDKQKVFEGTLLAFEEDELTMEYMDKTRKKTVRIPYSLVSKARLAVKL

SEQ ID NO: 2660 - protein, 123 aa, Streptococcus pneumoniae
  misc_feature (B) LOCATION 1...123
  hypothetical: YES
KKLSEVSHMAFEKIIQLKNCRYDYTLSPSVKKFTLKDNTFFETKVGNYELTRLLEKVPNSGEGFQLKIIINKELTGAKINITDKFGLRLVDIFKSEDHHIHQEKFYFLMDSLVERGIFTKSER

SEQ ID NO: 2661 - protein, 75 aa, Streptococcus pneumoniae
  misc_feature (B) LOCATION 1...75
  hypothetical: YES
SGLSLAERPRIRFFLAHCWERLHHARVGPVDNGAWDVGGGWNAETYAAVELIESHSTKEEFIRRTTAFISNSYAI

SEQ ID NO: 2662 - protein, 332 aa, Streptococcus pneumoniae
  misc_feature (B) LOCATION 1...332
  hypothetical: YES
FWLSYQTCLQDESIQTQLCSRKEENMAKKKIKKEKIDNVGIHSFSKKADIFFSIISGLIALSCILPFVFVIIISVTDEKSLLQYGYSFFPSQFGLDGFEFLAQFKDKILQALFISVFVTVVGTLTNVFITTTYAYAISRTTFKYRRFFTIFVLLSMLFNAGLVPGYIMVTRVLQLGDTVWALIVPMLLSPFNIILMRSFFKKTIPEAILESARIDGASEARIFFQICLPLSLPGIATITLLTALGFWNDWFNALLYIKSDNLYPLQYLLMQIQQNMDYIAKAVGLTGQLGVALPKETGRMAMVVVATLPIAILYPFFQRYFVKGLTIGGVKE

SEQ ID NO: 2663 - protein, 306 aa, Streptococcus pneumoniae
  misc_feature (B) LOCATION 1...306
  hypothetical: YES
LSLSLSSQSLWLHSRNYTHLIWRTSKMNNSIKLKRRLTQSLTYLYLIGLSIVIIYPLLITIMSAFKAGNVSAFKLDTNIDLNFDNFKGLFTETLYGTWYLNTLIIALITMAVQTSIIVLAGYAYSRYNFLARKQSLVFFLIIQMVPTMAALTAFFVMALMLNALNHNWFLIFLYVGGGIPMNAWLMKGYFDTVPMSLDESAKLDGAGHFRRFWQIVLPLVRPMVAVQALWAFMGPFGDYILSSFLLREKEYFTVAVGLQTFVNNAKNLKIAYFSAGAILIALPLCILFFFLQKNFVSGLTSGGDKG

SEQ ID NO: 2664 - protein, 423 aa, Streptococcus pneumoniae
  misc_feature (B) LOCATION 1...423
  hypothetical: YES
LQLSKRNCQNAKGKPMLDVEAIRKDFPILDQIVNDEPLVYLDNAATTQKPLVVLKAINSYYEQDNANVHRGVHTLAERATASYEAARETIRKFINAGSTKEVLFTRGTTTSLNWVARFAEEILAEGDRVLISVMEHHSNIIPWQEACRKTGAELVYVYLKDGALDMEDLRAKLTDKVKFVSLAHASNVLGVVNPIKEITQLAHQVGAIMVVDGAQSTPHMKIDVQDLDLDFFAFSGHKMAGPTGIGVLYGKEKYLEQMSPVEFGGEMIDFVYEQFASWKELPWKFEAGTPNMAGAIGLATAVDYLEKIGMDAVEAHEQELIAYVYPKLQAIEGLTIYGSQDLAQRSGVIAFNLGDLHPHDLATALDYEGVAVRAGHHCAQPLLQYLEVPATARASFYIYNTKADCDKLVDALQKTKEFFNGTF

SEQ ID NO: 2665 - protein, 70 aa, Streptococcus pneumoniae
  misc_feature (B) LOCATION 1...70
  hypothetical: YES
KMLSVNTILEKFYKEHQVKPFISPERELDTWLLSPKPVPKRNMDLLVDDSLAGDIILLWRIQFGTFTTET

SEQ ID NO: 2666 - protein, 64 aa, Streptococcus pneumoniae
  misc_feature (B) LOCATION 1...64
  hypothetical: YES
TLISNSFNIEASVRDADVVIGAILIPGAKAPELVTDEMVKQMRPGSVSLTLLLTKVALSKQLTV

SEQ ID NO: 2667 - protein, 109 aa, Streptococcus pneumoniae
  misc_feature (B) LOCATION 1...109
  hypothetical: YES
LERLAKSLGIAYFTANQLEVKEGLLTGKLVGQIISPQVKKETLEKWRKKLKLSKERTVAIGDGVNNLLMLKSAELGIAFCAKEVLKKEIPHHVDKRDFLEVLPLIDCLE

SEQ ID NO: 2668 - protein, 88 aa, Streptococcus pneumoniae
  misc_feature (B) LOCATION 1...88
  hypothetical: YES
PSVSVKWVSIASRVVPATGLAITRSSPKIALIKLDFPTFGRPIRLNLMTSGFSSSYSFGRFSTIASSTSPVPIPWTDEIGSGSPKPRA

SEQ ID NO: 2669 - protein, 202 aa, Streptococcus pneumoniae
  misc_feature (B) LOCATION 1...202
  hypothetical: YES
KGVSAMTRTEYLTQLELYLKKLPEADRIEAMDYFRELFDDAGVEGEEELIASLGTPKEVAHEVLSNLLDKKINEAPAQKNNRQILHIALLALLAAPIGIPLGIAILVTLFAILVAALTVILAFFAVSILGIIGGFLFLVESFTVLAQAKSAFILIFGSGLLAIGASSLVLLGISYVARFFGLLIVRLVQFVLKKGKRGNQHA

SEQ ID NO: 2670 - protein, 118 aa, Streptococcus pneumoniae
  misc_feature (B) LOCATION 1...118
  hypothetical: YES
KLVSSCQSVYATRASFLDGQGITVDEMAWIIRGIVNALIGRYIKLGTYAAKYGISMARSILNRAAATAAARVGLLTKIFGWILRIAVLAADVYGNFANNIAVAWDAHDKIPNNGRINF

SEQ ID NO: 2671 - protein, 77 aa, Streptococcus pneumoniae
  misc_feature (B) LOCATION 1...77
  hypothetical: YES
NVVSLQNRKDRAKMFELTYKDCYHVERTLKYEDHEALMLTLSGCCTPYXDTLYVTSLTFRGQKVYQGLSETSTVFYL

SEQ ID NO: 2672 - protein, 97 aa, Streptococcus pneumoniae
  misc_feature (B) LOCATION 1...97
  hypothetical: YES
IISSKLLPNVILPRLIIFSVMYTNSKGTLINISVKRVILSLFLRKKLFSISIGFTLSPVFLPKAIPLPKRRISISFLLCAITALWFSIRFMIIKFPF

SEQ ID NO: 2673 - protein, 71 aa, Streptococcus pneumoniae
  misc_feature (B) LOCATION 1...71
  hypothetical: YES
AISSRVIFSSASSNDIGVKWLKKLVEAAKSQTKGLTSFPIPMITGAVRIRKASFRLRAILLGYNSPKTMEI

SEQ ID NO: 2674 - protein, 104 aa, Streptococcus pneumoniae
  misc_feature (B) LOCATION 1...104
  hypothetical: YES
TYSSSQEKQSDWKVQYTRCLDIIFPELDKIVGKHSEYTYQLLTRYPNPQKRIEAGFDKLIEIKRLTASNSRAFCRALKSSPNHQIEIRNSLDKTIDFSYSLSFS

SEQ ID NO: 2675 - protein, 134 aa, Streptococcus pneumoniae
  misc_feature (B) LOCATION 1...134
  hypothetical: YES
FNSSSLHLEFFYTFHLSKLMTKLLNKKWKVKIMKQILLVCNAGMSTSMLVKKMQQSATERGIEISIQAKSMTEAKKNIHEADVILIGPQIRYELLAVKEIAGNIPVDTIDMRDYGMMNGAKVLEQALAWIGEIR

SEQ ID NO: 2676 - protein, 233 aa, Streptococcus pneumoniae
  misc_feature (B) LOCATION 1...233
  hypothetical: YES
TLSSNSRLNRSYSRGGNPMNTSLKLSKQLSFGEEIANSVTHAVGAVIMLILLPISSIYSYEAHGFLSSIGVSIFVISLFLMFLSSTIYHSMAYGSTHKYVLRIIDHSMIYVAIAGSYTPVVLTLMNNWFGYLIIVIHWGTTIFGTLYKIFAINVNDKFSLALYLIMGWLVLAIIPAIINQTTPVFWSLMVTGGLCYTVGAGFYAKKKPYFHMIWHLFILAASVLQYIAIVYYM

SEQ ID NO: 2677 - protein, 150 aa, Streptococcus pneumoniae
  misc_feature (B) LOCATION 1...150
  hypothetical: YES
RQSSLYIIFQGGRMKILPFIARGTSYYLKMSVKKLVPFLVVGLMLAAGDSVYAYSRGNGSIARGDDYPAYYKNGSQEIDQWRMYSRQCTSFVAFRLSNVNGFEIPAAYGNANEWGHRARREGYRVDNTPTIGSITCSTAGTNVHGAWVSK

SEQ ID NO: 2678 - protein, 280 aa, Streptococcus pneumoniae
  misc_feature (B) LOCATION 1...280
  hypothetical: YES
SSSSPIWRSLGGNMTQDLQKRTLFAGIALAIFLPILMIGGLLLQIAIGIIAMLAMHELLKMRGLETMTMEGLLTLFATFALTIPLENYLTFLPVDGNVVAYSVLISIMLGTTVFSKSYTIEDAVFPLAMSFYVGFGFNALLDARVAGLDKALLALCIVWATDSGAYLVGMNYGKRKLAPRVSPNKTLEGALGGILGAILVTIIFMIVDSTVALPYGIYKMSVFAIFFSIAGQFGDLLESSIKRHFGVKDSGKFIPGHGGVLDRFDSMLLVFPIMHLFGLF

SEQ ID NO: 2679 - protein, 81 aa, Streptococcus pneumoniae
  misc_feature (B) LOCATION 1...81
  hypothetical: YES
SNGLKLHVSAVRFRLAPFIYFGRVAKRLNAADCKSAPSGSGVRIPPLPFYGHSLKVELRSPKPSVWVQFLLPVLIELWRVW

SEQ ID NO: 2680 - protein, 139 aa, Streptococcus pneumoniae
  misc_feature (B) LOCATION 1...139
  hypothetical: YES
PFPSIPAIPTISPARTSKDRFLTAGTPRFSLTTKSLIDKTTSFGLEACFSVLKETERPTIISAKSALVAPAISTVSIDFPRRITVTRSETARISSNLWVIKIIDFPSLTRFFIIAINSSISDGVKTAVGSSKIRISAPL

SEQ ID NO: 2681 - protein, 169 aa, Streptococcus pneumoniae
  misc_feature (B) LOCATION 1...169
  hypothetical: YES
TLPSVQLFVKQFQKEWKCLVSMTDMLVWLPVKIHPLNAASVGDIISRGGTFLHSARYPNFAQLEGQLKGIEQLKKHGIEGVVVIGGDGSYHGAMRLTEHGFPAIGLPGTIDNDIVGTDFTIGFDTAVTTAMDAINKIRDTSSIHRRTFVIEFMGRNAGDIALWAGIATG

SEQ ID NO: 2682 - protein, 183 aa, Streptococcus pneumoniae
  misc_feature (B) LOCATION 1...183
  hypothetical: YES
NTTSGGTPMLYVGIDVAKNKHDVTALNVPGKTVLKPLTFSNNKAGFELLDLSLRQLNQDCLIALENTGHYAFNLLNFLHEQGYKVYTYNPLLIKEFAKSLSLRKTKTDKKDAHGIALKLLSDPNREQFQHDNRQVELKILARHIHRLKKNSLIGKYNTLVVLISSFLSWIKSLESIQNIPTNS

SEQ ID NO: 2683 - protein, 110 aa, Streptococcus pneumoniae
  misc_feature (B) LOCATION 1...110
  hypothetical: YES
RKTSMVDMLTEDDFKELTKVKTVGEICCRFFDSKGKEVYENLQERTIAISLEDLKNIPQSLAVAYGDTKVSSILSVLRANLVNHLITDKNTILKVLEEDGDLTFREILGE

SEQ ID NO: 2684 - protein, 152 aa, Streptococcus pneumoniae
  misc_feature (B) LOCATION 1...152
  hypothetical: YES
VWASISLIIRAGTPATTTFSGTSWVTIAPAATTEPLPIWTPSITTALAPIRTLSPTRTGSALAGSITPAKTAHAPTWLFYPTMARPPRMAPMSIMVPAPISAPILITAPIMITALSPISTWSRIIAPGSIRALIARLSSKGTAELRASCSTT

SEQ ID NO: 2685 - protein, 184 aa, Streptococcus pneumoniae
  misc_feature (B) LOCATION 1...184
  hypothetical: YES
IKGLINQKEGDFLRTYENKEELKAEIEKTFEKYILEFDNIPENLKDKRADEVDRTPAENLAYQVGWTNLVLKWEEDERKGLQVKTPSDKFKWNQLGELYQWFTDTYAHLSLQELKAKLNENIHSISAMIDSLSEEELFEPHMRKWADEATKTATWEVYKFIHVNTVAPFGTFRTKIRKWKKIVL

SEQ ID NO: 2686 - protein, 430 aa, Streptococcus pneumoniae
  misc_feature (B) LOCATION 1...430
  hypothetical: YES
DMGLFDRLFGKKEEPKIEEVVKEALENLDLSEDIEPAFTEAEEVSQEEAEVESSEESVFQEEDSQDTVEENLDLEPVVEVSQEEVEEFPNSQEVTEEEKLEHEGTVEENNFEVLEPEAPQTEETVQEKYDRSLKKTRTGFGARLNAFFANFRSVDEEFFEELEELLIMSDVGVQVASNLTEELRYEAKLENAKKPDALRRVIIEKLVELYEKDGSYDESIHFQDNLTVMLFVGVNGVGKTTSIGKLAHRYKRAGKKVMLVAADTFRAGAVAQLAEWGRRVDVPVVTGPEKADPASVVFDGMERAVAEGIDILMIDTAGRLQNKDNLMAELEKIGRIIKRVVPEAPHETFLALDASTGQNALVQAKEFSKITPLTGIVLTKIDGTARGGVVLAIREELNIPVKLIGFGEKIDDIGEFNSENFMKGLLEGLI

SEQ ID NO: 2687 - protein, 126 aa, Streptococcus pneumoniae
  misc_feature (B) LOCATION 1...126
  hypothetical: YES
YAGLRNDEWSKSSGTSTCMDRRNKMTEEMEYICFQLIANSGAAKSSFIEAIQLAKAGNLKEAKIKVEEAEDSLVEAHKIHSNLIQKEATGEKIGFSLLFMHAEDQMASTEIIQLLSKEFIDLYQNK

SEQ ID NO: 2688 - protein, 194 aa, Streptococcus pneumoniae
  misc_feature (B) LOCATION 1...194
  hypothetical: YES
HLKSSNLLTMTRKIFKTVNKSVEAGFYQAILDAVSDLLASSKTTITILDIGCGEGFYSRKLQESHSEKTFYAFDISKDSVQIAAKSEPNWAVNWFVGDLARLPIKDASMDILLDIFSPANYGEFRRVLSKDGILIKVIPTENHLKEIRQRVQDQLTNKEYSNQDIKEHFQEHFTILSSQTASLTKTITAEKLQA

SEQ ID NO: 2689 - protein, 60 aa, Streptococcus pneumoniae
  misc_feature (B) LOCATION 1...60
  hypothetical: YES
TIKSSTKRENILLFITLLALKILFNRTFIVVSTQIFIKKIRANTPAAAPISQPPRPPTLI

SEQ ID NO: 2690 - protein, 65 aa, Streptococcus pneumoniae
  misc_feature (B) LOCATION 1...65
  hypothetical: YES
AYKSSQITLLIGGPNLQCRGSFYIGLCAFWDSKPFWQILQNLSDNCLFLILHLDFFNYKHHKFLS

SEQ ID NO: 2691 - protein, 124 aa, Streptococcus pneumoniae
  misc_feature (B) LOCATION 1...124
  hypothetical: YES
FIKSYFSVKAASCGRTLPSRSSIDAPPPVLIHENLSARPRLIAAAAESPPPMIDLTPGCFTIASITPIVPAWKSGFSNTPIGPFHTTVLAPVKASSNLAIDFGPMSRPRKPSETASPSVSRTSV

SEQ ID NO: 2692 - protein, 109 aa, Streptococcus pneumoniae
  misc_feature (B) LOCATION 1...109
  hypothetical: YES
KIKSEEIQMIKILAACGAGVNSSHQIKSALEEELSNRGYDVHCDAVMVKDVNEDLMKGYDIFTPIAATDLGFEPGIPVIEAGPILFRIPAMSAPVFDNIEAAIKEHGLS

SEQ ID NO: 2693 - protein, 108 aa, Streptococcus pneumoniae
  misc_feature (B) LOCATION 1...108
  hypothetical: YES
KIKSEEIQMIKILAACGAGVNSSHQIKSALEEELSNRGYDVHCDAVMVKDVNEDLMKGYDIFTPIAATDLGFEPGIPVIEAGPILFCIPAMSVPVFDNIILPAKQNMV

SEQ ID NO: 2694 - protein, 83 aa, Streptococcus pneumoniae
  misc_feature (B) LOCATION 1...83
  hypothetical: YES
STKSAWETKRIFYVSKHLPEKVNNIGQTVGINHEGKGFGQNDDGHVALETHLGQGSQHTEKVSWANGPNHHKNKEAVKTIALI

SEQ ID NO: 2695 - protein, 76 aa, Streptococcus pneumoniae
  misc_feature (B) LOCATION 1...76
  hypothetical: YES
LPKSRRFPRKLYQHHRERLGQLGRPSLFRNRGKFIPRGGMSIDPYYNYGKQGNKYEXLAEQRVFQHDVYPEKIDNR

SEQ ID NO: 2696 - protein, 206 aa, Streptococcus pneumoniae
  misc_feature (B) LOCATION 1...206
  hypothetical: YES
KRKSIMKFLELNKKRHATKHFTDKPVDPKDVRTAIEIATLAPSAHNSQPWKFVVVREKNAELAKLAYGSNFEQVSSAPVTIALFTDTDLAKRARKIARVGGANNFSEEQLQYFMKNLPAEFARYSEQQVSDYLALNAGLVAMNLVLALTDQGIGSNIILGFDKSKVNEVLEIKDRFRPELLITVGYTDEKLEPSYRLPVDEIIEKR

SEQ ID NO: 2697 - protein, 539 aa, Streptococcus pneumoniae
  misc_feature (B) LOCATION 1...539
  hypothetical: YES
KEESMSTKYIFVTGGVVSSIGKGIVAASLGRLLKNRGLKVTIQKFDPYINIDPGTMSPYQHGEVFVTDDGAETDLDLGHYERFIDINLNKYSNVTTGKIYSEVLRKERRGEYLGATVQVIPHITDALKEKIKRAALTTDSDVIITEVGGTVGDIESLPFLEALRQMKADVGADNVMYIHTTLLPYLKAAGEMKTKPTQHSVKELRGLGIQPNMLVIRTEEPAGQGIKNKLAQFCDVAPEAVIESLDVEHLYQIPLNLQAQGMDQIVCDHLKLDAPAADMTEWSAMVDKVMNLKKQVKISLVGKYVELQDAYISVVEALKHSGYVNDVEVKINWVNANDVTAENVAELLSDADGIIVPGGFGQRGTEGKIQAIRYARENDVPMLGVCLGMQLTCIEFARHVLGLEGANSAELAPETKYPIIDIMRDQIDIEDMGGTLRLGLYPSKLKRGSKAAAAYHNQEVVQRRHRHRYEFNNAFREQFEAAGFVFSGVSPDNRLVEIVEIPENKFFVACQYHPELSSRPNRPEELYTAFVTAAVENSN

SEQ ID NO: 2698 - protein, 368 aa, Streptococcus pneumoniae
  misc_feature (B) LOCATION 1...368
  hypothetical: YES
KTRSLVASTVKTIRLLLVLASISLMLKLTSFQHKVIEIQAGDEKQELTAETIVINTGAVSNVLPIPGLATSKNVFDSTGIQSLDKLPEKLGVLGGGNIGLEFAGLYNKLGSKVTVLDALDTFLPRAEPSIAALAKQYLEEDGIELLQNIHTTEIKNDGDQVLVVTEDETYRFDALLYATGRKPNVEPLQLENTDIELTERGAIKVDKHCQTNVPGVFAVGDVNGGLQFTYISLDDFRVVYSYLAGDGSYTLEDRLNVPNTMFITPALSQVGLTESQAADLKLPYAVKEIPVAAMPRGHVNGDLRGAFKAVVNTETKEILGASIFSEGSQEIINIITVAMDNKIPYTYFTKQIFTHPTLAENLNDLFAI

SEQ ID NO: 2699 - protein, 287 aa, Streptococcus pneumoniae
  misc_feature (B) LOCATION 1...287
  hypothetical: YES
GGRSLMQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLSAITVLIILLINIFTKGFIKSISILIGLVVGTAIAASMGLVDFSPVAAAPVVHVPTPFYFGMPTFEISSIVMMCIIATVSMVESTGLFIWPCLISQRIQSTAPPAQRIPRRRFGLNFWGDF

SEQ ID NO: 2700 - protein, 777 aa, Streptococcus pneumoniae
  misc_feature (B) LOCATION 1...777
  hypothetical: YES
TVLSSSKTSSVSYFYFAFDVLGILIFVGKAYNFINPKGIKMAKQVFQTTFAGRELIVETGQVAKQANGSVVVRYGESTVLTAAVMSKKMATGDFFPLQVNYEEKMYAAGKFPGGFMKREGRPSTDATLTARLIDRPIRPMFAEGFRNEVQVINTVLSYDENASAPMAAMFGSSLALSISDIPFDGPIAGVQVGYVDGQIIINPSQEQAEQSLLELTVAGTKHAVNMVESGAKELSEEIMLEALLKGHEAVKELIAFQEEIVAAVGKEKAEVELLHVDAELQAEIIAAYNSDLQKAVQVEEKLAREAATQVVKDQVTAVYEEKYADHEEFDRIMRDVAEILEQMEHAEVRRLITEDKVRPDGRKVDEIRPLDAVVDFLPRVHGSGLFTRGQTQALSVLTLAPMGETQIIDGLDPEYKKRFMHHYNFPQYSVGETGRYGAPGRREIGHGALGERALAQVLPSLEEFPYAIRLVAEVLESNGSSSQASICAGTLALMAGGVPIKAPVAGIAMGLISDGNNYTVLTDIQGLEDHFGDMDFKVAGTRDGITALQMDIKIQGITAEILTEALAQAKKARFEILDVIEATIPEVRLELAPTAPKIDTIKIDVDKIKIVIGKGGETIDKIIAETGVKIDIDEEGNVSIYSSDQDAINRAKEIIAGLVREAKVDEVYRAKVVRIEKFGAFVNLFDKTDALVHISEMAWTRTNRVEDLVEIGDEVDVKVIKIDEKGRIDASMKALLPRPPKPEHDEKGEKSERPHRPRHHKDHKPKKEFTETPKDSE

SEQ ID NO: 2701 - protein, 357 aa, Streptococcus pneumoniae
  misc_feature (B) LOCATION 1...357
  hypothetical: YES
DCLSQLCDSALELILRVLEVGPGDEVIVPAMTYTASCSVITHVGATPVMVDIQADTFEMDYDLLEQAITEKTKVIIPVELAGIVCDYDRLFQVVEKKRDFFTASSKWQKAFNRIVIVSDSAHALGSTYKGQPSGSIADFTSFSFHAVKNFTTAEGGSATWKANPVIDDEEMYKEFQILSLHGQTKDALAKMQLGSWEYDIVTPAYKCNMTDIMASLGLVQLDRYPSLLQRRKDIVDRYDSGFAGSRIHPLAHKTETVESSRHLYITRVEGASLEERSLIIQELAKAGIASNVHYKPLPLLTAYKNLGFDMTNYPKAYAFFENEITLPLHTKLSDEEVDYIIETFKTVSEKVLTLSKK

SEQ ID NO: 2702 - protein, 169 aa, Streptococcus pneumoniae
  misc_feature (B) LOCATION 1...169
  hypothetical: YES
NPLSVQMVHNIAGTSFWLCKKEVLELINGFEKIDSHQDGVVLLKLLAQGYQIDIVREFLVNYYAHSKENGITGVTQKTINADEEYYNYCRKYFNLLSFNERILVTKKYYSLNIKRLLLIGDKCKALKVIKKAREEKIFNEFLFLKYMLLYNLGFFYCIYDNYVQLKFRK

SEQ ID NO: 2703 - protein, 132 aa, Streptococcus pneumoniae
  misc_feature (B) LOCATION 1...132
  hypothetical: YES
YILSTHFVLQELKKTRIRKCLMKSLARLLNIHVFISIFLFFALISGAVSHTVLLLLLLFLPALNKGLEKIQSKRIPVLNAALFFLLISFPQLLTNPVQWKFSIFLVVTIISSLAYFYNFYQVVKEVDQKQLI

SEQ ID NO: 2704 - protein, 172 aa, Streptococcus pneumoniae
  misc_feature (B) LOCATION 1...172
  hypothetical: YES
RLLSLSRWTRIGMRSMTSCASELPKKNLFALSDLETGMVYLTAAAKQNRILLEHIQGHALYRSFDEIEREQFDDAMIEAHQLVSMTDLISQILQQLSASYNNILNNNLNDNLTTLTIISVLLAVLAVVTGFFGMNVPLPLTDEPHAWLYISLASAGLWIVLSLLLRKIAKKS

SEQ ID NO: 2705 - protein, 272 aa, Streptococcus pneumoniae
  misc_feature (B) LOCATION 1...272
  hypothetical: YES
AWLSCQQQHATSEGTNQRQSSSAKVPWKASYTNLNNQVSTEEVKSLLSAHLDPNSVDAFFNLVNDYNTIVGSTGLSGDFTSFTHTEYDVEKISHLWNQKKGDFVGTNCRINSYCLLKNSVTIPKLEKNDQLLFLDNDAIDKGKVFDSQDKEEFDILFSRVPTEATTDVKVHAEKMETFFSQFQFNEKARMLSVVLHDNLDGEYLFVGHVGVLVPADDGFLFVEKLTFEEPYQAIKFASKEDCYKYLGTKYADYTGEGLAKPFIMDNDKWVKL

SEQ ID NO: 2706 - protein, 157 aa, Streptococcus pneumoniae
  misc_feature (B) LOCATION 1...157
  hypothetical: YES
QSMSDKIGLFTGSFDPMTNGHLDIIERASRLFDKLYVGIFFNPHKQGFLPIENRKRGLEKALGHLENVEVVASHDELVVDVAKRLGATCLVRGLRNASDLQYEASFDYYNHQLSSDIETIYLHSRPEHLYISSSGVRELLKFGQDIACYVPESIWRK

SEQ ID NO: 2707 - protein, 97 aa, Streptococcus pneumoniae
  misc_feature (B) LOCATION 1...97
  hypothetical: YES
ENMSDNKTSKIPTNPANIGLLFLPIFKAIGPAKKDIQAIGPVIEVEKAVKDTAQKIKTSLESSGFAPSPIAISSPSSIISSLLLKNKTNIVAIILTN

SEQ ID NO: 2708 - protein, 427 aa, Streptococcus pneumoniae
  misc_feature (B) LOCATION 1...427
  hypothetical: YES
GSMSCSIDLLKHRYLKNIKENPELFVGIELEYPVASLEGDATDVEVMKDLFHYLVSTLDLTVAKVDDFGNLIQLVDPISQDAILFEVSYTTIEFAFGKAETIQEVENRFNNYMNVIQRKLAESNHAIVGCGIHPNWDKNENCPVAYPRYQMLMDYLNLSRNIIKSDLHHFPEYGTFICGSQVQLDISKTNYLRVINAFTQIEAAKAYLFANSEFSGADWDTKISRDIFWEESMHGIYPENVGVNARLLNDETDFFDYLNHSAIFTAERDGQTYYFYPIQAGDYLATSEIQAFALNGDEVIIYPQEKDFETHRSYQYQDLTTRGTVEFRSVCTQPLDRTFASAAFHLGLLVNLDKLEAYLETAPFFKVFGYDYKSLRRQFSKKNLTDEEETTIIEFSKDLLLLAEEGLVVRNKEEMTYLQPLREELSL

SEQ ID NO: 2709 - protein, 238 aa, Streptococcus pneumoniae
  misc_feature (B) LOCATION 1...238
  hypothetical: YES
SLMSMLKVENLSVHYGMIQAVRDVSFEVNEGEVVSLIGANGAGKTTILRTLSGLVRPSSGKIEFLGQEIQKMPAQKIVAGGLSQVPEGRHVFPGLTVMENLEMGAFLKKNREENQANLKKVFSRFPRLEERKNQDAATLSGGEQQMLAMGRALMSTPKLLLLDEPSMGLAPIFIQEIFDIIQDIQKQGTTVLLIEQNANKALAISDRGYVLETGKIVLSGSGKELASSEEVRKAYLGG

SEQ ID NO: 2710 - protein, 249 aa, Streptococcus pneumoniae
  misc_feature (B) LOCATION 1...249
  hypothetical: YES
SIMSQKNNKKKNKRKNLLTNILAGFLILLSLALIFNTQIRNIFIVWNTNKYQVSQVSKEKLEENQDTEGNFDFDSVKAISSEAVLTSQWNAQKLPVIGGIAIPELEMNLPIFKGLDNVNLFYGAGTMKREQVMGEGNYSLASHHIFGVDNANKMLFSPLDNAKNGMKIYLTDKNKVYTYEIREVKRVTPDRVDEVDDRDGVNEITLVTCEDLAATERIIVKGDLKETKDYSQTSDEILTAFNQPYKQFY

SEQ ID NO: 2711 - protein, 124 aa, Streptococcus pneumoniae
  misc_feature (B) LOCATION 1...124
  hypothetical: YES
KKMSKNIVQLNNSFIQNEYQRRRYLMKERQKRNRFMGGVLILIMLLFILPTFNLAQSYQQLLQRRQQLADLQTQYQTLSDEKDKETAFATKLKDEDYAAKYTRAKYYYSKSREKVYTIPDLLQR

SEQ ID NO: 2712 - protein, 169 aa, Streptococcus pneumoniae
  misc_feature (B) LOCATION 1...169
  hypothetical: YES
TGMSFKNNWIDKEGRVFIYFTVEEIMKRRNISKPTAIKTLDELDIKKGIGLIERVRLGLGKPNIIYVKDFMSIFQVKENDLQKSKNLTSEVKDFNLRSKENELQEVKNLDSNYIENNKSKYSKREYSFGENGLGTFQNVFLAAEDISDLQIIMNSQLENYIRLPAKLES

SEQ ID NO: 2713 - protein, 118 aa, Streptococcus pneumoniae
  misc_feature (B) LOCATION 1...118
  hypothetical: YES
VKMSIITLLPLLVSSMLIYSAPLIFTSIGGVFSERGGVVNVGLEGIMVMGAFSGVVFNLEFAEQFGAATPWLSLLVAGLLGRVFLFIQGSGDGSFPCRPCGQRYGIELDGACLGCFLS

SEQ ID NO: 2714 - protein, 347 aa, Streptococcus pneumoniae
  misc_feature (B) LOCATION 1...347
  hypothetical: YES
WPVSTFFVFNVNYTREVVRIQEMGKTVNSLDLYLKDINEPAASVLRFFEDVSKDYKVSIIKTDSGDEVVKSGVFDKDTFPYQEFGISSLDFTTDGEGVYSNKEISNKLGTIPTFLKAKPIQLMTFQTYIKDTSRSLNGRYTITSTQEMDKDRIVQKWSDFFKIDQATLLEPTYKSAVEVINRDLLLSAIVFVLAILLLVLVTVYQPMMEMKRVGVQKLLGFQDRAVLADVVKGNLYLLLGGALVINLGVFFLLDYKPKRFVSYTVVVSFFAVAALSLYQLVDLPLNPKNDNQLSAERFFIFQIWSYLQLCDENRDNYFTDGLTDWGGQKFRTRKQRTCLSATVGKSR

SEQ ID NO: 2715 - protein, 376 aa, Streptococcus pneumoniae
  misc_feature (B) LOCATION 1...376
  hypothetical: YES
QPVSFWRKIMKASPHRPTKVLIHLGAIRQNIQQMGAHIPQGTLKWAVVKANAYGHGAVAVAKAIQDDVDGFCVSNIDEAIELRQAGLSKPILILGVSEIEAVALAKEYDFTLTVAGLEWIQALLDKEVDLTGLTVHLKIDSGMGRIGFREASEVEQAQDLLQQHGVRVEGIFTHFATADEESDDYFNAQLERFKTILASMKEVPELVHASNSATTLWHVETIFNAVRMGDAMYGLNPSGAVLDLPYDLIPALTLESALVHVKTVPAGACMGYGATYQADSEQVIATVPIGYADGWTRDMQNFSVLVDGQACPIVGRVSMDQITIRLPKLYPLGTKVTLIGSNGDKEITATQVATYRVTINYEVVCLLSDRIPREYY

SEQ ID NO: 2716 - protein, 124 aa, Streptococcus pneumoniae
  misc_feature (B) LOCATION 1...124
  hypothetical: YES
IKVSIMIKVIAKTNDNGASAVPITIPIGAGVVQGKIILKLFICRTSTKNFIIQTLIIGAVTNGIKKIGFKTIGAPNRIGSFTPKKVGTTDARPTILFLFDLHNHININGTTSVAPVPPIVTTKV

SEQ ID NO: 2717 - protein, 80 aa, Streptococcus pneumoniae
  misc_feature (B) LOCATION 1...80
  hypothetical: YES
WKVSQARQLHMQACKNLISWLFFMIQMISTWMVRQRIPLQKVFVTVTMPTVGILPWLKMEQTWKPSMLLSKQQKLQASHL

SEQ ID NO: 2718 - protein, 331 aa, Streptococcus pneumoniae
  misc_feature (B) LOCATION 1...331
  hypothetical: YES
LPSSGKWRCLPRWRFDCGRVDAHYTGEKMSFTVAVKEEILGQHHLSWHELSAIIKMSGSIGLSTSGLTLSVVTENAKLARHLYESFLHFYEIKSEIRHHQRSNLRKNRVYTVFTDEKVQDLLSDLHLADSFFGLETGIDEAILSDEEAGRAYLCGAFLANGSIRDPESGKYQLEISSVYLDHAQGIASLLQQFLLDAKVLERKKGAVTYLQRAEDIMDFLIVIGAMQARDDFERVKILRETRNDLNRANNAETANIARTVSASMKTINNISKIKDIMGLENLPVDLQEVAQLRIQHPDYSIQQLADSLSTPLTKSGVNHRLRKINKIADEL

SEQ ID NO: 2719 - protein, 539 aa, Streptococcus pneumoniae
  misc_feature (B) LOCATION 1...539
  hypothetical: YES
LTSSVLSTTSKQCFEQPAASFLVCSLIFIEYKIITLFISLKIKKGVFIMKNWKKYAFASASVVALAAGLAACGNLTGNSKKAADSGDKPVIKMYQIGDKPDNLDELLANANKIIEEKVGAKLDIQYLGWGDYGKKMSVITSSGENYDIAFADNYIVNAQKGAYADLTELYKKEGKDLYKALDPAYIKGNTVNGKIYAVPVAANVASSQNFAFNGTLLAKYGIDISGVTSYETLEPVLKQIKEKAPDVVPFAIGKVFIPSDNFDYPVANGLPFVIDLEGDTTKVVNRYEVPRFKEHLKTLHKFYEAGYIPKDVATSDTSFDLQQDTWFVREETVGPADYGNSLLSRVANKDIQIKPITNFIKKNQTTQVANFVISNNSKNKEKSMEILNLLNTNPELLNGLVYGPEGKNWEKIEGKENRVRVLDGYKGNTHMGGWNTGNNWILYINENVTDQQIENSKKELAEAKESPALGFIFNTDNVKSEISAIANTMQQFDTAINTGTVDPDKAIPELMEKLKSEGAYEKVLNEMQKQYDEFLKNKK

SEQ ID NO: 2720 - protein, 80 aa, Streptococcus pneumoniae
  misc_feature (B) LOCATION 1...80
  hypothetical: YES
PSSSSFFTYSCEQAARLKASKAAQDKVSFFHFYSFISNSLSTSDDKHSTNLLISSRFYLASFCCHFFKGTHQTGPRPLRP

SEQ ID NO: 2721 - protein, 66 aa, Streptococcus pneumoniae
  misc_feature (B) LOCATION 1...66
  hypothetical: YES
EGSSVKLENIDKSIQKQDILQGISLEVSPQKLTAFIGPNGAGKSTLPLHHEQTNQERSGSSQYQRT

SEQ ID NO: 2722 - protein, 78 aa, Streptococcus pneumoniae
  misc_feature (B) LOCATION 1...78
  hypothetical: YES
RMPSLIKSTRLALLAAAVEWVTMRMVWPRSLISSKTSSKAADDLESRAPVGSSARRISGSVMMARATATRCFWPPEIS

SEQ ID NO: 2723 - protein, 96 aa, Streptococcus pneumoniae
  misc_feature (B) LOCATION 1...96
  hypothetical: YES
ILTSRRKLSLSLEECQLMLEEGTKDQLAELTYPFGRGVNLSFGIKDVPKLYQKVMEANYPIYRLLTKRKFRVSDPYIYPHKFAVLDPDGYFLRFSE

SEQ ID NO: 2724 - protein, 72 aa, Streptococcus pneumoniae
  misc_feature (B) LOCATION 1...72
  hypothetical: YES
KETSNAHETTNTGIKTMTKQIPKFTKDTAQLYTCKWLLYNKVTKMYDHTVVNHSVREYITDSISTNTSKESG

SEQ ID NO: 2725 - protein, 279 aa, Streptococcus pneumoniae
  misc_feature (B) LOCATION 1...279
  hypothetical: YES
SVASESLSRHGSLKTKGEMMHTYLQKKIENIKTTLGEMSGGYRRMVAAMADLGFSGTMKAIWDDLFAHRSFAQWIYLLVLGSFPLWLELVYEHRIVDWIGMICSLTGIICVIFVSEGRASNYLFGLINSVIYLILALQKGFYGEVLTTLYFTVMQPIGLLVWIYQAQFKKEKQEFVARKLDGKGWTKYLSISVLWWLAFGFIYQSIGANRPYRDSITDATNGVGQILMTAVYREQWIFWAATNVFSIYLWWGKSLQIQGKYLIYLINSLIWLVSMEQGH

SEQ ID NO: 2726 - protein, 78 aa, Streptococcus pneumoniae
  misc_feature (B) LOCATION 1...78
  hypothetical: YES
RSASSVKGASKSMVSPKTLKTRPKVSLPTGTEIGRPVSNTSIPRVNPSVDSMAIVRTIPSPNSKATSRTIFVFLSSFL

SEQ ID NO: 2727 - protein, 233 aa, Streptococcus pneumoniae
  misc_feature (B) LOCATION 1...233
  hypothetical: YES
NLASETNHEIDSNFAGRLNILRAGVLGANDGIISIAGVVIGVASATTNIWIIFLSGFAAILAGAFSMAGGEYVSVSTPKDTEEAAVSREKLLLDQDRELAKKSLYAAYIQNGECKTSAQLLTNKIFLKNPLKALVEEKYGIEYEEFTNPWHAAISSFVAFFLRSLPPMLSVTIFPSEYRIPATVLIVGVALLLTGYTSARLGKDPTRTAMIRNLAIGLLTRGVTFLLEQLFSI

SEQ ID NO: 2728 - protein, 79 aa, Streptococcus pneumoniae
  misc_feature (B) LOCATION 1...79
  hypothetical: YES
KMASCYAKSSMLLMKLISIALKIVIRLMIFTKKFLKIFKMLGTQENFIRHVQRLILLPKFLTQNLENQWQTLLAEQEAS

SEQ ID NO: 2729 - protein, 100 aa, Streptococcus pneumoniae
  misc_feature (B) LOCATION 1...100
  hypothetical: YES
MNTLGDKLMELSAIYHRTESEYAYLYKDKKLHIRIRTKKGDIESINLHYGDPFIFMEEFYQDTKEMVKITSGTLFDHWQVEVSVDFARIQYLFELRDTEG

SEQ ID NO: 2730 - protein, 82 aa, Streptococcus pneumoniae
  misc_feature (B) LOCATION 1...82
  hypothetical: YES
LRQSYPATSKQCFEQPAASFLQILVGTRFNSCDNVKIVRAFYIEYTWEWSLLPFPYLIEKEELNATLYKRRLARIGCRNHYA

SEQ ID NO: 2731 - protein, 91 aa, Streptococcus pneumoniae
  misc_feature (B) LOCATION 1...91
  hypothetical: YES
QSQSHIYGKATLARFEEIFEEYKNPQDTFFYPLVYKENTYEKTAISIFALLMLGVCCLFLFSQQSYKKLVQYYANDQNLPSRITYSEYSDK

SEQ ID NO: 2732 - protein, 308 aa, Streptococcus pneumoniae
  misc_feature (B) LOCATION 1...308
  hypothetical: YES
RCQSQIVWFVEDTYMIQARNKLSQEELSEAKKVINCCQNYDGTYRDPYLSNMLNFDPNMPAFFLYYEKGELVGLLTVYADDQDVEVTILVHPGHRRQGIARALFTSFERETASFPIRSVTFQTERIFLENHPDFASNWGLIEDEETETWLGKDRRPYQLAKLSNLEVLLADSSYQEQISQLKFQAFSGEHESREVVDRYVAEALKDPESRLYILLKDGQVIGTCTVDLSSDTNYFYGLAISEPERGKGYGSYLAKSLVNQLIEQNDKEFQIAVEDSNVGAKRLYEKIGFVKQTQVVYLNEKGARDSEV

SEQ ID NO: 2733 - protein, 228 aa, Streptococcus pneumoniae
  misc_feature (B) LOCATION 1...228
  hypothetical: YES
ICTLFQLPSVCFWESAYFPTRLNDLLENYQVFVLWSFAGAIIGTVPSLLKESTRESDRDKIDLAWLWTTFIISGLGLYALNFVVGTLSASFLNFVLAGALLALGVLVPGLSPSNLLLILGLYAPMLTGFKTFDLLGTFFPIGIGAGATLIVFSKLMDYALNNYHSRVYHFIIGIVLSSTLLILIPNAGNAESIQYTGLSLVGYVIIAFFFALGIWLGIWMSQLEDKYK

SEQ ID NO: 2734 - protein, 79 aa, Streptococcus pneumoniae
  misc_feature (B) LOCATION 1...79
  hypothetical: YES
CRKSFGTGCLLGAVVASFIGLEKGQELKSLETAMLVYNIAGEMAEKRPNGHLPGTFKVEFINALYEITDEDVKEFKRVK

SEQ ID NO: 2735 - protein, 65 aa, Streptococcus pneumoniae
  misc_feature (B) LOCATION 1...65
  hypothetical: YES
ALWSKRRDRIRTRNLPENWLISFTTPCAIVAINHIDLTKTVFEKDKTAAVNYQHKHNLEGFLKGK

SEQ ID NO: 2736 - protein, 224 aa, Streptococcus pneumoniae
  misc_feature (B) LOCATION 1...224
  hypothetical: YES
GGWSMKCLLCGQTMKTVLTFSSLLLLRNNDSCLCSDCDSTFERIGEENCPNCMKTELSTKCQDCQLWCKEGVEVSHRAIFTYNQAMKDFFSRYKFDGDFLLRKVFASFLSEELKKYKEYQFVVIPLSPDRYANRGFNQVEGLVEAAGFEYLDLLEKREERASSSKNRSERLGTELPFFIKSGVTIPKKILLIDDIYTTGATINRVKKLLEEAGAKDVKTFSLVR

SEQ ID NO: 2737 - protein, 338 aa, Streptococcus pneumoniae
  misc_feature (B) LOCATION 1...338
  hypothetical: YES
YSWSWSSSWQTLARSPSELAQLLRTKPQHIFFTSGGTEGNNTTIIGYCLRHQEQGKHIITTAIEHHAVLETIDYLVQHFGFEATIIQPENQEITAQQIQKALRDDTILVSTMFANNETGNLLPIAEIGQILKQHPAAYHVDAVQAIGKIPIHSEELGIDFLTASAHKFHGPKGIGFLYASSMDFDSYLHGGDQEQKKRAGTENLPAIVGMVAALKEDLEKQEEHFQHVQNLETAFLAELEGIQYYLNRGKHHLPYVLNIGFPGQKNDLLLLRLDLAGISISTGSACTAGVVQSSHVLEAMYGANSERLKESLRISLSPQNTVEDLQTLAKTLKEIIGG

SEQ ID NO: 2738 - protein, 257 aa, Streptococcus pneumoniae
  misc_feature (B) LOCATION 1...257
  hypothetical: YES
IRWSLICTMIYFQNVSKLYGDKDALSNLNLQIENGEIMGLIGHNGAGKSTTIKSLVSIISPSSGRILVDGQELSENRLAIKRKIGYVADSPDLFLRLTANEFWELIASSYDLSRSDLEASLARLLNVFDFAENRYQVIETLSHGMRQKVFVIGALLSDPDIWVLDEPLTGLDPQAAFDLKQMMNEHALKGKTVLFSTHVLEVAEQVCDRIAILTKGHLIYCGXVKDLRKDYPDQSLESIYLSLAGRKEEVADASQGH

SEQ ID NO: 2739 - protein, 71 aa, Streptococcus pneumoniae
  misc_feature (B) LOCATION 1...71
  hypothetical: YES
GCRSGDRNSCYHHQPRCLYSDYYWNLSDNDPSWSISHGRYTNLILFENLFKPRQLYLQPQNSVLSNLWLAS

SEQ ID NO: 2740 - protein, 102 aa, Streptococcus pneumoniae
  misc_feature (B) LOCATION 1...102
  hypothetical: YES
STTLGNSENCPVLFYFEKIWSLSLKLLDCILDYQERFNGKTCQVSTNYKYLEIFKVNFCLTDLHHLFDLYKITRDYASQTKPAIQAGVFILEDFRNILCTMM

SEQ ID NO: 2741 - protein, 503 aa, Streptococcus pneumoniae
  misc_feature (B) LOCATION 1...503
  hypothetical: YES
LLFPFPHYKRVNSYNLPFHALPHHKAGQSLPTAHQTESYFASESSHQVLFLVSCPTILPKRAGFCYNGHMNEKVFRDPVHNYIHVNNQIIYDLINTKEFQRLRRIKQLGTSSYTFHGGEHSRFSHCLGVYEIARRITEIFEEKYPEEWNPAESLLTMTAALLHDLGHGAYSHTFEHLFDTDHEAITQEIIQNPETEIHQVLLQVAPDFPEKVASVIDHTYPNKQVVQLISSQIDADRMDYLLRDSYFTGASYGEFDLTRILRVIRPVENGIAFQRNGMHAIEDYVLSRYQMYMQVYFHPATRAMEVLLQNLLKRAKELYPEDKNFFARTSPHLLPFFEKNVTLTDYLALDDGVMNTYFQLWMTSPDKILADLSQRFVNRKVFKSITFSQEDQDQLTSMRKLVEDIGFDPDYYTAIHKNFDLPYDIYRPESQNPRTQIEILQKNGELAELSSLSPIVQSLAGSRHGDNRFYFPKEMLDQNSIFASITQQFLHLIENDHFTPNKN

SEQ ID NO: 2742 - protein, 169 aa, Streptococcus pneumoniae
  misc_feature (B) LOCATION 1...169
  hypothetical: YES
HAFPDGVTIDAQFSTLNGRPLTEATVGDDLYATETESPTQTIKVGKQQMNGSTLLNYARFRDDDEADYGRTKRQQQVLTAILEQIKDPTKLFTGSEALGKVFAMTSTNVPYTFLLTNGLSVLDGAKNGIEKLTIPELGDWVDAYDVYGGLGLLVDQNKYQTKLAQMGLR

SEQ ID NO: 2743 - protein, 327 aa, Streptococcus pneumoniae
  misc_feature (B) LOCATION 1...327
  hypothetical: YES
GAFPSREAISLFDFPSFFPSSNLNIWLSTQPILAQIYAFPLATATMAAILSFLFFFLSFYKKNKQIRFYSGILLLLSLILLLFGTDKTLSSASNKTKTLKLVTWNVANQIEAQHIERIFSHFDADMAIFPELATNIRGEQENQRIKLLFHQVGLSMANYDIFTSPPTNSGIAPVTVIVKKSYGFYTEAKTFHTTRFGTIVLHSRKQNIPDIIALHTAPPLPGLMEIWKQDLNIIHNQLASKYPKAIIAGDFNATMRHGALAKISSHRDALNALPPFERGTWNSQSPKLFNATIDHILLPKNHYYVKDLDIVSFQNSDHRCIFTEITF

SEQ ID NO: 2744 - protein, 71 aa, Streptococcus pneumoniae
  misc_feature (B) LOCATION 1...71
  hypothetical: YES
FDFPDRVVHILFQSTIFYRTDYSESSFRPLMISYQLECHQKKIAGLKTCYLLLFLQNQMFRILLLLFSLFP

SEQ ID NO: 2745 - protein, 435 aa, Streptococcus pneumoniae
  misc_feature (B) LOCATION 1...435
  hypothetical: YES
MQFPEGFVEKYKEILGDEARDFLASFEEEAVSAFRVNPLXEEQLSFSDAITQTPWGHYGKVSGXSPXHATGLVYXQETAAQMVAQVAQPSPGMKVLKLAAAPGGKSTQLAAYLAGEGLLVSNEISSKRAKILVENMERFGATNVVVTNESADRLVKVFKGYFDLIVLDAPCSGEGMFRKQPDAMDYWSLDYPSQCASLQREILWEDAVTMLAEGGHLVYSTCTWAPEENEEIVNWLLEEYDFDLLPVEHINGMVAGIDLPETARMYPHQFKGEGQFVAHLQFKGNNPAPKFKASKSNLSREQVALWQEFAQNHLKVNLPGILQTFGDQLYLLPELLPDLGKLKIARNGLHLGTFKKKRFEPSFALGLALKPSQVEQSVEIGQEAFVKYAAGEIVQLAESLPNGWYQVLVKGNGLGFAKVTGNVLKNYFPKGLRFK

SEQ ID NO: 2746 - protein, 119 aa, Streptococcus pneumoniae
  misc_feature (B) LOCATION 1...119
  hypothetical: YES
LSFPIVIPRYQAGYLRVTHPFATHPEKQAPPSAFYLHVLGTPPAFVLSQDQTLIKSLSSHSFLSLTDLLFFSLFSTTTYVVAPCTLVRLVQFSKVFVTCFSQATTILVYHSHFHLSTLF

SEQ ID NO: 2747 - protein, 60 aa, Streptococcus pneumoniae
  misc_feature (B) LOCATION 1...60
  hypothetical: YES
AHLFRTSLIFFRKDIKVSGGKTSLKSGMFVLIKLTKSRAISFWSELGRFSIIVRKSPNSR

SEQ ID NO: 2748 - protein, 255 aa, Streptococcus pneumoniae
  misc_feature (B) LOCATION 1...255
  hypothetical: YES
KELPSMGTFSVRHLDLFYGDFQALKNISIQLPERQITALIGPSGCGKSTFLKTLNRMNDLVPSCHIEGQVLLDEQDIYSSKFNLNQLRKRVGMVFQQPNPFAMSIYDNVAYGPRTHGIRDKKQLDALVEKSLKGAAIWEEVKDDLKKSAMSLSGGQQQRLCIARALAVEPDILLMDEPTSALDPISTLKIEDLIQQLKKDYTIIIVTHNMQQASRISDKTAFFLTGEICEFGDTVDVFTNPKDQRTEDYISGRFG

SEQ ID NO: 2749 - protein, 68 aa, Streptococcus pneumoniae
  misc_feature (B) LOCATION 1...68
  hypothetical: YES
FNIPKIIPDRPKSASEKVDPWKPSPPKTGIKKTGRKLIKIPCKNAPIVAPRTPPDAFPMTPAVAPQKK

SEQ ID NO: 2750 - protein, 295 aa, Streptococcus pneumoniae
  misc_feature (B) LOCATION 1...295
  hypothetical: YES
KPIPSPLIPMRLIFNGIFCFTFRFIPLSYHILSYNRAMKITKLEKKKRLYLMELDNGDKCYITEDTIVRFMLSRDKVISEEELKEIQDFAQFSYGKNLALYHLSFKARTEKEVREYLKKYDIDKNIVSQVIANLKEDKWINDGQYAYAIINTNQLSGDKGPYVLTQKLAQKGISKSTIEENLKEFDFSEVAQRVANKLLKKYEGKLPARALQDKIIQNLTNKGFSYSDAKIAFDDLDSQVDQETTQELIFKELDKQYTKYARKYEGYELKQRLTQVLARKGYDFSDIASALREYL

SEQ ID NO: 2751 - protein, 61 aa, Streptococcus pneumoniae
  misc_feature (B) LOCATION 1...61
  hypothetical: YES
AIVPRKARKRRKGWLAKSTAKRLSVWFTVCRFILVLLSMLGCIDFTIDLAGFHQVIVLANS

SEQ ID NO: 2752 - protein, 359 aa, Streptococcus pneumoniae
  misc_feature (B) LOCATION 1...359
  hypothetical: YES
PGSPIFKKYRRIKMAEITAKLVKELREKSGAGVMDAKKALVETDGDIEKAIELLREKGMAKAAKKADRVAAEGLTGVYVNGNVAAVIEVNAETDFVAKNAQFVELVNTTAKVIAEGKPANNEEALALIMPSGETLEAAYVSATATIGEKISFRRFALIEKTDAQHFGAYQHNGGRIGVISVVEGGDEALAKQLSMHIAAMKPTVLSYKELDEQFVKDELAQLNHVIDQDNESRAMVNKPALPHLKYGSKAQLTDDVIAQAEADIKAELAAEGKPEKIWDKIIPGKMDRFMLDNTKVDQAYTLLAQVYIMDDSKTVEAYLESVNASVVEFARFEVGEGIEKAANDFEAEVAATMAAALNN

SEQ ID NO: 2753 - protein, 62 aa, Streptococcus pneumoniae
  misc_feature (B) LOCATION 1...62
  hypothetical: YES
GMLFRPTPPVTITETCGIGALTAEIYAGLRVLPGKSLMISLPASSAVVISVRVIQPGMYGVL

SEQ ID NO: 2754 - protein, 199 aa, Streptococcus pneumoniae
  misc_feature (B) LOCATION 1...199
  hypothetical: YES
SCTPPHLPRPHSGARGATRRTPQRSRPQPPQIRGNQTEQQATTHAPPPAPAHAHPPQPRARHAAQHRQQGDEPPPPRTGPPGPRPATPSPPQGEKTKPPRPTNAPPRSSLTKEIPTKSIKFRRKGIKERSGRATFDNFNQCSKPHPLPSIRNIIRNINFLSTSISKLPIMFLMCFKYIKRRKNTPIDNGVEIGLLLMRL

SEQ ID NO: 2755 - protein, 83 aa, Streptococcus pneumoniae
  misc_feature (B) LOCATION 1...83
  hypothetical: YES
VFTPWLLRSNFNSERSKSTPRAAGKSMTTRPTRTGKILNSILRKDAAGKSGKSKYISTNEMADKIAMVESRRVFVITGSSNFL

SEQ ID NO: 2756 - protein, 74 aa, Streptococcus pneumoniae
  misc_feature (B) LOCATION 1...74
  hypothetical: YES
TFTPNKAAEIILKVLNSAVANAENNFGLDKANLVVSEAFANEGPTMKRFRPRAKGSASPINKRTAHITVAVAEK

SEQ ID NO: 2757 - protein, 115 aa, Streptococcus pneumoniae
  misc_feature (B) LOCATION 1...115
  hypothetical: YES
VITPCHPPTKNPDKIAGVLQGNVTPENGCMKPVAIAPYTITAASTGTRMKGTNITGFMTIGNPNTTGSFTLNIAGKAATFPKAWYCFDFAAKSMATTRPNVIPEPDRIKNESKNC

SEQ ID NO: 2758 - protein, 154 aa, Streptococcus pneumoniae
  misc_feature (B) LOCATION 1...154
  hypothetical: YES
FLAPAGISANEVKQDVTSEVVIGVLDSKEELKESENDAPKLETPLREEPRLAPQTLPEASEVLENKREESKVEITEPAQADDIRKVVGELAKDISITKLYMTGHSLGGYLAQIAAVEDYQKYPDFYNHVLRKVTTFSAPKVITSRTVWDAKNGF

SEQ ID NO: 2759 - protein, 178 aa, Streptococcus pneumoniae
  misc_feature (B) LOCATION 1...178
  hypothetical: YES
ERAPPAALTPISDPTVSRINLTSAIVAPPVEKPVDVLTKSAPAFWANWQTTIFSWSVRRQASIMTFTNLSPLASTTARISDSTKAKLPDLRAPTLITISISSAPFWIASFVSNAFTAEVVAPKGKPTTVQTLTSVPSSPFLACSTQVGLTQTLAKSYSLASDNKLSICFFCASCLPSV

SEQ ID NO: 2760 - protein, 65 aa, Streptococcus pneumoniae
  misc_feature (B) LOCATION 1...65
  hypothetical: YES
LFYPISISFHYIIAIVFFFMILILLYRFDTVNSFLALYFIISNLIIVLFLIKFNYLYVKFLISKK

SEQ ID NO: 2761 - protein, 132 aa, Streptococcus pneumoniae
  misc_feature (B) LOCATION 1...132
  hypothetical: YES
LIYPVLISFYYSSMNYEGSKQLTDARFKCLVGVQRTTFEEMLAVLKTAYQLKHAKGGRKPKLSLEDLLMATLHYVREYRTYEEIAADFGIHESNLLRRSQWVEVTLVQSGVTISRTPLSSEDTVMIIDATEV

SEQ ID NO: 2762 - protein, 85 aa, Streptococcus pneumoniae
  misc_feature (B) LOCATION 1...85
  hypothetical: YES
KGYPMHIHYNTNQTTLPLEISSFLPQDHLVFTIEKVVNTLEDCHFHAFYHAFDRPSYHPKMLVSTLLFAYSQGIFSGRKIEKWKS

SEQ ID NO: 2763 - protein, 176 aa, Streptococcus pneumoniae
  misc_feature (B) LOCATION 1...176
  hypothetical: YES
KGYPMHIHYNTNQTTLPLEINSFLPQDHLVFTIEKVVNTDEKEVNHLIKYAMFDKEQKRGYKQSARNLANWHYNDKEDSYTHPDGWYYRFHHTKYQKTQTDFQQEIKVYYADEPESAPQKGLYMNERYQNLKAKECQALLSPQGRQIFAQRKIDVEPVFGQIKASLGYKRCNLRGK

SEQ ID NO: 2764 - protein, 60 aa, Streptococcus pneumoniae
  misc_feature (B) LOCATION 1...60
  hypothetical: YES
LLTLSVLSTTSKQYFELSAPSFLVCSLIFIEYTTILLPLARDFVYVEGLGSYVVELFCSF

SEQ ID NO: 2765 - protein, 208 aa, Streptococcus pneumoniae
  misc_feature (B) LOCATION 1...208
  hypothetical: YES
LCLFSVCLAFPRRLFVFADDSLSANSKVVSGEAQFENGSSVRFGDTQVNILSDEVLEVVNPDGSVDTIERRADGVYINGAFYMAYQKNEIDLNISFRSYDPNVWNYVNTIHGNKQANTFANFMTGAGISYMIGRIGALLGGPWGAIIGGAYFGIQAYQSYLDSQSPYPYYITSTYIHVAQRKWKFITEYYRNSNYTGYVKTVTTYVNF

SEQ ID NO: 2766 - protein, 131 aa, Streptococcus pneumoniae
  misc_feature (B) LOCATION 1...131
  hypothetical: YES
ARHPLVLYSSPPPPSPLWREGRDPPHPPAQPAAASPDPRQPNGAAGHHTRTPPRPGPRPPATTQSAPRSPAQTARRRATPAPHGTPGPPPRDPQPPTGRENQATPTHQRTTEVQPHQRNSNKVNKVQKEGN

SEQ ID NO: 2767 - protein, 368 aa, Streptococcus pneumoniae
  misc_feature (B) LOCATION 1...368
  hypothetical: YES
PINPYLQHRCTSYLGGSVMNKKQWLGLGLVAVAAVGLAACGNRSSRNAASSSDVKTKAAIVTDTGGVDDKSFNQSAWEGLQAWGKEHNLSKDNGFTYFQSTSEADYANNLQQAAGSYNLIFGVGFALHNAVEEAAKEHTDLNYVLIDDVIKDQKNVASVTFADNESGYLAGVAAAKTTKTKQVGFVGGIESEVISRFEAGFKAGVASVDPSIKVQVDYAGSFGDAAKGKTIAAAQYAAGADIVYQVAGGTGAGVFAEAKSLNESRPENEKVWVIGVDRDQEAEGKYTSKDGKESNFVLVSTLKQVGTTVKDISNKAEKGEFPGGQVIVYSLKDKGVDLAVTNLSEEGKKAVEDAKAKILDGSVKVPEK

SEQ ID NO: 2768 - protein, 426 aa, Streptococcus pneumoniae
  misc_feature (B) LOCATION 1...426
  hypothetical: YES
QMNPIQRSWAYVSRKRLRSFILFLILLVLLAGISACLTLMKSNKTVESNLYKSLNTSFSIKKIENGQTFKLSDLASVSKIKGLENVSPELETVAKLKDKEAVTGEQSVERDDLSAADNNLVSLTALEDSSKDVTFTSSAFNLKEGRHLQKGDSKKILIHEELAKKNGLSLHDKIGLDAGQSESGKGQTVEFEIIGIFSGKKQEKFTGLSSDFSENQVFTDYESSQTLLGNSEAQVSAARFYVENPKEMDGLMKQVENLALENQGYQVEKENKAFEQIKDSVATFQTFLTIFLYGMLIAGAGALILVLSLWLRERVYEVGILLALGKGKSSIFLQFCLEVVLVSLGALLPAFVAGNGITTYLLQTLLASGDQASLQDTLAKASSLSTSILSFAESYVFLVLLSCLSVALCFLFLFRKSPKEILSSIS

SEQ ID NO: 2769 - protein, 391 aa, Streptococcus pneumoniae
  misc_feature (B) LOCATION 1...391
  hypothetical: YES
LKDPIQLLELSHTQGQLTDEQLFWLQCLLNLSQTNNLVKIKKIEEHKYDYKTECNSVLQFLLDKTVNSEGRITSSTEFGNFVSNLSFQHGIAGLLFPLNKLYPPELDSKILSIIKKAVTIRTTHTYEYQYSLLFGDAGYLWLLLHLFSISKNQYYLQLANVTAKKLIENYDTLEEIDFALGKSGVLLSLIKYYQFTNDNTLKIFIHNSIGEIYHYFLQRDTAKESILDYSFAHGYCGIAYALFAYSKVLEPSMFYNDLHTFHTELKKLLEKVTSNTENLGNLQLSWCKGISGIILYLCMYDCDGNKDIISKYQEFVFNHHLKMMTGYCHGITSLLQTTVYNQNKLLMKKIQQVILACSERDDHGLLMFQGDSGKADLFDFGIGSMGYIGVY

SEQ ID NO: 2770 - protein, 148 aa, Streptococcus pneumoniae
  misc_feature (B) LOCATION 1...148
  hypothetical: YES
KISPLRMHLPTLLKNKEKSQRSRQMSSSKTIGIIGGGQLGQMMAISAIYMGHKVIALDPAADCPASRVAEIIVAPYNDVDALRQLADRCDVLTYEFENVDADGLDAVIKDDNSLKKQILPHFAKSYFRKGLFVKQGSSHCGTLQGRDF

SEQ ID NO: 2771 - protein, 99 aa, Streptococcus pneumoniae
  misc_feature (B) LOCATION 1...99
  hypothetical: YES
VRSPRIVFANKMDKIGADFLYSVSTLHDRLQANAHPIQLPIGSEDDFRGIIDLIKMKAEIYTNDLGTDILEEDIPAEYLDQAQEYREKLIEAVAETDEN

SEQ ID NO: 2772 - protein, 74 aa, Streptococcus pneumoniae
  misc_feature (B) LOCATION 1...74
  hypothetical: YES
QVGPEVQLVFLDPPYTKEQIVADIEKMAERELFSEDVMVVCETDKAVELPEEIACLGIWKEKIYGISKVTVYVR

SEQ ID NO: 2773 - protein, 182 aa, Streptococcus pneumoniae
  misc_feature (B) LOCATION 1...182
  hypothetical: YES
IKTFVSANLLEIFSNTIWVSSIILVFVTELLNKTESYWGYSNTAYSIGIIISGLIAFRLSEKFLAAKWESILFPLVAMAIVTLTILYFPNAQMFLLFSALVGMLSQLKEVPESVFLQETVEENHLVNVYSVLEVISTLAFSVFVLLMSYITESFGISISFWLSAICLMIEAILIYIRRDYFK

SEQ ID NO: 2774 - protein, 300 aa, Streptococcus pneumoniae
  misc_feature (B) LOCATION 1...300
  hypothetical: YES
VYMLLEISIKNFAIIEAISLNFEKGMTVLTGETGAGKSIIIDAMNMMLGARATTDVIRHGAPKAEIEGLFSVENSRLLQEIFDEQGLELGDEIIIRREILQNGRSISRVNGQMVNLSVLRAIGQHLVDIHGQHDHEELMRPQLHIQMLDEFGDAAFWDLKETYQTSFDAYRKMRKQVLEVKKNQQEHKARIEMLEFQMAEIEAANLQAGEDLDLNQERDKLLNHKNIADTLTNAYSMLDNEDFSSLANVRSAMNDMESVEEYDPEYREISSSLSETYYVLEDISKRLEAIIEDLDFDGNR

SEQ ID NO: 2775 - protein, 664 aa, Streptococcus pneumoniae
  misc_feature (B) LOCATION 1...664
  hypothetical: YES
ISMFRLTNKLAVSNLIKNRKLYYPFALAVLLAVTLTYLFYSLTFNPKIAEIRGGTTIQATLGFGMFVVTLASAIIVLYANSFVMKKRSKELGIYGMLGLEKRHLISMTFKELVVFGILTVGAGIGIGALFDKLIFAFLLKLMKLKVELVATFQTKVVITVLVVFGLIFLGLMFLNALRIARMNALQLSREKASGEKKGRFLPLQTILGSISLGIGYYLALTVKDPLTALTTFFIAVLLVIFGTYLLFNAGITVFLQILKKNKKYYYQPNNLISVSNLIFRMKKNAVGLATIAILSTMVLVTMSAATSIFNSAESFKKVLNPHDFGVSGQNVEKEDLDKLLSQFASDNGYKIKEKEVFRYTYFGVANQEGNKLTFFEKGQNRVQPTTVFMVFDQKDYENMTGQKLSLSGNEVGLFAKNDGLKGQKTLILNDHQFSVKEEFNKDFIVNHVPNQFNILTADYNYLVVPDLQAFLNQFPDSDIYNQFYGGMNVNVSEEEQLKVAEEYENYLNQFNAQLDTEGSYVYGSNLADASSQMSALFGGVFFIGIFLSIIFMVGTVLVIYYKQISEGYEDRERFIILQKVGLDQKQIKQTIHKQVLTVFFLPLLFAFIHLAFAYHMLSLILKVIGVLDTTMMLIVTLSICAIFLIAYVLIFMITSRSYRKIVQM

SEQ ID NO: 2776 - protein, 63 aa, Streptococcus pneumoniae
  misc_feature (B) LOCATION 1...63
  hypothetical: YES
TFMFLSVFSFSLPLFQELFLIQFYYSYSSFFLRSIKDLRKYNQNGYLSSTQPSSFSSYPFHNF

SEQ ID NO: 2777 - protein, 70 aa, Streptococcus pneumoniae
  misc_feature (B) LOCATION 1...70
  hypothetical: YES
ISMFSLVLILTIQEISRTLYNFQSNKLHSFSQAGILVWINKKFRKFKNRKENKSYGKRYSCLTLLPLYSN

SEQ ID NO: 2778 - protein, 115 aa, Streptococcus pneumoniae
  misc_feature (B) LOCATION 1...115
  hypothetical: YES
SLMLEQAFKEKHYENTILHSDQGWQYQHDSYHRFLESKGIQASMSRKGNSQDNGRMESFFGILKSEMFYGYEQTFKSLNQLEQAIIDYIDYYNNKRIKIKLKGLSSVQYRTKSFG

SEQ ID NO: 2779 - protein, 262 aa, Streptococcus pneumoniae
  misc_feature (B) LOCATION 1...262
  hypothetical: YES
PCFPKIRRSEGSGTFYRQSSKNCNGSTNLGEMMKEQNTIEIDVFQVLKTLWKHKLIILLVALVTGAGAFAYSTFIVKPEYTSTTRIYVVNRNQEGKSGLTNQDLQAGTYLVKDYREIILSQDVLEKVATNLKLDMPAKALTSKVQVTVPTDTRIVSISVKDKEPEEASRIANSLREVAAGKIVAVTRVSDVTTLEEARPATTPSSPNVRRNTLVGFLGGAVVTVITVLLIELLDTRVKRPEEVEEVLQVPLLGVVPDLDKMK

SEQ ID NO: 2780 - protein, 276 aa, Streptococcus pneumoniae
  misc_feature (B) LOCATION 1...276
  hypothetical: YES
KIFPGLDXYDFDAAKLNKKIGFWGSKFFIGFILGIVIGIMGTPHPIAGVADADKWRLVIKGWLSLGLTAGVSLELFSLIGSWFIAAVEPLSQGITNVATKRLQGRKFNIGLDWPFIAGRAEIWACANVLAPIMLIEAVLLSKVGNGILPLAGIIARGVTPALLVVTRGKLLRMIIFGTLLLPLFLLSGTLIAPFATELAKGVGAFPEGVSQTQLITHSTLEGPIEKLLGWTIGNTTTGDIKAILGAVAFLVFYIGIFAWYRKQMIKRNEEYAAKAK

SEQ ID NO: 2781 - protein, 65 aa, Streptococcus pneumoniae
  misc_feature (B) LOCATION 1...65
  hypothetical: YES
TSLPITAQCYRIKHLTQFTPHCLDRLFQSSALVSLLRPSITTYSSTGISTCCPSDTPFGLSLGPD

SEQ ID NO: 2782 - protein, 211 aa, Streptococcus pneumoniae
  misc_feature (B) LOCATION 1...211
  hypothetical: YES
SKMFHKELLKLYFICGTTTCQGKNLYTVVEEALKGGITLFQFREKGESALEGLEKLELAIQIKELCKKYNVPFIVNDDIDLAMEIDADGVHVGQDDIGVDEIRKLMPDKIIGLSIRNEEEFQQSKVEYVDYVGVGPVFDTQSKDDAGGAIGYEGLELMRKLLPQMPLVAIGGIQTKHIKDIIKTNVDGVSIISAISYAKNIEKTVREMSEQ

SEQ ID NO: 2783 - protein, 443 aa, Streptococcus pneumoniae
  misc_feature (B) LOCATION 1...443
  hypothetical: YES
RRMFLERWCLQMSQTYQIKQNDIVVDLPKTVGAGYGQFWRSRSLYRVVKGSRGSKKSKTTALNYVIRLLKYPWANLLVIRRYSNTNKQSTYTDFKWACNVLGVTHLFKFNESLPEITIKATGQKILFRGLDDELKITSITVDIGSLCWAWFEEAYQIETEDKFSTVVESIRGSLDVPDFFKQITVTFNPWNERHWLKRVFFDEETRRADTFATTTTYKCNEWLDEVDIKRYEDLYHTNPRRARIVCDGEWGVAEGLIYENVTVKDFNKDELLQDSANKLCIGLDFGFTHDPTALCCSLINDTTKEIYVFDEAYKVGLITKEVAKMIKDKGYHRSQIIADSAESRLIEELRSEHGISRIKESRKGKDSIMAGVSKLQGYAIYVHPDCKNIMDEFYSYCYQRDKEGNWLNKPEDKNNHLMDALRYSLQCIEGGKATVRRRSDYGL

SEQ ID NO: 2784 - protein, 130 aa, Streptococcus pneumoniae
  misc_feature (B) LOCATION 1...130
  hypothetical: YES
KQIPIFRGGGCMKKVKLGQVATFINGYAFKPQDWSSEGKEIIRIQNLTKTSKGINYYSGTIDKKYIVEAGDILISWSGTLGVFQWCGRSAVLNQHIFKVVFDKIDIDKSYFKYVVEKGLQDAVKHTHGQQ

SEQ ID NO: 2785 - protein, 521 aa, Streptococcus pneumoniae
  misc_feature (B) LOCATION 1...521
  hypothetical: YES
RRIPIVSNKPIADMIETIEHFAQTQPSYPVYNVLGQEHTYGDLKADSDSLAAVIDQLGLPEKSPVVVFGGQEYEMLATFVALTKSGHAYIPIDSHSALERVSAILEVAEPSLIIAISAFPLEQVSTPMINLAQVQEAFAQGNNYEITHPVKGDDNYYIIFTSGTTGKPKGVQISHDNLLSFTNWMITDKEFATPSRPQMLAQPPYSFDLSVMYWAPTLALGGTLFTLPSVITQDFKQLFAAIFSLPIAIWTSTPSFADMAMLSEYFNSEKMPGITHFYFDGEELTVKTAQKLRERFPNARIINAYGPTEATVALSAVAVTDEMLATLKRLPIGYTKADSPTFIIDEEGNKLPNGEQGEIIVSGPAVSKGYMNNPEKTAEAFFEFENLPAYHTGDVGTMTDEGLLLYGGRMDFQIKFNGYRIELEDVSQNLNKSRFIESAVAVPRYNKDHKVQNLLAYVILKDGVREQFERDIDITKAIKEDLTDIMMSYMMPSKFLYRDSLPLTPNGKIDIKGLINEVNKR

SEQ ID NO: 2786 - protein, 1030 aa, Streptococcus pneumoniae
  misc_feature (B) LOCATION 1...1030
  hypothetical: YES
HYVFQNILQNYLLLRKLYVNNEEIKMENKKIAKQILIATAVLTSFLGSNLVYADVVQSNSNNRASTETARVTGNNLEKLITKDKEIDKEMTYLSDMDWSSATHGDIDKTKTVQKDAPFTTGNKGEHTKISLLTSDDKVKYFDKGIGTVADSPSVISYDISGQGFEKFETYIGIDQSANSSRSDHAVVDRIEIEIDGKVVYSSSVTNPEGFRYNTQAQFISVTIPQNAKKISLKSFAGEHTWGDEVVFADAKLIKTVSTQTITPDLLNKGINGGVYLSDLEWVDATHGDDDKSKTVQKDKPFTPGNNGSNNKIKLLIDGKEVEFNKGLGTVASNPSSIKYDVSGANVTRFISYVGIDRSANHLNSDYADIQKFEVVADGKVIYSSDSKYPKGIKYDISAFLVDVEIPKDTQTIELKSYSGKYTWADELVLGGALFMANGKFKNPNDWSEVDKRREINNEHPLLMMPLYANGEEFNQGKYTFWGGDTLTGKWENIPDDLKPYTVIQLHPDDLPKRDGAARDFYEHMLEEAAKYVNPKTGKNEPIPVILTVYTAGNMPYYTSAHWLSTSWIDKMYQKYPNLHGIFSTENYWIWANDIENKAADYLKVSAKNGGYFIWAEQNNGSAIEKAFGKNGKIAFQKSVDKYWKNLIFMFKNTPAAEGNDSTTESYMKGLWLSNHTYQWGGLMDTWKWYETGKWKLFASGNIGKSQGDRQWLTEPESMLGEEALGVYLNGGVVYNFEHPAYTYGVNNKESLLFSEVIKEFFRYVIAHPAPSKEKVLEDTKVFIHGDYSNKGNGKFFVNVNTDREQTPLYMTGRYNVIPAIPGVLKTDKLKESVSGSRIQIKEITSPEFSSTQARKEYLNKLYPMNYEGDIFAQKLDNRWFVYNYKVNENVKQTGKLKFNSLEMDVEFEPHTYGIFERISNGLKVNLNNFRTNKDSLWSNAQDANQAKKLPQLTKKGAIKWIEEHYIKDTQFGEKRVTKIVLRGIDKLPTIHSLSGTNNSYDQPSLNFDQKNHMVTITINSNGNLEFELHF

SEQ ID NO: 2787 - protein, 93 aa, Streptococcus pneumoniae
  misc_feature (B) LOCATION 1...93
  hypothetical: YES
PPPPPPTPPPPPTPPPPQPTPPPPPPPPHPPPPPPPNTPHPKNPQKKKTKKKNFFEKKKKKKKKKKKNLGLLGRKTLANIWSIRPPKAPKIVT

SEQ ID NO: 2788 - protein, 69 aa, Streptococcus pneumoniae
  misc_feature (B) LOCATION 1...69
  hypothetical: YES
TPPPPHPPHPPPPPPPPPNPPPPPPPPPPTPPPPPPPTPHTPKTHKKKKQKKKIFLKKKKKKKKKKKKT

SEQ ID NO: 2789 - protein, 207 aa, Streptococcus pneumoniae
  misc_feature (B) LOCATION 1...207
  hypothetical: YES
IVYPFFCVSEVTMKRIIPVYIFQQVNVLLVSLYLLKFLCIGELTILQILYGSSLISFLWMYGQRKQAHKVNMKSRMKWLGIGFVSLLIISLCFSLIHAQESTNQANLIGLQHQVPWFSFLLFLINASMVEEFLYREILWNLVRKLDIRVALTSVLFALAHHPGTIIAWCLYVSLGMFLGLVRYKLDLWGSMGLHLVWSLLVYSLLLF

SEQ ID NO: 2790 - protein, 369 aa, Streptococcus pneumoniae
  misc_feature (B) LOCATION 1...369
  hypothetical: YES
IQYPWWKMSNVICSDSSYSFHNKNFMIFIRRKSLMVVKVGINGFGRIGRLAFRRIQNVKGVEVTRINDLTDPVMLAHLLKYDTTQGRFDGTVEVKEGGFEVNGKFVKVSAERDPEQIDWATDGVKIVLEATGFFAKKEAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWYDNEMSYTAQLVRTLEYFAKIAK

SEQ ID NO: 2791 - protein, 320 aa, Streptococcus pneumoniae
  misc_feature (B) LOCATION 1...320
  hypothetical: YES
TAHPPRLSAIGVRRAATLDGACRAIRAGLDHRALHRAGGRRRHERAGGRRDPLDSRRAHRAVAQAGRRQPLSGHRRAALGEPGHEPDRRRRSAPCGRTLARMAGEVRGSRVAAEDRRIPERPGQRSRPGHREDRGDPPVAAPGYPRNQRLRTGLRAVAEPLRMSLALLLRVRRLRLDRAERAQGRQLLRVRAAAQEHTERQAAQRDYRDWRLAEEQRLFLACQAAMLDRRRLEAWQQQVGLLREKEAGLEQDCAETAQRLEGERERLRQCRRELLERQRQLEKFAELERHVDAERQGLRERSEEGELEEFTRHETWPCSS

SEQ ID NO: 2792 - protein, 67 aa, Streptococcus pneumoniae
  misc_feature (B) LOCATION 1...67
  hypothetical: YES
AFNPINNVAFQPRFGIQPCLSVGIFYSGLYLLENIISFSKLYYYIMFLRTCKVFFDKKQKYNRLKLE

SEQ ID NO: 2793 - protein, 152 aa, Streptococcus pneumoniae
  misc_feature (B) LOCATION 1...152
  hypothetical: YES
PNNPFVFCLEADNQEQLFDQVASLLEEREIVTPTYREALITREKSFPTGLDMEFLGKDLPNVAIPHTDIVHNLAEKVVVVRLEKPVTFHNMIAPGKEVEVSLLFFIINNSSSSQTNILAQLMDFFTGNGHLEDLSKISEPEKLYAYIAEATA

SEQ ID NO: 2794 - protein, 248 aa, Streptococcus pneumoniae
  misc_feature (B) LOCATION 1...248
  hypothetical: YES
TPNPPLLHAKRGLESENHFMKKPVIGITGNEKTHPDDDIMMSYAAKGFVEGVKDAGGIPIILPIGDQEMACHYISLIDKLILTGGQNVDPKFYGEPKTIDSDDYHLQRDIFELALIKEAIKQKKPIFSVCRGTQLFNVAMGGTLYQDIEDHWQDSSVEYTTQRLVTEPDTVLQEIYGEISHINSFHHQSIKDLAPNLKVVAHDPKDGIIEAVMSTDDVAFLGVQWHPELLFENRPKDKKLFDYVVNEL

SEQ ID NO: 2795 - protein, 331 aa, Streptococcus pneumoniae
  misc_feature (B) LOCATION 1...331
  hypothetical: YES
VMSPICEPHFSDTSYGFRPNRSCEKAIMKLLEYLNDGYEWIVDIDLEKFFDTVPQDRLMSLVHNIIEDGDTESLIRKYLHSGVIINGQRYKTLVGTPQGGNLSPLLSNIMLNELDKELEKRGLRFVRYADDCVITVVSEAAAKRMMYSVSRFIEKRLGLKVNMTKTKITRPRELKYLGFGFWKSSDGWKSRPHQDSVRRFKLKLKKLTQRKWSIDLTRRIEQLNLSIRGWINYFSLGNMKSIVASIDERLRTRLRVIIWKQWKKKSRRLWGLLKLGVPKWIADKVSGWGDHYQLVAQKSVLKRAISKPVLEKRGLVSCLDYYLERHALKVS

SEQ ID NO: 2796 - protein, 221 aa, Streptococcus pneumoniae
  misc_feature (B) LOCATION 1...221
  hypothetical: YES
WFLPRLRYDIELGNQLAQDLGVKVKYISVDAANRAEYLISNKVDITLANFTVTDERKKQVDFALPYMKVSLGVVSPKTGLITDVKQLEGKTLIVTKGTTAETYFEKNHPEIKLQKYDQYSDSYQALLDGRGDAFSTDNTEVLAWALENKGFEVGITSLGDPDTIAAAVQKGNQELLDFINKDIEKLGKENFFHKAYEKTLHPTYGDAAKADDLVVEGGKVD

SEQ ID NO: 2797 - protein, 392 aa, Streptococcus pneumoniae
  misc_feature (B) LOCATION 1...392
  hypothetical: YES
KELPMNYLVISPYYPQNFQQFTIELANKGITALGIGQESYEQLDEPLRNSLTEYFRVDNLENIDEVKRAVAFLFYKHGPIDRIESHNEYWLELDATLREQFNVFGAKPEDLKKTKYKSEMKKLFKKAGVPVVPGAVIKTEADVDQAVKEIGLPMIAKPDNGVRAAATFKLETEDDINHFKQEWDHSTLYFFEKFVTSSEICTFDGLVDKDGKIVFSTTFDYAYTPLDLMIYKMDNSYYVLKDMDPKLRKYGEAIVKEFGMKERFFHIEFFREGDDYITIEYNNRPAGGFTIDVYNFAHSLDLYRGYAAIVAGEEFPASDFETQYCLATSRRANAHYVYSEEDLLAKYSQQFKVKKVMPAAFAELQGDYLYMLTTPSRQEMEQMIADFGQRQE

SEQ ID NO: 2798 - protein, 264 aa, Streptococcus pneumoniae
  misc_feature (B) LOCATION 1...264
  hypothetical: YES
PPLPTVTPREPHFAHHSGLPLYAALTRGACSNFSSPTPHTPTLPLQQIPSQLLPLFPNPVASPRHTSVQPISPCRHGPPHTNCPPLTPLHPSPDRPRLNPGHPTSLHPPFPRMPPPSTRPIPHRARATPPPHPHHRPPHANPPTPPPAGIRRPTPGPHRTGLTAPPRPRTPPPLRHQPTPAPLPHPQRTSRPAPRQPQNPPATHPAPPPTYRPCSRPPAPSXPXXXXXXXFXXXXXXXXXXXXXTTQTGKQLATLTLLTTVLPT

SEQ ID NO: 2799 - protein, 116 aa, Streptococcus pneumoniae
  misc_feature (B) LOCATION 1...116
  hypothetical: YES
SISFDETAIFGELIRYLDQYEDVILREIKAQFPDVAVDKLMEEYIKAGLILRENKRYYLNFPTLESLDSLELDQEIFVREASPVYQALLEQSFETELRNQINAAILVERRTLRALK

SEQ ID NO: 2800 - protein, 75 aa, Streptococcus pneumoniae
  misc_feature (B) LOCATION 1...75
  hypothetical: YES
FLIPAIVKPEVFSSAKPHSVFTTMCPCHHESPNDLTRKYDFYVYPNSIMTFFSKVNISHFFNDKKEAANRPTSCF

SEQ ID NO: 2801 - protein, 143 aa, Streptococcus pneumoniae
  misc_feature (B) LOCATION 1...143
  hypothetical: YES
FLIPAIVKPEVFSSAKPHSVFTTMCPCHHESPNDLTRKYDFYVYPNSIMTFFSKVNISHFFNDKKEATNRPTSYSEPITPSLFSFIRFLSDCNLVFDLVIPLTGTTMSNCSRSYLMRYFNQFFRNQRAAQGRYQGILLFIIGM

SEQ ID NO: 2802 - protein, 73 aa, Streptococcus pneumoniae
  misc_feature (B) LOCATION 1...73
  hypothetical: YES
KPIPNIISLAAEKPSFLASKNNIKDDVSPQVIEIIPVVKLFVFNTNMQKTAAIDEELVTPIISGLARGFLNIV

SEQ ID NO: 2803 - protein, 127 aa, Streptococcus pneumoniae
  misc_feature (B) LOCATION 1...127
  hypothetical: YES
QKIPTIQSSSNKEKNMSNIYDSANELSRGLRGLPEYKAVKAAKDAIAADAEASKIFTEYLAFQEEIQKLAQTGQMPDASFQAKMEGFGKQIQGNSLLSEFFTKQQQLAIYLSDIEKIVFEPVSELLK

SEQ ID NO: 2804 - protein, 612 aa, Streptococcus pneumoniae
  misc_feature (B) LOCATION 1...612
  hypothetical: YES
TSIPAQNLRAVSLLANLSKKIAQSTISNISNSCLTNCSITKKKLAPSKLRSSNMAYTLKPEEVGVFAIGGLGEIGKNTYGIEYQDEIIIVDAGIKFPEDDLLGIDYVIPDYSYIVDNIDRVKAVLITHGHEDHIGGIPFLLKQANVPIYAGPLALALIRGKLEEHGLLRNAKLYEINHNTELTFKNLKATFFRTTHSIPEPLGIVIHTPQGKIVCTGDFKFDFTPVGEPADLHRMAALGEEGVLCLLSDSTNAEVPTFTNSEKVVGQSIMKIIQGIEGRIIFASFASNIFRLQQATEAAVKTGRKIAVFGRSMEKAIVNGIDLGYIKAPKGTFIEPNEIKDYPAGEVLILCTGSQGEPMAALSRIANGTHRQVQLQPGDTVIFSSSPIPGNTTSVNKLINIISEAGVEVIHGKVNNIHTSGHGGQQEQKLMLCLIKPKYFMPVHGEYRMQKVHAGLAVDTGVEKDNIFIMSNGDVLALTADSARIAGHFNAQDIYVDGNRIGEIGAAVLKDRRDLSEDGVVLAVATVDFKSQMILSGPDILSRGFVYMRESGDLIRQSQRILFNAIRIALKNKDASVQSVNGAIVNAIRPFLYENTEREPIIIPMILTPDEE

SEQ ID NO: 2805 - protein, 81 aa, Streptococcus pneumoniae
  misc_feature (B) LOCATION 1...81
  hypothetical: YES
SIVPGMMVIPLPVPASPRIEANPPPIAPAINERKNGLRKRKFTPKIAGSVIPRKAERAAGKASVFSFGFFVLTPTATVAAP

SEQ ID NO: 2806 - protein, 247 aa, Streptococcus pneumoniae
  misc_feature (B) LOCATION 1...247
  hypothetical: YES
GDSFRRSKPSMTETIKLMKAHTSVRRFKEQVLPQEDLTEILTAAQMASSWKNFQSYSVIVVRSQEKKDALYELVPQEAIRQSAVFLLFVGDLNRAEKGARLHTDTFQPQGVEGLLISSVDAALAGQNALLAAESLGYGGVIIGLVRYKSEEVAELFNLPDYTYSVFGMALGVPNQTHDVKPRLPLDNVVFEEEYQEQSTEAIQAYDRVQADYAGARATTSWSQRLAEQFGQAEPSSTRKNLKQKKLL

SEQ ID NO: 2807 - protein, 158 aa, Streptococcus pneumoniae
  misc_feature (B) LOCATION 1...158
  hypothetical: YES
SSVPLPIGPVPFTLQNFAIGLIATVFRPREAVLSAGLYLLLGAIGLPVFAGGGAGFQALVGPTAGYLWFYLVYSGLTSSLTNSKSGVVKIFLANLLGDALVFVGGILSLHFLAGMAFEKALVVGVLPFIIPDLGKLLAISFISRPLLQRLKNQTYFTN

SEQ ID NO: 2808 - protein, 155 aa, Streptococcus pneumoniae
  misc_feature (B) LOCATION 1...155
  hypothetical: YES
DYPPQEPFITATMKEVDELAELDIEVISLDCTKRERYDGLEIQEFIRQVKEKYPNQLLMADTSIFEEGLAAVEAGIDFVGTTLSGYTSYSPKVDGPDFELIKKLCDAGVDVIAEGKIHTPEQAKQILEYGVRGIVVGGAITRPKEITERFVASLK

SEQ ID NO: 2809 - protein, 301 aa, Streptococcus pneumoniae
  misc_feature (B) LOCATION 1...301
  hypothetical: YES
MTAFQQLPSSVLQTGAIFLSIIIEALPFVLIGSIVSGLIEVYITPDKVYHFLPRNRWGRIFFGTFVGILFPSCECGIVPIINRFLEKKVPSYTAVPFLVTAPVINPIVLFATYSAFGNSFHVALLRALGSIVVAVILGIFLGFFWQEPIQKENRLACHEHDFSHLSPAKKVFQVFVQAIDEFFDTGRYLVFGCLFASVIQVYVPTRILTSISATPLFAILLLMILAFLLSLCSEADAFIGASLLSSFGLAPVLAFLVIGPMLDIKNILMMKNYLKARFISHFITIVTLVVLAYSLLIGVIL

SEQ ID NO: 2810 - protein, 118 aa, Streptococcus pneumoniae
  misc_feature (B) LOCATION 1...118
  hypothetical: YES
FSSLTLTIPRSIRPEATVPRPVIENTSSTGRSNGLSVSRSGSGIYSSTVFINSITMSSYLESPSRALSAEPWITGRSSPGKSYSDNRSRISISTNSSNSSSSTKSTLFMKTIRCLTPT

SEQ ID NO: 2811 - protein, 523 aa, Streptococcus pneumoniae
  misc_feature (B) LOCATION 1...523
  hypothetical: YES
LTTPGHVDFTYEVSRSLAACEGAILVVDAAQGIEAQTLANVYLALDNDLEIMPIINKIDLPAADPERVRTEIEDVIGLDASEAVLASAKAGIGIEEILEQIVEKVPAPTGDVTAPLKALIFDSVYDAYRGVILQVRVMDGVVKPGDKIQLMSNSKTFDVAEVGIFTPKAVGRDFLATGDVGYIAASIKTVQDTRVGDTVTLATNPAAEPLHGYKQMNPMVFAGLYPIESNKYNDLREALEKMQLNDASLQFEPETSQALGFGFRCGFLGLLHMDVIQERLEREFNIDLIMTAPSVIYKVNLTDGESMDVSNPSEFPDPTKIATIEEPYVKAQIMVPQEFVGAVMELAQRKRGDFVTMDYIDDNRVNVIYQIPLAEIVFDFFDKLKSSTRGYASFDYELSEYRPSKLVKMDILLNGDKVDALSFIVHKDFAYERGKLIVDKLKKIIPRQQFEVPIQAAIGHKIVARTDIKALRKNVLAKCYGGDVSRKRKLLEKQKAGKKRMKSIGSVEVPQEAFLSVLSMDEE

SEQ ID NO: 2812 - protein, 63 aa, Streptococcus pneumoniae
  misc_feature (B) LOCATION 1...63
  hypothetical: YES
SYRPIHXCXIFTFPKLEHVKFIGLTHCGRIWEGWGVPXERIIVVKPGDHIGIKRYEDSCSRII

SEQ ID NO: 2813 - protein, 172 aa, Streptococcus pneumoniae
  misc_feature (B) LOCATION 1...172
  hypothetical: YES
EGRPIYIRLEVDKKDRIWGLLAYQEDFQRLARPAYNNMQNQNWPAIVYRLKLSGTFVYLPENNMLGFIHPSERYAEPRLGQVLDARVIGFREVDRTLNLSLKPRSFEMLENDAQMILTYLESNGGFMTLNDKSSPDDIKATFGISKGQFKKALGGLMKAGKIKQDQFGTELI

SEQ ID NO: 2814 - protein, 172 aa, Streptococcus pneumoniae
  misc_feature (B) LOCATION 1...172
  hypothetical: YES
GTRPRKVALFLKNFNSLKHLAPVYIDETGIDRYLYRPYARAPRGEKVYEKISGRRFERTSIVAGQVDGEFIAPMIYKKSMTSDFFVEWFKTQLLPALKTPHVIVMGNASFHPKNILDELCIQDKHFFLPLPPYSPDLNPIEQAWAILKKKVTDVLREVSTIFECLECFFKTR

SEQ ID NO: 2815 - protein, 131 aa, Streptococcus pneumoniae
  misc_feature (B) LOCATION 1...131
  hypothetical: YES
KGGPAMQDSGIQVLFQGNNLLRILQGLGVTIGISILSVLLSMMFGTVMGIIMTSHSRIIRFLTRLYLEFIRIMPQLVLLFIVYFGLARNFNINISGETSAIIIFTLWGTAEMGDLVRGAITSLPKHQFESG

SEQ ID NO: 2816 - protein, 73 aa, Streptococcus pneumoniae
  misc_feature (B) LOCATION 1...73
  hypothetical: YES
RPGPCMLLSSTSTALFDPLIEVTQNFSTLQTSMVSAGRVFALIDESTYEPLQENGQAKVKEGNISFGTCVYLV

SEQ ID NO: 2817 - protein, 95 aa, Streptococcus pneumoniae
  misc_feature (B) LOCATION 1...95
  hypothetical: YES
PIALLPHMRKHVKRFVFNKRKRFYCVRSRIKSFSIVVGRFTSFSPEIEFLPSRFIHHLKTVFYTLRKSLQITSASPYRTQVQPEASFLVCFLIFI

SEQ ID NO: 2818 - protein, 65 aa, Streptococcus pneumoniae
  misc_feature (B) LOCATION 1...65
  hypothetical: YES
IPLPLKEIKPSFYQIRQMVWMISEHKSCQPFALRRNNRLILFENLFKPRQRRLAVYLQPQNSVLS

SEQ ID NO: 2819 - protein, 721 aa, Streptococcus pneumoniae
  misc_feature (B) LOCATION 1...721
  hypothetical: YES
KELPMTSYKRTFVPQIDARDCGVAALASIAKFYGSDFSLAHLRELAKTNKEGTTALGIVKAADEMGFETRPVQADKTLFDMSDVPYPFIVHVNKEGKLQHYYVVYQTKKDYLIIGDPDPSVKITKMSKERFFSEWTGVAIFLAPKPSYQPHKDKKNGLLSFLPLIFKQKSLIAYIVLSSLLVTIINIGGSYYLQGILDEYIPNQMKSTLGIISVGLVITYILQQVMSFSRDYLLTVLSQRLSIDVILSYIRHIFELPMSFFATRRTGEIISRFTDANSIIDALASTILSLFLDVSILILVGGVLLAQNPNLFLLSLLSIPIYMFIIFSFMKPFEKMNHDVMQSNSMVSSAIIEDINGIETIKSLTSEENRYQNIDSEFVDYLEKSFKLSKYSILQTSLKQGTKLVLNILILWFGAQLVMSSKISIGQLITFNTLFSYFTTPMENIINLQTKLQSAKVANNRLNEVYLVESEFQVQENPVHSHFLMGDIEFDDLSYKYGFGRDTLTDINLTIKQGDKVSLVGVSGSGKTTLAKMIVNFFEPYKGHISINYQDIKNIDKKVLRRHINYLPQQAYIFNGSILENLTLGGNHMISQEDILRACELAEIRQDIERMPMGYQTQLSDGAGLSGGQKQRIALARALLTKAPVLILDEATSGLDVLTEKKVIDNLISLTDKTILFVAHRLSIAERTNRVIVLDQGKIIEVGSHQELMQAQGFYHHLFNK

SEQ ID NO: 2820 - protein, 248 aa, Streptococcus pneumoniae
  misc_feature (B) LOCATION 1...248
  hypothetical: YES
DSMPMRDRISAFLEEKQGLSVNSKQSYKYDLEQFLDMVGERISETSLKIYQAQLANLKISAQKRKISACNQFLYFLYQKGEVDSFYRLELAKQAEKKTEKPEILYLDSFWQESDHPEGRLLALLILEMGLLPSEILAIKVADINLDFQVLRISKASQQRIVTIPTALLSELEPLMGQTYLFERGGKPYSRQWAFRQLESFVKEKGFPSLSAQVLREQFILRQIENKVDLYEIAKKLGLKTVLTLEKYR

SEQ ID NO: 2821 - protein, 221 aa, Streptococcus pneumoniae
  misc_feature (B) LOCATION 1...221
  hypothetical: YES
AVSPKMGLGAYHCFNLSSQYSGAGMGAILETQRELREVLNDGVKPCDLHAEILPSGGDKKHYPIAFNALPQIDVFTDNDYTYEEMKMTKETKKIMEDDSIAVSATCVRIPVLSAHSESVYIETKEVAPIEEVKAAIAAFPGAVLEDDVAHQIYPQAINAVGSRDTFVGRIRKDLDAEKGIHMWVVSDNLLKGAAWNSVQIAETLHERGLVRPTAELKFELK

SEQ ID NO: 2822 - protein, 68 aa, Streptococcus pneumoniae
  misc_feature (B) LOCATION 1...68
  hypothetical: YES
AFSPNVIPCKIPPVPFFQSSYHLLAFAYYIIICVHLSKHSDTLVIEKASLKLTLKGPSLVQYRTQSSF

SEQ ID NO: 2823 - protein, 311 aa, Streptococcus pneumoniae
  misc_feature (B) LOCATION 1...311
  hypothetical: YES
LVAPMEPATCVRVSSLTFLFWEPMPMPWYRFMAMTMRLSRLTLRPTKIVSFLWIPMIPFASVYQLPFRWRVSWVIRLTLWVCGLTLGILPTFLRKSVSNWTRLDLQRLRFMLLMIWTKILSSISRCKRPRLMSGVWVPQLITAYDQPALGAVYKIVAIEDETGQMRNTIKLSNNAEKVSTPGKKQVWRITSREKGKSEGDYITYDGVDISDMTEIKMFHPTYTYIKKTVRNFDAVPLLVDIFKEGILVYNLPSLTDIQDYARKEFDKLWDEYKRVLNPQHYPVDLARDVWQDKMDLIDKMRKEALGEGEEE

SEQ ID NO: 2824 - protein, 143 aa, Streptococcus pneumoniae
  misc_feature (B) LOCATION 1...143
  hypothetical: YES
SPQPRYWISNLAPTFSSMILLAFANNSSKLSGLSPIWYILITGLSPESAAFLLLPVKFPQAARPAARATTLADAKAYFFQFFMIKTPFFIFKLINNVMILYSMKIKEQTRKLAAGCSKHCFEVVDKTDEVSYIYLRQGDVDTV

SEQ ID NO: 2825 - protein, 197 aa, Streptococcus pneumoniae
  misc_feature (B) LOCATION 1...197
  hypothetical: YES
PRQPTNWASRLLRSMLFHTENWTRPDQEVKFIMNLPVEFYDNYVPELHANNVKIQMIGETDRLPKQTFEALTKAEELTKNNTGLILNFALNYGGRAEITQALKLISQDVLDAKINPGDITEELIGNYLFTQHLPKDLRDPDLIIRTSGELRLSNFLPWQGAYSELYFTDTLWPDFDEAALQEAILAYNRRHRRFGGV

SEQ ID NO: 2826 - protein, 168 aa, Streptococcus pneumoniae
  misc_feature (B) LOCATION 1...168
  hypothetical: YES
SCKPWSFPYRKPFKSLGKDDLEIINRSMVKANVEDLANNLVEELSGGQRQRVWIALALAQDTSILLLDEPTTYLDISYQIELLDLLTDLNQKYKTTICMILHDINLTARYADYLFAIKEGKLVAEGKPEDILNDKLVKDIFNLEAKIIRDPISNSPLMIPIGKHHVSS

SEQ ID NO: 2827 - protein, 115 aa, Streptococcus pneumoniae
  misc_feature (B) LOCATION 1...115
  hypothetical: YES
ISKPTQTPSVFKVKSVISVIPIAKIYCKHSNNKLIKKPVPTILKLDKLVFIKGKQTPNGIKKIRLNNISAKTIFPSTISGSENGIQLIYLGAKKNAINSGFVSNLNKIPQVNNIR

SEQ ID NO: 2828 - protein, 81 aa, Streptococcus pneumoniae
  misc_feature (B) LOCATION 1...81
  hypothetical: YES
RRALNQSFQKPRAVKSVMVAIPGSDNGKQIWKKIRASLAPSIRADSRMASGMVFLKKERIKMMLNGERSIGTIKAQTVSPS

SEQ ID NO: 2829 - protein, 229 aa, Streptococcus pneumoniae
  misc_feature (B) LOCATION 1...229
  hypothetical: YES
HAEPAPTSLPPPPIHPRSPSSRSHRNFSLCSQTPWPHHGTHPCSPYLPADTALLTPTAPHSPHSTRPRTAPASTPATPLPSTPRSPACRPPPRGQSPTAREQLPPPTPTTARRTPTPPRPPPQESAAPPRAHTAPASPPHPAPAHPPHSATSPHRPPYHTPNERAAPPHASPKTPPPPTPPRRXPTAHARDPPHRASHXXXXXXXFXXXXXXXXXXXXXLHKLASSWRP

SEQ ID NO: 2830 - protein, 405 aa, Streptococcus pneumoniae
  misc_feature (B) LOCATION 1...405
  hypothetical: YES
QYFLRGDIFMSERKLFTSESVSEGHPDKIADQISDAILDAILAKDPEAHVAAETAVYTGSVHVFGEISTNAYVDINRVVRDTIAEIGYTNTEYGFSAETVGVHPSLVEQSPDIAQGVNEALEVRGNADQDPLDLIGAGDQGLMFGFAVDETEELMPLPIALSHKLVRRLAELRKSGEISYLRPDAKSQVTVEYDENDRPVRVDTVVISTQHDPEATNEQIHQDVIDKVIKEVIPSSYLDDKTKFFINPTGRFVIGGPQGDSGLTGRKIIVDTYGGYSRHGGGAFSGKDATKVDRSASYAARYIAKNIVAAGLAKKAEVQLAYAIGVAQPVSVRIDTFGTGTVAESQLEKAARQIFDLRPAGIIQMLDLKRPIYRQTSAYGHMGRTDIDLPWERLDKVDALKEAVK

SEQ ID NO: 2831 - protein, 253 aa, Streptococcus pneumoniae
  misc_feature (B) LOCATION 1...253
  hypothetical: YES
SSWPSKVSLFAKEAGVLAGLTVFQRVFTLFDAEVTFQNPHQFKDGDRLTSGDLVLEIIGSVRSLLTCERVALNFLQHLSGIASMTAAYVEALGDDCIKVFDTRKTTPNLRLFEKYAVRVGGGYNHRFNLSDAIMLKDNHIAAVGSVQKAIAQARAYAPFVKMVEVEVESLAAAEEAAAAGADIIMLDNMSLEQIEQAITLIAGRSRIECSGNIDMTTISRFRGLAIDYVSSGSLTHSAKSLDFSMKGLTYLDV

SEQ ID NO: 2832 - protein, 68 aa, Streptococcus pneumoniae
  misc_feature (B) LOCATION 1...68
  hypothetical: YES
DLAFVMESDSRSFFLCHTLRKSLQTTSVLSETSKLCFEQPATSFLVCFLIFIEYQFEWKMESYHLVMS

SEQ ID NO: 2833 - protein, 127 aa, Streptococcus pneumoniae
  misc_feature (B) LOCATION 1...127
  hypothetical: YES
LLRPGSQGVVFGALTADKKLDKPNLEKLIAASKGMEIVFHMAFDELSDEDQPEAIDWLSQAGVTRILTRAGVSGDSLEKRFVHYHRILEYAKGKIEILPGGGIDLDNRQTFIDQVGVTQLHGTKVVF

SEQ ID NO: 2834 - protein, 316 aa, Streptococcus pneumoniae
  misc_feature (B) LOCATION 1...316
  hypothetical: YES
YCGPQKTSQELNVLKNTYNTFHKMEELQDEVEILLDFLAEDESVHDELVAQLAELDKIMTSYEMTLLLSEPYDHNNAILEIHPGSGGTEAQDWGDMLLRMYTRYGNAKGFKVEVLDYQAGDEAGIKSVTLSFEGPNAYGLLKSEMGVHRLVRISPFDSAKRRHTSFTSVEVMPELDDTIEVEIREDDIKMDTFRSGGAGGQNVNKVSTGVRLTHIPTGIVVQSTVDRTQYGNRDRAMKMLQAKLYQMEQEKKAAEVDSLKGEKKEITWGSQIRSYVFTPYTMVKDHRTSFEVAQVDKVMDGDLDGFIDAYLKWRIS

SEQ ID NO: 2835 - protein, 690 aa, Streptococcus pneumoniae
  misc_feature (B) LOCATION 1...690
  hypothetical: YES
DFKLEMRLICMIKFNSHSIPIRLNLLFSIVILLFMTIIGRLLYMQVLNKDFYEKKLASASQTKITSSSARGEIYDASGKPLVENTLKQVVSFTRSNKMTATDLKETAKKLLTYVSISSPNLTERQLADYYLADPEIYKKTVEALPSEKRLDSDGNRLSESELYNNAVDSVQTSQLNYTEDEKKEIYLFSQLNAVGNFATGTIATDPLNDSQVAVIASISKEMPGISISTSWDRKVLETSLSSIVGSVSSEKAGLPAEEAEAYLKKGYSLNDRVGTSYLEKQYEETLQGKRSVKEIHLDKYGNMESVDTIEEGSKGNNIKLTIDLAFQDSVDALLKSYFNSELENGGAKYSEGVYAVALNPKTGAVLSMSGIKHDLKTGELTPDSLGTVTNVFVPGSVVKAATISSGWENGVLSGNQTLTDQSIVFQGSAPINSWYTQAYGSFPITAVQALEYSSNTYMVQTALGLMGQTYQPNMFVGTSNLESAMEKLRSTFGEYGLGTATGIDLPDESTGFVPKEYSFANYITNAFGQFDNYTPMQLAQYVATIANNGVRVAPRIVEGIYGNNDKGGLGDLIQQLQPTEMNKVNISDSDMSILHQGFYQVAHGTSGLTTGRAFSNGALVSISGKTGTAESYVADGQQATNTNAVAYAPSDNPQIAVAVVFPHNTNLTNGVGPSIARDIINLYQKYHPMN

SEQ ID NO: 2836 - protein, 68 aa, Streptococcus pneumoniae
  misc_feature (B) LOCATION 1...68
  hypothetical: YES
YNKFMNKQQFIIMALFTAAETYFFNEAWMTGRYIMAAFWAILLFRNFRVSYVMGKIVDVIDQHFNRKD

SEQ ID NO: 2837 - protein, 80 aa, Streptococcus pneumoniae
  misc_feature (B) LOCATION 1...80
  hypothetical: YES
VLKLKKEPLLIQLPPMYEALEVAPMHPTGPTPATETVDSYRDMKHRKNLLQFYKKYSENNILSLYIPASRRWCESCIPYR

SEQ ID NO: 2838 - protein, 99 aa, Streptococcus pneumoniae
  misc_feature (B) LOCATION 1...99
  hypothetical: YES
QIFTVQMHRRSLHLLTAWNKRQDSAWQILCPFTMQCATSWLLAQLTSFFVVPTICSLCVIAWIASLSQFWMKWDDSMTGQKKKKQLTVLMSKQLSLTTI

SEQ ID NO: 2839 - protein, 574 aa, Streptococcus pneumoniae
  misc_feature (B) LOCATION 1...574
  hypothetical: YES
LNFTREELNKMDKLIIFIEKGKPFFEKLSRNIYLRAIKDGFISSMPAVLFSSIFILIAAVPNIFGFKWSDEQLAFILKPYNYSMGILALLVAGTTAKSLTDSVNTRSMEKTNQINYMSTFLAAVVGLLILAADPIEGGFANGLLGTRGLLTAFLAAFITVNIYKVCIKNNVTIRLPEEVPPNIAQVFKDVIPFALSVLSIYGLDLIVRNIFGTNVAESVGKILAPLFSATDGYIGLAIVFGAYAFFWFVGIHGPSVVEPLIVAISYANIEANVQLVQAGMHADKILNPVTQTFVVTMGGTGATLVVPFMFMWLCKSKRNRIVGRASVVPTFFGVNEPILFGAPIVLNPIFFIPFVTAPIINVWIMKFFVDVLQMNSFSIILPWTTPAPIGIVMGTALAPLSFVLAITLIIIDTLIYYPFVKVYDHQILEEERKGNSSSELKEKVAANFNTVKADAILEKAGVDAAQNTITEETNVLVLCAGGGTSGLLANALNKAAAEYNVPVKATAGGYGAHREMLPEFDLVILAPQVASNFEDMKAETDKLGIKLAKTEGAQYIKLTRDGKGALAFVQEQFD

SEQ ID NO: 2840 - protein, 73 aa, Streptococcus pneumoniae
  misc_feature (B) LOCATION 1...73
  hypothetical: YES
MIFTMAHDQRGGSMKDLFLKRKQAFRRECLGYLRYVLNDHFVLFLLVLLGFLATSTVNSYNIFLKIIGLSFCL

SEQ ID NO: 2841 - protein, 190 aa, Streptococcus pneumoniae
  misc_feature (B) LOCATION 1...190
  hypothetical: YES
SSFTGGNLTGQLTEKIQEHELIKTNQAEKSVQDVLDNCIERVQNNSLKSDRVTSFETPFALLFIFATIAVMLTYGGYRVSAGYISVGTLVSFLIYLFQLLNPISNIANFVTVYSRSKGSSVALDNLLAVPKEKFEGGKSVSGQGLNFNHVYFGYDENRPVLKDITCSIFKGQKLLLLDHLDQENQRLCVC

SEQ ID NO: 2842 - protein, 263 aa, Streptococcus pneumoniae
  misc_feature (B) LOCATION 1...263
  hypothetical: YES
KRFTRCCKTYSWSTMIHLTIEYCDNIIDPYTNLGEQQRIASELDLLSKLILRRQEQLEELNLLVKSRFNEMFGENKIFESIDNLFDIIDGDRGKNYPKSDELFSEEYCLFLNTKNVTKNGFSFDTKQFITKTKDKLLRKGKLERYDIVLTTRGTVGNVAYYDELIKYKHLRINSGMVILRPKTPNLNQKFIIHVLRNNNYSRVISGSAQPQLPITKLKKILLPLPPLALQNEFADFVVQVDKSQFACEIAIKVWRNSLKFSII

SEQ ID NO: 2843 - protein, 156 aa, Streptococcus pneumoniae
  misc_feature (B) LOCATION 1...156
  hypothetical: YES
ITLTTIYTVDERDGTIEETTSRQITKEMVKRRIRRGTREPEKVVVPEQSSIPSYPVSVTSNQGTDVAVEPAKAVAPTTGWKQENGMWYFYNTDGSMATGWVQVNGSWYYLNSNGSMKVNQWFQVGGKWYYVNASGELAVNTSIDGYRVNDNGEWVR

SEQ ID NO: 2844 - protein, 180 aa, Streptococcus pneumoniae
  misc_feature (B) LOCATION 1...180
  hypothetical: YES
IMKLLSIAIPSYNAAAYLHYCVESLVIGGEQVGILIINDGSQDQTQEIAECLASKYPNIVRAIYQENKCHGGAVNRGLAEASGRYFKVVDSDDWVDPRAYLKILETLQELESKGQEVDVFVTNFVYEKEGQSRKKSMSYDSVLPVRQIFGWDQVGNFSKGQYTMMHSLIYRTDLLRASQF

SEQ ID NO: 2845 - protein, 651 aa, Streptococcus pneumoniae
  misc_feature (B) LOCATION 1...651
  hypothetical: YES
KTLTGEREYMDNREALKTFMTGENFYLQHYLGAHREELNGEYGYTFRVWAPNAQAVHLVGDFTNWIENQIPMVRNDFGVWEVFTNMAQEGHIYKYHVTRQNGHQLMKIDPFAVRYEARPGTGAIVTELPDKKWRDGLWLARRKRWGFAERPVNIYEVHAGSWKRNPDGSPYSFAQLKDELIPYLVEMNYTHIEFMPLMSHPLGLSWGYQLMGYFALEHAYGRPEEFQDFVEECHTHNIGVIVDWVPGHFTINDDALAYYDGTPTFEYQDHNKAHNHGWGALNFDLGKNEVQSFLISCIKHWIDIYHLDGIRVDAVSNMLYLDYDDAPWTPNKDGGNLNYEGYYFLQRLNEVIKLEYPDVMMIAEESSSATKITGMKEIGGLGFDYKWNMGWMNDILRFYEEDPIYRKYDFNLVTFSFMYVFKENYLLPFSHDEVVHGKKSMMHKMWGDRYNQFAGLRNLYTYQICHPGKKLLFMGSEYGQFLEWKSEEQLEWSNLEDPMNAKMKYFTSQLNQFYKDHRCLWEIDTSYDGIEIIDADNRDQSVLSFIRKGKKGEMLVCIFNMVPVERKDFTIGLPVAGIYEEVWNTELEEWGGVWKEHNQTVQTQEGLWKDYEQTLTFTLPAMGASVWKIKRRLKSTKTVTNKNQKGVENEK

SEQ ID NO: 2846 - protein, 60 aa, Streptococcus pneumoniae
  misc_feature (B) LOCATION 1...60
  hypothetical: YES
RSITKRRKDKKAEGFPRLFTYYLWLYNIVVGNPPMDIMEPILCRKKVPYVPIMKSDKTTH

SEQ ID NO: 2847 - protein, 461 aa, Streptococcus pneumoniae
  misc_feature (B) LOCATION 1...461
  hypothetical: YES
SLITCMRAIMVEHFSSVSKILTVNAMSRMVNVPQLENLRWLGMDWDESPESHENYRQSERLDLYQKYIDQLLAEGKAYKSYVTEEELAAERERQEVAGETPRYINEYLGMSEEEKAAYIAEREAAGIIPTVRLAVNESGIYKWHDMVKGDIEFEGGNIGGDWIIQKKDGYPTYNFAVAIDDHDMQISHVIRGDDHIANTPKQLMVYEALGWEAPEFGHMTLIINSETGKKLSKRDTNTLQFIEDYRKKGYLAEAVFNFIALLGWNPGSEDEIFSREELIKLFDENRLSKSPAAFDQKKLDWMSNDYIKNADLETILEMAKPFLEEAGRLTDKAEKLVELYKPQMKSVDEIIPLTDLFFSDFPELTEAEREVMTGETVPTVLEAFKAKLEAMTDDKFVTENIFPQIKAVQKETGIKGKNLFMPIRIAVSGEMHGPELPDTIFLLGREKSIQHIENMLKEISK

SEQ ID NO: 2848 - protein, 145 aa, Streptococcus pneumoniae
  misc_feature (B) LOCATION 1...145
  hypothetical: YES
EIITIHDSNDVNRSDVFVDLVSITFSLMNFFKILINLTAQVSPQVIDEKILMMDLNLNNYLSTVIQLRQDVYTGIKILHRVGHGRQDMNVTSLQNSHIFGWQVQHIADKLTSDFWVAENFLSNQVIGRANSQMSENHPFPPSIVN

SEQ ID NO: 2849 - protein, 568 aa, Streptococcus pneumoniae
  misc_feature (B) LOCATION 1...568
  hypothetical: YES
EKITQTSLWKVSTLVLLVEKRRLRMRLKVINKLVDINILYSSQEANLANLRKKQAKNPGKKVNVSARVLSSYIFSSLLMLICFSNIAFRFPFEEMPSFFSTMVAILLVLAFSTSFTAFYNVFYESKDLASYRPYAFKESEIIMAKGLSVLLPALTGIVPILAYFLVLYIRLAPSLWLGLPLMLLSLTLLFVSVTLVTVVAVHFLAQTRVFRKYQSIFSNVMIGIGVLIPLIFIFFLQSTFGSIVDKVRDIPFLLYPLHIFYKIAVEPFSTEALVGLLAWIGLTLFLLYLTKKKVLPRFYDVILLNSEEKVKKERRSKERISTTKKGFFRMVLRYHLTLLGQGTGVITVLFTSAFLPYLMMISLISKIRDSQIVPDIHPPYWLPLFFVGVFIAVVNNNITSLHSIALSLERENVDFLKSLPFDFARYVKVKFWIIFAVQSFLPVLTLLGLSLYLGLPIISMIYLLVVWIIASVILSCHHYFKDVKNLSTNWSSITDLVNRSNGIVAIVLLFIYSAILMALVIGSIFLVQSLSTILAISLGVGALILLLALAIFGYHYYLSRILAEIEKR

SEQ ID NO: 2850 - protein, 78 aa, Streptococcus pneumoniae
  misc_feature (B) LOCATION 1...78
  hypothetical: YES
RLSTRFFKSIIVSCSHLLFFKEKWWGEFFQFFKALLSSICIFTDDKTDIITTKGSDSVREAQSINDRTKGLSQSRKGF

SEQ ID NO: 2851 - protein, 80 aa, Streptococcus pneumoniae
  misc_feature (B) LOCATION 1...80
  hypothetical: YES
RFEFAGFTWSLCLRIYLHGPLIITVSQDFTSLSDISATHFEQLHIMTIVHSDIQRNNSPLTCDNRLSLHSVAFLFTRIIR

SEQ ID NO: 2852 - protein, 80 aa, Streptococcus pneumoniae
  misc_feature (B) LOCATION 1...80
  hypothetical: YES
RLEFAGFTWSLYLRIYLHESLITTVSQDFTSLSDISATHFEQLHIMTIVHSDIQRNNSPLTCDNRLSLHSVAFLFTRIIR

SEQ ID NO: 2853 - protein, 80 aa, Streptococcus pneumoniae
  misc_feature (B) LOCATION 1...80
  hypothetical: YES
RLEFAGFTWSLCLRIYLHEPLITTVSQDFTSLSDISATHFEQLHIMTIVHSDIQRNNSPLTCDNRLSLHSVKFLFTRMIR

SEQ ID NO: 2854 - protein, 83 aa, Streptococcus pneumoniae
  misc_feature (B) LOCATION 1...83
  hypothetical: YES
RLEFAGFTWSLCLRIYLHEPLITTVSQDFTSLSDISATHFEQLHIMTIVHSDIQRNNSPLTCDNRLSLHSVAFFYKNNSLILF

SEQ ID NO: 2855 - protein, 80 aa, Streptococcus pneumoniae
  misc_feature (B) LOCATION 1...80
  hypothetical: YES
RLEFAGFTWSLCLRIYLHGPLITTVSQDFTSLSDISATHFEQLHIMTIVHSDIQRNNSPLTCDNRLSLHSVKFLFTKIIR

SEQ ID NO: 2856 - protein, 105 aa, Streptococcus pneumoniae
  misc_feature (B) LOCATION 1...105
  hypothetical: YES
VGSTCKRLPGKPTFTDLIEMPAFSSAWEMADLIAVAAVSISTIIPSFTPLLLALLTPITFNSPFLCSATSTLTELVPISRPVKKPSLAITSLPLYLPSFALRIIP

SEQ ID NO: 2857 - protein, 75 aa, Streptococcus pneumoniae
  misc_feature (B) LOCATION 1...75
  hypothetical: YES
YTSTSKTLLEIDLTVLIDLSYYYFILLYSVNLYEFKPISSLTSSKAVSNICLRVFDSLQLTDKLSDKICTTSETE

SEQ ID NO: 2858 - protein, 86 aa, Streptococcus pneumoniae
  misc_feature (B) LOCATION 1...86
  hypothetical: YES
YTSTSKTFLEIDLTVLIDLSCSCFILLYRSHSKEFVPKLLGSFFSWTTKELMGIIFFNNFPTVYKNNMMGYISSKTYLIKLIKNSI

SEQ ID NO: 2859 - protein, 63 aa, Streptococcus pneumoniae
  misc_feature (B) LOCATION 1...63
  hypothetical: YES
YTSTSKILLEIDLTILIYLSCSYFISLYLKLSMTKCAPMSWERTFFIFFIFLNPSIKTIGMNF

SEQ ID NO: 2860 - protein, 861 aa, Streptococcus pneumoniae
  misc_feature (B) LOCATION 1...861
  hypothetical: YES
PTEFSIILRGNMKSFLKTYRTYFISFIIPVVIMSGVYLSQGIYWNSDNSPLLGDGFHQYVIFDIALRNILHGNSSLFYTFTSGLGLNFYALSSYYLGSFLAPLVYFFDLTNMPDAIYLTTLLKFGLIGLSTFFSLNKLFQSIPQTLKLALSTSYALMSFTVSQLEIKTWLDVFILIPLIITGLHLLITEKKLLLYFTSLSILFIQNYYFGYMTVLFLIFWYLCQISWDFKTRKSSVLDFIVISFLAGMASLIMTLPTLFDLQTHGEKLTEVTKFQTESSWYLDLFAKQFIGSFDTTKYGAIPMIFVGLLPFILTILFFTLKSIKFHVKLIYVIFFAFLIASFYIEALDLFWQGMHTPNMFLHRYAWIFSTLLIYTAAEVLKRLKELKVWNFLVSLFLVVAGFLATIYLKSHYSFLTDLNILLTLEFLVVYSLLLLAVIKKFISVNLFAILISLFILVEMSLNASSQMDGIAKEWGFASRSAYSRDIPAMESFSTYIGNQFTRTEKLQTQTGNDSMKFNYNGISQFSSVRNRSSSSTLDKLGFKSSGTNLNLRYANNSILADSLFGIQYNISDSPIDKYGFKDIYQKDNLTLYENQYSLPIAVASQSVYNDVKFNEHTLDNQASFLNQLANVNFDYFSPIPYEKTEKIENTNDLISVTSSSNEDAAIQYQIEVPENSQVYLSFINLHFSNDKQKKVDILVNGEKKTFTTDNVFSFFNLGYTKEKKTFNINVSFPGNSQVSFESPTFYRLDTKTFTEAIQKIKEQPVTVSTSKNKVFATYDVQQDTSIFFTIPYDKGWSAYQDGKKIEIKQAQTGFMKVDIPKGKGTITLSFIPYGFITGAICSFTSLLLFGIYNHRRKSSKA

SEQ ID NO: 2861 - protein, 63 aa, Streptococcus pneumoniae
  misc_feature (B) LOCATION 1...63
  hypothetical: YES
RIPTLFHNDINEFSWLKQFGKLFEVGNQQINWLFYNNINQFIWYTNHFHDFLTVNFCFDFFIR

SEQ ID NO: 2862 - protein, 311 aa, Streptococcus pneumoniae
  misc_feature (B) LOCATION 1...311
  hypothetical: YES
MIEFEKPNITKIDENKDYGKFVIEPLERGYGTTLGNSLRRVLLASLPGAAVTSINIDGVLHEFDTVPGVREDVMQIILNIKGIAVKSYVEDEKIIELDVEGPAEVTAGDILTDSDIEIVNPDHYLFTIGEGSSLKATMTVNSGRGYVPADENKKDNAPVGTLAVDSIYTPVTKVNYQVEPARVGSNDGFDKLTLEILTNGTIIPEDALGLSARILTEHLDLFTNLTEIAKSTEVMKEADTESDDRILDRTIEELDLSVRSYNCLKRAGINTVHDLTEKSEAEMMKVRNLGRKSLEEVKLKLIDLGLGLKDK

SEQ ID NO: 2863 - protein, 440 aa, Streptococcus pneumoniae
  misc_feature (B) LOCATION 1...440
  hypothetical: YES
CETTSDLLYGRNRMTKVVFEEKYYPAVKEMVYRTRLANGLTVALLPKKEFKEVYGSVTVQFGSVDTFVTEVDGDVKQYPGGIAHFLEHKLFEREDSSDLMSAFTSLGADSNAFTSFTKTNYLFSATDYFLENLDLLDELVTSAHFTEASILTEQDIIQQEREMYQDDPDSCLFFSTLANLYPGTPLATDIVGSEESISQINLTNLQENFTKFYKPVNMSLFLVGNFDVERVQDYFESKELKDSDFQEVAREKLFLQPVKLTDSMRMEVSSPKLAIGVRGKREVSEADCYRHHILLKLLFAMMFGWTSDRFQKCYESGKIDASLSLEVEITSRFHFVMLTMDTKEPVALSHQFRKAIRNFTKDLDITEEHLDIIKREMFGEFFSSMNSLEFIATQYDAFENGETIFDLPKILQEITLEDVLDAGHHLIDDGDIVDFTIFPS

SEQ ID NO: 2864 - protein, 313 aa, Streptococcus pneumoniae
  misc_feature (B) LOCATION 1...313
  hypothetical: YES
KQTTYRLAQVGVQPYRQVHAHSTGNRNSTVQNEADYHWRKDPELGFFSHVVGNGRIMQVGPVNNGSWDVGGGWNAETYAAVELIESHSTKEEFMADYRLYIELLRNLADEAGLPKTLDTDDLAGIKTHEYCTNNQPNNHSDHVDPYPYLASWGISREQFKQDIENGLSAATGWQKNGTGYWYVHSDGFYPKDKFEKINGTWYYFDGSGYMLSDRWKKHTDGNWYWFDNSGEMATGWKKIAEKWYYFDVEGAMKTGWVKYKDTWYYLDAKEGAMVSNAFIQSADGTGWYYLKPDGSMADKPEFTVEPDGLITVK

SEQ ID NO: 2865 - protein, 417 aa, Streptococcus pneumoniae
  misc_feature (B) LOCATION 1...417
  hypothetical: YES
NKTTMKKIFLTLLTVSLLGGASTAVAQDFTIAAKHAIAVEANTGKILYEKDATQPVEIASITKLITVYLVYEALENGSITLSTPVDISDYPYQLTTNSEASNIPMEARNYTVEELLEATLVSSANSAAIALAEKIAGSEKDFVDMMRAKLLEWGIQDATVVNTTGLNNETLGDNIYPGSKKDEENKLSAYDVAIVARNLIKKYPQVLEITKKPSSTFAGMTITSTNYMLEGMPAYRGGFDGLKTGTTDKAGESFVGTTVEKGMRVITVVLNADHQDNNPYARFTATSSLMDYISSTFTLRKIVQQGDAYQDSKAPVQDGKEDTVTAVAPEDIYLIEQIGNQSSQSVQFTPDSKAIPAPLEAGTVVGHLTYKDKDLIGQGYITTERPSFEMVADKKIEKAFFLKVWWNQFVRFVNEKL

SEQ ID NO: 2866 - protein, 134 aa, Streptococcus pneumoniae
  misc_feature (B) LOCATION 1...134
  hypothetical: YES
LHYTRFGENMLEIKNLTGGYVHVPVLKDVSFTVESGQLVGLIGLNGAGKSTTINEIIGLLAPYSGSININGLTLQGDATSYRKQIGYIPETPSLYEELTLREHIETVAMAYGIEQKVAFERVEPLLKMFRLDRN

SEQ ID NO: 2867 - protein, 112 aa, Streptococcus pneumoniae
  misc_feature (B) LOCATION 1...112
  hypothetical: YES
KNYTPEQQKLHDQFEAEATEDAKKQGDIVLNVDQDFMSISKSNKSGSDWKKTFTVRTTNRLANDLNNVLKQADKDTPNTPTWLNSAASKAKDDDRAYKLLKTLIPGENYLSC

SEQ ID NO: 2868 - protein, 109 aa, Streptococcus pneumoniae
  misc_feature (B) LOCATION 1...109
  hypothetical: YES
SLYTRISLLLWTHTGESFFLIAGGCNTEWMNVFLEELSQAYPDDYLLFVMDNAIWHKSSTLKIPTNIGFAFIPPYTPEMNPIEQVWKEIRKRGFKNKAFQTLEDVMNQL

SEQ ID NO: 2869 - protein, 115 aa, Streptococcus pneumoniae
  misc_feature (B) LOCATION 1...115
  hypothetical: YES
LGELSIPLRQSSTLITTKNIFHCNVIAPSVILSASILTMCLLMWILRVNGKQMKVVSVALAKLLLTVFVKKSKVVLKMLAWKSLKHVSLTYLMLQKLLPLCFNANKHLPLLMHEK

SEQ ID NO: 2870 - protein, 93 aa, Streptococcus pneumoniae
  misc_feature (B) LOCATION 1...93
  hypothetical: YES
FQYTITVPSQPASPVPAPSSAPTQDPRVVASASASSTSTQAQEQVDKSELRALSQELDQRLKALATISDPKIDATKAVLLDAQKAPEDSALTE

SEQ ID NO: 2871 - protein, 273 aa, Streptococcus pneumoniae
  misc_feature (B) LOCATION 1...273
  hypothetical: YES
ARYTRFYYKSFSFSELIGIFLANDKVLGPIQSIAYSLNKINTTKDLRKPFLKYLSGEKNFIDAEHDNNGLYTSSIDVIHMKDVVYSITPENKLSIDFSFKSPFRVLLTGTSGSGKTTILNLINGSLKPQKGYVNLLSHGKKSSDSIPTVDQTPYIFDTTIRENVTLFQNEYFSDDQIIEVLKKVNLYEELEKIDILNYQCGENGSNLSGGQKQKIALARALIRNNKVYLFDEISANLDNDNSNSIHDILFNLGISFIEVSHHYDLNDKRYTDI

SEQ ID NO: 2872 - protein, 501 aa, Streptococcus pneumoniae
  misc_feature (B) LOCATION 1...501
  hypothetical: YES
TKYTSNPFCGVLVGIGMTALIQSSSGVTVITVGLVSAGLLTLRQAIGIVMGANIGTTVTSFLIGFKLGNYALPMLFIGAVCLFFTKNRTVNNIGRILFGVGGIFFALNLMSGAMAPLKDLQVFKDYMIELSKNPVLGVFVGTGLTLLIHASSATIGILQNLYAGNLIDLQGALPVLFGDNIGTTITAIIASLGANIAAKRVAGAHVAFNVIGTVVCVIFLVPFTVLIHWFEATLNLAPEMTIAFAHGTFNITNTIVQFPFIGALAYFVTKIIPGEDEVVKYEPLYLDEHFIKQAPSIALGNAKKELLHLGNYAAKAFDLSYKYIIDLDEKVAEKGHKTEEAINTIDEQLTRYLIALSSEALSQKESEVLTNILDSSRDLERIGDHTEALLNLTDYLQRKNVEFSDAALKELEEVYRQTSDFIKDALDSVENNDIEKARSLVERHEAINKIERVLRKTHIKRLNKGECSTQAGVNFIDIISHYTRVSDHAMNLAEKVFAEQI

SEQ ID NO: 2873 - protein, 66 aa, Streptococcus pneumoniae
  misc_feature (B) LOCATION 1...66
  hypothetical: YES
FFHTNVFLTDNSPFYYIKKSPLSHSKTXLESIWEFFRQRFSVLAANLGQDKEKSPIKGFLGCLHPP

SEQ ID NO: 2874 - protein, 417 aa, Streptococcus pneumoniae
  misc_feature (B) LOCATION 1...417
  hypothetical: YES
IMELVHGISTHFIQSKKFKTNKITVRFTAPLSLDTIAGHMLSASMLETANQMYPTSQDLRRHLASLYGTDMSTNCFRRGQSHIIELTFTYVRDEFLSRKNVLTSQILELVKETLFSPVVVDNGFDPALFEIEKKQLLASLAADMDDSFYFAHKELDKLFFHDERLQLEYSDLRNRILAETPQSSYSCFQEFLANDRIDFFFLGDFNEVEIQNVLESFGFKGRKGDVKVQYCQPYSNILQEGMVRKNVGQSILELGYHYRSKYGDEQHLPMIVMNGLLGGFAHSKLFTNVRENAGLAYTISSELDLFSGFLRMYAGINRENRNQARKMMNNQLLDLKKGYFTEFELNQTKEMIRWSLLLSQDNQSSLIERAYQNALFGKSSADFKSWIAKLEQIDKDAICRVANNVKLQAIYFMEGIE

SEQ ID NO: 2875 - protein, 111 aa, Streptococcus pneumoniae
  misc_feature (B) LOCATION 1...111
  hypothetical: YES
QSEFQVNGSRWFLEMRNIGQAGKILADSGYQGLMKIYPQAQTPRKSSKLKPLTLEDKACNHALSKERSKVENIFAKVKTFKMFSTTYRNHRKRFGLRMNLIAGIINHELGF

SEQ ID NO: 2876 - protein, 63 aa, Streptococcus pneumoniae
  misc_feature (B) LOCATION 1...63
  hypothetical: YES
FQHTIKSGNTTAKKFEFIEIPVQKLKKAIYKAHLKDSDDFRPETSTPNLFESCLKLCPCFLSS

SEQ ID NO: 2877 - protein, 186 aa, Streptococcus pneumoniae
  misc_feature (B) LOCATION 1...186
  hypothetical: YES
HWHTCLLEDGLQTEVFVMLESKKTTRYVFYVYLMLLTWGILFKFETNPEFIAFFLAPRYINWIPFSEPLIVDGKIVFAEMLFNLIFFIPLGVCFPLIKTNLSSLRIVGTGFLISLLFECLQYILAIGITDITDLTLNTLGVCVGLLIYQIFIRVFKSQTRKWINILGMLSLGFAYLVLLLLHLIGV

SEQ ID NO: 2878 - protein, 207 aa, Streptococcus pneumoniae
  misc_feature (B) LOCATION 1...207
  hypothetical: YES
LKEFHMSNEKNTNTNVEKKDATVVAHEIKGELTYEDKVIQKIIGLSLENVSGLLGIDGGFFSNLKEKIVNSDDVTSGVNVEVGKTQVAVDLNVIVEYQKNVPALYSEIREIVSSEVAKMTDLEIVEINVNVVDIKTKEQHEADSVSLQDRVSDVAESTGEFTSEQFEKAKSGLGSGFSTVQEKVSEGVEAVKGAANGVVSHENTRVN

SEQ ID NO: 2879 - protein, 78 aa, Streptococcus pneumoniae
  misc_feature (B) LOCATION 1...78
  hypothetical: YES
IKELIMKVVNLYDLKQMGNKGGCTIQLIHHFPFGMGLGHLKKDYIEFKRVGIFDGKAVEVTLREPYSRDLLQVVKSIK

SEQ ID NO: 2880 - protein, 250 aa, Streptococcus pneumoniae
  misc_feature (B) LOCATION 1...250
  hypothetical: YES
YNNTTFFYVFYKCRKYSHLPRRNNMRWDYGQIFKEIRKSKGLTQQDVCGQVIHRTTLTNIEHGKVIPSFENMVFLLEQIDMSLAEFKYICNEYHPSKRRDIIVESQNPSTFQDTRKMVELTEKCQKYLKTHHDVPIQNIYRHTKIVTELRTKGFKNNHVLKDLSEEIWDYLEPMDTWYISDLKLLGTILFFFPSENLPLLIDRIMKTIEKYKYFRETKVFLSSFLANLSTVYFNIIYSKNVKQSPYNFWY

SEQ ID NO: 2881 - protein, 84 aa, Streptococcus pneumoniae
  misc_feature (B) LOCATION 1...84
  hypothetical: YES
PNNTGSLILKIPGPKDNLATFLETALRLTKNVAINKHNVDPLPPIKANVCICDRLMMCGMACPLFAAVMFSVMLINSNGSRMAL

SEQ ID NO: 2882 - protein, 145 aa, Streptococcus pneumoniae
  misc_feature (B) LOCATION 1...145
  hypothetical: YES
YSNTKTGKAKSAKFRPSFFNLKSLVRIMQTTKVSINNKIDANFIKIIPILYHKKRLMETRNRGIYRKVRLLRLWVIFVIMKVIKSYNTLNDYYRKLFGEKTFKVPIDAGFDCPNRDGTVAHGGCTFCTVSGSGDAIVAPDAPIRE

SEQ ID NO: 2883 - protein, 117 aa, Streptococcus pneumoniae
  misc_feature (B) LOCATION 1...117
  hypothetical: YES
YPNTPVRHKPPWTRYPPHKGAKDSLQELPYRSPPPPKEAGKWQDNRKRPHVPLLKLSYYVPDRHQLFLSFFPFTRRKNVLFFIQVLILSYLFYYIFTKKAIVSIHNRFFHYRTHSPL

SEQ ID NO: 2884 - protein, 92 aa, Streptococcus pneumoniae
  misc_feature (B) LOCATION 1...92
  hypothetical: YES
TENTMFTLKMRPMRTIFGQKKRLNVRSRNTVIIITQEQIMLLLQPEPKDVIQRMMGISSMHLISLRTRVMLISFLTATITITFLRMSYQLAS

SEQ ID NO: 2885 - protein, 191 aa, Streptococcus pneumoniae
  misc_feature (B) LOCATION 1...191
  hypothetical: YES
VMNTVKNKQEILEAFRENPDMMAILTIIRDLGLKDSWLAAGSVRNFIWNLLSDKSPFDHETDIDVIFFDPDFSYEETLLLKKKLREDFPQYQWELKNQVYMHQHSPHTASYTSSRDAMSKYPERCTAVGLRLNEESDFELYVPYGLEDILNFQVRPTPHFLENEDRMELYQTRLSKKNWQEKWKNLIFKNT

SEQ ID NO: 2886 - protein, 88 aa, Streptococcus pneumoniae
  misc_feature (B) LOCATION 1...88
  hypothetical: YES
TMNTNLKPKLQRFASATAFACPICQENLTLLETNFKCCNRHSFDLAKFGYVNLAPQIKQSANYDKENFQNRQQIRRSRLLPSYLRCCI

SEQ ID NO: 2887 - protein, 413 aa, Streptococcus pneumoniae
  misc_feature (B) LOCATION 1...413
  hypothetical: YES
SGDTMKISKRHLLNYSILIPYLLLSILGLIVVYSTTSAILIEEGKSALQLVRNQGIFWIVSLILIALIYKLRLDFLRNERLIILVILIEMLLLFLARFIGISVNGAYGWISVAGVTIQPAEYLKIIIIWYLAHRFSKQQEEIATYDFQVLTQNQWLPRAFNDWRFVLLVLIGSLGIFPDLGNATILVLVSLIMYTVSGIAYRWFSTILALVSATSVFVLTTISLIGVETFSKIPVFGYVAKRFSAFFNPFADRADAGHQLANSYFAMVNGGWFGLGLGNSIEKRGYLPEAHTDFVFSIVIEEFGFVGASLILALLFFMILRIILVGIRAENPFNAMVALGVGGMMLVQVFVNIGGISGLIPSTGVTFPFLSQGGNSLLVLSVAVAFVLNIDASEKRAKLYRELENQPMNLLLK

SEQ ID NO: 2888 - protein, 503 aa, Streptococcus pneumoniae
  misc_feature (B) LOCATION 1...503
  hypothetical: YES
LIDTKNNLVMQSQFYDGELRELTEQILNSVTGDEKKIIEFFRDSIFNFNFLYRKLETINELFDEIREEHESYRRGGWSANNHLFNAEFTVKNLYNFLKLNCLCVEHYKIYKSIINRYLEILLLSYDNSYVNPDSSIFDRTSSWLKNLDLDDVKLILPNIDFKVVNLYFRNYSFGKIKITEEAKDYLLNRITYLQERLEITEDENLRELKNMLIFLPLVDDIDIEKVIEILNNQTLYYNWSEEFRRIIKIVLDNMDVIDKDSLKSKIIGIVNKHLNEILEKNFSLYNSVYPLYSQLLEYCSTDQETAIIVLEKFNTDILRIKYKNDDIKNIIEYSDLICHLFKYFEKDIKDDILDTLKVYEESENIIYHKVIDLMSYNVYDFPQIQNKIYHYLIKRINDKRVEGVKTFPDPREKSVSDLYNLSRKGYFSDFEILKDIEEDIRGLYPEVDWTWFHDRSDDVIHRLLEHRTPNNIKTYFSKNEEDNKLINEYILKAFDEDKLILKK

SEQ ID NO: 2889 - protein, 73 aa, Streptococcus pneumoniae
  misc_feature (B) LOCATION 1...73
  hypothetical: YES
TGDTALHSQRQQIFLLQKTNDLFDELAIQAESRHSFLKKENPTYLESKDRYLLFTHFPNSFFYIFCIRYCRND

SEQ ID NO: 2890 - protein, 85 aa, Streptococcus pneumoniae
  misc_feature (B) LOCATION 1...85
  hypothetical: YES
ELDTKIGISKNTIRNYEKRVRSTKKNTIFDLVKVFSSLIDALFSPVQKDSPSDIQSIYDQRAPPRQGKVLTYAERQLYDQKNEVS

SEQ ID NO: 2891 - protein, 80 aa, Streptococcus pneumoniae
  misc_feature (B) LOCATION 1...80
  hypothetical: YES
QMDTIENLIIAIVKPLISQPDALTIKIEDTPEFLEYHLNLDQSDVGRVIGRKGRTISAIRTIVYSVPTEYKKVRIVIDEK

SEQ ID NO: 2892 - protein, 146 aa, Streptococcus pneumoniae
  misc_feature (B) LOCATION 1...146
  hypothetical: YES
RIGTYQMIDIQGIKEALPHRYPMLLVDRVLEVSEDTIVAIKNVTINEPFFNGHFPQYPVMPGVLIMEALAQTAGVLELSKPENKGKLVFYAGMDKVKFKKQVVPGDQLVMTATFVKRRGTIAVVEAKAEVDGKLAASGTLTFAIGN

SEQ ID NO: 2893 - protein, 187 aa, Streptococcus pneumoniae
  misc_feature (B) LOCATION 1...187
  hypothetical: YES
KEGTHMIKYSIRGENLEVTEAIRDYVVSKLEKIEKYFQPEQELDARINLKVYREKTAKVEVTIPLGSITLRAEDVSQDMYGSIDLVTDKIERQIRKNKTKIERKNKNKVATGQLFTDALVEDSNVVQSKVVRSKQIDLKPMDLEEAILQMDLLGHDFFIYVDVEDQTTNVIYRREDGEIGLLEVKES

SEQ ID NO: 2894 - protein, 278 aa, Streptococcus pneumoniae
  misc_feature (B) LOCATION 1...278
  hypothetical: YES
WLFTLPSSSGCQRKRGRKDFSWKDKFEFAKELVKKAGQYILDHMQEDLRVETKSSPTDLVTRLDKEVQELLVGEILSRYPEDKICAEEGCLRASVQEGKVWVIDPIDGTNNFVAQQEDFAVMMAYFENGQGQFGLIYDVVKGDCYHGGGEFPVCLNDRSLAPFKTKPLGDFLIAGNSGMLETNEWGLADLSRSVLGVRVYGSAAISFAKILSGRLLTYLTYLQPWDYAAASILGESLGYRVVTLFGEAPDFQTRQPVMMVPLEMQEEIQSYIYERKRT

SEQ ID NO: 2895 - protein, 321 aa, Streptococcus pneumoniae
  misc_feature (B) LOCATION 1...321
  hypothetical: YES
KRFTMSEIEIINAKKIYHDVSVIENLNITIPKGSLFTLLGASGCGKTTLLRMIAGFNSIKDGEFYFDDTKINNMEPSKRNIGMVFQNYAIFPHLTVRDNVAFGLMQKKVPKEELIQQTNKYLELMQIAQYADRKPDKLSGGQQQRVTLACALAVNPSVLLMDEPLSNLEAKLRLDMRQAIREIQHEVGITTVYVTHDQEEAMAISDQIAVMKDGVIQQIGRPKELYHKPANEFVATFIGRTNIIPANLEKRSDGAYIVFSDGYALRMPALDQVEEQAIHVSIRPEEFIKDESGDIEGTISDSVYLGLNTKYFIETGFASKI

SEQ ID NO: 2896 - protein, 104 aa, Streptococcus pneumoniae
  misc_feature (B) LOCATION 1...104
  hypothetical: YES
KFWFHPLLFLAIDQMGVKATLCKQISMLSFFDNLALIQDNYLLCPLSNSQAVSNENQGLVQSHEIIDNPLLCQNIQTASRLIQNQDRRICQESTRQSDSLTLTT

SEQ ID NO: 2897 - protein, 397 aa, Streptococcus pneumoniae
  misc_feature (B) LOCATION 1...397
  hypothetical: YES
VSITITLRKWQAEAIKRSEHLSNGIFLEALGGRGKTICALAIAKHKKAKKIIITNNRLAILNGWIDAVKFMNFDKGVEIIIQTDRYLQNQVKKGHKLDCDVLIVDEWQNMSSDKQVALYRKIKRKYTIGLSATPIRKKGQNFYPLEKTVFGWATPNNKFDWQKTHGKMVYDPFSYSKEKWEDFQNYESYISSLPNFFRWEEIEGIENAVENNGFEIKFYQKRVASGNPEKLAEFRKLNLVTVDGKTAMAKQSFGRKTFERYLNQTGVAVDFPKLKPVNADTPLMLQLDGLIERAPHDMLIVSKSKQIVNVISERHPEIGIWTGDIQEGLYKKFVVATSQVLGVGVDGLQHKYQTIVVLDPVEEGSGEYDDYRQLLWRITGSRQQHDVNVIEFYYKES

SEQ ID NO: 2898 - protein, 364 aa, Streptococcus pneumoniae
  misc_feature (B) LOCATION 1...364
  hypothetical: YES
RRWLKTKTEECFMKAYTYVKPGLASFVDVDKPVIRKPTDAIVRIVKTTICGTDLHIIKGDVPTCQSGTILGHEGIGIVEEVGEGVSNFKKGDKVLISCVCACGKCYYCKKGIYAHCEDEGGWIFGHLIDGMQAEYLRVPHADNTLYHTPEDLSDEALVMLSDILPTGYEIGVLKGKVEPGCSVAIIGSGPVGLAALLTAQFYSPAKLIMVDLDDNRLETALSFGATHKVNSSDPEKAIKEIYDLTDGRGVDVAIEAVGIPATFDFCQKIIGVDGTVANCGVHGKPVEFDLDKLWIRNINVTTGLVSTNTTPQLLKALESHKIEPEKLVTHYFKLSEIEKAYEVFSKAADHHAIKVIIENDISEA

SEQ ID NO: 2899 - protein, 83 aa, Streptococcus pneumoniae
  misc_feature (B) LOCATION 1...83
  hypothetical: YES
ALWFCSNELGGGMILAGLFSNVLSPVYELSFTLDIWSILICLIIAFFGTAFAFFISMKAVSLVSPLVGFPLTQCAVNLSLLLS

SEQ ID NO: 2900 - protein, 266 aa, Streptococcus pneumoniae
  misc_feature (B) LOCATION 1...266
  hypothetical: YES
GPSTELRFELARLVEICQPXKISLGMVLGNASNIIVRDGGIRGFVILCDKLNNVSVDGYTIEAEAGANLIETTRIALRHSLTGFEFACGIPGSVGGAVFMNAGAYGGEIAHILQSCKVLTKDGEIETLSAKDLAFGYRHSAIQESGAVVLSVKFALAPGTHQVIKQEMDRLTHLRELKQPLEYPSCGSVFKRPVGHFAGQLISEAGLKGYRIGGVEVSEKHAGFMINVADGTAKDYEDLIQSVIEKVKEHSGITLEREVRILGESK

SEQ ID NO: 2901 - protein, 69 aa, Streptococcus pneumoniae
  misc_feature (B) LOCATION 1...69
  hypothetical: YES
SNSTSAFSLPTAATISSWKAINSLTASCPLRSASNMISSDNSLAPDSTMLTACLVPATVNSRRDCSACS

SEQ ID NO: 2902 - protein, 72 aa, Streptococcus pneumoniae
  misc_feature (B) LOCATION 1...72
  hypothetical: YES
LNSTSSKKFTLFLIMNISLNKHIYKYFNILSISSSKFSSIFCISPFTILLKKDKLFISKIKYFHTTVVSRNI

SEQ ID NO: 2903 - protein, 458 aa, Streptococcus pneumoniae
  misc_feature (B) LOCATION 1...458
  hypothetical: YES
KCSTPSSSGDQSRLDATSLQGTNEKDVGYGVYDLFDLGEFNQKGTVRTKYGFKEDYLQAIQALKAQGIQPMADVVLNHKAAADHREAFQVIEVDPVDRTVELGEPFTINGWTSFTFDGRQDTYNDFHWHWYHFTGTDYDAKRRKSGIYLIQGDNKGWANEELVDNENGNYDYLMYADLDFKHPEVIQNIYDWADWFMETTGVAGFRLDAVKHIDSFFMRNFIRDMKEKYGDDFYVFGEFWNPDKEANLDYLEKTEEHFDLVDVRLHQNLFEASQAGANYDLRGIFTDSLVELKPDKAVTFVDNHDTQRGQALESTVEEWFKPAAYALILLRQDGLPCVFYGDYYGISGQYAQEDFKEILDRLLAIRKDLAYGEQNDYFDHANCIGWVRSGAENQSPIAVLISNDQENSKSMFVGQEWTNQTFVDLLGNHQGQVTIDEEGYGQFPVSARSVSVWAVNTI

SEQ ID NO: 2904 - protein, 511 aa, Streptococcus pneumoniae
  misc_feature (B) LOCATION 1...511
  hypothetical: YES
RTTTLRRSNTRSLLQLLFPHPPYTHAPPPADPIATSPFVPKPRGLTTAHIRAAHISLPTRPSSHQLPPTHPTPPVPGPPPPQPRPPHFPPPPVPPHAAPLHAANPPPRASNSPPPPPPPPAARQPPHAPPRRNPPPHPGPTPHRPHRPTPPPHTPPTPPPAHTGPPTTPPTNEPPRPTPAPKPPRHPPRPAAXLPPMLATPRTEXATXXPXXXFSXXXXXXXXXXXXXYTNWQAVGDLDFANDRTAYMMECPNLVFVEEQPVLLYCPQGLDKKVLDYDNIFPNMYKIGASFDPKNAKMVDVSQLQNMDYGFEAYATQAFNAPDGRALAVSWLGLPDVSYPSDRFDHQGTFSLVKELTIKDDKLYQYPVAAIKDLRASEEAFSNRFQTKNTYELELNLEANSQSEIVLLADKEGKGLSINFDLVNGQVTVDRSQAGEQYAQEFGTTRSCPIENQATTATIFIDNSVFEIFINKGEKVFSGRVFPHADQNGILIKSGNPTGTYYELDYGRKTN

SEQ ID NO: 2905 - protein, 549 aa, Streptococcus pneumoniae
  misc_feature (B) LOCATION 1...549
  hypothetical: YES
IYYTYRRKILLTVSDVSLRFSDRKLFDDVNIKFTEGNTYGLIGANGAGKSTFLKILAGDIEPTTGHISLGPDERLSVLRQNHFDYEDERAIDVVIMGNEKLYSIMKEKDAIYMKEDFSDEDGVRAAELEGEFAELGGWEAESEASQLLQNLNIPEELHYQNMSELANGEKVKVLLAKALFGKPDVLLLDEPTNGLDIQSITWLEDFLIDFDNTVIVVSHDRHFLNKVCTHMADLDFGKIKLYVGNYDFWKESSELAAKLLADRNAKAEEKIKQLQEFVARFSANASKSRQATSRKKMLDKIELEEIVPSSRKYPFINFKAEREIGNDLLTVENLTVKIDGETILDNISFILRPDDKTALIGQNDIQTTALIRAIMGDIDYEGTVKWGVTTSQSYLPKDNSADFAGGESILDWLRQFASKEDDDNTFLRGFLGRMLFSGDEVNKPVNVLSGGEKVRVMLSKLMLLKSNVLVLDDPTNHLDLESISSLNDGLKNFKESIIFASHDHEFIQTLANHIIVLSKNGVIDRIDETYDEFLENAEVQAKVKELWKD

SEQ ID NO: 2906 - protein, 89 aa, Streptococcus pneumoniae
  misc_feature (B) LOCATION 1...89
  hypothetical: YES
LNYTPKVRQKKSNFWGVFIMKLSYDDKVQIYELRKQGYSLEKLSNKFGINNSNFRYMIKLIDRYGIEFGKKGKNRYYFPDLKQEMIYKV

SEQ ID NO: 2907 - protein, 72 aa, Streptococcus pneumoniae
  misc_feature (B) LOCATION 1...72
  hypothetical: YES
FQYTVTCDENASNDTEKKAEKLFPALFVIVKANDLFLCIYMSMDPKGYNCSWSCVADIQIIDNRDIVVNDIQ

SEQ ID NO: 2908 - protein, 127 aa, Streptococcus pneumoniae
  misc_feature (B) LOCATION 1...127
  hypothetical: YES
IQYTIDCNQTTIWRNVKKYEEFGLDSLLQETRGGRNHAYMTVGEEKAFLARHLKATEAGEFVTIDALFQAYKKELGRSYTRDAFYQLLKRHGWRNIMPRPEHPRKTDAQTIVASKNKISIQEEKKAL

SEQ ID NO: 2909 - protein, 294 aa, Streptococcus pneumoniae
  misc_feature (B) LOCATION 1...294
  hypothetical: YES
ERYTIMKGIILAGGSGTRLYPLTRAASKQLMPVYDKPMIYYPLSTLMLAGIKDILIISTPQDLPRFKDLLLDGSEFGIKLSYAEQPSPDGLAQAFLIGEEFIGDDSVALILGDNIYHGPGLSKMLQKAAQKEKGATVFGYQVKDPERFGVVEFDTDMNAISIEEKPENPRSNYAVTGLYFYDNDVVEIAKGIKPSARGELEITDINKAYLNRGDLSVELMGRGFAWLDTGTHESLLEASQYIETVQRMQNVQVANLEEIAYRMGYISCEDVLELAQPLKKNEYGQYLLRLIGEA

SEQ ID NO: 2910 - protein, 273 aa, Streptococcus pneumoniae
  misc_feature (B) LOCATION 1...273
  hypothetical: YES
RRHTMTFLNKIHETATFLKEKGIAAPEFGLILGAGLGELAEEIENPVVVDYAEIPNWGRSTVVGHAGKLVYGELAGRKVLALQGRFHFYEGNPLEVVTFPVRVMKVLGCEGVIVTNAAGGIRFGPGTLMAISDHINMTGQNPLMGENLDDFGPRFPDMSRAYTPEYRATAHEVAKKLNIKLDEGVYIGVTGPTYETPAEIRSYKTLGADAVGMSTVPEVIVAAHSGLKVLGISCITNFAAGFQEELNHEEIVEVTERVKGDFKGLLKAILAEL

SEQ ID NO: 2911 - protein, 66 aa, Streptococcus pneumoniae
  misc_feature (B) LOCATION 1...66
  hypothetical: YES
EENTMAKVCYFTGRKTVSGNNRSHAMNQTKRAVKPNLQKVTVLIDGKPKKVWASARALKSGKVERV

SEQ ID NO: 2912 - protein, 515 aa, Streptococcus pneumoniae
  misc_feature (B) LOCATION 1...515
  hypothetical: YES
RGNTSRSLSGGQYMSQEKYIMAIDQGTTSSRAIIFNKKGEKVSSSQKEFTQIFPQAGWVEHNANEIWNSVQSVIAGAFIESGVKPNQIEAIGITNQRETTVVWDKKTGLPIYNAIVWQSRQTAPLAEQLKSQGYVEKFHEKTGLIIDAYFSATKVRWILDHVEGAQERAEKGELLFGTIDTWLVWKLTDGAAHVTDYSNAARTMLYNIKELKWDDEILEILNIPKAILPEVRSNSEIYGKTAPFHFYGGEVPISGMAGDQQAALFGQLAFEPGMVKNTYGTGSFIIMNTGEEMQLSENNLLTTIGYGINGKVYYALEGSIFIAGSAIQWLRDGLRMVENSPESEKYARDSHNNDEVYVVPAFTGLGAPYWNQNARGSVFGLTRGTSKEDFIKATLQSIAYQVRDIIDTMQVDTQTAIQVLKVDGGAAMNNFLMQFQADILGIDIARAKNLETTALGAAFLAGLSVGYWKNLDELKLLNETGELFEPSMNESRKEQLYKGWKKAVKATQVFAEVDD

SEQ ID NO: 2913 - protein, 68 aa, Streptococcus pneumoniae
  misc_feature (B) LOCATION 1...68
  hypothetical: YES
KMNTEQLNQALQMTISEMSTTSTNSMITSNILSIQLNEQREENQRLQARVDELEALLDEQTKPADKGE

SEQ ID NO: 2914 - protein, 89 aa, Streptococcus pneumoniae
  misc_feature (B) LOCATION 1...89
  hypothetical: YES
LNCTPKVRQKKSNFWGVFIMKLTYDDKVQIYELRKQGYSLEKLSNKFGINNSNIRYMIKLIDRYGIEFVKKGKNRYYSPDLKQEMINKV

SEQ ID NO: 2915 - protein, 190 aa, Streptococcus pneumoniae
  misc_feature (B) LOCATION 1...190
  hypothetical: YES
MNCTPKVRQKKSNFWGVFIMKLTYDDKVQIYELRKQGYSLEKLSNKFGINNSNIRYMIKLIDRYGIEFVKKGKNRYYSPDLKQEMIHKVLHEGWTKDRVSLEYGLPSRTILLNWLAQYRKNGYTIVEKTRGRVPKMGRKPKTRPEERTELERLQAENEYLRAEKAILKKLRELRLKEEKEKEERQKLFKN

SEQ ID NO: 2916 - protein, 63 aa, Streptococcus pneumoniae
  misc_feature (B) LOCATION 1...63
  hypothetical: YES
MNCTPKVRQKKSNFWSVFIMKLTYDDKVQIYELRKQGYSLEKLSNKFEINNSNLRYMIKLIDR

SEQ ID NO: 2917 - protein, 928 aa, Streptococcus pneumoniae
  misc_feature (B) LOCATION 1...928
  hypothetical: YES
FICTMPVSRMWCSTSILRILTVWSTSMIKRKTYWKDLIQSFTGSKGRFLSILILMMLGSLALVGLKVTSPNMEATANAYLTTAQTLDLAVMSNYGLDQADQEELKQTEGAEVEFGYLTDVTMDNGQDAIRLYSKPERISTFQLRKGRLPQSDKEIALATHLQDQYSVGQEISFKEKEEGHSSLKDHTYTITGFVDSAEILSQRDMGYAGSGSGTLAAYGVILPSQFDQKVYNIARLKYQDLAGLNAFSSAYEEKSKQHQEELEQILSDNGKVRLQLLKKEGQESLDKGQETLDKAQTNLQEGKRRLAAAQARIQAQESQLALFPQVQREQASAQLTQAKQELGKEEAKLKQAEQNLAQEKEKLEKHQQVLDDLAEPRYQVYNRQTMPGGQGYLMYSNASSSIRAVGNIFPVVLYAVAAMVTFTTMTRFVDEERTHAGIFKALGYRSKDIIAKFLLYGLVAGTVGTALGSILGHYLLASVISSVITKGMVVGETQIQFYWTYSLLAFVLSLLASVLSAYLVAWRELHDEAAQLLLPKPPVKGAKILLERIGFIWRRLSFTHKVTARNIFRYKQRMLMTIFGVAGSVALLFAGLGIQSSVAGVPSKQFQQIQQYQMLVSENPSATNQDKVELAEVLKGQEILAYQKIYSKTLDKDFKGKAGLQNITLMMIEKEDLTPFIHLQHHQQELTLKDGIVITAKLAQLAGVKVGQTLEIEGKELKVAAITENYVGHFIYMSQASYEQLYGQLPQANTYLVSLRDTSATSIESQAGLLMNQSAVSSVVQNASAIRLFDSIASSLNQTMTILVIVSVLLAIVILYNLTNINVAERIRELSTIKVLGFHNNEVTLYIYRETIVLSLVGIVLGLIAGFYLHQFLIQMISPATILFYPQVGWEVYVIPVAAVSFILTLLGFFVNYYLRKVDMLEALKSVE

SEQ ID NO: 2918 - protein, 265 aa, Streptococcus pneumoniae
  misc_feature (B) LOCATION 1...265
  hypothetical: YES
KTSTLLLLSTVALAGCSSVQRSLRGDDYVDSSLAAEESSKVAAQSAKELNDALTNENANFPQLSKEVAEDEAEVILHTSQGDIRIKLFPKLAPLAVENFLTHAKEGYYNGITFHRVIDGFMVQTGDPKGDGTGGQSIWHDKDKTKDKGTGFKNEITPYLYNIRGALAMANTGQPNTNGSQFFINQNSTDTSSKLPTSKYPQKIIEAYKEGGNPSLDGKHPVFGQVIGGMDVVDKIAKAEKDEKDKPTTAITIDSIEVVKDYDFKS

SEQ ID NO: 2919 - protein, 167 aa, Streptococcus pneumoniae
  misc_feature (B) LOCATION 1...167
  hypothetical: YES
KNSTTLTISSNRLSFNISYFPIDFLRNKIWYSSSMNDEASKQLTDARFKRLVGVQRTTFEEILAVLKTAYQLKHAKGGRKPKLSLEDLLMATLQYVREYRTYEQIAADFGIHESNLIRRSQWVEVTLVQSGVTISRTPLSSEDTVMIIDATEVKINRPKKRISELFW

SEQ ID NO: 2920 - protein, 155 aa, Streptococcus pneumoniae
  misc_feature (B) LOCATION 1...155
  hypothetical: YES
EQGTLSLVNCEPLEAYRQLEEAALVGCWAHVRRKFFEATPKQADKSSLGAKGLAYCDQLFSLERDWEALPADERLQKRQEELQPLIEDFFAWCRRQSVLAGSKLGRAIEYSLKYEETFKTILKDGHLVLSNNLAECAIKSLVMGRSKRVQWTLLA

SEQ ID NO: 2921 - protein, 111 aa, Streptococcus pneumoniae
  misc_feature (B) LOCATION 1...111
  hypothetical: YES
ILGTSQDIFISLASDNLVLFFVDFLDIQKNQVSDSHEFVKLLKVTWFITERKSTGIQGTVDSLFLSLGEESNQEINLQESFSSTDCNPTLISPETTVAQGLCQDIIYRPFT

SEQ ID NO: 2922 - protein, 102 aa, Streptococcus pneumoniae
  misc_feature (B) LOCATION 1...102
  hypothetical: YES
KNRLKIKTMISMVANLITKSRIPKPLAFQLRVNSLEIMISNSLATSTKKMQLLLDLLVSVSEQVLRTSKKASLQPAFLVVWKSSLRKMEPRSSSTMPTMGIV

SEQ ID NO: 2923 - protein, 403 aa, Streptococcus pneumoniae
  misc_feature (B) LOCATION 1...403
  hypothetical: YES
GGLTDSQRRNHMTQHLTAETLRKDFLAVFGQEADQIFFSPGRINLIGEHTDYNGGHVFPAAISLGTYGAARKRDDQVLRFYSANFEDKGIIEVPLADLKFEKEHNWTNYPKGVLHFLQEAGHVIDKGFDFYVYGNIPNGAGLSSSASLELLTGVVAEHLFDLKLERLDLVKIGKQTENNFIGVNSGIMDQFAIGMGADQRAIYLDTNTLEYDLVPLDLKDNVVVIMNTNKRRELADSKYNERRAECEKAVEELQVALDIQTLGELDEWAVDQYSYLIKDENRLKRARHAVLENQRTLKAQAALQAGDLETFGRLMNASHVSLEHDYEVTGLELDTLVHTAWAQEGVLGARMTGAGFGGCAIALVQKDTVEAFKEAVGKHYEEVVGYAPSFYIAEVAGGTRVLD

SEQ ID NO: 2924 - protein, 77 aa, Streptococcus pneumoniae
  misc_feature (B) LOCATION 1...77
  hypothetical: YES
KTLTNIVGKSLGPKSAVRFGEALSYIEGPLRRINETIDGGLYQIEQMIASGLKESGLNDWTAKTLASAIRGILDVLI

SEQ ID NO: 2925 - protein, 266 aa, Streptococcus pneumoniae
  misc_feature (B) LOCATION 1...266
  hypothetical: YES
WKLTTVALHLSKRLFRTCWRADEMIDIHSHIVFDVDDGPKSREESKALLTEAYRQGVRTIVSTSHRRKGMFETPEEKIAENFLQVREIAKEVASDLVIAYGAEIYYTPDVLDKLENNRIPTLNNSRYALIEFSMNTPYRDIHSALNKILMLGITPVIAHIERYDVLENNEKRVRELIDMGCYTQINSSHVLKSKLFGEPYKFMKKRAQYFLERDLVHIIASDMHNVDGRPPHMAEAYDLVSQKYGEAKAQELFIDNPRKIVMDQLI

SEQ ID NO: 2926 - protein, 315 aa, Streptococcus pneumoniae
  misc_feature (B) LOCATION 1...315
  hypothetical: YES
TSLTLKFLSQLLLNAITTISVSVLNKVSTSSQFHSYVLQKNVNEVRAICEETGNGHVQLFAKIENQQGIDNLDEIIEAADGIMIARGDMGIEVPFEMVPVYQKMIIKKVNAAGKVVITATNMLETMTEKPRATRSEVSDVFNAVIDGTDATMLSGESANGKYPLESVTTMATIDKNAQALLNEYGRLDSDSFERNSKTEVMASAVKDATSSMDIKLVVTLTKTGHTARLISKYRPNADILALTFDELTERGLMLNWGVIPMLTDAPSSTDDMFEIAERKAVEAGLVESGDDIVIVAGVPVGEAVRTNTMRIRTVR

SEQ ID NO: 2927 - protein, 80 aa, Streptococcus pneumoniae
  misc_feature (B) LOCATION 1...80
  hypothetical: YES
KTRLEEMIFDTHTHLNVEEFAGREAEEIALADEMGVTQMNIVGFDIPTIERALELVDEYEQLYATIGWHPTEAGIYTVGS

SEQ ID NO: 2928 - protein, 421 aa, Streptococcus pneumoniae
  misc_feature (B) LOCATION 1...421
  hypothetical: YES
KKRFYMLSSKDIIKAHKVLNGVVVNTPLDYDHYLSEKYGAKIYLKKENAQRVRSFKIRGAYYAISQLSKEERERGVVCASAGNHAQGVAYTCNEMKIPATIFMPITTPQQKIGQVRFFGGDFVTIKLVGDTFDASAKAAQEFTVSENRTFIDPFDDAHVQAGQGTVAYEILEEARKESIDFDAVLVPVGGGGLIAGVSTYIKETSPEIEVIGVEANGARSMKAAFEAGGPVKLKEIDKFADGIAVQKVGQLTYEATRQHIKTLVGVDEGLISETLIDLYSKQGIVAEPAGAASIASLEVLAEYIKGKTICCIISGGNNDINRMPEMEERALIYDGIKHYFVVNFPQRPGALREFVNDILGPNDDITRFEYIKRASKGTGPVLIGIALADKHDYAGLIRRMEGFDPAYINLNGNETLYNMLV

SEQ ID NO: 2929 - protein, 66 aa, Streptococcus pneumoniae
  misc_feature (B) LOCATION 1...66
  hypothetical: YES
HSITIYYLIKKENHNMDKKQNLTSFQELTTTELNQIIGGGWWEDFLYRFNIIEQKNTKGFYQPIQL

SEQ ID NO: 2930 - protein, 114 aa, Streptococcus pneumoniae
  misc_feature (B) LOCATION 1...114
  hypothetical: YES
ANITKKRRNTMAKAITDATFEQETKDGLVLVDFWATWCGPCRMQGPILDKLSEELSEDVLKIVKMDVDENPNTARAFGIMSIPTLLFKKDGQVVKQVAGVHTAEQIKAIIAELS

SEQ ID NO: 2931 - protein, 178 aa, Streptococcus pneumoniae
  misc_feature (B) LOCATION 1...178
  hypothetical: YES
KRITSPKDVSAQITINHKKARYVRIELEGYNALSLAEVEVFRFIATNGETAIQVSKPVQPISQTPVKDKTLTIQHSGAYIARYSITWEEVPVDKDGNQVVRSHSWEGNGRNQTAGFVLNLPIKENMRNLRVKIEKKTGLLWNRWQTIYENRPILAQPHRKITHWGTILNSKVSDDDVL

SEQ ID NO: 2932 - protein, 156 aa, Streptococcus pneumoniae
  misc_feature (B) LOCATION 1...156
  hypothetical: YES
ERRLEEMIITKISRLGTYVGVNPHFATLIDFLEKTGLENLTEGSIAIDGNRLFGNCFTYLADGQAGAFFETHQKYLDIHLVLENEEAMAVTSPENVSVTQEYDEEKDIELYTGKVEQLVHLRAGECLITFPEDLHQPKVRINDEPVKKVVFKVAIS

SEQ ID NO: 2933 - protein, 79 aa, Streptococcus pneumoniae
  misc_feature (B) LOCATION 1...79
  hypothetical: YES
SHSTTCKCPCLGCLGTTWRCCDLSRSGRKSICTRDCCGNCQWCICSYCRNSSLTCLCRNPNSCRKFEKGLILNENQRAN

SEQ ID NO: 2934 - protein, 222 aa, Streptococcus pneumoniae
  misc_feature (B) LOCATION 1...222
  hypothetical: YES
ENSTRRTWNPLLSKLSKGGLMGKIIGITGGIASGKSTVTNFLKHQGLSSSGLPTQCSTNYRKPGGRLFEALVQHFGQEIILENGELNRPLIASLIFSNPEEQKWSNQIQGEIIREELATLREQLAQTEEIFFMDIPLLFEQDYSDWFAETWLVYVDRDAQVERLMKRDQLSKDEAESRMAAQWPLEKKKDLASQVLDNNGNQNQLLNQVHILLEGGRQDDRD

SEQ ID NO: 2935 - protein, 137 aa, Streptococcus pneumoniae
  misc_feature (B) LOCATION 1...137
  hypothetical: YES
TLSTDSRRRKNAGRNQRKQRIKEKPMQVIKRNGEIAEFNPDKIYQAILKAAQTVYVLTDDLRQNLAQVTKKVVLDLQEAKVERATISMIQSMVEHRLLGAGYITIAEHYISYRLQRDLERSGYGDHIAVHLHFEQIR

SEQ ID NO: 2936 - protein, 212 aa, Streptococcus pneumoniae
  misc_feature (B) LOCATION 1...212
  hypothetical: YES
KESTMECKKLNIWTASSFFIFLTYLVFLVYPIVTVLKQALIHEGQFSLANFVTFFSKVYYSETLVNSFKVSITATVTSLVVGTLLAYLFSMYDFKGKKFLQILIIIASMSAPFVGAYSWVLLLGRNGVITKFLTNALHLPAIDIYGFKGIVLVFTLQLFPLVFLYVAETMNSIDNSLLEAAESMGSFGFKPIVTVVLPLLVPTLLAAPCLYL

SEQ ID NO: 2937 - protein, 263 aa, Streptococcus pneumoniae
  misc_feature (B) LOCATION 1...263
  hypothetical: YES
KKPTFIIVMIGISLIPDLYNIIFLSSMWDPYGQLSDLPVAVVNNDKEASYNGNTMAIGKDMVSNLKENKTLDFHFVDEEEGKKGLEDGDYYMVVTLPSDLSDKTTTLSNIQSTAAYQSLTSEQQTEISDSVSQNSTDSIQSAQSIVALVQDLQGSLENLQNQSSNLSTLKNQANQVSPITSTSLIGLSSGLTEIQGDVTSKLVPASQSIASGVNAYTTGVDKVSQGASQLSEKNATLTGSLDKLVSGSNTLTQKSSRLTAGVG

SEQ ID NO: 2938 - protein, 72 aa, Streptococcus pneumoniae
  misc_feature (B) LOCATION 1...72
  hypothetical: YES
SIGFYSTRKQGQENFQEENDSRQVILTVTQIIERLYPMFLDIEGKPLDFWDLTVLEIREMIESYNRVKIQER

SEQ ID NO: 2939 - protein, 458 aa, Streptococcus pneumoniae
  misc_feature (B) LOCATION 1...458
  hypothetical: YES
RGATSYGDSPYQSFSAFAGNTHFIDLDILVEQGLLEASDLEGVDFGSDASEVDYAKIYYARRPLLEKAVKRFFEVGDVKDFEKFAQDNQSWLELFAEYMAIKEHFDNLAWTEWPDADARARKASALESYREQLADKLVYHRVTQYFFFQQWLKLKAYANDNHIEIVGDMPIYVAEDSSDMWANPHLFKTDVNGKATCIAGCPPDEFSVTGQLWGNPIYDWEAMDKDGYKWWIERLRESFKIYDIVRIDHFRGFESYWEIPAGSDTAAPGEWVKGPGYKLFAAVKEELGELNIIAEDLGFMTDEVIELRERTGFPGMKILQFAFNPEDESIDSPHLAPANSVMYTGTHDNNTVLGWYRNEIDDATREYMARYTNRKEYETVVHAMLRTVFSSVSFMAIATMQDLLELDEAARMNFPSTLGGNWSWRMTEDQLTPAVEEGLLDLTTIYRRINENLVDLKK

SEQ ID NO: 2940 - protein, 65 aa, Streptococcus pneumoniae
  misc_feature (B) LOCATION 1...65
  hypothetical: YES
KLGLGYRTNLFLNNTFSHAQTYKQSMTENALCVHEDVLYFLSSILLLLKFFQIYFSLVYFQHQSY

SEQ ID NO: 2941 - protein, 159 aa, Streptococcus pneumoniae
  misc_feature (B) LOCATION 1...159
  hypothetical: YES
VVQTRGTGLKFVKEVINWNYESYNSGHGRKFIFKRIIEARLTISNSPFVQRRYQIKPEAFYVLFKELTAPIPLNTDFPIFAADGSDISIPRNPMDTETYIQTQTDVKSYNLIHINALYDLTTGVYRDVSIQDKHAQHERLALIQMMEASPFRESSCYHG

SEQ ID NO: 2942 - protein, 118 aa, Streptococcus pneumoniae
  misc_feature (B) LOCATION 1...118
  hypothetical: YES
DGQTNASRLCIVDLAVDQGGLIETADRVTTHDEPVYEKHGVLHYTVANIPGAVARTSTIALTNVTLPYIEALAGKGFAQAISEDEGLRQGVTTYQGYLTSLPVAQGLNRDYTDINDLV

SEQ ID NO: 2943 - protein, 124 aa, Streptococcus pneumoniae
  misc_feature (B) LOCATION 1...124
  hypothetical: YES
VWQTYRRTLLSSSKPELSQKTNTEENIMLKMTLNNLQLFAHKKGGGSTSNGRDSQAKRLGAKAADGQTVTGGSILYRQRGTHIYPGVNVGRGGDDTLFAKVEGVVRFERKGRDKKQVSVYPIAK

SEQ ID NO: 2944 - protein, 806 aa, Streptococcus pneumoniae
  misc_feature (B) LOCATION 1...806
  hypothetical: YES
SYKTSYTKDLRRLLQVFFFCPKQIYSFKLYQTLIFYNYTDAFFSVKIVSTTNFGGHIMSTTIVGFPRLGEFRELKFTTEKYFRKEISEEELLAAAKDLRAKHWNIVKEKGITEIPSNDFSHYDNFLDAAFLFNVVPASVQNLDLSDLERYFALGRGYQGEKGDVRALPMKKWFNTNYHYIVPKFEKDTQVKLAGHKIFDEFQEAKEIGLNTRPVLVGPFTFLQLSDFEEGVKADDFVDSLVAAYQEVFAKLAELGATCIQLDEAALVKDLTAEEKALFLNLYNKLLADKKGLEVLLQTYFGDVRDVYADLVNLPVDAIGFDFVEGKKTLELVKGGFPADKTLYAGIVNGKNIWRNNYEKSLAVLEQIPAENIVLTSSCSLLHVPFTTANEEFEPALLNHFAFAVEKLDEIRDLDAIRNGQGSEALAANKELFATERVGENAELRARIAGLTDTDYTRLPAFAEREAIQEEAFKLPALPTTTIGSFPQTKEVRAKRLAYRKGELSQKEYDAFLAETIDEWIKWQEDIDFDVLVHGEFERNDMVEYFGQNLSGYLFSKNGWVQSYGMRGVKPPIIWGDVTRLNPITVKWSSYAQSRTNKPVKGMLTGPVTILNWSFPREDISIKDSTLQIALAIKDEVLDLEAAGVKIIQIDEAALREKLPLRRSDWYEDYLDWAIPAFRLVHSTVAPDTQIHTHMCYSEFTDIIPAIDNMDADVISFEASRSNLEILDELKAKNFQTEVGPGVYDIHSPRVPNEGEIDNTIEAILAKVPSKKVWINPDCGLKTRGIPETKESLIRLVEAAKAAREKL

SEQ ID NO: 2945 - protein, 536 aa, Streptococcus pneumoniae
  misc_feature (B) LOCATION 1...536
  hypothetical: YES
YGKTNINRKRFLECLFKKVVGFLHFVRHQEEKQMSEKAKKGFKMPSSYTVLLIIIAIMAVLTWFIPAGAFIEGIYETQPQNPQGIWDVLMAPIRAMLGTHPEEGSLIKETSAAIDVAFFILMVGGFLGIVNKTGALDVGIASIVKKYKGREKMLILVLMPLFALGGTTYGMGEETMAFYPLLVPVMMAVGFDSLTGVAIILLGSQIGCLASTLNPFATGIASATAGVGTGDGIVLRLIFWVTLTALSTWFVYRYADKIQKDPTKSLVYSTRKEDLKHFNVEESSSVESTLSSKQKSVLFLFVLTFILMVLSFIPWTDLGVTIFDDFNAWLTGLPVIGNIVGSSTSALGTWYFPEGAMLFAFMGILIGVIYGLKEDKIISSFMNGAADLLSVALIVAIARGIQVIMNDGMITDTILNWGKEGLSGLSSQVFIVVTYIFYLPMSFLIPSSSGLASATMGIMAPLGEFVNVRPSLIITAYQSASGVLNLIAPTSGIVMGALALGRINIGTWWKFMGKLVVAIIVVTIALLLLGTFLPFL

SEQ ID NO: 2946 - protein, 74 aa, Streptococcus pneumoniae
  misc_feature (B) LOCATION 1...74
  hypothetical: YES
KSKTQGMKFIKKLHKIILLNKQTSYTSFFSSSLSKTNHFILFENQIQTTSTSPCRTQVQPAASFLVCSLIFIEY

SEQ ID NO: 2947 - protein, 120 aa, Streptococcus pneumoniae
  misc_feature (B) LOCATION 1...120
  hypothetical: YES
IPKTKTLAELADVILWSFDFVNAHAHAFFMDNVEWSHADSYFLSFVSDDVEERYTENVYLDSLSVKQKFKFLFDFGDEWRFECQVLREIETEDEEAYLVRSVGTSPEQYPDYDGFDYEEW

SEQ ID NO: 2948 - protein, 641 aa, Streptococcus pneumoniae
  misc_feature (B) LOCATION 1...641
  hypothetical: YES
MKKTTILSLTTAAVILAAYVPNEPILADTPSSEVIKETKVGSIIQQNNIKYKVLTVEGNIRTVQVGNGVTPVEFEAGQDGKPFTIPTKITVGDKVFTVTEVASQAFSYYPDETGRIVYYPSSITIPSSIKKIQKKGFHGSKAKTIIFDKGSQLEKIEDRAFDFSELEEIELPASLEYIGTSAFSFSQKLKKLTFSSSSKLELISHEAFANLSNLEKLTLPKSVKTLGSNLFRLTTSLKHVDVEEGNESFASVDGVLFSKDKTQLIYYPSQKNDESYKTPKETKELASYSFNKNSYLKKLELNEGLEKIGTFAFADAIKLEEISLPNSLETIERLAFYGNLELKELILPDNVKNFGKHVMNGLPKLKSLTIGNNINSLPSFFLSGVLDSLKEIHIKNKSTEFSVKKDTFAIPETVKFYVTSEHIKDVLKSNLSTSNDIIVEKVDNIKQETDVAKPKKNSNQGVVGWVKDKGLWYYLNESGSMATGWVKDKGLWYYLNESGSMATGWVKDKGLWYYLNESGSMATGWVKDKGLWYYLNESGSMATGWVKDKGLWYYLNESGSMATGWVKDKGLWYYLNESGSMATGWVKDKGLWYYLNESGSMATGWFTVSGKWYYTYNSGDLLVNTTTPDGYRVNANGEWVG

SEQ ID NO: 2949 - protein, 160 aa, Streptococcus pneumoniae
  misc_feature (B) LOCATION 1...160
  hypothetical: YES
CRKTAKGKTMKPLLETIDTRFGTTNKHAFSRGNTLPYTGVPFGMNYFVPQTSDQDGAWFFDPHLPIFQGIRLTHQPSPWIGDYSWLLLTPVTSQLGEDSLFHRQSSYNRDKASFQPHYLKIFSLRYQIETQLTPTCYGASIRLKQKQGKASPSIFTQQMN

SEQ ID NO: 2950 - protein, 654 aa, Streptococcus pneumoniae
  misc_feature (B) LOCATION 1...654
  hypothetical: YES
GRKTMKIQDLLRKDVMLLDLQATEKTAVIEEMIKSLTGHGYVTDFETFKEGILAREALTSTGLGDGIAMPHSKNAAVKEATVLFAKSNKGVDYESLDGQATDLFFMIAAPEGANDTHLAALTELSQYLMKDGFADKLRQATSADQVIELFDQASEKTEELVQAPANDSGDFIVAVTACTTGIAHTYMAQEALQKVAAEMGVGIKVETNGASGVGNQLTAEDIRKAKAIIIAADKAVEMDRFDGKPLINRPVADGIRKTEELINLAISGDAEVYRAANGAKVATASNEKQSLGGAFYKHLMSGVSQMLPFVIGGGIMIALAFLIDGALSVPNENLGNLGSYHELASMFMKIGGAAFGLMLPVFAGYVAYSIAEKPGLVAGFVAGAIAKEGFAFGNIPYAAGGEATSTLAGVSSGFLGALVGGFIAGALVLAIKKYVKVPRSLEGAKSILLLPLLGTILTGFVMLAVNIPMAAINTAMNDFLGGLGGGSAVLLGIVLGGMMAVDMGGPVNKAAYVFGTGTLAATVSSGGSVAMAAVMAGGMVPPLAIFVATLLFKDKFTKEERNSGLTNIIMGLSFITEGAIPFGAADPARAIPSFILGSAVAGGLVGLTGIKLMAPHGGIFVIALTSNALLYLVSVLVGAIVSGVVYGYLRKPQA

SEQ ID NO: 2951 - protein, 82 aa, Streptococcus pneumoniae
  misc_feature (B) LOCATION 1...82
  hypothetical: YES
KRKTWGLVLFENLFKPRQRRLAVCRLLTSSVLSTTSKQCFEQPAASFLVCSLIFIEYWPQVSICNQKGILCPLFKNFGGFSS

SEQ ID NO: 2952 - protein, 131 aa, Streptococcus pneumoniae
  misc_feature (B) LOCATION 1...131
  hypothetical: YES
KMKTKKLLKMVIPVLMISAVGTTFVEANQIGAFSNFVITTSYKRTGYLTKENEGAEYIMNLNPCRNLHPMTVKHRIVNSNGEARSGESLTTCGTRSTHGNWATVGYVYAADMARQNWWDLSAAISGSWSPN

SEQ ID NO: 2953 - protein, 127 aa, Streptococcus pneumoniae
  misc_feature (B) LOCATION 1...127
  hypothetical: YES
KEKTEMIQTETRLKVADNSGAREILTIKVLGGSGRKFANIGDVIVASVKQATPGGAVKKGDVVKAVIVRTKSGARRADGSYIKFDENAAVIIREDKTPRGTRIFGPVARELREGGFMKIVSLAPEVL

SEQ ID NO: 2954 - protein, 70 aa, Streptococcus pneumoniae
  misc_feature (B) LOCATION 1...70
  hypothetical: YES
MSETILEIKELKKSFGDNPILQGLSLEIKKGGSCCHPRGIWLWEKYPPSLPQRLRKYSRWRYSSGWSVYR

SEQ ID NO: 2955 - protein, 148 aa, Streptococcus pneumoniae
  misc_feature (B) LOCATION 1...148
  hypothetical: YES
IDETGFDTYFYREYGRSLKGQLRRGKVSGRRYQRISLVAGLTNGELIAPMTYEEMMTSDFFEAWFQKFLLPTLTTPSVIIMDNARFHRMGKLELLCEEFGHKLLSLPPYSPEYNPIEKTWAHIKKHLKKVLPSCNTFYEALLSCSCFN

SEQ ID NO: 2956 - protein, 82 aa, Streptococcus pneumoniae
  misc_feature (B) LOCATION 1...82
  hypothetical: YES
IDETGFDTYFYREYGRSLKGQLRRGKVSGRRYQRISLVAGLTNGELIAPMTYEEMMTSDFFEVWFQKFFLPTLTTPSVIIVK

SEQ ID NO: 2957 - protein, 148 aa, Streptococcus pneumoniae
  misc_feature (B) LOCATION 1...148
  hypothetical: YES
IDETGFDTYFYREYGRSLKDQLIRGKVSGRRYQRISLVAGLTNGELIAPMTYEETMTSDFFEAWFQKFLLPTLNTPSVIIMDNARFHRMGKLELLCEEFGYKLLPLPPYSPEYNPIEKTWAHIKKHLKRVLPSCNTFYEALLSCSCFN

SEQ ID NO: 2958 - protein, 149 aa, Streptococcus pneumoniae
  misc_feature (B) LOCATION 1...149
  hypothetical: YES
IDETGFDTYFYREYGRSLKGQLRRGKVSGRRYQRISLVAGLTNGELIAPITYEEMMTSDFFEAWFQKFLLPTLTTPSVIIMDNARFHRMGKLELLCEEFGHKLLPLPPYSPEYNPIEKTWAHIKKHLKKVLPSCCNTFYEALLSCSCFN

SEQ ID NO: 2959 - protein, 235 aa, Streptococcus pneumoniae
  misc_feature (B) LOCATION 1...235
  hypothetical: YES
YEETSGESREFNMKKRAIQILLALSLIFYKSTWFWRVFNHLAKPYLPASREFFQILLLMESGVLFLAVIYLLVFAGKKIFHFKWQLRYFIYLLLGYIISYMSDFLFSYFISLSSNQISLNETVEMMGRQEFPYFLLIVCFIAPIAEELIYRGVLMTTFFKNSPWYGDVLLSAIIFGYIHINFALTPLAFFIYASGGLILALLYRMTKNLYYPILVHILINITAFWDVWLLLFSGS

SEQ ID NO: 2960 - protein, 358 aa, Streptococcus pneumoniae
  misc_feature (B) LOCATION 1...358
  hypothetical: YES
DRETERTNMKLKSYILVGYIISTLLTILVVFWAVQKMLIAKGEIYFLLGMTIVASLVGAGISLFLLLPVFTSLGKLKEHAKRVSAKDFPSNLEVQGPVKFQQLGQTFNEMSHDLQVSFDSLEESEREKGLMIAQLSHDIKTPITSIQATVEGILDGIIKESEQAHYLATIGRQTERLNKLVEELNFLTLNTARNQVETTSKDSIFLDKLLIECMSEFQFLIEQERRDVHLQVIPESARIEGDYAKLSRILVNLVDNAFKYSAPGTKLEVVTKLEKGQLSISVTDEGQGIAPEDLENIFKRLYRVETSRNMKTGGHGLGLAIARELAHQLGGEITVSSQYGLGSTFTLVLNLSGSENKA

SEQ ID NO: 2961 - protein, 99 aa, Streptococcus pneumoniae
  misc_feature (B) LOCATION 1...99
  hypothetical: YES
NMETSISMADFYGKYQNENLELIDVREAHEFQAGHALGAKNLPLSTLEASYKELKPDHEYYVICQGGVRSASTCQFLSSQGLTVTNVEGGMNAWPGQVK

SEQ ID NO: 2962 - protein, 339 aa, Streptococcus pneumoniae
  misc_feature (B) LOCATION 1...339
  hypothetical: YES
SEETRMKEIIEKLAKFENLSGVEMTDVIERIVTGRVTEAQIASLLLALKMKGETPEERTAIAQVMRGHAQHIPTEIHDAMDNCGTGGDKSFSFNISTTAAFVLAGGGIHMAKHGNRSISSKSGSADVLEALGINLDLKPAELGKVFDKTGIVFLFAKNMHPAMKYIMPARLELGIPTIMNLTGPLIHPMALETQLLGISRPELLESTAQVLKNMGRKRAIVVAGPEGLDEAGLNGTTKIALLENGEISLSSFTPEDLGMEGYAMEDIRGGNAQENAEILLSVLKNEASPFLETTVLNAGLGFYANGKIDSIKEGVALARQVIARGKALEKLRLLQEYQK

SEQ ID NO: 2963 - protein, 194 aa, Streptococcus pneumoniae
  misc_feature (B) LOCATION 1...194
  hypothetical: YES
NWRTKTMILLIDNYDSFTYNLAQYIGNFAEVQVLRNDDSKLYEEAEKADGLVFSPGPGWPVDAGKMEDMIRDFAGKKPILGICLGHQAIAEVFGGKLGLAPKVMHGKQSNINFEAPSVLYQGIEDGRAVMRYHSILIEEMPEDFEVTARSTDDQAIMGIQHKNLPIYGFQYHPESIGTPDGLSSIRNFIEKVVK

SEQ ID NO: 2964 - protein, 888 aa, Streptococcus pneumoniae
  misc_feature (B) LOCATION 1...888
  hypothetical: YES
LRRTHMSKELSSKYNPAEVEAGRYQKWLDADVFKPSGDQKAKPYSIVIPPPNVTGKLHLGHAWDTTLQDIIIRQKRMQGFDTLWLPGMDHAGIATQAKVEERLRGEGISRYDLGRESFLTKVWEWKDEYATTIKEQWGKMGLSVDYSRERFTLDEGLSKAVRKVFVDLYKKGWIYRGEFIINWDPAARTALSDIEVIHKDVEGAFYHMNYMLEDGSRALEVATTRPETMFGDVAVAVNPEDPRYKDLIGKNVILPIANKLIPIVGDEHADPEFGTGVVKITPAHDPNDFLVGQRHNLPQVNVMNDDGTMNELAFEFSGMDRFEARKAVVAKLEEIGALVKIEKRVHSVGHSERTGVVVEPRLSTQWFVKMDQLAKNAIANQDTEDKVEFYPPRFNDTFLQWMENVHDWVISRQLWWGHQIPAWYNADGEMYVGEEAPEGDGWTQDEDVLDTWFSSALWPFSTMGWPEVDSEDFKRYFPTSTLVTGYDIIFFWVSRMIFQSLEFTGRQPFQNVLIHGLIRDEEGRKMSKSLGNGIDPMDVIDKYGTDSLRWFLSNGSAPGQDVRFSYEKMDASWNFINKIWNISRYILMNNGGLTLDVAHDNVTKVATGEAGNVTDRWILHNLNETIAKVTENFDKFEFGVAGHILYNFIWEEFANWYVELTKEVLYSDNEDDKVITRSVLLYTLDKILRLLHPIMPFVTEEIFGQYAEGSIVTAAYPTVNPAFEDLAAHTGVESLKNLIRAVRNARAEVNVAPSKPITILVKTSDSDLEAFFNSNVNYIKRFTNPEHLEIASTIPAPELAMSSVITGAEIYLPLADLLNVEEELARLDKELAKWQKELDMVGKKLSNERFVANAKPEVVQKERDKQADYQAKYDATVARIDEMKKLVK

(The sequence listing continues in the following parts.)

What is claimed is:

1. An isolated nucleic acid conprising a nucleotide sequence encoding a *Streptococcus pneumoniae* polypeptide, selected from the group consisting of SEQ ID NO; 2943, SEQ ID NO: 3124, SEQ ID NO: 3435, SEQ ID NO: 3472, SEQ ID NO: 3604, SEQ ID NO: 3888, SEQ ID NO: 4277, SEQ ID NO: 4317, and SEQ ID NO: 4714.

2. A recombinant expression vector comprising the nucleic acid of claim 1 operably linked to a transcription regulatory element.

3. A cell comprising the recombinant expression vector of claim 2.

4. An isolated nucleic acid comprising at least 20 consecutive nucleotides of a nucleic acid sequence selected from the group consisting of SEQ ID NO: 340, SEQ ID NO: 521, SEQ ID NO: 832, SEQ ID NO: 869, SEQ ID NO: 1674, and SEQ ID NO: 1714 wherein said nucleic acid encodes a *Streptococcus pneumontae* polypeptide or a fragment thereof.

5. A recombinant expression vector comprising the nucleic acid of claim 1 operably linked to a transcription regulatory element.

6. A cell comprising the recoxubinant expression vector of claim 5.

7. A probe comprising at least 20 consecutive nucleotides of a nucleic acid sequence selected from the group consisting of SEQ ID NO: 340, SEQ ID NO: 521, SEQ ID NO: 832, SEQ ID NO: 869, SEQ ID NO: 1674, and SEQ ID NO: 1714.

8. An isolated nucleic acid comprising at least 40 consecutive nucleotides, wherein the nucleic acid sequence is hybridizable under high stringency conditions to a nucleic acid sequence selected from the group consisting of SEQ ID NO: 340, SEQ ID NO: 521, SEQ ID NO: 832, SEQ ID NO: 869, SEQ ID NO; 1674, and SEQ ID NO: 1714.

9. An isolated nucleic acid consisting of a nucleic acid sequence selected from the group consisting of SEQ ID NO: 340, SEQ ID NO: 521, SEQ ID NO: 832, SEQ ID NO: 869, SEQ ID NO: 1001, SEQ ID NO: 1285, SEQ ID NO: 1674, SEQ ID NO: 1714 and SEQ ID NO: 2111.

10. A recombinant expression vector comprising the nucleic acid of claim 9 operably linked to a transcription regulatory element.

11. A cell comprising the recombinant expression vector of claim 10.

12. An isolated nucleic acid comprising at least 30 consecutive nucleotides of a nucleic acid sequence selected from the group consisting of SEQ ID NO: 340, SEQ ID NO: 521, SEQ ID NO: 832, SEQ ID NO: 869, SEQ ID NO: 1001, SEQ ID NO: 1285, SEQ ID NO: 1674, SEQ ID NO: 1714, and SEQ ID NO: 2111 wherein said nucleic acid encodes a *Streptococcus pneumoniae* polpeptide or a fragment thereof.

13. An isolated nucleic acid comprising at least 60 consecutive micleotides, wherein the nucleic acid sequence is hybridizable under high stringency conditions to a nucleic acid sequence selected from the group consisting of SEQ ID NO: 340, SEQ ID NO: 521, SEQ ID NO: 832, SEQ ID NO: 869, SEQ ID NO: 1001, SEQ ID NO: 1285, SEQ ID NO: 1674, SEQ ID NO: 1714 and SEQ ID NO: 2111.

14. An isolated nucleic acid comprising at least 300 consecutive nucleotides, which is hybridizable under high stringency conditions to a nucleic acid sequence selected from the group consisting of SEQ ID NO: 340, SEQ ID NO: 521, SEQ ID NO: 832, SEQ ID NO: 869, SEQ ID NO: 1001, SEQ ID NO: 1285, SEQ ID NO: 1674, SEQ ID NO: 1714, and SEQ ID NO: 2111.

* * * * *

UNITED STATES PATENT AND TRADEMARK OFFICE
CERTIFICATE OF CORRECTION

PATENT NO. : 6,800,744 B1
DATED : October 5, 2004
INVENTOR(S) : Lynn Doucette-Stamm and David Bush It is certified that error appears in the above-identified patent and that said Letters Patent is hereby corrected as shown below:

Column 297,
Line 15, please delete "conprising" and insert -- comprising --;
Line 34, please delete "claim 1" and insert -- claim 4 --;
Line 36, please delete "recoxubinant" and insert -- recombinant --.

Column 298,
Line 33, please delete "micleotides" and insert -- nucleotides --.

Signed and Sealed this

Second Day of August, 2005

JON W. DUDAS
*Director of the United States Patent and Trademark Office*